United States Patent 8,664,475 (PLANTS WITH INCREASED YIELD) - sequence listing, part 3

SEQ ID NO: 4384 - protein, 608 aa, Legionella pneumophila subsp. pneumophila str. Philadelphia 1
MFVRICAMFGFVSDLLTAAVSSLDELLQDTPAHQIILGTAALYFLYNQYHNPSISRWYRSRNNASMKQRIIDSAYALAKNLPGVNQIIEKELNKELSSTREKLRIQRSGMTLREEIPEEGLSPQDILSAFDVDVEKCHFDFLSVTNDSPEREFLVERGDGKDSGALYAIHPKELTELLKEVYGATALTNPLHDKWPRINAMQAEVIRWCQNLFHGSKECYGLLTHGGTTSIIEAMAAYVIRARAKGIDYPEIVVPETAHAAFKKAAELTGAILITVPVDKKTGAVNPKVMSSYITRNTAVIVGSAPSFMNGIHDPVSELGQLAKKKNVPFHVDACLGGFLTAFLDTSSEPMDFRVPGVTSISADLHKYGCCPKGTSVCLFSEDSPALSVYAALNWSGGLYATPGILDGSTSGARVAEVYATLSYYGKNKYQEIAKSIITLRNAIQKELTTLLEEGNGLTSEDIYVYGNPQWSILGFRSNTCNAHFIADELEKRGWKLNLLQNPDGFHLCLTHVHTLVKGFETQFIKDLREAVIDVKNYPPGKKPSGNVKVYGAVGMMPIELQREICKQYQKARLNYTSASPGSLRIFTNVPVEEDEGLRNRKTEKYKV

SEQ ID NO: 4385 - DNA, 1530 bp, Myxococcus xanthus DK 1622
  CDS (1)..(1530): transl_table=11
atggcacttccagacctgaaggcgctgagcctgctcaaccacgtcccgccgaggctgctatccgcggcggagcgctacctcaaggctgttccgggtgtgaagggcctgctcaaccgggagacgggctcgctgctgtccgaactggagagcggcctcaagccctaccgcgggaagatgcagtcgttcgaccacctgccgccgacggggcgctcgcgcgaggacgtgctgcgtgagctccaggccctggagtcgcaggaggagtaccgctggcgggagggccgcgtgtccggaggcgtgtacaacggcgacgcggagcacatcgcgttcctcaaccgcgtctatgcgctgcattcgcagagcaacccgctgcacgccgacctgtggcccagcgccaccaagttcgaggcggaggtggtggcgatgacggccagcatgctcggcgcggacgtggcgaacgcgggccagccggaggaggcgcgcatctgcggggccatgtcgtccggtggcaccgagagcatcatgctggcgatgaagacgtaccgggactgggcccgggagaccaagggcatcaccaggccggagatggtggcgcccgccagcgcgcacccggccttcgacaaggcggcgcactacttcggcatcaagatggtgcgggtgccggtgggcccggactaccgtgcggacgtggccgccatgcgcaaggccatcaaccgcaacaccatcgtcctcatcggctcggcgcccggctttccgcacggtgtcatcgaccccatcgaggcgctgtccgagatcgcgcgcaagaagcgcatcggcttccacaccgacgcgtgcctgggcggcttcgtgctgcccttcgccatgaagctgggctacgacgtgccgcccttcgacttccggctgccgggcgtgacgtccatgtccgtggacacgcacaagttcggctatgcggccaagggctcctcggtggtgttgtaccggggcacggagctgcgctcgcaccagtacttcacggcgacggactggccgggtggcatctacttctcgcccaccttctccggcagccggcccggggcgctcatcgcctcggcgtgggccgcgctggtgagcacgggggagcagggctacctggacgccacccggagcatcctggagacggcggcggccatcaagaagggcatccgggacatcccggagctgcacgtgctgggggacccgctgttcgtcatcgccttcggttcggagtccgtggacatcttccaggtgatggagcggatgagcgagcacgggtggaacctcaacggcctgcacaaaccgtccgccgtccacctgtgcgtcacgctgcgccacacgcagcccggcgtcgcggagcagttcctggtcgacctgcgcgacgccgtggactacgtgaagtcccaccccagcgcgaaggggacgatggcgcccgtgtacggcatggcggcctccgtgcccttccgcggtctggtgagcgacctgctcaagaagtacatggacctgctctacaaggtgtaa

SEQ ID NO: 4386 - protein, 509 aa, Myxococcus xanthus DK 1622
MALPDLKALSLLNHVPPRLLSAAERYLKAVPGVKGLLNRETGSLLSELESGLKPYRGKMQSFDHLPPTGRSREDVLRELQALESQEEYRWREGRVSGGVYNGDAEHIAFLNRVYALHSQSNPLHADLWPSATKFEAEVVAMTASMLGADVANAGQPEEARICGAMSSGGTESIMLAMKTYRDWARETKGITRPEMVAPASAHPAFDKAAHYFGIKMVRVPVGPDYRADVAAMRKAINRNTIVLIGSAPGFPHGVIDPIEALSEIARKKRIGFHTDACLGGFVLPFAMKLGYDVPPFDFRLPGVTSMSVDTHKFGYAAKGSSVVLYRGTELRSHQYFTATDWPGGIYFSPTFSGSRPGALIASAWAALVSTGEQGYLDATRSILETAAAIKKGIRDIPELHVLGDPLFVIAFGSESVDIFQVMERMSEHGWNLNGLHKPSAVHLCVTLRHTQPGVAEQFLVDLRDAVDYVKSHPSAKGTMAPVYGMAASVPFRGLVSDLLKKYMDLLYKV

SEQ ID NO: 4387 - DNA, 1635 bp, Arabidopsis thaliana
  CDS (1)..(1635)
atggattctttttcatattcttcgatgaaatccatgttgattcaagctcgtggctcgttgaactcgcgtttgtcggagtttgagccactggttctgctattggttccgcttgtctctctgtttctcgctcagattatcggatctgtgtttggcgttgttcacgagaaaggcctcaaagcttgtcttattgggtttatcatgggactcctcaaaatgattcctggagttcagaattacattgatgctgagaaacaaaaggttgttgaccaattacaatctggtagcagctctaagaaaaagaataagactgaagtattgccagtaaaaggtctaggagttgaagttttagagaaaatggagaatgagaagaggaatgatgctatttggcaaggaaaatgctctggcactgtatacataggtggagccgagtctgaaggacatttttcattgataaatcaagcatgttcaatgtttgcgcataccaatccgttgcatatagacgtattccagagtgtggtgcggtttgagtcagaagtagtcgcaatgactgctgcgttacttgggagtaaagaaacggcgtcaggaggtcaaatatgcggaaacatgacgtctggaggaacagaaagtatagtgttggctgtgaagtcatctcgtgactatatgaagtacaagaagggaatcacacggccagaaatgattatacctgagtcgggtcattcggcttatgataaggcggcccagtattttaaaatcaagttgtggcgagttccagttgacaaagacttccgagctgatgtgaaggcaacaaggcggcatattaacagaaacaccatcatgattgttggatcagcaccaggattccctcatggcatcattgatcctatcgaggagcttggtcaactggctcttagctatggaatatgctttcatgttgacctttgccttggtggttttgtgttacctttcgctcgtaaacttgggtaccagatcccaccttttgatttttctgtacaaggagttacttcaatttctgtggacgtgcataaatatggtttggctcctaaaggaactagtacagttctatatagaaatcatgagatcagaaagcaccaatttgttgctgtaactgaatggtcaggaggtctatacgtgtctccaactatcgctgggagtaggcctgggtctttggtagccggtgcttgggctgcaatgatgtcgctcggcgaagaaggttacctacaaaacacaagtaagataatggaagcatcaaagagactagaagaaggagtaagagaaatccatgaactattcgtcattggaaagccagatatgacaatcgtggcttttggttctaaagcattggatatatttgaagttaatgacatcatgtcttctaaaggttggcatttgaatgcactacagagacccaacagcattcatatatgtattactcttcaacacgtccctgtagtcgatgacttccttcgggatctgcgtgaagctgtggaaactgtaaaagcaaacccaggaccgatcacgggaggcttggctccaatatatggagcagcagggaagatgccagaccgaggcatggtgaatgagcttctggttagtttcatggacagtcaatattaa

SEQ ID NO: 4388 - protein, 544 aa, Arabidopsis thaliana
MDSFSYSSMKSMLIQARGSLNSRLSEFEPLVLLLVPLVSLFLAQIIGSVFGVVHEKGLKACLIGFIMGLLKMIPGVQNYIDAEKQKVVDQLQSGSSSKKKNKTEVLPVKGLGVEVLEKMENEKRNDAIWQGKCSGTVYIGGAESEGHFSLINQACSMFAHTNPLHIDVFQSVVRFESEVVAMTAALLGSKETASGGQICGNMTSGGTESIVLAVKSSRDYMKYKKGITRPEMIIPESGHSAYDKAAQYFKIKLWRVPVDKDFRADVKATRRHINRNTIMIVGSAPGFPHGIIDPIEELGQLALSYGICFHVDLCLGGFVLPFARKLGYQIPPFDFSVQGVTSISVDVHKYGLAPKGTSTVLYRNHEIRKHQFVAVTEWSGGLYVSPTIAGSRPGSLVAGAWAAMMSLGEEGYLQNTSKIMEASKRLEEGVREIHELFVIGKPDMTIVAFGSKALDIFEVNDIMSSKGWHLNALQRPNSIHICITLQHVPVVDDFLRDLREAVETVKANPGPITGGLAPIYGAAGKMPDRGMVNELLVSFMDSQY

SEQ ID NO: 4389 - DNA, 1620 bp, Oryza sativa
  CDS (1)..(1620)
atggagctcgccatggattttgcgctccgcctccgcgacgccgccaaccaccacctctcccgctacgagcctctcgtgctcctcgccgcgcccctcctcgccctcctcgctgcccgcaccctccacgccgccgctgccgccgtcgccgaccgcggtctccgcaccgtcctcctcgctctagccatgacagccatcaagttgcttccgggagttagcgcctacatcaacgctgagaagaggaaggttgttgaccagctgcagtcaggtggcacgtccacaaaaagtactctgcggaccgagttgccaactgttgggctttccaaccaagtgataaacgatctcgaaacactgaaagctagagatgtaaactggcagggaaaatgctctggcacagtttatattgctgggagtgaatccgaaggtcattttgcattgataaacaaggcttactctatgttttcacacaccaacccacttcaccaggacgtattcaagagtgtggcacaattagaggctgaagtagttgcaatgacagctgctttgcttggcatcaaagaaaaatcatccggtggacagatttgtggtaatatgacatcgggcggaactgaaagcatattattagcagtaaaaacatcacgcgactatatgcgaacaaagaagggcattacaaagcctgaaatgataattgccgaatcagcacattctgcatacgataaagctgctcaatatttcaatattaaagtgcggcgtgtgccagtgaacaaagagtttcttgcagatgtgaaaggattcaaaaggtgtataaacggaaatacgataatgatggtggggtctgcaccaggatttcctcatggtttaattgatcctattgaggaacttggggagttggcttcacgatatgacatttgcttgcatgttgatctctgccttggtggatttgtattgcctttcgctcgtaagcttgggtaccctattcctccattcgacttctgtgtcaagggagttacatcaatctcaactgatgttcataagtatggattagccccaaaagggacaagcattgtcctatataaaaatcatgaaattagaaagcatcaatttgttgctgttactgaatggactggtgggctctatgtttcacctactattgctggaagtaggcctggtgggttgatagcgggagcttgggctgctatgacgtctcttggactgaacggttatatggaaaatacaggtcatatcatggaagtgtcgaagaaaatacaaagagggattgaagatatcccagggttgtttgtgattggaaagccagacatgactgtcgtggcatttggctcagattcggttgatatatttgaggtgaacgacataatgtcatcaaaaggctggcaccttaatgctctgcagagacccaacagtttacacatttgtgtgacactgcagcacacggtcatatatgaggaattcctgaaggatctgaaagattcagtggacactgtaaaagcaaatccagggcctattagcggggggcgagctccgatttacggagctgctggcaagatgccggacagaggcatggtcagggagctgctggtggagttcatggacgcgtcttgctga

SEQ ID NO: 4390 - protein, 539 aa, Oryza sativa
MELAMDFALRLRDAANHHLSRYEPLVLLAAPLLALLAARTLHAAAAAVADRGLRTVLLALAMTAIKLLPGVSAYINAEKRKVVDQLQSGGTSTKSTLRTELPTVGLSNQVINDLETLKARDVNWQGKCSGTVYIAGSESEGHFALINKAYSMFSHTNPLHQDVFKSVAQLEAEVVAMTAALLGIKEKSSGGQICGNMTSGGTESILLAVKTSRDYMRTKKGITKPEMIIAESAHSAYDKAAQYFNIKVRRVPVNKEFLADVKGFKRCINGNTIMMVGSAPGFPHGLIDPIEELGELASRYDICLHVDLCLGGFVLPFARKLGYPIPPFDFCVKGVTSISTDVHKYGLAPKGTSIVLYKNHEIRKHQFVAVTEWTGGLYVSPTIAGSRPGGLIAGAWAAMTSLGLNGYMENTGHIMEVSKKIQRGIEDIPGLFVIGKPDMTVVAFGSDSVDIFEVNDIMSSKGWHLNALQRPNSLHICVTLQHTVIYEEFLKDLKDSVDTVKANPGPISGGRAPIYGAAGKMPDRGMVRELLVEFMDASC

SEQ ID NO: 4391 - DNA, 26 bp, Artificial sequence
  primer
atgagtggagtatcaaataaaacagt

SEQ ID NO: 4392 - DNA, 22 bp, Artificial sequence
  primer
ctacttggtggcggtatcctct

SEQ ID NO: 4393 - protein, 857 aa, Artificial sequence
  consensus sequence
  Variant (2)..(5): Xaa in position 2 to 5 is any amino acid
  Variant (6)..(24): Xaa in position 6 to 24 is any or no amino acid
  Variant (26)..(33): Xaa in position 26 to 33 is any amino acid
  Variant (35)..(56): Xaa in position 35 to 56 is any amino acid
  Variant (57)..(58): Xaa in position 57 to 58 is any or no amino acid
  Variant (61)..(62): Xaa in position 61 to 62 is any amino acid
  Variant (64)..(70): Xaa in position 64 to 70 is any amino acid
  Variant (71)..(71): Xaa in position 71 is any or no amino acid
  Variant (74)..(75): Xaa in position 74 to 75 is any amino acid
  Variant (77)..(81): Xaa in position 77 to 81 is any amino acid
  Variant (82)..(91): Xaa in position 82 to 91 is any or no amino acid
  Variant (93)..(94): Xaa in position 93 to 94 is any amino acid
  Variant (95)..(103): Xaa in position 95 to 103 is any or no amino acid
  Variant (105)..(106): Xaa in position 105 to 106 is any amino acid
  Variant (112)..(112): Xaa in position 112 is any amino acid
  Variant (114)..(119): Xaa in position 114 to 119 is any amino acid
  Variant (120)..(122): Xaa in position 120 to 122 is any or no amino acid
  Variant (124)..(134): Xaa in position 124 to 134 is any amino acid
  Variant (136)..(136): Xaa in position 136 is any amino acid
  Variant (139)..(139): Xaa in position 139 is any amino acid
  Variant (144)..(146): Xaa in position 144 to 146 is any amino acid
  Variant (148)..(148): Xaa in position 148 is any amino acid
  Variant (154)..(154): Xaa in position 154 is any amino acid
  Variant (156)..(167): Xaa in position 156 to 167 is any amino acid
  Variant (168)..(176): Xaa in position 168 to 176 is any or no amino acid
  Variant (178)..(179): Xaa in position 178 to 179 is any amino acid
  Variant (187)..(187): Xaa in position 187 is any amino acid
  Variant (189)..(189): Xaa in position 189 is any amino acid
  Variant (191)..(201): Xaa in position 191 to 201 is any amino acid
  Variant (202)..(202): Xaa in position 202 is any or no amino acid
  Variant (206)..(206): Xaa in position 206 is any amino acid
  Variant (209)..(209): Xaa in position 209 is any amino acid
  Variant (211)..(211): Xaa in position 211 is any amino acid
  Variant (213)..(215): Xaa in position 213 to 215 is any amino acid
  Variant (217)..(220): Xaa in position 217 to 220 is any amino acid
  Variant (223)..(224): Xaa in position 223 to 224 is any amino acid
  Variant (227)..(228): Xaa in position 227 to 228 is any amino acid
  Variant (230)..(232): Xaa in position 230 to 232 is any amino acid
  Variant (234)..(241): Xaa in position 234 to 241 is any amino acid
  Variant (242)..(242): Xaa in position 242 is any or no amino acid
  Variant (244)..(250): Xaa in position 244 to 250 is any amino acid
  Variant (253)..(253): Xaa in position 253 is any amino acid
  Variant (256)..(259): Xaa in position 256 to 259 is any amino acid
  Variant (264)..(264): Xaa in position 264 is any amino acid
  Variant (270)..(270): Xaa in position 270 is any amino acid
  Variant (272)..(272): Xaa in position 272 is any amino acid
  Variant (274)..(275): Xaa in position 274 to 275 is any amino acid
  Variant (277)..(278): Xaa in position 277 to 278 is any amino acid
  Variant (281)..(284): Xaa in position 281 to 284 is any amino acid
  Variant (286)..(287): Xaa in position 286 to 287 is any amino acid
  Variant (291)..(291): Xaa in position 291 is any amino acid
  Variant (295)..(295): Xaa in position 295 is any amino acid
  Variant (297)..(299): Xaa in position 297 to 299 is any amino acid
  Variant (301)..(304): Xaa in position 301 to 304 is any amino acid
  Variant (305)..(307): Xaa in position 305 to 307 is any or no amino acid
  Variant (309)..(310): Xaa in position 309 to 310 is any amino acid
  Variant (311)..(312): Xaa in position 311 to 312 is any or no amino acid
  Variant (314)..(314): Xaa in position 314 is any amino acid
  Variant (315)..(318): Xaa in position 315 to 318 is any or no amino acid
  Variant (323)..(324): Xaa in position 323 to 324 is any amino acid
  Variant (331)..(331): Xaa in position 331 is any amino acid
  Variant (338)..(338): Xaa in position 338 is any amino acid
  Variant (343)..(343): Xaa in position 343 is any amino acid
  Variant (345)..(347): Xaa in position 345 to 347 is any amino acid
  Variant (350)..(352): Xaa in position 350 to 352 is any amino acid
  Variant (353)..(353): Xaa in position 353 is any or no amino acid
  Variant (355)..(356): Xaa in position 355 to 356 is any amino acid
  Variant (359)..(363): Xaa in position 359 to 363 is any amino acid
  Variant (365)..(365): Xaa in position 365 is any amino acid
  Variant (368)..(368): Xaa in position 368 is any amino acid
  Variant (370)..(370): Xaa in position 370 is any amino acid
  Variant (373)..(374): Xaa in position 373 to 374 is any amino acid
  Variant (375)..(375): Xaa in position 375 is any or no amino acid
  Variant (384)..(385): Xaa in position 384 to 385 is any amino acid
  Variant (387)..(387): Xaa in position 387 is any amino acid
  Variant (390)..(394): Xaa in position 390 to 394 is any amino acid
  Variant (396)..(397): Xaa in position 396 to 397 is any amino acid
  Variant (400)..(405): Xaa in position 400 to 405 is any amino acid
  Variant (407)..(416): Xaa in position 407 to 416 is any amino acid
  Variant (418)..(422): Xaa in position 418 to 422 is any amino acid
  Variant (423)..(431): Xaa in position 423 to 431 is any or no amino acid
  Variant (433)..(435): Xaa in position 433 to 435 is any amino acid
  Variant (437)..(437): Xaa in position 437 is any amino acid
  Variant (439)..(440): Xaa in position 439 to 440 is any amino acid
  Variant (441)..(441): Xaa in position 441 is any or no amino acid
  Variant (443)..(444): Xaa in position 443 to 444 is any amino acid
  Variant (446)..(451): Xaa in position 446 to 451 is any amino acid
  Variant (452)..(456): Xaa in position 452 to 456 is any or no amino acid
  Variant (458)..(467): Xaa in position 458 to 467 is any amino acid
  Variant (468)..(479): Xaa in position 468 to 479 is any or no amino acid
  Variant (481)..(570): Xaa in position 481 to 570 is any amino acid
  Variant (572)..(575): Xaa in position 572 to 575 is any amino acid
  Variant (578)..(578): Xaa in position 578 is any amino acid
  Variant (579)..(607): Xaa in position 579 to 607 is any or no amino acid
  Variant (609)..(611): Xaa in position 609 to 611 is any amino acid
  Variant (613)..(615): Xaa in position 613 to 615 is any amino acid
  Variant (617)..(629): Xaa in position 617 to 629 is any amino acid
  Variant (630)..(632): Xaa in position 630 to 632 is any or no amino acid
  Variant (634)..(653): Xaa in position 634 to 653 is any amino acid
  Variant (654)..(772): Xaa in position 654 to 772 is any or no amino acid
  Variant (775)..(775): Xaa in position 775 is any amino acid
  Variant (778)..(786): Xaa in position 778 to 786 is any amino acid
  Variant (787)..(845): Xaa in position 787 to 845 is any or no amino acid
  Variant (847)..(849): Xaa in position 847 to 849 is any amino acid
  Variant (850)..(851): Xaa in position 850 to 851 is any or no amino acid
  Variant (853)..(853): Xaa in position 853 is any amino acid
  Variant (855)..(855): Xaa in position 855 is any amino acid
GXXXXXXXXXXXXXXXXXXXXXXXPXXXXXXXXEXXXXXXXXXXXXXXXXXXXXXXXXLPXXGXXXXXXXXELXXLXXXXXXXXXXXXXXXWXXXXXXXXXXXGXXSGAVYXGXXXXXXXXXLXXXXXXXXXXXNXLHXDVFPXXXKXEAEVVXMXXXXXXXXXXXXXXXXXXXXXGXXTSGGTESXLXAXXXXXXXXXXXXGITXPEXIXPXXXHXXXXKAXXYFXXKXXXVXXXXXXXXXDXXXXXXXINXNTXXXXGSAPXFPHGIXDXIXXLXXLAXXXXIXXHVDXCLGXFXXXFXXXXXXXGXXXXPXXXXXFDFRXXGVTSISXDTHKYGXAPKGXSXXXYRXXXXRXXQYXXXXXWXGGXYXSPXXXAGSRPGALXXGXWAXXXXXGXXGYXXXXXXIXXXXXXXXXXIXXXXXXXXXXXXXXLXXXGXPXXXVXXFXXXXXXXXXXXIXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXXXXLQXXXXXXXXXXXXXXXXXXXXXXXXXXXXXXPXXXHXXXTXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXYGXAGXXXXXXXXXXXXXXXXXXXXXXXXXXXXXXXXXXXXXXXXXXXXXXXXXXXXXXXXXXXXXXXXXXXXLXXXXXFXDXLY

SEQ ID NO: 4394 - protein, 50 aa, Artificial sequence
  protein pattern
  Variant (3)..(3): Xaa in position 3 is any amino acid
  Variant (6)..(6): Xaa in position 6 is Ile or Val
  Variant (7)..(7): Xaa in position 7 is Ile, Leu, Met or Val
  Variant (8)..(8): Xaa in position 8 is Ile, Leu or Met
  Variant (9)..(9): Xaa in position 9 is any amino acid
  Variant (14)..(14): Xaa in position 14 is Gly or Asn
  Variant (15)..(15): Xaa in position 15 is Phe or Tyr
  Variant (19)..(19): Xaa in position 19 is Ile, Leu or Val
  Variant (20)..(20): Xaa in position 20 is Ala, Ile or Val
  Variant (22)..(22): Xaa in position 22 is Asp or Pro
  Variant (24)..(24): Xaa in position 24 is any amino acid
  Variant (25)..(25): Xaa in position 25 is Ala, Glu, Gly or Ser
  Variant (26)..(26): Xaa in position 26 is Ile or Leu
  Variant (27)..(27): Xaa in position 27 is Gly or Ser
  Variant (28)..(28): Xaa in position 28 is any amino acid
  Variant (29)..(29): Xaa in position 29 is Ile or Leu
  Variant (30)..(30): Xaa in position 30 is Ala or Gly
  Variant (31)..(34): Xaa in position 31 to 34 is any amino acid
  Variant (35)..(35): Xaa in position 35 is Ile or Leu
  Variant (36)..(36): Xaa in position 36 is any amino acid
  Variant (37)..(37): Xaa in position 37 is Phe, Leu or Val
  Variant (39)..(39): Xaa in position 39 is Thr or Val
  Variant (41)..(41): Xaa in position 41 is any amino acid
  Variant (45)..(45): Xaa in position 45 is Gly or Ser
  Variant (47)..(48): Xaa in position 47 to 48 is Ile, Leu or Val
  Variant (49)..(49): Xaa in position 49 is Ala, Pro or Ser
  Variant (50)..(50): Xaa in position 50 is Phe or Leu
INXNTXXXXGSAPXXPHGXXDXIXXXXXXXXXXXXXXHXDXCLGXFXXXX

SEQ ID NO: 4395 - protein, 27 aa, Artificial sequence
  protein pattern
  Variant (6)..(6): Xaa in position 6 is Ala, Gly or Ser
  Variant (7)..(7): Xaa in position 7 is Ile or Leu
  Variant (8)..(8): Xaa in position 8 is Ile, Met or Val
  Variant (9)..(9): Xaa in position 9 is Ala or Val
  Variant (11)..(11): Xaa in position 11 is Ala, Cys or Thr
  Variant (13)..(13): Xaa in position 13 is Ala or Ser
  Variant (14)..(14): Xaa in position 14 is Ala, Ser or Thr
  Variant (15)..(15): Xaa in position 15 is Leu or Met
  Variant (16)..(17): Xaa in position 16 to 17 is any amino acid
  Variant (18)..(18): Xaa in position 18 is Phe, Ile, Leu, Met or Val
  Variant (20)..(20): Xaa in position 20 is any amino acid
  Variant (21)..(21): Xaa in position 21 is Ala, Asp, Glu, Asn, Gln or Ser
  Variant (22)..(22): Xaa in position 22 is Gly or Asn
  Variant (24)..(26): Xaa in position 24 to 26 is any amino acid
  Variant (27)..(27): Xaa in position 27 is Cys or Thr
GSRPGXXXXGXWXXXXXXGXXXYXXXX

SEQ ID NO: 4396 - protein, 21 aa, Artificial sequence
  protein pattern
  Variant (2)..(2): Xaa in position 2 is Leu or Val
  Variant (3)..(3): Xaa in position 3 is Phe or Trp
  Variant (4)..(4): Xaa in position 4 is Pro or Gln
  Variant (5)..(5): Xaa in position 5 is Ala, Gly or Ser
  Variant (6)..(6): Xaa in position 6 is Ala, Thr or Val
  Variant (7)..(7): Xaa in position 7 is any amino acid
  Variant (8)..(8): Xaa in position 8 is Lys or Arg
  Variant (9)..(9): Xaa in position 9 is Phe or Met
  Variant (11)..(11): Xaa in position 11 is Ala or Ser
  Variant (15)..(15): Xaa in position 15 is any amino acid
  Variant (17)..(17): Xaa in position 17 is any amino acid
  Variant (18)..(20): Xaa in position 18 to 20 is any or no amino acid
DXXXXXXXXEXEVVXMXXXXL

SEQ ID NO: 4397 - protein, 29 aa, Artificial sequence
  protein pattern
  Variant (2)..(2): Xaa in position 2 is Ile or Val
  Variant (3)..(4): Xaa in position 3 to 4 is any amino acid
  Variant (7)..(7): Xaa in position 7 is any amino acid
  Variant (8)..(8): Xaa in position 8 is Ile or Val
  Variant (9)..(9): Xaa in position 9 is Ala, Ile, Leu or Val
  Variant (10)..(10): Xaa in position 10 is Ala, Pro or Ser
  Variant (11)..(11): Xaa in position 11 is any amino acid
  Variant (12)..(12): Xaa in position 12 is Ser or Thr
  Variant (13)..(13): Xaa in position 13 is Ala, Gly or Ile
  Variant (15)..(15): Xaa in position 15 is any or no amino acid
  Variant (17)..(18): Xaa in position 17 to 18 is any amino acid
  Variant (19)..(19): Xaa in position 19 is any or no amino acid
  Variant (22)..(22): Xaa in position 22 is Ala, Cys, Gly or Ser
  Variant (23)..(23): Xaa in position 23 is any amino acid
  Variant (26)..(26): Xaa in position 26 is any amino acid
  Variant (27)..(27): Xaa in position 27 is Ile or Met
  Variant (29)..(29): Xaa in position 29 is Ile, Leu, Met or Val
GXXXPEXXXXXXXHXAXXXKAXXYFXXKX

SEQ ID NO: 4398 - protein, 29 aa, Artificial sequence
  protein pattern
  Variant (2)..(2): Xaa in position 2 is Phe, His or Tyr
  Variant (3)..(3): Xaa in position 3 is any amino acid
  Variant (4)..(4): Xaa in position 4 is Ile, Leu or Val
  Variant (5)..(5): Xaa in position 5 is any amino acid
  Variant (6)..(6): Xaa in position 6 is Asp or Glu
  Variant (7)..(7): Xaa in position 7 is any amino acid
  Variant (8)..(8): Xaa in position 8 is Leu or Met
  Variant (9)..(9): Xaa in position 9 is Ala, Gly, Ser or Thr
  Variant (10)..(11): Xaa in position 10 to 11 is any amino acid
  Variant (14)..(14): Xaa in position 14 is any amino acid
  Variant (15)..(15): Xaa in position 15 is Phe or Leu
  Variant (16)..(16): Xaa in position 16 is Ala, Asn or Ser
  Variant (17)..(17): Xaa in position 17 is Ala, Gly, Ser or Thr
  Variant (19)..(20): Xaa in position 19 to 20 is any amino acid
  Variant (22)..(22): Xaa in position 22 is any amino acid
  Variant (23)..(23): Xaa in position 23 is Ala or Ser
  Variant (24)..(24): Xaa in position 24 is Phe, Ile, Leu, Met or Val
  Variant (26)..(26): Xaa in position 26 is Phe, Ile, Leu, Met or Val
  Variant (27)..(27): Xaa in position 27 is Ala or Cys
  Variant (28)..(28): Xaa in position 28 is Phe, Ile, Leu or Val
IXXXXXXXXXXGWXXXXLXXPXXXHXXXT

SEQ ID NO: 4399 - protein, 21 aa, Artificial sequence
  protein pattern
  Variant (2)..(2): Xaa in position 2 is Asn, Ser, Thr or Val
  Variant (3)..(3): Xaa in position 3 is any amino acid
  Variant (9)..(9): Xaa in position 9 is Asp or Glu
  Variant (11)..(12): Xaa in position 11 to 12 is any or no amino acid
  Variant (14)..(15): Xaa in position 14 to 15 is any or no amino acid
  Variant (17)..(18): Xaa in position 17 to 18 is any amino acid
  Variant (19)..(19): Xaa in position 19 is Ala, Ser or Thr
  Variant (20)..(20): Xaa in position 20 is any amino acid
  Variant (21)..(21): Xaa in position 21 is Lys or Arg
GXXTSGGTXSXXLXXAXXXXX

SEQ ID NO: 4400 - protein, 19 aa, Artificial sequence
  protein pattern
  Variant (2)..(2): Xaa in position 2 is any amino acid
  Variant (3)..(3): Xaa in position 3 is Asp, Glu, Gly, Asn or Gln
  Variant (5)..(5): Xaa in position 5 is any amino acid
  Variant (6)..(6): Xaa in position 6 is Ala or Val
  Variant (9)..(9): Xaa in position 9 is Ala or Gly
  Variant (12)..(16): Xaa in position 12 to 16 is any or no amino acid
  Variant (18)..(18): Xaa in position 18 is Gly or Ile
  Variant (19)..(19): Xaa in position 19 is Ala, Glu or Gly
WXXGXXSGXVYXXXXXHXX

SEQ ID NO: 4401 - protein, 10 aa, Artificial sequence
  protein pattern
  Variant (2)..(2): Xaa in position 2 is Pro, Ser or Thr
  Variant (5)..(5): Xaa in position 5 is Leu, Met or Val
  Variant (7)..(7): Xaa in position 7 is any amino acid
  Variant (10)..(10): Xaa in position 10 is Gly, Ser or Thr
WXGGXYXSPX

SEQ ID NO: 4402 - DNA, 1503 bp, Saccharomyces cerevisiae
  CDS (1)..(1503)
atgtcagagggaaaagtagacgaatttatggccatcactggcgctgatgacgctgctattgccactcaattcatcgaaatggcagacgggaacttgaacacagccatatcattgtttttcgaaaatggtggggctgctttactgagcagtaacaacacacctactccgtctaattcgactcctatggcgcccacctctgtagattcagatgccgatgcacaattagcggagaggttgcaaagggaagcttaccaacaacaacagcctgaccaagattatgtcaggccacctgatgaggcaagacatgaagtacttactgaaacttcaggattcccaatttcttacggcggcattggcggaagatttgaaccattgcatagggtgaacgacatgtttgacgaaggaagacctgaaagcatttttaatcaacgattggatgacacaaatactaatacatacatcaatgacaactcttcagattccttggactccgaggaagaaaatgacgacgacgaatatgagtatgtggaagagccggtcatcgaacttgatgaagacggcaatatcaaggagtacaccaaattagtgagaaagcctaaaaccatttccaaggagcagaaattagctttgttatttaggcctccattttcaatcatgtccaaactcgacttagacgctgcaaagcaaaaggcaagggcaaagcaaaaatggataatgattaacattcaggattcaggaatcttccaatgccaagccctcaacagggatttgtggtcgtccagaccggtaaaaactataatcaaagagaacttcgttttcctacagtatcaatatgaatcacgtaatgcccaaccctatcttcagttctatcacttgaataataaggatgatttgccccatatcgcgatactggatccaattaccggtgaacgtgtcaagcaatggaatagggttgttcccattccagagcaattcatctcagaaatcaacgagtttttggcctcattttcgctagatccaaaggtccctaatcccacggttaatgaacctcttcctaaagtggatccaacaactttgaccgaagagcaacaaatggaattagccattaaagagtcattaaataataactcgagcaaatcaaaccaagaagaagtgccgagtactggcgaagaacagaaacgagtacaagaaccggatccattcagtaccattgaagccagggtgcatccagaaccgccaaataaaccagggatcactacaagaattcaaattcgtaccggtgatggctccagactagttcgtagattcaatgctctggaagacactgtgcgtactatttacgaggttatcaagacagaaatggatggttttgccgattcaagattcacactaaatgatcaccaaagagaggacttgattgataaattaaacatgaccatagcggacgccggcttaaaaaatagttctttactacttgagaagcttgaccctgaaatagaataa

SEQ ID NO: 4403 - protein, 500 aa, Saccharomyces cerevisiae
MSEGKVDEFMAITGADDAAIATQFIEMADGNLNTAISLFFENGGAALLSSNNTPTPSNSTPMAPTSVDSDADAQLAERLQREAYQQQQPDQDYVRPPDEARHEVLTETSGFPISYGGIGGRFEPLHRVNDMFDEGRPESIFNQRLDDTNTNTYINDNSSDSLDSEEENDDDEYEYVEEPVIELDEDGNIKEYTKLVRKPKTISKEQKLALLFRPPFSIMSKLDLDAAKQKARAKQKWIMINIQDSGIFQCQALNRDLWSSRPVKTIIKENFVFLQYQYESRNAQPYLQFYHLNNKDDLPHIAILDPITGERVKQWNRVVPIPEQFISEINEFLASFSLDPKVPNPTVNEPLPKVDPTTLTEEQQMELAIKESLNNNSSKSNQEEVPSTGEEQKRVQEPDPFSTIEARVHPEPPNKPGITTRIQIRTGDGSRLVRRFNALEDTVRTIYEVIKTEMDGFADSRFTLNDHQREDLIDKLNMTIADAGLKNSSLLLEKLDPEIE

SEQ ID NO: 4404 - DNA, 2472 bp, Arabidopsis thaliana
  CDS (1)..(2472)
atgggttcgtcacaaggctccacactctcggctgatgtgatgagccttgtggatacattgcctgtgcttgcaaaaacccttatcgctggaggagctgctggggcaattgctaagactgctgttgcacctttggaaaggatcaaaattctattgcagactagaacaaacgactttaagacccttggtgtgtcccagtcattaaagaaggtgttacaatttgatggtcctctcggattctataaaggaaatggggcgagtgttattcggattattccatatgccgcccttcattacatgacgtatgaagtttatcgtgactggattttggaaaaaaatcttcccttaggttctggtccaattgttgatcttgtggctggttcagctgcaggtggaacagcagttttgtgcacatatccccttgatttagctcgtactaagctagcttaccaggtttctgacacaagacagagtctccgaggtggtgcgaatggattttaccgtcaacctacttattcaggcataaaagaggtgcttgcaatggcttataaagaagggggaccacgcgggctatatcgtggcataggaagtctattcatcttagctataataaacggttggcatcaaaggccaacgctgatcgggatccttccttacgcggggcttaagttctacatatatgaggaattgaaaaggcatgttcctgaagagcatcaaaactctgttcgaatgcatctaccatgtggagctttagctggtttatttggccagaccatcacttacccattggacgttgttaggagacaaatgcaggtagagaatctgcaacctatgacgagtgaaggcaacaacaagcgttacaagaacacatttgatgggcttaacacgattgttcgaactcagggttggaaacagttgtttgctggtttaagcatcaactacattaagggttataatcgtctttttgtgaacaaatccgaccgagagagagagagagatatatttttggcagtaagatcaaattttggcattgaaattcgaggtttttatagggttgtggtcttagcaatggaaggaatgttgtcgtccggtgaccaacagagattagtctcttctttccttgaaatcgccgtcggacagaccgccgaaactgctcgacagttcttacaggcgacaagctggaaacttgaggaagctattcagctcttttacattggaaatgaaggtggtatgcttcagtctggtacacacactcagccagcgtccaacgatgatgcggctgcacagtcttggggggcggctacaggcacaggtaatgaaatgatactgcccaacgatgtcgatgaagtccgtgctcctttacctgttgtgagggagactctttatggtgaatcaatgtattatggggctatgagggtgggtaactctcagcctgaaccaaattctttgattgctttccgtaacttcagtgaagagccaaaaagccctggaatttgggaaccagatgagggtgattcctcagcctctgcctcagcatccgcatctgcatcagagtcagcatccgcacctcgggacagcctggcctcgttgtaccgtcctccttttcacctgatgttccagggctcttttgaacaggcaaaaactacttcgtcttcccaggataaatggcttctcgtcaacctccaatctaccacggaattcagctctcatatgctaaatcgagatacttgggcgaatgatgctgtttctcagactatcaaagccaacttcatcttctggcaggtctatgatgataccacggaaggaagaaaggtttgcacatactacaagctcgaatctattcccgtggtgcttgtaattgatccaaccactggtcaaagaatgagaatgtggaccggaatggttgaccctgagaatttgctagaggatttagtgccgttcatggatggtggtcctcgtgaacactttgcttctctctcaaagaagcggccaagaggcagcttctcattgactcctcattccaaacccaaagaggatgttgcaaaagatgaagaagaagaggaactgcaacgagcattagctgcttccttggaagataacaacatgaaagagtcttcagatgatcaatcaacaataatacctgaagaagtagcagttgaagcagttacatccgcggtcctgccaacattcccaccactgccggaagaaccaaagggaggcgatcgcagcctacaatgcagagttgggatccgtttacctaacggacaaagactccagaggaatttcctcaaaacagacacaattcagcttctctggtcattctgctattcccagcttgaggaatcagagaggaagaagccattgaagctaacacaagcgattccaggtgaatcaaagacattggagtatgaatctaacttaaccttggagcagtctggtgttgccaattccatgatctctgctacgtgggaatga

SEQ ID NO: 4405 - protein, 823 aa, Arabidopsis thaliana
MGSSQGSTLSADVMSLVDTLPVLAKTLIAGGAAGAIAKTAVAPLERIKILLQTRTNDFKTLGVSQSLKKVLQFDGPLGFYKGNGASVIRIIPYAALHYMTYEVYRDWILEKNLPLGSGPIVDLVAGSAAGGTAVLCTYPLDLARTKLAYQVSDTRQSLRGGANGFYRQPTYSGIKEVLAMAYKEGGPRGLYRGIGSLFILAIINGWHQRPTLIGILPYAGLKFYIYEELKRHVPEEHQNSVRMHLPCGALAGLFGQTITYPLDVVRRQMQVENLQPMTSEGNNKRYKNTFDGLNTIVRTQGWKQLFAGLSINYIKGYNRLFVNKSDRERERDIFLAVRSNFGIEIRGFYRVVVLAMEGMLSSGDQQRLVSSFLEIAVGQTAETARQFLQATSWKLEEAIQLFYIGNEGGMLQSGTHTQPASNDDAAAQSWGAATGTGNEMILPNDVDEVRAPLPVVRETLYGESMYYGAMRVGNSQPEPNSLIAFRNFSEEPKSPGIWEPDEGDSSASASASASASESASAPRDSLASLYRPPFHLMFQGSFEQAKTTSSSQDKWLLVNLQSTTEFSSHMLNRDTWANDAVSQTIKANFIFWQVYDDTTEGRKVCTYYKLESIPVVLVIDPTTGQRMRMWTGMVDPENLLEDLVPFMDGGPREHFASLSKKRPRGSFSLTPHSKPKEDVAKDEEEEELQRALAASLEDNNMKESSDDQSTIIPEEVAVEAVTSAVLPTFPPLPEEPKGGDRSLQCRVGIRLPNGQRLQRNFLKTDTIQLLWSFCYSQLEESERKKPLKLTQAIPGESKTLEYESNLTLEQSGVANSMISATWE

SEQ ID NO: 4406 - DNA, 2472 bp, Arabidopsis thaliana; identical to SEQ ID NO: 4404
  CDS (40)..(2472)

SEQ ID NO: 4407 - protein, 810 aa, Arabidopsis thaliana
MSLVDTLPVLAKTLIAGGAAGAIAKTAVAPLERIKILLQTRTNDFKTLGVSQSLKKVLQFDGPLGFYKGNGASVIRIIPYAALHYMTYEVYRDWILEKNLPLGSGPIVDLVAGSAAGGTAVLCTYPLDLARTKLAYQVSDTRQSLRGGANGFYRQPTYSGIKEVLAMAYKEGGPRGLYRGIGSLFILAIINGWHQRPTLIGILPYAGLKFYIYEELKRHVPEEHQNSVRMHLPCGALAGLFGQTITYPLDVVRRQMQVENLQPMTSEGNNKRYKNTFDGLNTIVRTQGWKQLFAGLSINYIKGYNRLFVNKSDRERERDIFLAVRSNFGIEIRGFYRVVVLAMEGMLSSGDQQRLVSSFLEIAVGQTAETARQFLQATSWKLEEAIQLFYIGNEGGMLQSGTHTQPASNDDAAAQSWGAATGTGNEMILPNDVDEVRAPLPVVRETLYGESMYYGAMRVGNSQPEPNSLIAFRNFSEEPKSPGIWEPDEGDSSASASASASASESASAPRDSLASLYRPPFHLMFQGSFEQAKTTSSSQDKWLLVNLQSTTEFSSHMLNRDTWANDAVSQTIKANFIFWQVYDDTTEGRKVCTYYKLESIPVVLVIDPTTGQRMRMWTGMVDPENLLEDLVPFMDGGPREHFASLSKKRPRGSFSLTPHSKPKEDVAKDEEEEELQRALAASLEDNNMKESSDDQSTIIPEEVAVEAVTSAVLPTFPPLPEEPKGGDRSLQCRVGIRLPNGQRLQRNFLKTDTIQLLWSFCYSQLEESERKKPLKLTQAIPGESKTLEYESNLTLEQSGVANSMISATWE

SEQ ID NO: 4408 - DNA, 2472 bp, Arabidopsis thaliana; identical to SEQ ID NO: 4404
  CDS (295)..(2472)

SEQ ID NO: 4409 - protein, 725 aa, Arabidopsis thaliana
MTYEVYRDWILEKNLPLGSGPIVDLVAGSAAGGTAVLCTYPLDLARTKLAYQVSDTRQSLRGGANGFYRQPTYSGIKEVLAMAYKEGGPRGLYRGIGSLFILAIINGWHQRPTLIGILPYAGLKFYIYEELKRHVPEEHQNSVRMHLPCGALAGLFGQTITYPLDVVRRQMQVENLQPMTSEGNNKRYKNTFDGLNTIVRTQGWKQLFAGLSINYIKGYNRLFVNKSDRERERDIFLAVRSNFGIEIRGFYRVVVLAMEGMLSSGDQQRLVSSFLEIAVGQTAETARQFLQATSWKLEEAIQLFYIGNEGGMLQSGTHTQPASNDDAAAQSWGAATGTGNEMILPNDVDEVRAPLPVVRETLYGESMYYGAMRVGNSQPEPNSLIAFRNFSEEPKSPGIWEPDEGDSSASASASASASESASAPRDSLASLYRPPFHLMFQGSFEQAKTTSSSQDKWLLVNLQSTTEFSSHMLNRDTWANDAVSQTIKANFIFWQVYDDTTEGRKVCTYYKLESIPVVLVIDPTTGQRMRMWTGMVDPENLLEDLVPFMDGGPREHFASLSKKRPRGSFSLTPHSKPKEDVAKDEEEEELQRALAASLEDNNMKESSDDQSTIIPEEVAVEAVTSAVLPTFPPLPEEPKGGDRSLQCRVGIRLPNGQRLQRNFLKTDTIQLLWSFCYSQLEESERKKPLKLTQAIPGESKTLEYESNLTLEQSGVANSMISATWE

SEQ ID NO: 4410 - DNA, 1533 bp, Candida glabrata CBS 138
  CDS (1)..(1533)
atggaagaggacaaaatcaacaatttcctggttattaccgctgttgaagacgcagatgttgccaggcagttcctggacatggcaggcggtgatgtggacactgccatatcgctgtacttcgagcatggcgtctcgggtctgccatcgggtggtgctgacgctggtgctggcactagtggtgctagctcttctgtggctcacgcggagagtgactctgcgctggcggagagattgcaacaggaagcatatcaggaaccacagacggatgtgaggcctcccgatgaggctaggcatgagactctggcggagactcatgtgtttccgactacatatggtggaattggcggatcttttgggtctctaaggcaccacagtggcaatgtggcgcaggacatgtttgataactcgacaccacagggaatattcaaccagcggatggactttgactacagtgatgactcgtcttcagaagggtcttcatcgtcgtcgttgtctgagtttaatagtaactcagacgacgatgatgagtacgagtatgttgaagaggacgtagtggaagttgacgatgatggcaacattacggagaggaaagagctagtacgccggctgaagaaccctatcaccaaggaggcccgcctcgccatgctatttagacccccatttgatatcatgtcaaaggtgaacttggacagagccaaattaaaagcaagaaagaagaagagatggattatgatcaacattcaggactcgggcgtctttcaatgccaagcgctgaacagggacatatggtcaaacaagcgtgttaagagactgataaagaaaaacttcatatttttgcaataccaattcgaatcgagaaatgctgagccgtacgtacacttctatggtctcaaatccaaggaagaactgccacatattgctatcctagaccccctaactggtgaaagactaaaacaatgggacagcacagtgccgagattagagagtttcttagatgaagttgagaagttcttaaaagacttctctctggagccgggctccaagaacccgctgatcaaacaaccaacaccggatcttgaccctactactctttcagaagaacaacagatggaacttgctatcagacaatccctaggagctggtgaacaagaagtgtcgccatctaacaacgagcgaaacacagacgaagtctctgaaacagaaatagctgatgcaaaggaagaagaaaaaccatctactgggtcactgttcgatcaaattgaacccatcaaccacgaggaaccacagaatgaaccaggaaagaccacaaggatacagatcagaactggtgacggccgtaggatggttagaagattcaacctaacagatacagttagaaatatttacgaggttatcaaggctaagctcgatggatttgccgattgccagttcattttaagcaaccaccaaagagaaaaccttatcgagaagctatcgcttacaatagcagaggcagagttgggaaatagctctctacttgtagagaaggaataa

SEQ ID NO: 4411 - protein, 510 aa, Candida glabrata CBS 138
MEEDKINNFLVITAVEDADVARQFLDMAGGDVDTAISLYFEHGVSGLPSGGADAGAGTSGASSSVAHAESDSALAERLQQEAYQEPQTDVRPPDEARHETLAETHVFPTTYGGIGGSFGSLRHHSGNVAQDMFDNSTPQGIFNQRMDFDYSDDSSSEGSSSSSLSEFNSNSDDDDEYEYVEEDVVEVDDDGNITERKELVRRLKNPITKEARLAMLFRPPFDIMSKVNLDRAKLKARKKKRWIMINIQDSGVFQCQALNRDIWSNKRVKRLIKKNFIFLQYQFESRNAEPYVHFYGLKSKEELPHIAILDPLTGERLKQWDSTVPRLESFLDEVEKFLKDFSLEPGSKNPLIKQPTPDLDPTTLSEEQQMELAIRQSLGAGEQEVSPSNNERNTDEVSETEIADAKEEEKPSTGSLFDQIEPINHEEPQNEPGKTTRIQIRTGDGRRMVRRFNLTDTVRNIYEVIKAKLDGFADCQFILSNHQRENLIEKLSLTIAEAELGNSSLLVEKE

SEQ ID NO: 4412 - DNA, 1545 bp, Kluyveromyces lactis NRRL Y-1140
  CDS (1)..(1545)
atgatatctgacgaggatatttcaactttccaaggtgtttgcggtacagataacgatgaattgtcaagacatttccttgagatggccggaggcaatttggaaacagccatctcgttattctttgaacatggtggtgagagacagttgaacagcaattctggtaataataatgccggtgctggtgctggtgctaatacagggggttctggcggtctgagtggcgacgtagagtttgctgaagaattacaaagacaagcgtatcaggatgaagatcaatatagggctccggatcaggcaagacacgagacattggtggagacaaatgtgtttcctagtgtttatggtggtattggaggttcttttgaaccattgcgtaatgccagggatatgtttgacaattcaagaccttcaggaatttttaatcaacaattagacacagacctactacgttctggtagatctaacaactaccatcgggatgacgatgatgacgatagtgattctgcgtttactgatgaagaaaattatcccagtaatgaggatgagtacgaatacgtagaagaaaacgtcgtggaaatagacgacgatggtgaactacgggaatatacgaaatgggttaagaagccaaaaccaatgtcaaaggaaaccaggctagcattattgtttagacctccattcgatttaatggcaaaatacgatcttgacactgcaaggcaaaaagccaagaaaaggaataaatgggtaatgattaacatccaatgtgcagatattttccagtgccagatgcttaacagagatctttggtccaatgcaggtataaaatccttcataaaacaaaatttcatatttctgcaatatcaatatgaatcaagactagcatctgcctatgtacaacgttatgggttcaacgataaggaagattgtcctcatatcgccatcttggatccaataaccggggagaggttgaaattttggagccgtgaagtgccaactgtggaaaatttcagacaagagctagagatatttctagaggaattctcattagatcccactactactaatccacctgttaaggaacccactccaaagattgatcccagcactttaagtgaggaaaaacagcttgaattggccatacgagaatcgctaggcaaccagactcctactacctcggacgaaacaaatgagaaatctgatcaagtggaagaaaccgaagaaactgaagagcccgacggagcgcaatggaaactcttcgactcaatcaaaccaatagaacatgcagaacctgataacaaacctggaatcacaaccagaatacaagtacgatccggtgatggtaaaagactagtgagaaggttcgatgcaatgcatgatactgtcagaacgatatatgaggttatcaaatctcactggccggaatattcacaagaccaattcgtacttacgactcataccagagaaaatcttatcgagaagcttgacgagtcgataaacgatgcaggtttgaaaaatagctccattctacttgaaaagatctcggactga

SEQ ID NO: 4413 - protein, 514 aa, Kluyveromyces lactis NRRL Y-1140
MISDEDISTFQGVCGTDNDELSRHFLEMAGGNLETAISLFFEHGGERQLNSNSGNNNAGAGAGANTGGSGGLSGDVEFAEELQRQAYQDEDQYRAPDQARHETLVETNVFPSVYGGIGGSFEPLRNARDMFDNSRPSGIFNQQLDTDLLRSGRSNNYHRDDDDDDSDSAFTDEENYPSNEDEYEYVEENVVEIDDDGELREYTKWVKKPKPMSKETRLALLFRPPFDLMAKYDLDTARQKAKKRNKWVMINIQCADIFQCQMLNRDLWSNAGIKSFIKQNFIFLQYQYESRLASAYVQRYGFNDKEDCPHIAILDPITGERLKFWSREVPTVENFRQELEIFLEEFSLDPTTTNPPVKEPTPKIDPSTLSEEKQLELAIRESLGNQTPTTSDETNEKSDQVEETEETEEPDGAQWKLFDSIKPIEHAEPDNKPGITTRIQVRSGDGKRLVRRFDAMHDTVRTIYEVIKSHWPEYSQDQFVLTTHTRENLIEKLDESINDAGLKNSSILLEKISD

SEQ ID NO: 4414 - DNA, 1482 bp, Debaryomyces hansenii CBS767
  CDS (1)..(1482)
atggatgagctagttagcacatttttagcagttacaggaatagaagatgaatcaaccgccaaacagtatttggaaatcaccaataatgatttagagtatgcagttaccctatacatggaatcgaacccgccagctaatgcttctggtcagaatgcatctcatggagacgatgaagaattggcacagaggcttcaacaagaagcgtatggaaatgaaggatcggacgttagagaagcagatacaaatattcatagacatgagacgttggtcgattctttcggcgggggatttacgccatcacctcatattagcagaccaggagatatatttggcgcgggcagggttggtgttttcaaccaaagatatgatggtgaaggagatgagttccattttgatcggtttgaagaattacccgacgatgatgatgatgaagaagaagatgatgatgatgaagtaatggtattagataatgatggagaagtggttgaaaacgatagagaaaggcctcgttcaaggagaagaatgaatagaaatgacagaatgagtgaattaacatctacacaaagaagactagccaacttattcaaaccaccatttgatataatgtctaagattgatttagatgcagcgaagactgagggaagacgcctgaaaaaatggattttaataaatatccaagattcatccgagttcacctgccaggttttaaatagagacttttggtctcaactgaagatcaagaatgttgtccgtgatcactttatatttttgcagtatcaacatgattcgccaaatggtacaaattataaaaacttttattcaattgataaatatcctcatatttctattttggatccattaacgggtgaaagagtcttcaaatggacagatggtgagatacctgaagctgatacctggttagaggaagtggatcagtttttagataaattctcgttgttacctaattcaaataatccaattattaaccatgaagctaaatttgatcctgatgcattatcggaagaacaacaaattgaatttgcaatgaaacaatcaattattgatagccaaactggtggtacaacctctgatgatgctattgaggtagatgaaacaaacgaaatgggtgcttcagataacaattctgttcctgaggaaggagacaagttctcaagcatacagacgcttgaccacgaagaaccaagtgctggaaattcggtcactcgtatacagattcgttttccaaatggaaagagactcatccataaatttgacctcgatgaagatactgtattaactgtctatcaatggctaaagtatattgtagcaaatagcgatgatgaatatggtttgagtaaagatgatagatttattttatcgaatgtttctaataaagcgaaaaagtcgttaattgactcattggattcaacaattaatgaagctgaattaaaaaatgcaagtattttattagagaaagaataa

SEQ ID NO: 4415 - protein, 493 aa, Debaryomyces hansenii CBS767
MDELVSTFLAVTGIEDESTAKQYLEITNNDLEYAVTLYMESNPPANASGQNASHGDDEELAQRLQQEAYGNEGSDVREADTNIHRHETLVDSFGGGFTPSPHISRPGDIFGAGRVGVFNQRYDGEGDEFHFDRFEELPDDDDDEEEDDDDEVMVLDNDGEVVENDRERPRSRRRMNRNDRMSELTSTQRRLANLFKPPFDIMSKIDLDAAKTEGRRLKKWILINIQDSSEFTCQVLNRDFWSQLKIKNVVRDHFIFLQYQHDSPNGTNYKNFYSIDKYPHISILDPLTGERVFKWTDGEIPEADTWLEEVDQFLDKFSLLPNSNNPIINHEAKFDPDALSEEQQIEFAMKQSIIDSQTGGTTSDDAIEVDETNEMGASDNNSVPEEGDKFSSIQTLDHEEPSAGNSVTRIQIRFPNGKRLIHKFDLDEDTVLTVYQWLKYIVANSDDEYGLSKDDRFILSNVSNKAKKSLIDSLDSTINEAELKNASILLEKE

SEQ ID NO: 4416 - DNA, 1467 bp, Yarrowia lipolytica CLIB122
  CDS (1)..(1467)
atggacgacgaactgatcagcaatttcatcgcaattacgaccgcaaccaccgaaaaggccgagcggtacctccaggtctgcgacaacgatcttgagcgtgccgtgactctgtatttggagaacgatggagctgatttggggggagctgagccctcagggggttctagggccgctgccgacgacgacaccgacgccgatgcctacgctcgccagctgcaggaggaggagtacgccaacaatggaggcgaggtgcgagaggccatccagcgacgaacagacactctagtaggaggagacgatgacgacggttttggaggctggcagaacgactacctgccacaacatgctccaggtggccccggaacttacagaggcacgggatcacggcctgccggcatatttagtcagcgacttcggcctgccgacgaagacgaagacgatatgatcatcatcgactcggatgacgaggaagaggacgacgatccctacgaggccaacattcggcgtcagcgcacagccgttgatactggtgtccagccctcacgaatgaccgctcaccagaaccgcttggccaagctgttccaaccacccttcgatatcatgaagatcttaggcttcgaagatgccaggcggtttgcacgagaacagaccaaatggctgctggtaagcatccacgacacgacagacttccggtgccaggtgctgaaccgggacttttggtccgacaaggccgtcaaggacgtggttcgagaaaactttgtgtttgtgcaatacgacagcgactcgcccgagggccagtactatacaaacctgtatccgtttgacgatttcccacacgttgcgattctggacccgcgaacgggagagcaggtcaaggtgtggagcaaggctctggtgcctgcagactggatgcaagacgtgtacgagttcttgagtcggtactcgctggagaagggccacaagaaccccatcaagaccaagaccacaaagcccgtcagccgcatgaccgaggaggagcagctggagtatgcggtgcgaaagtcacagggtcacgacgtggatgaggaggttgaggttgaggtggacggcaagggtaaggccaaggagacagaggtggttgatctggacggcaatgaggctgattctgctgctaccggagctccagaggctgactctgatgaagacaagtttttggccatcattcctgacgcccctgaagaacctcccaatgagcctgatactacccgaatccagcttcgactggctgatggatcgcgggtggtgcgacgaatccgaacctcggatcctgtgcgggccatctatgcatttgtcaagaccctcgaaaaggtccaaggcacctattttgagctcaccagtgcgcgagagaagctcttccccaagctggaccagaccgtggaggaggctggactcaagaacgccagtattctcgtcgaggttctggactag

SEQ ID NO: 4417 - protein, 488 aa, Yarrowia lipolytica CLIB122
MDDELISNFIAITTATTEKAERYLQVCDNDLERAVTLYLENDGADLGGAEPSGGSRAAADDDTDADAYARQLQEEEYANNGGEVREAIQRRTDTLVGGDDDDGFGGWQNDYLPQHAPGGPGTYRGTGSRPAGIFSQRLRPADEDEDDMIIIDSDDEEEDDDPYEANIRRQRTAVDTGVQPSRMTAHQNRLAKLFQPPFDIMKILGFEDARRFAREQTKWLLVSIHDTTDFRCQVLNRDFWSDKAVKDVVRENFVFVQYDSDSPEGQYYTNLYPFDDFPHVAILDPRTGEQVKVWSKALVPADWMQDVYEFLSRYSLEKGHKNPIKTKTTKPVSRMTEEEQLEYAVRKSQGHDVDEEVEVEVDGKGKAKETEVVDLDGNEADSAATGAPEADSDEDKFLAIIPDAPEEPPNEPDTTRIQLRLADGSRVVRRIRTSDPVRAIYAFVKTLEKVQGTYFELTSAREKLFPKLDQTVEEAGLKNASILVEVLD

SEQ ID NO: 4418 - DNA, 1566 bp, Aspergillus nidulans FGSC A4
  CDS (1)..(1566)
atggatagcgacgttgtggcccaattttccgaaattaccggttcaaagccggagcttgcaactcagtacctgcagttgaccgacttcaacattgagcaggccatgcagctgtactttgaaaacgacggagcggaattaacgcgcgatccggttccatcaaattctgcagcaaacagagcatcgcgttccacaggctacgaagatgcgtcgggggtagtgcacctggactctgatgaagacgaagctcaatctacgccacgaaaccggccatcaaatacatcaacgctcgaagacgatgcagctatggcacgccgtctacaagaggaaatgtacggaggacaaagtgctgccgatgaagtgcgtgcgccgatggcccgtaccactgaaacacttgttggaccagaggtagactttgcggatgatatgcatgagagtatcttagggcaaatccggaatcgtcaacgacgcacagatcgacctggtattttcaaccagagagatactacgtcaatatgggccggcgaagaggaggaagagtcccaccgcgaaaggctggcggcagcaacaggcggcgcctccgagagatcgagcaaaacaaatctgcttgcagaactgtaccgcccacctttcgaaatcatgtcaagattaccttgggatctcgctcgggaagatggccgtgagcatgagaagtggcttctggtgaatattcaggacccatccatctttgactgccaggttttgaaccgtgatttatggaaggacgccaacgtcaaggagaccatacaagagcatttcatatttctgcagtacaccaaggatgacccccgtgccgcgccatacctacaatattacttccaggctagtgacgtttctgataactaccctcatattgccatcgtcgacccgcggacgggtgaacaaatgaagatttggtcaggccctccggtggtgaaggctgctgattttctgatgcaacttcacgagtttctcgaccgttacagcttgaagcacaatgtccgaaacccagtggcgaaacggaaacgcgaaattaaggagaagagcattgatgctatgacagaggaagagatgttggagctagcattgaaaaacagcctcggggcgaacgctggacagtctcgaaagatggaagaccccgacgacttaacgcggagcgctggagacgtcaaaggcaaaggtagagcggtcgatgacgaggacgctgagatggatgaggcagacgaaagtgcagatgcagacgctgagacatccgcattttggtctattgcaagtgatcgaccacacaccgaacctcctactgaccctgtaacaacgacacgcattcagttccgacatcccaccggaagagtcataagacgtttcgcattgaatgatccggtcaggaggatttacgaatggctgaaagccgagcctgtcctgaaggagaaagctggcgttgaattcgagcttaatgctatgggccgcaacttgattgatgctctagatcagagtgtggaggctgccggtctgaagaatggtaccatcatgataggatacatcgaggattaa

SEQ ID NO: 4419 - protein, 521 aa, Aspergillus nidulans FGSC A4
MDSDVVAQFSEITGSKPELATQYLQLTDFNIEQAMQLYFENDGAELTRDPVPSNSAANRASRSTGYEDASGVVHLDSDEDEAQSTPRNRPSNTSTLEDDAAMARRLQEEMYGGQSAADEVRAPMARTTETLVGPEVDFADDMHESILGQIRNRQRRTDRPGIFNQRDTTSIWAGEEEEESHRERLAAATGGASERSSKTNLLAELYRPPFEIMSRLPWDLAREDGREHEKWLLVNIQDPSIFDCQVLNRDLWKDANVKETIQEHFIFLQYTKDDPRAAPYLQYYFQASDVSDNYPHIAIVDPRTGEQMKIWSGPPVVKAADFLMQLHEFLDRYSLKHNVRNPVAKRKREIKEKSIDAMTEEEMLELALKNSLGANAGQSRKMEDPDDLTRSAGDVKGKGRAVDDEDAEMDEADESADADAETSAFWSIASDRPHTEPPTDPVTTTRIQFRHPTGRVIRRFALNDPVRRIYEWLKAEPVLKEKAGVEFELNAMGRNLIDALDQSVEAAGLKNGTIMIGYIED

SEQ ID NO: 4420 - DNA, 1641 bp, Candida albicans SC5314
  CDS (1)..(1641): transl_table=12
atggatgaaagtatacccacttttcttgctgttacaggcttagaagatgaatctgttgccaaacagtttttagaagtagctggtggcgatttagaattggcagtgacattatatatggaatcgggccaacacggtgggagtaaaccctcaacaacagacaacaacaacaatactagtgatagcaccaatccaataacatttgccaatgaggatgaagatgaagcatttgccaaacgattacaagaagaagcataccgtgctaacgacaatacagatgataatgtccgtgaagccgatgcaaatgtccatcgacacgaaactttggtggagaacgttggattcccagggtttatgaatcaacaaccaagtattactagaccaagtgatatttttggtaatagacaccaaggtgttttccaccaacgatttgatttccaacaacgtatgatgcctggatttgacgattataatgatgataataataatgatgatagaattgaagaaattgatgacgatgacaatgatgatattgaatatcacgactcacatgatatacaagtgttagactctgatgacgatgaacaaggacactataatggtgctgtgggaggaataacgggtcgtagaagacaattgagacaaaatcgtcatcaagaactatcatcaacacaaagacgattagcaaatttattccgtccaccatttgatatcatatctgtattaaatcttgatgaagccaaatatcaaggtcgacaattgaaaaaatggattctaataaatattcaagattcactggaatttcaatgtcaagttttaaatagagatttttggtctaatgaaagaatcaaacaaattgtcaaacaaaacttcatatttttacaataccaaactgattctgttaatgggcaatcatacgttaacttttatcatgttgatactttccctcatattgctattttggatccattaacaggggaaagagtacataaatggactgatggtcaagttcccttggtaaatgaatggattgaacagacatataagtttttagattcattttcattaattcctgggtctaagaatcctttagtacatcatgatgtgaaaattgatcctactagtttaagtgaagaacaacaaattgaattggccatgaaacaatcaattatagataataacgtggacaataataataacactagttataaatcgggaaatactattgatgatgccattgaattggatagtgatagtgatagtgctataccagatgatgtcatctcaactccatcattggacactccacaagaaccagaaataccaaaagatccatttgaagctataactccaatcgatcatctggaacccacggaacaaccattcactagaattcaaatcagatttcctaatggtaaacgattagtacgtaaattaaatcctgatgctaaagttaaatcaatatttgaatggttgaaatatgtattacaaaatgatttccaagaatatggtttaaattctcctgatgataggtttattttatccaatagctccaacaaagcatttaaatttatagattctttggataaaactatagaggaggctaatttgaaaaatgctagtattcttttggaacaagattaa

SEQ ID NO: 4421 - protein, 546 aa, Candida albicans SC5314
MDESIPTFLAVTGLEDESVAKQFLEVAGGDLELAVTLYMESGQHGGSKPSTTDNNNNTSDSTNPITFANEDEDEAFAKRLQEEAYRANDNTDDNVREADANVHRHETLVENVGFPGFMNQQPSITRPSDIFGNRHQGVFHQRFDFQQRMMPGFDDYNDDNNNDDRIEEIDDDDNDDIEYHDSHDIQVLDSDDDEQGHYNGAVGGITGRRRQLRQNRHQELSSTQRRLANLFRPPFDIISVLNLDEAKYQGRQLKKWILINIQDSSEFQCQVLNRDFWSNERIKQIVKQNFIFLQYQTDSVNGQSYVNFYHVDTFPHIAILDPLTGERVHKWTDGQVPLVNEWIEQTYKFLDSFSLIPGSKNPLVHHDVKIDPTSLSEEQQIELAMKQSIIDNNVDNNNNTSYKSGNTIDDAIELDSDSDSAIPDDVISTPSLDTPQEPEIPKDPFEAITPIDHSEPTEQPFTRIQIRFPNGKRLVRKLNPDAKVKSIFEWLKYVLQNDFQEYGLNSPDDRFILSNSSNKAFKFIDSLDKTIEEANLKNASILLEQD

SEQ ID NO: 4422 - DNA, 1587 bp, Aspergillus oryzae
  CDS (1)..(1587)
atgaacgacgatgtggtggctcagttcaccgaaatcacgggctcgagccctgagctggccattcagtatctccacttagccgattacaatatagaacaagcgatgcagctttatttcgaaaacggtggcgcaccactaactgatgagcccataccatctacatcagacgctccgggagctcgacctaccgcgggcgatagtggggctgtacatgtcggctctgatgacgaggtcactgttgacgaggcacgatctacccctcggcaccaagggccgcaaagttctacctatgaagatgacgaggccatggctcgccgtcttcaggaggaaatgtatggcggtgggggaggtgggggagcagcagttgaagatgatggtgtgcgtgctcccatggctcgcacaacagaaacactcgtaggcccagatgcggacttcgacgatggagatatgcacacaagcatactgggccaattgcgcgctcgccagcaacgaaacaatcgacctggtatcttcaatcaaagggacacttcttcgatatggacaggggaagacgaggcctcacgtcgccaaaggctctcagaagcaactgggggtgcgtctgatgcttcgaataaatccaacatgctagccgaaatgtaccgtccgccgtttgaaatcatgtcacgacttccatgggaccaagcccgccaggaaggccgtgagaatgagaggtggttgctggtcaatatacaagacccctccatcttcgactgccagctgctgaacagggacttgtggaaggacgccgggatcagagacactgtcaaagaacactttctcttcttgcagtactctaaggacgacccacgagctgcgccatacctacaatactattttcaagcgagcgacgtctccgacaactacccgcatatcgccattgtcgacccacgtaccggtgagcagatgaaggtgtggtctgggccgcctgtggtgaaggccgcagacttcctgatgcagctgcatgaatttctcgaccgttacagccttaaccacaatgtacggaacccagtggccaagcggaaaccggagaagaaggagaagagcatcgatgctatgacggaagaggaaatgatggaattggcaatgagaaatagtcttggtggagatccgtctcagccccagaaattggaagatcccgacgatttgacccggagcgtcgaggacgtgaaaggcaaaggccgagcagccgataccgaggacatcaacatggatgaagctgatcaaggcgggaagggcgaggtagaaacttctccattcgcctcgattccagatgataaacctcacacggagcccccctccgacccggctacgactacccgcattcagttccgccatccatccggaagagtaatccgccgcttcgctctgaaggatcccgtccgaagaatctacgaatggctcaaggccgatcctccgttgccagataaagcgggcgtcgagtttgagctcaactccctaggtcacaatttgcttgactcgcttgacaccagtgtggaagatgcgggcttgaagaatggtacagtaatgataggatacgttgaagagtaa

SEQ ID NO: 4423 - protein, 528 aa, Aspergillus oryzae
MNDDVVAQFTEITGSSPELAIQYLHLADYNIEQAMQLYFENGGAPLTDEPIPSTSDAPGARPTAGDSGAVHVGSDDEVTVDEARSTPRHQGPQSSTYEDDEAMARRLQEEMYGGGGGGGAAVEDDGVRAPMARTTETLVGPDADFDDGDMHTSILGQLRARQQRNNRPGIFNQRDTSSIWTGEDEASRRQRLSEATGGASDASNKSNMLAEMYRPPFEIMSRLPWDQARQEGRENERWLLVNIQDPSIFDCQLLNRDLWKDAGIRDTVKEHFLFLQYSKDDPRAAPYLQYYFQASDVSDNYPHIAIVDPRTGEQMKVWSGPPVVKAADFLMQLHEFLDRYSLNHNVRNPVAKRKPEKKEKSIDAMTEEEMMELAMRNSLGGDPSQPQKLEDPDDLTRSVEDVKGKGRAADTEDINMDEADQGGKGEVETSPFASIPDDKPHTEPPSDPATTTRIQFRHPSGRVIRRFALKDPVRRIYEWLKADPPLPDKAGVEFELNSLGHNLLDSLDTSVEDAGLKNGTVMIGYVEE

SEQ ID NO: 4424 - DNA, 25 bp, Artificial sequence
  primer
atgtcagagggaaaagtagacgaat

SEQ ID NO: 4425 - DNA, 25 bp, Artificial sequence
  primer
ttattctatttcagggtcaagcttc

SEQ ID NO: 4426 - protein, 714 aa, Artificial sequence
  consensus sequence
  Variant (2)..(14): Xaa in position 2 to 14 is any amino acid
  Variant (15)..(86): Xaa in position 15 to 86 is any or no amino acid
  Variant (88)..(88): Xaa in position 88 is any amino acid
  Variant (90)..(207): Xaa in position 90 to 207 is any amino acid
  Variant (208)..(297): Xaa in position 208 to 297 is any or no amino acid
  Variant (299)..(309): Xaa in position 299 to 309 is any amino acid
  Variant (310)..(386): Xaa in position 310 to 386 is any or no amino acid
  Variant (389)..(389): Xaa in position 389 is any amino acid
  Variant (391)..(391): Xaa in position 391 is any amino acid
  Variant (396)..(397): Xaa in position 396 to 397 is any amino acid
  Variant (399)..(405): Xaa in position 399 to 405 is any amino acid
  Variant (407)..(414): Xaa in position 407 to 414 is any amino acid
  Variant (417)..(419): Xaa in position 417 to 419 is any amino acid
  Variant (421)..(421): Xaa in position 421 is any amino acid
  Variant (423)..(426): Xaa in position 423 to 426 is any amino acid
  Variant (428)..(431): Xaa in position 428 to 431 is any amino acid
  Variant (436)..(436): Xaa in position 436 is any amino acid
  Variant (438)..(449): Xaa in position 438 to 449 is any amino acid
  Variant (451)..(451): Xaa in position 451 is any amino acid
  Variant (453)..(453): Xaa in position 453 is any amino acid
  Variant (455)..(463): Xaa in position 455 to 463 is any amino acid
  Variant (464)..(468): Xaa in position 464 to 468 is any or no amino acid
  Variant (470)..(474): Xaa in position 470 to 474 is any amino acid
  Variant (475)..(479): Xaa in position 475 to 479 is any or no amino acid
  Variant (481)..(485): Xaa in position 481 to 485 is any amino acid
  Variant (488)..(488): Xaa in position 488 is any amino acid
  Variant (491)..(495): Xaa in position 491 to 495 is any amino acid
  Variant (497)..(511): Xaa in position 497 to 511 is any amino acid
  Variant (512)..(513): Xaa in position 512 to 513 is any or no amino acid
  Variant (515)..(540): Xaa in position 515 to 540 is any amino acid
  Variant (541)..(551): Xaa in position 541 to 551 is any or no amino acid
  Variant (554)..(558): Xaa in position 554 to 558 is any amino acid
  Variant (560)..(562): Xaa in position 560 to 562 is any amino acid
  Variant (564)..(611): Xaa in position 564 to 611 is any amino acid
  Variant (612)..(637): Xaa in position 612 to 637 is any or no amino acid
  Variant (639)..(641): Xaa in position 639 to 641 is any amino acid
  Variant (643)..(645): Xaa in position 643 to 645 is any amino acid
  Variant (647)..(647): Xaa in position 647 is any amino acid
  Variant (649)..(650): Xaa in position 649 to 650 is any amino acid
  Variant (652)..(652): Xaa in position 652 is any amino acid
  Variant (654)..(656): Xaa in position 654 to 656 is any amino acid
  Variant (657)..(657): Xaa in position 657 is any or no amino acid
  Variant (659)..(679): Xaa in position 659 to 679 is any amino acid
  Variant (680)..(687): Xaa in position 680 to 687 is any or no amino acid
  Variant (689)..(694): Xaa in position 689 to 694 is any amino acid
  Variant (695)..(698): Xaa in position 695 to 698 is any or no amino acid
  Variant (700)..(713): Xaa in position 700 to 713 is any amino acid
LXXXXXXXXXXXXXXXXXXXXXXXXXXXXXXXXXXXXXXXXXXXXXXXXXXXXXXXXXXXXXXXXXXXXXXXXXXXXXXXXXXXXXYXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXXXXXLAXLXRPPFXXMXXXXXXXAXXXXXXXXKWXXXNXQXXXXFXXXXLNRDXWXXXXXXXXXXXXFXFXQXXXXXXXXXXXXXXYXXXXXXXXXXPXXXXXDPXTGXXXXXWXXXXXXXXXXXXXXXXXFXXXXXXXXXXXXXXXXXXXXXXXXXXXXXXXXXXXXXEEXXXXXAXXXSXXXXXXXXXXXXXXXXXXXXXXXXXXXXXXXXXXXXXXXXXXXXXXXXXXXXXXXXXXXXXXXXXXXXXXXXXXRXXXRXXXGXRXXRXFXXXXDXXXXXXXXXXXXXXXXXXXXXXXXXXXXXLXXXXXXXXXXLXXXXXXXXXXXXXXN

SEQ ID NO: 4427 - protein, 62 aa, Artificial sequence
  protein pattern
  Variant (4)..(4): Xaa in position 4 is any amino acid
  Variant (5)..(5): Xaa in position 5 is Ile or Leu
  Variant (6)..(6): Xaa in position 6 is Ile or Met
  Variant (7)..(8): Xaa in position 7 to 8 is any amino acid
  Variant (9)..(9): Xaa in position 9 is Gly, Ile, Leu or Val
  Variant (10)..(10): Xaa in position 10 is Asp, Asn, Pro or Ser
  Variant (11)..(11): Xaa in position 11 is any amino acid
  Variant (12)..(12): Xaa in position 12 is Asp or Glu
  Variant (13)..(13): Xaa in position 13 is any amino acid
  Variant (15)..(15): Xaa in position 15 is Lys or Arg
  Variant (16)..(17): Xaa in position 16 to 17 is any amino acid
  Variant (18)..(18): Xaa in position 18 is Ala, Gly or Ser
  Variant (19)..(19): Xaa in position 19 is Arg or Ser
  Variant (20)..(22): Xaa in position 20 to 22 is any amino acid
  Variant (23)..(23): Xaa in position 23 is Lys or Arg
  Variant (25)..(25): Xaa in position 25 is Ile or Leu
  Variant (26)..(26): Xaa in position 26 is Leu or Met
  Variant (27)..(27): Xaa in position 27 is Ile or Val
  Variant (29)..(29): Xaa in position 29 is Ile or Leu
  Variant (31)..(32): Xaa in position 31 to 32 is any or no amino acid
  Variant (34)..(34): Xaa in position 34 is any amino acid
  Variant (35)..(36): Xaa in position 35 to 36 is any or no amino acid
  Variant (38)..(38): Xaa in position 38 is Asp, Gln, Ser or Thr
  Variant (39)..(39): Xaa in position 39 is Cys or Ser
  Variant (40)..(41): Xaa in position 40 to 41 is any amino acid
  Variant (46)..(46): Xaa in position 46 is any amino acid
  Variant (48)..(48): Xaa in position 48 is any amino acid
  Variant (49)..(49): Xaa in position 49 is Asp, Asn, Gln or Ser
  Variant (50)..(51): Xaa in position 50 to 51 is any amino acid
  Variant (52)..(52): Xaa in position 52 is Ile or Val
  Variant (53)..(55): Xaa in position 53 to 55 is any amino acid
  Variant (56)..(56): Xaa in position 56 is Ile or Val
  Variant (57)..(59): Xaa in position 57 to 59 is any amino acid
  Variant (61)..(61): Xaa in position 61 is Ile, Leu or Val
PPFXXXXXXXXXXAXXXXXXXXXWXXXNXQXXSXXXFXXXXLNRDXWXXXXXXXXXXXXFXF

SEQ ID NO: 4428 - protein, 20 aa, Artificial sequence
  protein pattern
  Variant (2)..(2): Xaa in position 2 is any amino acid
  Variant (3)..(6): Xaa in position 3 to 6 is any or no amino acid
  Variant (8)..(8): Xaa in position 8 is any or no amino acid
  Variant (11)..(11): Xaa in position 11 is any amino acid
  Variant (14)..(14): Xaa in position 14 is Glu or Gln
  Variant (15)..(15): Xaa in position 15 is Gln or Arg
  Variant (16)..(16): Xaa in position 16 is Leu, Met or Val
  Variant (17)..(17): Xaa in position 17 is His, Lys or Arg
  Variant (18)..(18): Xaa in position 18 is any amino acid
  Variant (20)..(20): Xaa in position 20 is Asp, Asn, Ser or Thr
IXXXXXIXDPXTGXXXXXWX

SEQ ID NO: 4429 - protein, 14 aa, Artificial sequence
  protein pattern
  Variant (2)..(2): Xaa in position 2 is Ile or Val
  Variant (3)..(3): Xaa in position 3 is Gly or Gln
  Variant (4)..(4): Xaa in position 4 is Ile, Leu or Val
  Variant (6)..(6): Xaa in position 6 is any amino acid
  Variant (7)..(7): Xaa in position 7 is Ala, Gly or Pro
  Variant (8)..(8): Xaa in position 8 is Asp or Asn
  Variant (10)..(10): Xaa in position 10 is any amino acid
  Variant (12)..(12): Xaa in position 12 is Leu, Met or Val
  Variant (13)..(13): Xaa in position 13 is any amino acid
  Variant (14)..(14): Xaa in position 14 is His or Arg
RXXXRXXXGXRXXX

SEQ ID NO: 4430 - protein, 25 aa, Artificial sequence
  protein pattern
  Variant (2)..(3): Xaa in position 2 to 3 is any or no amino acid
  Variant (5)..(7): Xaa in position 5 to 7 is any amino acid
  Variant (8)..(9): Xaa in position 8 to 9 is any or no amino acid
  Variant (12)..(13): Xaa in position 12 to 13 is any amino acid
  Variant (14)..(14): Xaa in position 14 is Ile, Leu or Met
  Variant (15)..(15): Xaa in position 15 is Glu or Gln
  Variant (16)..(16): Xaa in position 16 is any amino acid
  Variant (18)..(18): Xaa in position 18 is Ile, Leu or Met
  Variant (19)..(19): Xaa in position 19 is any amino acid
  Variant (20)..(20): Xaa in position 20 is Ala, Glu, Asn or Gln
  Variant (22)..(22): Xaa in position 22 is Ile or Leu
  Variant (23)..(23): Xaa in position 23 is any amino acid
  Variant (24)..(24): Xaa in position 24 is Ala, Asp, Gly or Asn
  Variant (25)..(25): Xaa in position 25 is Asp, Asn, Gln or Ser
KXXDXXXXXEEXXXXXAXXXSXXXX

SEQ ID NO: 4431 - DNA, 303 bp, Saccharomyces cerevisiae
  CDS (1)..(303)
atgttagccttaatttctggaaagctgtcatcgaattgtgaagcttcactaaatagccttgtggagtcaattgtatcatcaatgcttcttctctgccttttcttaacagggccttcgttctcatcaccattattggcatttggaaccttagtaggcgatacaacttgtgtttgcgtggtgtttcgcttggatttgataaatcctacaggcgtaaattccatgttcttcaagctcccatttgggagatgtgacgcttcgtccatgagtgtttatcagccctttttcgctttgtgtggactgtaa

SEQ ID NO: 4432 - protein, 100 aa, Saccharomyces cerevisiae
MLALISGKLSSNCEASLNSLVESIVSSMLLLCLFLTGPSFSSPLLAFGTLVGDTTCVCVVFRLDLINPTGVNSMFFKLPFGRCDASSMSVYQPFFALCGL

SEQ ID NO: 4433 - DNA, 25 bp, Artificial sequence
  primer
atgttagccttaatttctggaaagc

SEQ ID NO: 4434 - DNA, 25 bp, Artificial sequence
  primer
ttacagtccacacaaagcgaaaaag

SEQ ID NO: 4435 - DNA, 2970 bp, Saccharomyces cerevisiae
  CDS (1)..(2970)
atgttgcggtttcagcgatttgcgtcctcgtatgcccaagcacaggccgttagaaaatatccagttggaggtatattccatggttatgaagtgagaagaattctaccggttccggagctgagactcactgcggtagatttggtgcactcccagacaggagccgagcatttgcatattgatagagacgacaagaataatgtgttcagcattgcttttaaaaccaaccctccagattccactggggtccctcatattctagagcatacaacgttgtgtgggtctgttaaatatccagttagggacccttttttcaaaatgctaaataaatctctagctaatttcatgaacgctatgacaggtccagattatacattttttcccttttccactacgaaccctcaagatttcgctaatttaagaggtgtttatttagactccaccttgaatccgctacttaaacaagaagattttgatcaggagggttggaggttggagcataaaaacatcacagacccggagagtaacattgttttcaaaggtgttgtctataacgaaatgaaaggtcaaatatcaaatgccaattactatttctggagtaaatttcaacagtctatttatccttccctgaataactccggcggagatcctatgaaaattacagacttgagatacggcgatctcttggatttccatcacaaaaattaccatccctccaatgcaaaaactttcacgtacggtaacttgccattggtggatacgttaaagcaattaaatgagcagttcagtggttacgggaagagagctcgaaaggataagttgttaatgcctattgatttaaaaaaagacatagatgtcaagttactgggtcaaatagatactatgcttccaccggagaagcagacaaaagcctcaatgacgtggatttgtggagcgccacaggacacatatgatacctttttgttaaaagtactggggaatttattaatggatggccattcttctgtaatgtatcaaaaattaatagaatcaggaattggtttggagttctccgtaaattcaggtgttgaaccaactacagcagtaaatttgctaactgttggtatacagggcgtgagtgatattgaaatatttaaagacactgtaaataatatttttcaaaacctgttggaaacagaacatccttttgaccgcaagcgtatcgatgccataattgaacaattggaattatctaagaaggatcaaaaggctgactttggacttcaattactctattctatactacctggttggacaaacaaaatcgatccttttgagagcttgttgtttgaggacgttttgcaaagatttagaggtgacttagaaacgaaaggtgatactttattccaagatttaatccgtaaatatatcgttcataaaccttgtttcacgttttccattcagggatctgaagagttctctaaatctttggatgatgaagaacaaacaagactgagagaaaaaattactgccttggatgaacaagacaagaaaaacatctttaaacgtggtatactgttacaggagaaacaaaatgaaaaagaagatttatcctgtttacctaccttacaaataaaagacatcccaagagctggtgataaatattcaatcgaacagaagaataatacaatgtctaggattactgataccaatggtatcacatatgtcagaggtaaacgtttactaaatgacataataccctttgaactcttcccatacttacctttatttgctgaatcgttaactaacctagggacaacaacagaatccttcagtgaaatagaagatcagataaaattacatacgggtggtatatcaacacatgtagaggttacatctgaccctaacaccacagagcctcgcctgattttcgggtttgacggatggtctttaaattcgaagaccgaccacatttttgaattctggtctaagatcttactagaaactgatttccataaaaacagcgataaattgaaagttcttatccgcttattagcatcttcaaacacatcttctgtagcagatgccggtcatgcatttgcaaggggctattctgccgcacattatagatcaagtggagctataaatgagaccctcaatggtattgagcaactacaatttataaatagattgcacagcttgttagacaatgaagaaactttccaaagagaagttgtcgacaagctaactgaattgcaaaagtacattgttgataccaataacatgaatttttttatcacctcagactctgatgttcaagcgaaaacagtagaaagccaaatttcaaaattcatggagagattacctcatggcagctgcttgcccaatggaccaaagacttcagattatcctcttattggatccaaatgtaaacatactttgataaaatttcctttccaggtccattacacatcccaagctttattgggtgtgccgtatacacataaggatggctctgcacttcaagttatgtcaaatatgctaacattcaaacatttgcacagagaagtcagagaaaagggtggtgcttatggtggtggtgcttcttatagcgccttagcgggtattttcagtttctattcctatagggatcctcagcctttgaagagtttagaaaccttcaagaatagcgggcgttatatactgaacgatgccaagtggggcgtcacagaccttgatgaagctaaattgacaatatttcaacaagtagacgcacctaaaagtcccaaaggagaaggcgtgacgtatttcatgagcggtgttacagacgatatgaaacaagcaagaagggaacaactcttagacgtatctctcctggacgttcatagagtcgccgaaaaatatctactaaacaaagaaggggtgagtacggtcattggacctggaatcgaggggaagactgtttcaccaaattgggaggtgaaggaactgtag

SEQ ID NO: 4436 - protein, 989 aa, Saccharomyces cerevisiae
MLRFQRFASSYAQAQAVRKYPVGGIFHGYEVRRILPVPELRLTAVDLVHSQTGAEHLHIDRDDKNNVFSIAFKTNPPDSTGVPHILEHTTLCGSVKYPVRDPFFKMLNKSLANFMNAMTGPDYTFFPFSTTNPQDFANLRGVYLDSTLNPLLKQEDFDQEGWRLEHKNITDPESNIVFKGVVYNEMKGQISNANYYFWSKFQQSIYPSLNNSGGDPMKITDLRYGDLLDFHHKNYHPSNAKTFTYGNLPLVDTLKQLNEQFSGYGKRARKDKLLMPIDLKKDIDVKLLGQIDTMLPPEKQTKASMTWICGAPQDTYDTFLLKVLGNLLMDGHSSVMYQKLIESGIGLEFSVNSGVEPTTAVNLLTVGIQGVSDIEIFKDTVNNIFQNLLETEHPFDRKRIDAIIEQLELSKKDQKADFGLQLLYSILPGWTNKIDPFESLLFEDVLQRFRGDLETKGDTLFQDLIRKYIVHKPCFTFSIQGSEEFSKSLDDEEQTRLREKITALDEQDKKNIFKRGILLQEKQNEKEDLSCLPTLQIKDIPRAGDKYSIEQKNNTMSRITDTNGITYVRGKRLLNDIIPFELFPYLPLFAESLTNLGTTTESFSEIEDQIKLHTGGISTHVEVTSDPNTTEPRLIFGFDGWSLNSKTDHIFEFWSKILLETDFHKNSDKLKVLIRLLASSNTSSVADAGHAFARGYSAAHYRSSGAINETLNGIEQLQFINRLHSLLDNEETFQREVVDKLTELQKYIVDTNNMNFFITSDSDVQAKTVESQISKFMERLPHGSCLPNGPKTSDYPLIGSKCKHTLIKFPFQVHYTSQALLGVPYTHKDGSALQVMSNMLTFKHLHREVREKGGAYGGGASYSALAGIFSFYSYRDPQPLKSLETFKNSGRYILNDAKWGVTDLDEAKLTIFQQVDAPKSPKGEGVTYFMSGVTDDMKQARREQLLDVSLLDVHRVAEKYLLNKEGVSTVIGPGIEGKTVSPNWEVKEL

SEQ ID NO: 4437 - DNA, 3575 bp, Glycine max
  CDS (92)..(3328)
aaggctggggatttgatacgtaagtggattgtccatccattatcatttatcaatctgcactctgcactctgcactgagaagagaagcagtgatggaaagggcggcactggttcgttgtctgccgtgctcttctgtgttgtgcagaagatatttacactctcactcacacttgtgtcgtccctcttcctctattagtattattccctctctctcccttccaaccataaggcctctctgtctgccccgccgccgctcctcctcctcctccagattgcttcccctttacttccgtaccaccatcaacaggaaacacttctcttctctcgccccgagagctgttctctccccttctccttcttcaggttttgctgaggttaatgatgaagttgcccttaaattggggtttgagaaagtttccgaggaattcattccagaatgcaaatcaaaagctgttcttttcaggcacatcaagaccggggctcaagtcatgtctgtttccaacgacgacgacaataaagtctttggaattgttttccgcactcctccgaaagactccactggtatccctcacattctggagcatagcgtattatgcggctcacgaaaataccctctcaaagagccttttgttgaattgttgaaaggaagcttgcacactttccttaatgcgttcacctatcccgataggacatgttacccagttgcttccacaaatgccaaggatttctataatttggttgatgtctacctggatgcggttttctttcccagatgtgtcgaggactttcagatttttcaacaggaaggctggcactttgagctcaacgatccttccgaagacatcacttataaaggtgtcgtgttcaatgagatgaagggtgtctactctcaaccggataatatacttgggcgagctgctcaacaggctcttttcccagacaccacctatggtgttgacagtggaggtgatcctcgagttattcccaagttgacttttgaggaatttaaggaatttcaccgcaagtattaccatcctagcaattcccgcatatggttttatggagatgatgatccaaatgagcgcctccgcatcctaagtgaatatttagacttgtttgattctagtttggcctctcatgaatcaagggttgaaccacagacactattttcaaagccagtccggattgttgagacatatcctgctggtgaagggggtgatttgaagaagaagcacatggtctgtcttaactggttgctctctgataagcccttagacctggaaactgagctaacactaggatttttgaatcaccttctgttgggcacccctgcttcaccactgaggaaaatattgctagaaagtagactgggcgatgccattgttggtggtggggttgaagatgaactactccagcctcaatttagcattggaatgaagggtgtttctgaagatgatattcataaggtagaagagctggtcacaagtacacttaaaaagttggcagaggaaggttttgatacagatgccattgaggcttctatgaatacaattgaattttctctgagagagaacaacactgggtcatttcctcgtgggttgtctctcatgctccagtccattggtaaatggatttatgatatgaatccctttgagccactgaagtatgagaagcctcttcaagacctaaaatctagaatagcaaaggagggctctaaatctgtgttttctcctctaatagagaaattcatcttgaacaaccctcatcaagttaccgtggaaatgcagcctgatcctgaaaaagctgctcgtgatgaagtcgcagagaaacagatattgcagaaagttaaagctagtatgacaacagaagatctagcagagttggcccgtgctactcatgagcttcggcttaagcaggagactcctgacccacctgaagctttgaaaactgttcctagcctttctctacaagatattcctaaagaacctattcgtgttcccactgaggttggggatatcaatggagtaaaagttttgcagcatgatctcttcaccaatgatgtcctttacactgaaatagtattcaacatgaaatcattgaagcaagagcttcttccattggtgccactgttttgccaatcattgttggagatgggaacaaaggacctgacttttgtccaattaaaccaattaattggaagaaaaactggaggaatatcagtttatccattcacatcatcagtgcggggcaaggaagatccatgtagtcacatggttattcgaggcaaagccatggctggacatattgaagacctttatgacttggttaattctgttcttcaagatgtccaatttacagatcaacagcgtttcaaacaatttgtttcccagagtagagcaagaatggagaaccggttaagaggaagtggtcacggaattgcagctgcaaggatggatgcaaaactaaatgcagcaggttggatgtcagaaaagatgggaggtctcagttaccttgaattcctccgaacacttgaagagagagttgatcaagattgggccgatatctcatcatctcttgaggagatccgcaaatctatattttccaagcaaggctgcttgataaatgtcactgctgataggaaaaaccttgcaaagacagaaaaagttctgagcaaatttgttgatctgcttcctactagctctcccattgcaacaactacttggaatgttagacttccattgacaaatgaagctatcgtgattcctactcaggttaattacattggaaaagcagccaacatttatgatactggttatcggcttaatgggagtgcatatgttatttccaaatacattagcaatacatggttgtgggatcgtgtacgtgttagtggtggagcttatggaggtttctgtgattttgatactcactcgggagtgttctccttcttatcttatcgtgatcccaatttgctgaagacacttgatgtatatgatggaactggtgacttcttaagagaactacaaatagatgacgacactttaacaaaagccataattggaaccattggggatgtagatgcgtatcaacttcctgatgccaaaggttatagtagtatgttgcggtacttactgggtatcacagaggaagaaaggcaaaggagacgtgaagagatattatctactagtttgaaggacttcaaaatttttatggatgctatggaagcagttaaggataaaggggttgtggttgcagtggcatctccagaggatgtagatacggccaacaaggaccgtcccgacttctttcaagtgaagaaagccctttagtttcagtatctattccccgcatggatttgaaattgtatcttttcttaaaatttcatacatcgaaacaaatgtttccttgattatttgtttaaataggttaactggctggagctagatacgagaatttattattactttcgtccctggaatatttttttaactaattcaaatcgtttgagaaagttggttattttagttaataacattaaatgttaacaatttgtattattttttcaaaattattttt

SEQ ID NO: 4438 - protein, 1078 aa, Glycine max
MERAALVRCLPCSSVLCRRYLHSHSHLCRPSSSISIIPSLSLPTIRPLCLPRRRSSSSSRLLPLYFRTTINRKHFSSLAPRAVLSPSPSSGFAEVNDEVALKLGFEKVSEEFIPECKSKAVLFRHIKTGAQVMSVSNDDDNKVFGIVFRTPPKDSTGIPHILEHSVLCGSRKYPLKEPFVELLKGSLHTFLNAFTYPDRTCYPVASTNAKDFYNLVDVYLDAVFFPRCVEDFQIFQQEGWHFELNDPSEDITYKGVVFNEMKGVYSQPDNILGRAAQQALFPDTTYGVDSGGDPRVIPKLTFEEFKEFHRKYYHPSNSRIWFYGDDDPNERLRILSEYLDLFDSSLASHESRVEPQTLFSKPVRIVETYPAGEGGDLKKKHMVCLNWLLSDKPLDLETELTLGFLNHLLLGTPASPLRKILLESRLGDAIVGGGVEDELLQPQFSIGMKGVSEDDIHKVEELVTSTLKKLAEEGFDTDAIEASMNTIEFSLRENNTGSFPRGLSLMLQSIGKWIYDMNPFEPLKYEKPLQDLKSRIAKEGSKSVFSPLIEKFILNNPHQVTVEMQPDPEKAARDEVAEKQILQKVKASMTTEDLAELARATHELRLKQETPDPPEALKTVPSLSLQDIPKEPIRVPTEVGDINGVKVLQHDLFTNDVLYTEIVFNMKSLKQELLPLVPLFCQSLLEMGTKDLTFVQLNQLIGRKTGGISVYPFTSSVRGKEDPCSHMVIRGKAMAGHIEDLYDLVNSVLQDVQFTDQQRFKQFVSQSRARMENRLRGSGHGIAAARMDAKLNAAGWMSEKMGGLSYLEFLRTLEERVDQDWADISSSLEEIRKSIFSKQGCLINVTADRKNLAKTEKVLSKFVDLLPTSSPIATTTWNVRLPLTNEAIVIPTQVNYIGKAANIYDTGYRLNGSAYVISKYISNTWLWDRVRVSGGAYGGFCDFDTHSGVFSFLSYRDPNLLKTLDVYDGTGDFLRELQIDDDTLTKAIIGTIGDVDAYQLPDAKGYSSMLRYLLGITEEERQRRREEILSTSLKDFKIFMDAMEAVKDKGVVVAVASPEDVDTANKDRPDFFQVKKAL

SEQ ID NO: 4439 - DNA, 3723 bp, Oryza sativa
  CDS (119)..(3355)
gcacgagagctggggatgtcctcatcgcgccccagctagccacgccgccacctggccccctcctccgaggcagcagaggaggaaaccacagtcgccggcaaagcggggcacctccgccatggagcgggtggcgctgctccgcaactccggccgccgcctcctccatcgctgccgccggcccaggcccgtcgtccaggccgcggggccgtccgcgccgtaccgcccgtcgtcgtcgtcgcacagccgcgcgggtctacccggcggcgcgcggctcctggccgccgcggcgccgctgcactgcgccgggcggtactggccgcacgccgcgcctcgcttcgtccggcgcctctccgcccctgccgtgtccacgtcgccctcacccgtgcccagtgatacagatgacgtccatgagtatgctgcaaagttagggtttgagaaggtatctgaacagagcatagatgagtgcaaatcaactgctgtcctttacaagcacaagaagacaggcgcagaagtgatgtctgtatcaaatgatgatgagaataaagtgtttggcattgttttccgcactccaccgaaaaattcgactggaatacctcacatccttgaacatagtgttctctgtggatcaagaaagtaccctttaaaagagccatttgttgagctcttaaagggcagcctgcacactttcctgaatgcgttcacttatccagatcggacatgttatccagttgcttcaacaaacgctaaggacttctataacttggtagatgtataccttgatgcagtctttttccctagatgtgttgaggacttccaaacatttcaacaggaaggttggcattatgaacttgacaatcctgaagaggagatatcctacaaaggtgttgtcttcaatgagatgaaaggagtttactctcaacctgacaacctaatggggcgtgtatctcaacaggcccttttccctgagaacacttatggtgtggatagcggtggagacccaaatgaaatcccaaagcttacttttgaagaattcaaggagttccacagcaagtattatcatccaagtaatgctaggatctggttctatggtgatgatgacccaaaagaacgcctacgcgttctaagtgaatatctcgatcagtttgaagccagccctgctcctaatgaatctaagatttggccacagaggctattcaaagaaccagtgagaattgttgagaagtatcctgttggtcaggaaggggatctaaagaagaaatttatggtgtgtattaattggctgctgtcagagcagccactagatgtagaaactgagcttacgcttggtttcttggaccaccttttgttgggaactcctgcttcaccccttagaaggattcttcttgaaagtggtttaggggatgctatagtaggtggtggtgttgaagatgagctccttcagccacaattcagtataggtttgaaaggtgtatctgaggataacattaaagaagttgaagagttggtaatgcaaactttgaagaatctggcagaggaagggtttgcaccagaagcagtggaggcatctatgaacacaattgaattcgctcttagggagaacaacacaggatcgttccctcgaggcttgtctctgatgcttcgttcgattggaaaatggatatatgacatggacccttttgagcctctgaaatatgaacgcccattgcagcagttgaaagcacgcattgcagcagagggatctaaagcagtattttcaccactcttggagaaatttttattgaataatgcgcatcgtgccacaattgaaatgcagcctgatccagagaaggcttcacgtgatgaagcagctgagaaagagattctaaagcaagtaaaggctagcatgactcgagaggatcttgcagaattggcacgtgccacaaaagagctgaaggataaacaagaaactccagatcccccagaagctctaaaagctgtccctagcctgtcattgcaagatatccctaaagagcctattcatgtacctatagaggtgggagagataaacggggtcaaggttttgcaacatgatctctttaccaatgatgttgtctactccgaaattgtatttgacatgagttcgttgaagaaagatcatctgcagttgttgccgttgttctgccaatctttgctggagatgggcacaaaagacatggacttcgtgcagcttaaccaattaattggaagaaaaactggaggcatatcagtttacccattcacatcgtcgataaggggaaaagatgatcctcttactcggatcgttgttagggggaagtctatggcaacacgagtagaagatttgtttaatctgatttactgcattctccaagatgttcagttcacagagcagcagaggttcaagcagtttgtttctcaaagtaaagcaagaatggagaatcgattgaggggcagtggccatggcatagctgctgctagaatggatgctaagttaaatgcagctggatggattgctgagcagatgggtggtattagttatcttgagtatttacgtgatctggaaacgaagatcgatcaagattgggacaaaatatcatcttcgcttgaggaaatgagacaatctctctttagaaaggacggttgcctggtcaacataacaagtgactggaaaaatcttgagaaatctaacaaacatattgccaaatttcttgattcgctgccaagtactacatcccttggaagtgatccatggctttctcgattgccatctgttaacgaagctatcgttgtacccactcaggttaattatgttggaaaagctggaaacctgtaccaaagtggatatcagctcaatggaagtgcctatgtcatctccaagcatataagcaatacgtggttgtgggaccgtgttcgagttagtggtggtgcatatggagggttttgtgattttgacacccattcaggagtgttctcatacttgtcataccgtgatccaaatttattgaaaacactagaagtttatgatgagacggccaagttcctaagagagctagaaatggatgatgattgtctcacaaaagctattattggtaccataggtgacgttgattcctaccagctgccagatgctaaaggttacagcagtctaatgcgatacttgctgggcatcacggtggaggaacgccagcaaagacgtgaagagatactatcaaccagcttgaaggatttcaaggagtttgctgatgctgtcgaaacaattaacgacaacggtgtcgtggttgccgttgcatcacctgaggacgtcgaagcagcaaacaaggaaaatcccttgttttcagacgtcaagaagtgcctgtgaagctccttcatttctgctgcctttgcaggattttagtctagatctgcgctgagcacagaggttcttcagtctctcctcgcctacgaatgatgattctgatactgtaacatcatatcttacatagcgagagtatccagccatgattttttttctcgcaattttggggacaacagtagttcaggatgatgggcaaagtgtattcagtgtatttcacttgcattgctgctttccccatcaaacaagtcagatgtacgcgaagtttctgacagaagataaataagagattgctcaaattgttgctccaaaaaaaaaacaaaataacaaaaaactcgagactaattccctccggcactagttccctcgtgcca

SEQ ID NO: 4440 - protein, 1078 aa, Oryza sativa
MERVALLRNSGRRLLHRCRRPRPVVQAAGPSAPYRPSSSSHSRAGLPGGARLLAAAAPLHCAGRYWPHAAPRFVRRLSAPAVSTSPSPVPSDTDDVHEYAAKLGFEKVSEQSIDECKSTAVLYKHKKTGAEVMSVSNDDENKVFGIVFRTPPKNSTGIPHILEHSVLCGSRKYPLKEPFVELLKGSLHTFLNAFTYPDRTCYPVASTNAKDFYNLVDVYLDAVFFPRCVEDFQTFQQEGWHYELDNPEEEISYKGVVFNEMKGVYSQPDNLMGRVSQQALFPENTYGVDSGGDPNEIPKLTFEEFKEFHSKYYHPSNARIWFYGDDDPKERLRVLSEYLDQFEASPAPNESKIWPQRLFKEPVRIVEKYPVGQEGDLKKKFMVCINWLLSEQPLDVETELTLGFLDHLLLGTPASPLRRILLESGLGDAIVGGGVEDELLQPQFSIGLKGVSEDNIKEVEELVMQTLKNLAEEGFAPEAVEASMNTIEFALRENNTGSFPRGLSLMLRSIGKWIYDMDPFEPLKYERPLQQLKARIAAEGSKAVFSPLLEKFLLNNAHRATIEMQPDPEKASRDEAAEKEILKQVKASMTREDLAELARATKELKDKQETPDPPEALKAVPSLSLQDIPKEPIHVPIEVGEINGVKVLQHDLFTNDVVYSEIVFDMSSLKKDHLQLLPLFCQSLLEMGTKDMDFVQLNQLIGRKTGGISVYPFTSSIRGKDDPLTRIVVRGKSMATRVEDLFNLIYCILQDVQFTEQQRFKQFVSQSKARMENRLRGSGHGIAAARMDAKLNAAGWIAEQMGGISYLEYLRDLETKIDQDWDKISSSLEEMRQSLFRKDGCLVNITSDWKNLEKSNKHIAKFLDSLPSTTSLGSDPWLSRLPSVNEAIVVPTQVNYVGKAGNLYQSGYQLNGSAYVISKHISNTWLWDRVRVSGGAYGGFCDFDTHSGVFSYLSYRDPNLLKTLEVYDETAKFLRELEMDDDCLTKAIIGTIGDVDSYQLPDAKGYSSLMRYLLGITVEERQQRREEILSTSLKDFKEFADAVETINDNGVVVAVASPEDVEAANKENPLFSDVKKCL

SEQ ID NO: 4441 - DNA, 2973 bp, Eremothecium gossypii
  CDS (1)..(2973)
atgttgaggttccaacgaacagtgccacgagtggccataaggaggcttgcgaatgtatattcggagggagcagtactgcacgggtacaaggtgcggcgggcgcaagagattccagagatgcgaatggctgcggtggagctggagcacgagatgaccggggccagacacctacacctggagcgagaggaccagaacaacgttttcagtgtcgggttccggactccgccgcccgatgcgacgggggtgccgcacattcttgagcacacgacgctgtgcgggtcgcagaagtacccggtgcgggatccgttcttcaagatgctgaaccggtcgctggcgaacttcatgaatgcgatgacggcgcacgaccacacattctacccgtttgcaacgacgaaccaaaaggactttgcgaacctgcgggacctgtacctggacgcgacgcttcggccgctgctgcggcacgcggactttctgcaggaggggtggaggctggagcaccgggacgtcggggacgcgagcagcgagctggtcttcaagggcgtagtgtacaacgagatgaagggccaggtgtcgaacgcggactactacttttggatccggttccaggaggccatctatccggcgctgcacaactcgggcggcgacccggagcacatcaccgacctgagctacgaggatcttgtggcttttcaccagaaccactaccatccgtcgaacgcgaagacgttcacgtatgggaacttcccgcttcgcgatacgctgcgcaagctggacgacgaattccgcggcttcgggcgccgcgcgatcccgcagatgcacgagaagccgttgcagctgcgcgaggctgtgtcggtggaggagccctgccagatcgatcctatgctccccgcagataaacagtgccgcacatccatgacgtggatatgcggaaacccgaatgatgtatacgagacattcctgttgaagattctcgggtctctgttgtttgatggtcattcttcggccttttacaagaagctggtcgaggaaactggacttgcgtatgagctgtcagtgaacacgggtgtggaatcccagacggcggcaaacttcttgaccgtcggtgtgcaaggatgcaccaatgtaggcaaggtccataaggttattatggagaccttcacggcgcttttggcccagccctttgagaaacacagggtcgaagcaatcctgcaccaactagagctctccaaaaaggatcagaagtctgactttggcctccaactgctgtacggcatcctcccaggatgggtcaacaacacagatccgttcgatctcttatctttgaacagtgcactgcagagattcagggccgactgggacagagagggcgatggtttgttccagcgcctgctgaacaagtacgtaattggcaagcccagtttcacgtttaccatggtgggcagttcggactttaaccaggtgaaggaccaaaacgagcagtcgaaactaaaggcgaaggtgtcctcgttaaccgagagtgataaggaagtgatttacaagcgtggtttgcatcttcaggaactgcagaatagtgagcaggacctttcaaaactaccaacgttgaccacagcggacatccctcattcgagtgggcactattttgtttctcgcgacggaccgatcacaactcgtcaaactgacacgaacggtataacgtacattagaatgaagcgtccgctcaagggagccataccttacgatgcatatccctacatcccactttactccgacggactaatgaacatcggcaccctacttgaagatgcctctgcaattgaggagcagattcgtctgcacacaggtgggatctccgtgtccataggtgtccatccaaacgtcgaaactcgcctttctgagctgtatctggaaatcagtgcctgtgcattgaattctaaaacgcagtatgtgtttgacataataaacaaaattatgaacgagacagccctcagcgttaggtcggagaagatgaaggtcttgattagggccgctgcatcctccttcacgtcctacgcagctgaaaacggacatgatttggccaggctacataccggagcccatttttcgcagactcaggcaattatggagcagactgctggtattgagcaagtgcgccacatgaacaacctcatgagtataattgaaaaagaggcagagttcaacactgtcctccagaacttggaagccatgcatcgtaagatctttgtcgcggatggcttggaggtgatgatcacaactgacaaccggcaaacgtcggacgtcgtcaaagatcaggctttgaagttcattgctggtgtgcagcagtcagcaggcgcggaatcctggcttccggaaaagtattcccgccgcgcgctcgagaagccgtacccggcactgcttcagttcccattccaggtacactatactgcccagtccacccaaggtgtctcctacacccatccagatggcgcacatctccaggtcttggcgtcgctgcttacgtttaagcacctgcatcgcgaagtacgcgagaagggcggcgcgtacggcggaggcgctacgtacaacgccacagatggtatcttcaacttcttctcgtacagggatccgcagcccgttcgctctctcaacatcttcagaaacgcagggaaatacgtgctgaatgaggcccgttggacggcggacgacctcaatgaggccaaactgagtatctttcagcgcgtggacgccccgatcagccccagctcggaggggctgctccagttccggcataacatcagcgatgaacagcgcgacagacgtcgccagcagctgctaaaatcaacgcttgacgacgtccgtcgtgttgcagacatttatcttgtgcagccgtctccttcgcaacatatgagtgctgtggttggcccagaacttccccgcgaagtttggtcgagccaatggccagtgataaaagtctga

SEQ ID NO: 4442 - protein, 990 aa, Eremothecium gossypii
MLRFQRTVPRVAIRRLANVYSEGAVLHGYKVRRAQEIPEMRMAAVELEHEMTGARHLHLEREDQNNVFSVGFRTPPPDATGVPHILEHTTLCGSQKYPVRDPFFKMLNRSLANFMNAMTAHDHTFYPFATTNQKDFANLRDLYLDATLRPLLRHADFLQEGWRLEHRDVGDASSELVFKGVVYNEMKGQVSNADYYFWIRFQEAIYPALHNSGGDPEHITDLSYEDLVAFHQNHYHPSNAKTFTYGNFPLRDTLRKLDDEFRGFGRRAIPQMHEKPLQLREAVSVEEPCQIDPMLPADKQCRTSMTWICGNPNDVYETFLLKILGSLLFDGHSSAFYKKLVEETGLAYELSVNTGVESQTAANFLTVGVQGCTNVGKVHKVIMETFTALLAQPFEKHRVEAILHQLELSKKDQKSDFGLQLLYGILPGWVNNTDPFDLLSLNSALQRFRADWDREGDGLFQRLLNKYVIGKPSFTFTMVGSSDFNQVKDQNEQSKLKAKVSSLTESDKEVIYKRGLHLQELQNSEQDLSKLPTLTTADIPHSSGHYFVSRDGPITTRQTDTNGITYIRMKRPLKGAIPYDAYPYIPLYSDGLMNIGTLLEDASAIEEQIRLHTGGISVSIGVHPNVETRLSELYLEISACALNSKTQYVFDIINKIMNETALSVRSEKMKVLIRAAASSFTSYAAENGHDLARLHTGAHFSQTQAIMEQTAGIEQVRHMNNLMSIIEKEAEFNTVLQNLEAMHRKIFVADGLEVMITTDNRQTSDVVKDQALKFIAGVQQSAGAESWLPEKYSRRALEKPYPALLQFPFQVHYTAQSTQGVSYTHPDGAHLQVLASLLTFKHLHREVREKGGAYGGGATYNATDGIFNFFSYRDPQPVRSLNIFRNAGKYVLNEARWTADDLNEAKLSIFQRVDAPISPSSEGLLQFRHNISDEQRDRRRQQLLKSTLDDVRRVADIYLVQPSPSQHMSAVVGPELPREVWSSQWPVIKV

SEQ ID NO: 4443 - DNA, 3039 bp, Neurospora crassa
  CDS (1)..(3039)
atgctgcgcaacgcgaccaaaggtgcagcgcgccgcgccgtcaccgagctctcccagtacccgaaacccggcgagaaactccacggcttcacccttctccggtcaaagcatgtcccggagctggagttgactgctttgcacttgcaacacgacaagaccggagcagagcatttgcacattgcccgtgacgacagcaacaatgtcttctctatcggcttcaaaacgaatcccccggacgacaccggtgtcccacatatcctggagcacaccactctgtgtggcagccaaaaataccctatccgagaccccttcttcaagatgcttccgcgaacgctttcgaatttcatgaacgcctttacagcatcagatcacaccttttacccgttcgccaccaccaatgctcaggactttaagaacctcatgtctgtctaccttgacgcgactctgcatcctctcttgaaggagacggactttacacaggaaggatggcgtattggacccgagaatccccaggctcttgttgcggctgagggcaacgcaaagcccgaggacaggaagcttgtcttcaagggtgtcgtttataacgagatgaaggggcagatgtcggatgctgcctacctcttctggattcggttccaagaccacattttcccagacatccacaactctggtggtgatccccagaaaatcacagacttgacataccaacagctcaagaagttccatgctgatcactaccacccgagcaacgccaaagtctttacttatggcgatatgccactggcagatcacttgaaggaaatcggtgcccagctcgacgtatttgagaagatccgggctgatgtggcacaccatagccctatcgacctcagcagtggccccagggaagtcaagctctatggacctattgacccccttgtggacgccaataagcagttcaagacttccgtttcgtgggttctgggtgaaaccaacaatgtcgtcgagtccttttcgctggcgctgatttctgctctgctcatggatggttatggctcgcctctctacaagggattgattgaatccgggctaggaacggactggagccccaacaccggatatgacagttcgggcaagcttggtatcttctccattggcctcagcggtgttcaagaagaagatgtgcccaaggtcaaggccaaggtacaggagattcttcgcagcatgcgggacaagggttttgagagatcaaagattgatggctatctccaccagcttgagctcggccttaagcacaagactgccaactttggcatgtctttgctccaccgtttgaagccaaagtggtttgttggagtcgatccatttgactctcttgcctggaacgacacgattgctgcttttgagaccgagcttgccaaaggtggttatcttgagggcttgattgataagtatctgatcaacgacaatactctctccttcacgatggcgccttcgccaacctttagccaggagctggcccaagaggaggaaactcgcttaagcaccaagatttcggaagttgtcaaagctgctggtagcgaagaggaagctcgtgctgctctcgaagctcgggaactcaaattgttggccgagcaaagcaagaccaacaccgaagatcttggctgccttcctagcgtgcatgtcaaggacattccccgccagaaggactcggttatcttgagacacgataacacagcaagagtcaagacacagtggcacgaggctcccacgaacgggctgacctacttccgtgctatcaatcagctggagaacctgcccgatgagctccgaagcctgatccccctcttcactgactccatcatgcgtttgggtacgaaggacatgacaatggagcagcttgaggatttgatcaagctcaaaactggaggtgtctcggtcggctaccattcggcttctcatccaactgacttcactcgggccacagaaggtctgatgttctcgggcatggcattggatcgtcatgtgccaacgatgtttgaccttttgcgcaagctggtcgtagagactgacttcgacagtcctcaagcagctcaacagatccgtcagctgttgcaagcatctgctgatggcgtcgtgaacgacattgcttcatcgggacacgcttacgctcggagagccgccgaatctggccttacgtgggattccttcctcaaggagcaggttagcggtctctcgcaggtaaagctggtgactagcttggcaagccggcccgagtcagacccgttggaggatgttattgcaaagctgaagcaaatccaacagttcgcactggctggcaatctccgtaccgccatcacctgcgacagcggaagtgtctctgacaacgcaaaggcgctcttaaattttgtcaactcgctgccttcggaagcggtgaccttcccaagccggggaccccctaactttacccgtgatatcaagacgttttatcccttgccttatcaggtttactatggtgctttagcccttcctacggcttcttacacggcttccgtgaatgcccctctccagattctctcgcagctcttgacccacaagcacttgcatcacgagattcgtgagaagggtggcgcctacggcggcggatcttacgcccgccccctcgacggtatcttcggcttctactcgtaccgcgaccctaatcctgtgaacacgctcaaaatcatgcggaacgctggccagtgggcggttgacaaggagtggactgatcgtgatcttgaggatgccaagatctctgtcttccaaggcgttgacgcacccaaggctgttaatgaagaaggcatggcccaattcctctacggcattaccgacgagatgaaacagaagcgccgcgaagagctcttggatgtcaccaaggatcaggtccgggaagtggcgcaggagtatgttgtcaaggcccttaacaacggctctgagcgtgtcgtcttccttggcgagaagcgcgactgggtcgacaagtcttgggcggtcaaagagatggacatcaacggttccacttag

SEQ ID NO: 4444 - protein, 1012 aa, Neurospora crassa
MLRNATKGAARRAVTELSQYPKPGEKLHGFTLLRSKHVPELELTALHLQHDKTGAEHLHIARDDSNNVFSIGFKTNPPDDTGVPHILEHTTLCGSQKYPIRDPFFKMLPRTLSNFMNAFTASDHTFYPFATTNAQDFKNLMSVYLDATLHPLLKETDFTQEGWRIGPENPQALVAAEGNAKPEDRKLVFKGVVYNEMKGQMSDAAYLFWIRFQDHIFPDIHNSGGDPQKITDLTYQQLKKFHADHYHPSNAKVFTYGDMPLADHLKEIGAQLDVFEKIRADVAHHSPIDLSSGPREVKLYGPIDPLVDANKQFKTSVSWVLGETNNVVESFSLALISALLMDGYGSPLYKGLIESGLGTDWSPNTGYDSSGKLGIFSIGLSGVQEEDVPKVKAKVQEILRSMRDKGFERSKIDGYLHQLELGLKHKTANFGMSLLHRLKPKWFVGVDPFDSLAWNDTIAAFETELAKGGYLEGLIDKYLINDNTLSFTMAPSPTFSQELAQEEETRLSTKISEVVKAAGSEEEARAALEARELKLLAEQSKTNTEDLGCLPSVHVKDIPRQKDSVILRHDNTARVKTQWHEAPTNGLTYFRAINQLENLPDELRSLIPLFTDSIMRLGTKDMTMEQLEDLIKLKTGGVSVGYHSASHPTDFTRATEGLMFSGMALDRHVPTMFDLLRKLVVETDFDSPQAAQQIRQLLQASADGVVNDIASSGHAYARRAAESGLTWDSFLKEQVSGLSQVKLVTSLASRPESDPLEDVIAKLKQIQQFALAGNLRTAITCDSGSVSDNAKALLNFVNSLPSEAVTFPSRGPPNFTRDIKTFYPLPYQVYYGALALPTASYTASVNAPLQILSQLLTHKHLHHEIREKGGAYGGGSYARPLDGIFGFYSYRDPNPVNTLKIMRNAGQWAVDKEWTDRDLEDAKISVFQGVDAPKAVNEEGMAQFLYGITDEMKQKRREELLDVTKDQVREVAQEYVVKALNNGSERVVFLGEKRDWVDKSWAVKEMDINGST

SEQ ID NO: 4445 - DNA, 2967 bp, Magnaporthe grisea 70-15
  CDS (1)..(2967)
atgctgcggcgcgcagcactaggcgcgaggggcgccggcaggtcttatgcaaccgtcacccagcagtttccgcagccaggcgaacgcctccatggcttcacaatgaagcgcatcaagcacgttcccgagctcaaactcacggccttggagcttcaacacgacaaaacaggtgccgaacacttgcacatcgctaggaacgacagcaataatgtcttttctattggtttcaagacaaatcccccggatgacacgggtttgcctcatatcctcgagcataccactctttgtggaagcgaaaaatatcccatacgagatccgttcttcaagatgctcccaaggacgttgtccaactttatgaacgccttcacagcgtctgaccataccttttaccccttcgcaactaccaatgccaaagactttcagaacctcatgtccgtatacatggacgccacactcaacccattattgaaaaagaccgacttttggcaagagggatggagggttggaccagaaaaccccgaggccctagctgctgcgggcgcagaagccacaccggaagacaagcgcctggtcttcaagggagtcgtatacaacgagatgaagggtcaaatgtcggatgcttcctatctgttctacatccgcttccaggaccacatctttcccgatataaacaactctggtggcgacccccaaaagatcacagacctgacttacgagcagctcaagcgcttccacgcggaccactaccacccaagcaacgccaaactcttcacatacggtgacatgccgcttgctgatcatttgcaggaaatcgatgcccagttgagcgcctttaacaaactctcgtcggaagacgtggccaagtcgtctgtatcctgggtattgggtgatacgggagacattgtggagtcgttttcactgtccctgatttcggctctacttatggacggttacggttctcccatgtacaagggtctcattgagtctggtctcggcatagcttggactcccaactctggctatgacaattcggcgaaagacggcatattctccattggtttgactggccttcaggagcaggatgtgcctaaagtcaagaccgaggtccaaagaatactccgggaggcttgtgaacaaggcttcaagaggtccaagattgatggctacttgcatcagatcgagctgggacttaagcacaagactgccaactttggaatgtctttattgcagcgggtcaagccaaagtggttcaacggtgtcgatgtgtttgacacgcttgcctggaacgaaaccattgaagcatttgagaacaaaatggccgagggaggttatctcgagggattgatggaccgctacctcctcaacgataacactttgaccttcaccatgacaccttctgccgactttggcgcagaactgggcaaggaggaagagaccaggctggcggccaaaatttctgaagtccgagaaagcttgggcggtgaagcagaggcacaaaaggcactcgaagaacgagagctccaactacttgccgaacagagcaagtcaacttccgaagacctcagctgcctccctaccgtgcgcgtatctgacatacccagacggaaagagccggcagtcgtgagacacgacgagactgacggcttcaggaccatgtggcacgaggcgccaactaatggcttgacttacttccgttccatcaacacgttcgagaacctcccacaagacttgcgcgagatgattcctttgttcacagatgcgataaatcgtcttggaaccaaggatctaacgatggaagagctggaagaccgtataaaactactcactggtggcaacctgtcagttggttaccacgccgcgtcgtctccaaacgattttacgcaggcatctgaaggccttacattcagcgggatggtcttggaccgaaatgttcaagaaatgtacgagcttctgcggctgttggttctggaaacgaactttgacagcccggatgccgtctctcacatccggcaattgttgaaggcgtctacggaggaagcgataaaccagatcgccgactcaggccattcgtacgcacgatcggctgccgaggctggtttgagtaccaagaatcattacaacgagcaagttggtggattgtcacagatcaagcttctcacatctctggccggtagaccggagtcagatcagctggaagacgttattggaaaactcaagaccattcagcgtctggcattcaacgccgacagcatgcgcacctttatcacgtgcggtagcgaaagtgtccagcagaaccagacagcgctttccaaattcataggtactctgcccaggaataacagtgtcaacttgtcgtccactggacagaccgcccaaagctttgcaagggatgtcaaggctttttacccattgccttaccaggtctactacggcgcacttgccgtccccacgtcttcgtatacctcgaaagacagcgcgccgctgctcatcctgtcgcagatgctcacgcacaggcacctgcaccacgagattcgtgagaaaggtggtgcctatggtggtggtgcatacgcacgctcgctggaaggcatcttcggcttctattcgtaccgggacccgaacccagtaaataccctcaagatcatgcgcaatgccggccgttgggccgttgacaagcagtggacagatcgtgatcttgaggaggccaagatctctgtgttcaagagcgttgacgcacccaaggacatcaacgcggagggcatgggtcagttcctttacggcgtcaccgaagagatggctcatgaacgccgggctcgtctcctcgatgtcacacgcgaacagatacaagaggtggcaaacaagtatgtcgtcgaatcgcttgacaaacaggccgagagggtcgccttcctcggtcagaaggcggactgggtcgacggttcttgggccacaaaagagatgaacgtcgactag

SEQ ID NO: 4446 - protein, 988 aa, Magnaporthe grisea 70-15
MLRRAALGARGAGRSYATVTQQFPQPGERLHGFTMKRIKHVPELKLTALELQHDKTGAEHLHIARNDSNNVFSIGFKTNPPDDTGLPHILEHTTLCGSEKYPIRDPFFKMLPRTLSNFMNAFTASDHTFYPFATTNAKDFQNLMSVYMDATLNPLLKKTDFWQEGWRVGPENPEALAAAGAEATPEDKRLVFKGVVYNEMKGQMSDASYLFYIRFQDHIFPDINNSGGDPQKITDLTYEQLKRFHADHYHPSNAKLFTYGDMPLADHLQEIDAQLSAFNKLSSEDVAKSSVSWVLGDTGDIVESFSLSLISALLMDGYGSPMYKGLIESGLGIAWTPNSGYDNSAKDGIFSIGLTGLQEQDVPKVKTEVQRILREACEQGFKRSKIDGYLHQIELGLKHKTANFGMSLLQRVKPKWFNGVDVFDTLAWNETIEAFENKMAEGGYLEGLMDRYLLNDNTLTFTMTPSADFGAELGKEEETRLAAKISEVRESLGGEAEAQKALEERELQLLAEQSKSTSEDLSCLPTVRVSDIPRRKEPAVVRHDETDGFRTMWHEAPTNGLTYFRSINTFENLPQDLREMIPLFTDAINRLGTKDLTMEELEDRIKLLTGGNLSVGYHAASSPNDFTQASEGLTFSGMVLDRNVQEMYELLRLLVLETNFDSPDAVSHIRQLLKASTEEAINQIADSGHSYARSAAEAGLSTKNHYNEQVGGLSQIKLLTSLAGRPESDQLEDVIGKLKTIQRLAFNADSMRTFITCGSESVQQNQTALSKFIGTLPRNNSVNLSSTGQTAQSFARDVKAFYPLPYQVYYGALAVPTSSYTSKDSAPLLILSQMLTHRHLHHEIREKGGAYGGGAYARSLEGIFGFYSYRDPNPVNTLKIMRNAGRWAVDKQWTDRDLEEAKISVFKSVDAPKDINAEGMGQFLYGVTEEMAHERRARLLDVTREQIQEVANKYVVESLDKQAERVAFLGQKADWVDGSWATKEMNVD

SEQ ID NO: 4447 - DNA, 3015 bp, Gibberella zeae PH-1
  CDS (1)..(3015)
atgcttcgcaacgccgctgctggcgctcgcaaggccgtgacggagctgtcacaattcccaaaacctggcgagaagctccacggtttcacccttgttcgatccaagcacgtcccggagctcgagttgacggctctacaccttcaacacgacaagaccggcgccgactatctccatatcgctcgtgatgacagcaacaatgtcttctcaatcggtttcaagacgaaccctccggatgataccggtattcctcatatcctcgagcacaccacgctgtgcggtagcgaaaaataccccattagagatccctttttcaagatgttgccacgaacgctatcgaacttcatgaacgccttcacagcctcggatcacaccttctaccccttcgcaacaaccaacgcgcaagatttcaagaacctcatgtctgtgtatctggactcaacgttgcatccgctgctcaaaaagtccgactttacccaggagggctggagaattgggccggagaacccccttgctgaggacgaggcgagcaagaagcttgtgttcaagggtgttgtgtacaacgagatgaagggccaaatgtcggacgctggctacctatactatatccgatttcacgatcatattttccccgatatcaacaactctggtggcgatccccagaagatcaccgacctcacatacgagcaactgcaaaagttccatgcggaacactaccaccctagcaacgccaaggtcttcacctatggtgatatgcccctgatcgaccacctcaagcaggttgacacgcagctccaagctttcgagaagattcaaggcgataagcaggttcatgagccagttactctcaatggccccaaggaagtgaccctctacggtcccctcgacccccttgttgatcaagatcgccagtacaagacgtccgtctcatggattatgggcgataccactgatgttctcgaatcattttctctggctcttctttccactcttttgatggatggttacggttcccccctataccgtggtcttatcgaggctggtatgggagctgattggagccctaacgccggctatgacagttctgccaagaagggcatcttctccattggcttgactggtgtccaggagggtgatgtgcccaagctcaaggagaaagttcagcaaatcttgcgagatgcgcgcaacaagggtttcgacaagaccaagattgacggctccctgcaccaattggagctgtcgctgaagcataagactgccaactttggtttctctatgctgaaccgtcttaagccaaagtggttcaacggtgtcgaccctttcgactcattggcatggaatgacaccatcaatggcttccaggccaagatggccgagggcaactacttggagggtcttattgacaagtacctcctcaacgataatactctgactttcactatggccccttcaacaacttatggtgaggacttggtaaaggaggagcaggagaggctttcaactagaatccaggcggcgatcaaggaggctggaagcgaggagaaggcgcgaaagcacttcgagaagcaagagcaagaattgttggtcgagcaaaacaagacaaacaccgaagatcttggttgcttgccaactgtccatgtcaaggatattccccgaagcaaagaggctgttgttgttcgagacgagaacgccaacggaacaaagatccaatggcacgaggcacccaccaacggcttgacatacttccgtgctatcaacacgctggagaacttgccagatgagcttcgtgagttggttcctctgttcactgacagcatcatgcgcctcggtaccaaggacttgaacatggaacagcttgaggatttgatcaagcttaagactggcggcgtttcggttggataccactgcacaccatctcccacagatttccatgctgccagtgagggcatcatctttactggtatggcattggaccacaacgttcctgttatgtttgacatcatccagaaactcgttttgggaaccgacttcgatagtcctgaagctgcccttagaattcgccagcttctccaggcttctgctgacggtgttgttaatgacattgcatcaaccggacacagatttgccatgggaagcgcagagtctggtctcacccgatctgcgtggttgcgacagcaagtgtctggtctttcacaagtgcagctggtgacttcgctggccagccgccctgagactgataagcttgaggacgtcatctctaagctaaagcagattcagaaccttgcacttgtcggtggaaatctccgcaccgcgatcacttgtggctcggagagcgttgcggcaaacggggcttcgctgcagaactttgtgggcaacctttctcgtgaccccttgaacttgaagaacccttcgccccgacagcttcccaaggatagcaagaccttctaccctctaccttaccaagtctactatggtggattatcactaccgaccacctcatacacatcggcagagggtgcacctcttcaaattctgtcccagctcctcacacacaagcatcttcatcatgagatccgtgagaagggtggcgcatacggtggcggtgcttactctcgagccttggacggcctcttcggcttctactcttaccgggatcccaacccccagaacaccctcagcatcatgcgaaatgctggccaatgggctgtcgataagaagtggtcagaccgcgatttggaggaggccaagatctctgtgttccaaggagtcgatgcgcccaagtctgtgaaccaggagggcatgggccgtttcctctcgggcatcaccgaagagatgaagcagaagaagcgagagcagtttctggatgttaccaaggatcaggttcgcgaggctgcgcagcgttaccttgttgacggactggccaagggtgaaggccgagtggctttccttggagagaagcaggcgtgggttgacggcgagtggcagatccgcgagatggatgtcaagggcgctgagtaa

SEQ ID NO: 4448 - protein, 1004 aa, Gibberella zeae PH-1
MLRNAAAGARKAVTELSQFPKPGEKLHGFTLVRSKHVPELELTALHLQHDKTGADYLHIARDDSNNVFSIGFKTNPPDDTGIPHILEHTTLCGSEKYPIRDPFFKMLPRTLSNFMNAFTASDHTFYPFATTNAQDFKNLMSVYLDSTLHPLLKKSDFTQEGWRIGPENPLAEDEASKKLVFKGVVYNEMKGQMSDAGYLYYIRFHDHIFPDINNSGGDPQKITDLTYEQLQKFHAEHYHPSNAKVFTYGDMPLIDHLKQVDTQLQAFEKIQGDKQVHEPVTLNGPKEVTLYGPLDPLVDQDRQYKTSVSWIMGDTTDVLESFSLALLSTLLMDGYGSPLYRGLIEAGMGADWSPNAGYDSSAKKGIFSIGLTGVQEGDVPKLKEKVQQILRDARNKGFDKTKIDGSLHQLELSLKHKTANFGFSMLNRLKPKWFNGVDPFDSLAWNDTINGFQAKMAEGNYLEGLIDKYLLNDNTLTFTMAPSTTYGEDLVKEEQERLSTRIQAAIKEAGSEEKARKHFEKQEQELLVEQNKTNTEDLGCLPTVHVKDIPRSKEAVVVRDENANGTKIQWHEAPTNGLTYFRAINTLENLPDELRELVPLFTDSIMRLGTKDLNMEQLEDLIKLKTGGVSVGYHCTPSPTDFHAASEGIIFTGMALDHNVPVMFDIIQKLVLGTDFDSPEAALRIRQLLQASADGVVNDIASTGHRFAMGSAESGLTRSAWLRQQVSGLSQVQLVTSLASRPETDKLEDVISKLKQIQNLALVGGNLRTAITCGSESVAANGASLQNFVGNLSRDPLNLKNPSPRQLPKDSKTFYPLPYQVYYGGLSLPTTSYTSAEGAPLQILSQLLTHKHLHHEIREKGGAYGGGAYSRALDGLFGFYSYRDPNPQNTLSIMRNAGQWAVDKKWSDRDLEEAKISVFQGVDAPKSVNQEGMGRFLSGITEEMKQKKREQFLDVTKDQVREAAQRYLVDGLAKGEGRVAFLGEKQAWVDGEWQIREMDVKGAE

SEQ ID NO: 4449 - DNA, 2973 bp, Candida glabrata CBS138
  CDS (1)..(2973)
atgttacggtttcagagatttgcgtcgacgtataatcagcgtgcggtgttgcgtaagtaccctgtcggagggattatacatgggtttcaagttcggagagcggtaccagtacctgagttgaaacttactgcggtggatttgatacatgaacagactggtgctgagcatctacatatcgacagagatgataagaacaatgtgttcagcattgcgttcaggactttgccacctgatgctacaggtgtcccgcatatattggagcatactacgctatgtggttccgagaagtatccagtgcgtgatcctttctttaagatgctaaataagtcgctagcaaactttatgaatgccatgactgggcctgactatacattctttcccttcgctactaccaacgcacgtgactttgtgaacttaagagatgtataccttaactcgacgcttagaccgcttttgaaggagcaggatttctaccaagaaggttggagacttgagcattcggaagtcaccaatccaaaaagtgatataatcttcaaaggtgtggttttcaatgagatgaagggtcaagtatctaatgctgattatcatttctggtcacagttccaacaaaatatctacccatcgctaaataactctggaggcgatccccaaaagattacagatcttcactatcaggacttagttgactttcatcacgcaaattatcacccttcaaatgcacgtacttttacttatggttcgttccctcttgaagacactttgaaaaaggtaaacgaagaattcagggcatatggcaaacgaattattaataagaagcttcctaaacctttggaattaattgagacaaaggagttaacgcttgaaggacagatagacccaatgttaccagccgaaaagcagacgaagacatccttaacctggaaatgtggtgagcctactgatctttacgagacatttctactgaaaatattaggtaatctattactggatggacatgattccataatgtataagggattgattgaatctggactaggacatgactttagtgttaacactggtgtcgaatcaatgactgctgcaaacttcctaactgttggtattcaaggctctcagaatgtagaagagtttaagtctaaagtttttgatctgtttaaagaatttattgaaaatgatgttgactcgaataaagttgatgctattatacatcaattggaattatcaaagaaagaccaaaaagcagatttcgggcttcaaattttatactcaattcttcccggatggaccaacggtatcgacccaattgaaggacttgaattcgatgaattgatagggagactcaaatcagatttcaaagagaatggaacgaagatcttcaaaaacatattagataagtacataatagaccaaccatatttccatttcacgatgaaaggttcggaagagttcagttctaagttagcagcggaagaatccaccaaattggacaaaaagttgaaagagctagacgagaccgaccggaaagctatttttgagcgtggattattgctagaggcagctcaaaatcacaaggaggatctgtcttgccttccaactttaggtgttgcagatatatcaagaaaggtagatacttatgacttgaacacaaatgctaacatcacggtcagaaatacggcaaccaatggaataagttatattagaggcaagaagttaatcaatgatatgattccattggaattatacccgtttttaagcttgtttgcagcctcgttgacccatctgggcaccaaaacaacaccatatggtgcaattgacaacgaaataaaactacacactggcggtatatcaacaaatatttctgttaatgctgatcctaccacattgcagcctaatctgtactttgatatgagcgggttttctctgaacgaaaaatcggactacatattcaattttttaaaaacaattttaatggaaactgactttagcactcacaaggataagctaaaagtgttgataaattctattgcatcttcgaatacatcgcatatagctgattctggtcacactgttgctagatcgtttgccagtggtcatttgagtacggttgctgcaattcaagagcatatctcaggtgtcgaacattacaaactgatttctagactatgttccattatgaatgacgataaattatttcaatcagaggttatagataaactagtgatgctacaaagaataatagttaattctcagaatatggaattttttgcgtctgttgactgtcaagcacaagagaataaaatcagaaaagaggttgactattttgtaagcactttacctaatacaagctccgatatctcaggggctattcagactgcgtgtgtgcctagatattcagactcccaagttttaaacttgataaaatttcctttccaagtccattacacagctcaagcatataatggggtttcatacacccataaagatggtgctgcactacaagttcttgctaatatgctgacatttaagcacttgcataaagaaattagagaaaaaggtggtgcatatggtggtggagccactttcagtgccttgtctggtatttttagttattattcttatagagatccaaacccgttggcaagtatccaaacatttgaaaaatctgcctcatatgtcttaaatgatgcaaagtggacacagtctgacttagatgagtcaaaactttctattttccaacaagtcgacgctcctattagtcctaagagcgagggatccacattcttcaacttaggagttactgatgaaatgagacaagtaagacgggagcagctgttggacacttcgttgctggatattcatagagttgcagagaggtatattctaccgaacaaatctatcgctacagtcgtcggaccaggtattgatggggagactgtatctccaaaatggcatatcgaagatataaaggtatga

SEQ ID NO: 4450 - protein, 990 aa, Candida glabrata CBS138
MLRFQRFASTYNQRAVLRKYPVGGIIHGFQVRRAVPVPELKLTAVDLIHEQTGAEHLHIDRDDKNNVFSIAFRTLPPDATGVPHILEHTTLCGSEKYPVRDPFFKMLNKSLANFMNAMTGPDYTFFPFATTNARDFVNLRDVYLNSTLRPLLKEQDFYQEGWRLEHSEVTNPKSDIIFKGVVFNEMKGQVSNADYHFWSQFQQNIYPSLNNSGGDPQKITDLHYQDLVDFHHANYHPSNARTFTYGSFPLEDTLKKVNEEFRAYGKRIINKKLPKPLELIETKELTLEGQIDPMLPAEKQTKTSLTWKCGEPTDLYETFLLKILGNLLLDGHDSIMYKGLIESGLGHDFSVNTGVESMTAANFLTVGIQGSQNVEEFKSKVFDLFKEFIENDVDSNKVDAIIHQLELSKKDQKADFGLQILYSILPGWTNGIDPIEGLEFDELIGRLKSDFKENGTKIFKNILDKYIIDQPYFHFTMKGSEEFSSKLAAEESTKLDKKLKELDETDRKAIFERGLLLEAAQNHKEDLSCLPTLGVADISRKVDTYDLNTNANITVRNTATNGISYIRGKKLINDMIPLELYPFLSLFAASLTHLGTKTTPYGAIDNEIKLHTGGISTNISVNADPTTLQPNLYFDMSGFSLNEKSDYIFNFLKTILMETDFSTHKDKLKVLINSIASSNTSHIADSGHTVARSFASGHLSTVAAIQEHISGVEHYKLISRLCSIMNDDKLFQSEVIDKLVMLQRIIVNSQNMEFFASVDCQAQENKIRKEVDYFVSTLPNTSSDISGAIQTACVPRYSDSQVLNLIKFPFQVHYTAQAYNGVSYTHKDGAALQVLANMLTFKHLHKEIREKGGAYGGGATFSALSGIFSYYSYRDPNPLASIQTFEKSASYVLNDAKWTQSDLDESKLSIFQQVDAPISPKSEGSTFFNLGVTDEMRQVRREQLLDTSLLDIHRVAERYILPNKSIATVVGPGIDGETVSPKWHIEDIKV

SEQ ID NO: 4451 - DNA, 2949 bp, Kluyveromyces lactis NRRL Y-1140
  CDS (1)..(2949)
atgtttcaaattcgtaactatgccacaaaatatgcacagtctcgggcgctgaggaagtacccagtaggtggcgtttttcacggatatgaagtgaaacgattacttcctgtccctgaactaaagctaacagccgtggatttattgcataaccaaaccggttcacaacatttacatattgatagagatgataacaacaacgtgttcagtatcggattcaaaaccaatcccccggattcaactggtgtgccacatattttggaacacacaactctttgcggttctcataagtatcctgttcgcgatccgttcttcaagatgttaaacagatcgttggcaaacttcatgaacgctatgactggtcatgactatactttttacccgtttgctaccactaatgagacggattttgctaatctaagagacgtttaccttgatgcaactctaaatccattgttgaatcagcaagatttcctacaagaaggttggaggcttgaacacactaaggttgatgatccaaacagcgatataggtttcaaaggtgttgtatacaatgaaatgaagggtcaagtatccaatgctaactattatttctggattaagtttcaagaaagctattatccatccttgaataactctggtggtgacccaactaaaatgactgatcttcaatatgaagatttaatcagtttccacagaaataattaccatccttctaatgctaagacgtttacatacgggaacttcgatttgaacaataccttacagaggttgaataaagaatatcaaggttatggtagaaggggttctaagaagagggaactattaccaatccaaatgaaagaagatgtttctgtagaaaccgaaggacaggttgatcctatgttaccaccggataaacagatcaagacctctgtgacttggatttgtggtaaacctgaagacacgtaccaaacatttctattgaagatcttgggtaatttattattagacggacattcctctcctttctatcaaaaactaattgaaagtgggctggcgtacgacttttcagttaacactggtgtagagtcgcagactgctgcaaactttatcactattggtgttcaaggatgtgatgaagtggattcgatatatgaagttattaacaaagtatgggaagaagtattacagaatccgtttgaggagtctaggatccaagcaatcattcaacaattagagttatctaagaaagaccaaagggcagatttcggtttacaattactgtactcggttttaccaggatgggttaacaagactgatccatttgattctttattgttcgatgagacactagaaagattccaagaagattgggccactaagggtgataatttattcaaagacttaatcaaagaattcgtgatttcaaaacctgtattcaaattcaccatgaagggctcagaaacgttctctcagaaacttgatgctgaggaacaagaacgtttggagagaaagttaaagctccttgacgaagaagacaaaaaggtcattttcgaacgtggtaaacaattgcaagaactacaggacctcaaagaggatttgagttgccttccttcattgcaaattagtgcaattccaagagtttcaaagacatacccattgttagagaaggataatgttttaaatcgtattaccgataccaatggtattacatacgtcagaggtaagcgtttactaaaccaccatattccaagagaactttatcctttcctaccattatacgcagactcattgacgaaccttggtacttcaactgaagagttttccaccattgaagaacaaatcaaattgcacactggcggtgtctcaactcgcgtatctgtaaatccagatgcacagactggtaagcctatgctgctattccaagttgatggatgggctttgaacagcaaaaccgatcacatcttcaagttttggaagaaacttttatgtgaaactgatttccataagcacaaagaaaagctaaaggtcttaataagatcattagcatcttcaaacacagcgtctgtggctgagactggtcatgcttttgcccggaacttcggtgctgctcatttaagtgtaactaaagccatcaacgaaagtttaaacggtatcgaacagttacagttaatcaataagttatctcaatgtttggatgatgaagcactatttgagaaagaagtggtttcaaaattggttgagcttcaatcatatataaatggcagttcagacatgaaattcatgatcaccagtgattctcaagttcaaatcgatgcagttcaccaacaaatcacgggctttttgagctccttacccaaggattcaaaaccatgtgacttctactctgagaattactcaatgttggaaaacccaggtaaaccaaccctactccagttcccatttcaggttcattacaccgccaagtgttacccaggcgtttcctatacccatcctgatggcgctaagctacaaatcctttctaacatgttgacacacaaatatttgcaccgtgaaattcgtgaaaaaggtggcgcatatggtggtggtgctacttacagcgctttggatggtactttcagtttctattcttacagggatcctcacgctttaaattctttgtccacattcgatagcgttccagaattcatattgaacaagtcttcgtggggtgaaccagacttgaatgaagcgaaattgagtgtcttccaacaagtagactccccaatgagcgccaaaaacgaaggtaccattttattccattacgacgtaacagacgaaatgaaacaacgtcgtagagagcaacttttagacgtcaacttgaatgatatacatcaagtggcagaggaatacctcaagcaagataaatccattgcctccatagttggtccggaaatcccaaattttgatgccttagttcaaaccgtgtaa

SEQ ID NO: 4452 - protein, 982 aa, Kluyveromyces lactis NRRL Y-1140
MFQIRNYATKYAQSRALRKYPVGGVFHGYEVKRLLPVPELKLTAVDLLHNQTGSQHLHIDRDDNNNVFSIGFKTNPPDSTGVPHILEHTTLCGSHKYPVRDPFFKMLNRSLANFMNAMTGHDYTFYPFATTNETDFANLRDVYLDATLNPLLNQQDFLQEGWRLEHTKVDDPNSDIGFKGVVYNEMKGQVSNANYYFWIKFQESYYPSLNNSGGDPTKMTDLQYEDLISFHRNNYHPSNAKTFTYGNFDLNNTLQRLNKEYQGYGRRGSKKRELLPIQMKEDVSVETEGQVDPMLPPDKQIKTSVTWICGKPEDTYQTFLLKILGNLLLDGHSSPFYQKLIESGLAYDFSVNTGVESQTAANFITIGVQGCDEVDSIYEVINKVWEEVLQNPFEESRIQAIIQQLELSKKDQRADFGLQLLYSVLPGWVNKTDPFDSLLFDETLERFQEDWATKGDNLFKDLIKEFVISKPVFKFTMKGSETFSQKLDAEEQERLERKLKLLDEEDKKVIFERGKQLQELQDLKEDLSCLPSLQISAIPRVSKTYPLLEKDNVLNRITDTNGITYVRGKRLLNHHIPRELYPFLPLYADSLTNLGTSTEEFSTIEEQIKLHTGGVSTRVSVNPDAQTGKPMLLFQVDGWALNSKTDHIFKFWKKLLCETDFHKHKEKLKVLIRSLASSNTASVAETGHAFARNFGAAHLSVTKAINESLNGIEQLQLINKLSQCLDDEALFEKEVVSKLVELQSYINGSSDMKFMITSDSQVQIDAVHQQITGFLSSLPKDSKPCDFYSENYSMLENPGKPTLLQFPFQVHYTAKCYPGVSYTHPDGAKLQILSNMLTHKYLHREIREKGGAYGGGATYSALDGTFSFYSYRDPHALNSLSTFDSVPEFILNKSSWGEPDLNEAKLSVFQQVDSPMSAKNEGTILFHYDVTDEMKQRRREQLLDVNLNDIHQVAEEYLKQDKSIASIVGPEIPNFDALVQTV

SEQ ID NO: 4453 - DNA, 3192 bp, Debaryomyces hansenii CBS767
  CDS (1)..(3192)
atgttaaggttggctaatagagtttccagaaaggacagtgggaacttggggatagcccaattgaagaagagactcttggccacttcaggtgtgtcacaaggtgagattttgagtaaatatcctatcggtcttaatatgcatgggtatgtgattgaacaagttcaacctataccagaattttcacttgtagcagtcaaattgaaacattctagaactggatcagaacacttacatttggatacacctaatgataaaaataatgtattcctggtagcgtttaagacgaatgctcctgacgccactggggttcctcacatattggaacatacaacgctttgtgggtcattcaaataccctgttagagacccgtttttcaagatgcttaatagatcgttgagtaattttatgaatgctatgacgggacatgattacacatattatccgtttgctactactaatgcgaaggactttgaaaacttgatggatgtatatttatcgtcagttttcgagccgctccttactcatgagagttttatgcaagaaggatggagattagagaattcagatctttccgatcctaaaagtcctataatctttaaaggggttgtttataatgagatgaaaggtcaatattctaactcggcatattattattggatcaaattccaagaagccatatacgggtcgttaaataattctgggggaaatccaaatgaaattactgatttaaggtatgaagatttagttgatttccactcttcaaattaccatccatccaatgcaaaaacctttacttacggtaatattgaattggttaatcatttgaacaaactaaatgagttttttgaatcttttggtagccgtggaataaggacaaatgttagaaaaccaataactgaacttaatccaaattatgaatcagacgtcactgttaagggtccccttgatacgatgtcaagtaggccaatcgaagaacaatacaaatcttcgattacttgggtgattgggaacccattagatgaatccaaattgtatgacgtatttaagtggaaagttttgagttctttgttatgtgatggtcataactcgccgttctatcaggaattaattgaaaaagaatatggagaggacttcgctgtcaattatggtttagatgctaccacagctttattatcttttacaattggcttaaataacttatctttagaaaaagctaaaaatttagaggataaagtacgtggaattttcgttgagaagatcatccctgaacttcaaaaggggaaagaaagtggcttcaacgatagaattgaagcaattttacatcaaattgaattgaacttcaaaaatcataaaccagaatttggtataggtctattaagttcagtcgtttctacttgggttaatggattaaatcctgttaagtcactacaaattgaccatattttaaacaggttcaaagaagactataaactcaatggcttaaagatgtttcaagatttgcttgatgaatcagttttaaaggatgatactccaaagtttaagttcacaatggaacccgatgaaagttttggaaaaaacttgacatctcaagaaactgaaagattgaataagaaaattgaggccttaaccgaagaagataaagagataatctacaaaagaagcatagagttggctgagaagcagaagaaagaggaagatgtatcagccttaccgactttgacggttaaagacattccacgagaaggcgatttttatcctcttgattttgcagacataaattctaaaaaacttcaaaaaagaattgttgatacgaacgggttaatttacatgaacgctactaaggatatttcatatttaccttctaaatactatgaatacttaccattattcgactgttgtcttactaatttagccggtacaagtaagacaccaataactgaattggagataaaaatccaaaagttgacaggtggtgttacattcaatgtttcggctaagactgatccatttgatatctccaagactaatatgaaatttatgttatcgggtatggctttgaaagacaaatctcagaacgtgtatgacttatggtttgaaattttaactcaaacgaaattcgattccgaggatgagcaagttgttgataaattattcactttggttaaaaacttaggacaaaatcaaatgaatacaatcgccgattcaggtcattcttatgcaaattcttacagtaattctcaacttacacctacaaagtatattcataatttaattggtggaataggccaagtttcgtttattctggatttgaatagaaaattagaaacagaaggcagagactttttaaagaaagagcttttgccagtgttaaaggatattcaacgccatttggttaatggtttcactgatggaaatcattcaggattcgaatacagcttagttggtgatagtgaatctgttattaaaaatgaaaaaatgattaaagaatttgacgatttattgacagcaaattctaatcgagtagctggcaccaatgaattatcttccttgatttctcaattcaatagcaacaaattgggtttaaataacaatggtcgtagtacgttgatcgacttgcctttccaagtcggatatgcttcgttagctaagttaggagctgcatatactagtaaagatggagctgcattgcgtgttttatcacaattattaaccttcaaacacttacattctgttattagagaagcaaatggggcatatggtggaggattactgtttgatggtttaggtggatgtttgaatttctactcatatagagaccctaatccacttacatcagttcagtcttttaaggattcgacttcagttgcattaggtaaaatgataaattctgagaataatggttggagtccaaaagatttgcaagaagcaaaattaaccatattccaaggcgtggatgcacctagccatatttctctgcagggatccttagatttccttgagcatatcacggacgagatgaggcaagaaagaagagaacggtttttggatgttacttatgaagacttgaagaatgttactgagaagtacttgttaaatggttcacaggatattgttacggtgattggagataatgaaactctcaaaattgattctagcgatgctcagtggaacattaagaaattaactgcctaa

SEQ ID NO: 4454 - protein, 1063 aa, Debaryomyces hansenii CBS767
MLRLANRVSRKDSGNLGIAQLKKRLLATSGVSQGEILSKYPIGLNMHGYVIEQVQPIPEFSLVAVKLKHSRTGSEHLHLDTPNDKNNVFLVAFKTNAPDATGVPHILEHTTLCGSFKYPVRDPFFKMLNRSLSNFMNAMTGHDYTYYPFATTNAKDFENLMDVYLSSVFEPLLTHESFMQEGWRLENSDLSDPKSPIIFKGVVYNEMKGQYSNSAYYYWIKFQEAIYGSLNNSGGNPNEITDLRYEDLVDFHSSNYHPSNAKTFTYGNIELVNHLNKLNEFFESFGSRGIRTNVRKPITELNPNYESDVTVKGPLDTMSSRPIEEQYKSSITWVIGNPLDESKLYDVFKWKVLSSLLCDGHNSPFYQELIEKEYGEDFAVNYGLDATTALLSFTIGLNNLSLEKAKNLEDKVRGIFVEKIIPELQKGKESGFNDRIEAILHQIELNFKNHKPEFGIGLLSSVVSTWVNGLNPVKSLQIDHILNRFKEDYKLNGLKMFQDLLDESVLKDDTPKFKFTMEPDESFGKNLTSQETERLNKKIEALTEEDKEIIYKRSIELAEKQKKEEDVSALPTLTVKDIPREGDFYPLDFADINSKKLQKRIVDTNGLIYMNATKDISYLPSKYYEYLPLFDCCLTNLAGTSKTPITELEIKIQKLTGGVTFNVSAKTDPFDISKTNMKFMLSGMALKDKSQNVYDLWFEILTQTKFDSEDEQVVDKLFTLVKNLGQNQMNTIADSGHSYANSYSNSQLTPTKYIHNLIGGIGQVSFILDLNRKLETEGRDFLKKELLPVLKDIQRHLVNGFTDGNHSGFEYSLVGDSESVIKNEKMIKEFDDLLTANSNRVAGTNELSSLISQFNSNKLGLNNNGRSTLIDLPFQVGYASLAKLGAAYTSKDGAALRVLSQLLTFKHLHSVIREANGAYGGGLLFDGLGGCLNFYSYRDPNPLTSVQSFKDSTSVALGKMINSENNGWSPKDLQEAKLTIFQGVDAPSHISLQGSLDFLEHITDEMRQERRERFLDVTYEDLKNVTEKYLLNGSQDIVTVIGDNETLKIDSSDAQWNIKKLTA

SEQ ID NO: 4455 - DNA, 2973 bp, Yarrowia lipolytica CLIB99
  CDS (1)..(2973)
atgttacgtctaaagtcgctcaaaaaaccggtccaggccgtggttcgacgtttcgccaccacctccgcacccactctctctgtcggcgacaatatccatggcttcaatgttctcagaaccaaagagatccccgagtttgatctgcaggctaccctgctagagcactccactggagcccagcatctgcacattgctcgagatgactccaacaacgtcttttccatcggcttcaagactaatcctcccgatcgaaccggagttccccatattctggagcatacaacgttgtgtggatcggaaaagtaccaagtccgagatcccttcttcaagatgcttaaccgatctcttgccaacttcatgaacgcgatgaccgcccaggactacaccttttacccctttgctaccaccaacgctaccgacatgaagaatctgcgagatgtgtacctcgatgctaccctgaagcctctgcttcgagagctggacttttctcaggaaggctggagactggaaaacgaggactccaaggacaagaccagtcccatcatcctcaagggtgtcgttttcaacgagatgaaaggtcaaatgtccaatgctgcttacgctttctacattcggtacctggagaagatctaccccagtttgaacaactctggaggagaccctcttgttattcccgaactcacctacgagggtctcaagaagtttcatgctgatcactacaaccccagcaacgccaagacgttttcttatggagatatctctgttgctgaccatttggaggctctgaacgccaaatttgagaattgtgagatctccaaaactcccggaaacaccgagagattgcctctcgaattttcttctgccgctgagaacacccgtatcgttgaagagggtcctattgacactcttctggatacgtctaagcagcacaagatgtccatgtcgtggttgatgggttctcccaaggacatttacgagtctttctgcgtcaagatcatctcttctctactcattgacggtcattcttccccccttcatcagaagctgattgattccggtcttggatcttcctactctcccaacactggccttgacagtgctcctggagctaacattttctctgttggtcttcagggagtgaccgagagcgatcttacaaaggtcgagactgttattctcgacaccatcaagactaccgttgctgagggcttcgacaagggccgaatcgacggtcttttgcatcagactgagcttgctcgaaaggaccagaacgccaagttcggtatggctcttatgaacggtgttcttcctggctggtttaaccaggtcgaccccctggaggctctggagtggaattctgtgctcgatcggttcaacaaagacatggaggccgaccctgagttcctgcagaaggtgatgaagaagtacttgctcgacaacaagtacttccactttcagatgaaccccaatcccgactatgagaagaatgtgcaggaaaaggaggacgagattctgaccgacaagctggccaaactgactgaatctgataaggaggaaatcttcgagaccggggccaacctggaaaagatgcaggaagagcctgagaaccttgactgtctgcccactcttcacgtctcagacatccccagaagcaagcctcgagttgccttggagcataccaagaatccctatcccatccagtggcgacttgcccccaccaacggtctgacttacttccactccatctcttctctagagggtcttccccacgagtactaccccttccttcctctgttcacctcgtccctaacctttttgggaaccaaggacaagactatgggccaactggaagacgaaatcaaactcaacactggtggtcttgatttctctgtctcctgctcttcttctcctctttctctgccgtcgtcccagctcaactttgctatggatggtgtggctttggacaaaaatgtggagaccatgtttggcctgtttcaggagctgcttcgaaacactgatttcaccaacgttgagaagcttaagaccatgattgcagcctccaccgctaacctgtccaacgcgttggctcagtctggacactcgttcgccatgcttcgagctgcttccgatatttcccctgtcaagaagattgacgacattctggggggtgtggcccaggtgcgcttcctgtctgagctggctgccaagtccgagcagcagcttgtcgacgaggtcatccccaagctccaggagattgccaagtttgctctgacccgtgagcagcgatttgccgtcacttgtggccaggacatgcagaccaagaacgacgagttggtgcgaaagttcgctgagtccttcgagaccaatgagtcgcccttcaatatctcgtcgttgtctatccccatgaccactcccacaagcaccttgttcaagttaccgttccaggtcaactacgctggtattgccatccccggagtgccctacactcatgctgacggagctcccctgcaggtactcgccaacatgctgacccacaagcatctgcatcgagaaatccgagaaaagggaggcgcttacggtggaggagcctcttataaccccactgacggcttcttctcatattattcataccgagaccccaacttggaacgaaccctgcagacctgccaggaggctggagagtggtctgtcaagaaggactggagctcttccgatctgcaggaggccaagctgtcccttttccagcgaatcgatgcccccatctccgtcaagtcagagggaatggctctctatgccaacggacttacctacgagcagcgagagaagcgacgacggcagctgcttgatgtggctgttgatgacgtcaagcgggttgccaagcagtatctcgtcaacccctccgggtactcagtggccgctctcggccccggatacgaaaccatggacaaaaagaagtggactgtgctggagtag

SEQ ID NO: 4456 - protein, 990 aa, Yarrowia lipolytica CLIB99
MLRLKSLKKPVQAVVRRFATTSAPTLSVGDNIHGFNVLRTKEIPEFDLQATLLEHSTGAQHLHIARDDSNNVFSIGFKTNPPDRTGVPHILEHTTLCGSEKYQVRDPFFKMLNRSLANFMNAMTAQDYTFYPFATTNATDMKNLRDVYLDATLKPLLRELDFSQEGWRLENEDSKDKTSPIILKGVVFNEMKGQMSNAAYAFYIRYLEKIYPSLNNSGGDPLVIPELTYEGLKKFHADHYNPSNAKTFSYGDISVADHLEALNAKFENCEISKTPGNTERLPLEFSSAAENTRIVEEGPIDTLLDTSKQHKMSMSWLMGSPKDIYESFCVKIISSLLIDGHSSPLHQKLIDSGLGSSYSPNTGLDSAPGANIFSVGLQGVTESDLTKVETVILDTIKTTVAEGFDKGRIDGLLHQTELARKDQNAKFGMALMNGVLPGWFNQVDPLEALEWNSVLDRFNKDMEADPEFLQKVMKKYLLDNKYFHFQMNPNPDYEKNVQEKEDEILTDKLAKLTESDKEEIFETGANLEKMQEEPENLDCLPTLHVSDIPRSKPRVALEHTKNPYPIQWRLAPTNGLTYFHSISSLEGLPHEYYPFLPLFTSSLTFLGTKDKTMGQLEDEIKLNTGGLDFSVSCSSSPLSLPSSQLNFAMDGVALDKNVETMFGLFQELLRNTDFTNVEKLKTMIAASTANLSNALAQSGHSFAMLRAASDISPVKKIDDILGGVAQVRFLSELAAKSEQQLVDEVIPKLQEIAKFALTREQRFAVTCGQDMQTKNDELVRKFAESFETNESPFNISSLSIPMTTPTSTLFKLPFQVNYAGIAIPGVPYTHADGAPLQVLANMLTHKHLHREIREKGGAYGGGASYNPTDGFFSYYSYRDPNLERTLQTCQEAGEWSVKKDWSSSDLQEAKLSLFQRIDAPISVKSEGMALYANGLTYEQREKRRRQLLDVAVDDVKRVAKQYLVNPSGYSVAALGPGYETMDKKKWTVLE

SEQ ID NO: 4457 - DNA, 3150 bp, Aspergillus nidulans FGSC A4
  CDS (1)..(3150)
atgctccggtcatacttgcacctaggcaggcatcgaacgccggcttttcgccagccactcggacgattgctaagaccaaccgcgtcgatactgcagtatgctcagtctcggacgctcgcttcagtatctagcttggagagcttgccggaggtgggagaccagctccatgggtttacagttcaggaaaagaaacaagtgccggaattgcaccttacagctatccgtttaaggcatgacaaaacccacgcggattacctgcatatcgcacgagaagacaagaacaatgttttcggcatcggtttcaagacaaaccctccggacgccacaggtgtgccccatattctggagcataccactctctgcggcagcgagaaatatcctatccgcgatccgtttttcaaaatgttaccgcggtccctctcaaatttcatgaacgcttttacttcgtccgaccacactatgtatccgtttgccacaacgaatcaacaagattttcagaacctcttgtcggtctacctagacgccactatgcatcctctgcttaaagaggaagactttaggcaggaaggatggcgtttgggacctgaggatccccgtgcaatccaaactcaggagggaaatctgaagcctgaagacattctgtttaagggtgttgtgtacaacgaaatgaagggtcagatgtcagatgcgaactacttatattggattaggttccaggaaagcatctttccggccatcaataactccggaggagacccccaacatatcacggatctgacgcacaagcaactcgtggagttttccaagaagaactacaatcccagtaatgctaagatcatcacttacggcgacatgcctttggccgatcatctgaagcaggtcggtggcgtcctaaacgacttttcgaaaggggctgtcgacacaacggtgaagttgcccattgagctccgaggccccataaatgtgactgtcccgggaccaatcgacactttcgtaagtgaagacagacaattcaaaacatccacttcttggtacatgggcgatatcacggatactgtcgagaccttttcggccggcatcctctcgtcccttttgttagatggttatgggtctcccatgtacaaagctctgattgaaagtggcttgggctcctcgttcactcctaacacgggactcgacacttctggtaaaatccctattttttcgattggagttacaggtgtgagcgaggagcaagctcctcgggtcaaagaagagattcagcgagtccttcaggaaactcttcagaggggcttcaacgatgaaaaggtccaaggatttctccaccagctggagcttgctctgcgtcataagacagcgaactttggcctcggtgttattcagaaaaccttcacctcttggttcaacggctccgatcctatgaaggagcttgcatggaacgaggttatcaatgccttcaaaagtaggtacgaaaaaggaggctacttagaggcgttgatgcaaaagtacctcatcaacgataactgcctgacttttacgatggttggtaccccttcatttaacaaggaattggatgataaggaaatggcgcggaaggagaaaaagtttgagcaattaactcagcaacatggttctgttgagaaggctgtgactgagcttgctaaagcagagctgcagctgcttgaagttcaggaaaaggcccagcatgctgacctgagctgtttgccgtctttgcgtgtggaggatatttcacggcagaaagagcacaagccagtccgcgaatctaaggtcgaaggcacagatattgtttggcgcgaagctccaaccaatggactgacctattttcaagctgtgaatgccttcgccgatcttcctgatgatctccgcctgctcctgccacttttcaacgatgcaatcatgcggcttggaacaccaactaggaccatggagcagtgggaagacctgataaaactcaaaacgggtggtgtctcgacctcgaatttccatactacatcgccaacagagatgggcaaatacactgagggacttcaattttctggtttcgctctggacaaaaatgtccccgacatgttggaaattctcacagctctcgttactgagacagacttcaccagcccttctgctccggccatgatccaggagcttttgcggctgactaccaacggggcattggatgctgttgcaggaactggtcaccgatacgctctaaacgcagctgctgccggtctttctcgtagcttctgggcacaagagcagacctcaggtctagcacagctgcaagctacggcgaatctcctgcgtgatgccgaaacttctccagaacgcctagccgagctgatcgaaaagcttcgtctcattcaatcattcgctatctcgaagacatctggtcttcgtgttcgcctcgtctgcgaaccggccagctcgacccagaatgaatctgttctgcaaaggtgggttactggactgcctaaggtcccgtcgcccacgtcccaacctcaaaggtttgacttgagcacaccttccaagaaggcgttctatgatctaccttacaaggtttactattctggtctggctttgcctaccgtgccatttacacactcatccagcgcgactctgagcgtcctttctcagcttctgacgcacaattacctccatcctgagatcagagagaaaggtggcgcctatggtgcaggagcaagcaacggtccggtcaagggattattcgcattcaccagctaccgcgaccccaaccctgccaacaccctcaaggtcttcaagaacagtggggtcttcgcgcgtgaccgggcttggtcagaccgtgaaatcaacgaggctaagcttggtatcttccaaggactcgatgcccccgttagcgttgatgaggaaggatctagatacttcctgaatggtatcacgcatgagatggaccagcgctggagagaacaggtcctagacgtcaccgccaaggacgtcaacgaggttgcgcagaccttcctggtagatggcacccggcggtctgtctgtctcctcggtgagaagaaggactgggccgaatctgagggctgggaggtccgcaagctctctatgaatcccaatggttccaacattccctccggtgatgccgcataa

SEQ ID NO: 4458 - protein, 1049 aa, Aspergillus nidulans FGSC A4
MLRSYLHLGRHRTPAFRQPLGRLLRPTASILQYAQSRTLASVSSLESLPEVGDQLHGFTVQEKKQVPELHLTAIRLRHDKTHADYLHIAREDKNNVFGIGFKTNPPDATGVPHILEHTTLCGSEKYPIRDPFFKMLPRSLSNFMNAFTSSDHTMYPFATTNQQDFQNLLSVYLDATMHPLLKEEDFRQEGWRLGPEDPRAIQTQEGNLKPEDILFKGVVYNEMKGQMSDANYLYWIRFQESIFPAINNSGGDPQHITDLTHKQLVEFSKKNYNPSNAKIITYGDMPLADHLKQVGGVLNDFSKGAVDTTVKLPIELRGPINVTVPGPIDTFVSEDRQFKTSTSWYMGDITDTVETFSAGILSSLLLDGYGSPMYKALIESGLGSSFTPNTGLDTSGKIPIFSIGVTGVSEEQAPRVKEEIQRVLQETLQRGFNDEKVQGFLHQLELALRHKTANFGLGVIQKTFTSWFNGSDPMKELAWNEVINAFKSRYEKGGYLEALMQKYLINDNCLTFTMVGTPSFNKELDDKEMARKEKKFEQLTQQHGSVEKAVTELAKAELQLLEVQEKAQHADLSCLPSLRVEDISRQKEHKPVRESKVEGTDIVWREAPTNGLTYFQAVNAFADLPDDLRLLLPLFNDAIMRLGTPTRTMEQWEDLIKLKTGGVSTSNFHTTSPTEMGKYTEGLQFSGFALDKNVPDMLEILTALVTETDFTSPSAPAMIQELLRLTTNGALDAVAGTGHRYALNAAAAGLSRSFWAQEQTSGLAQLQATANLLRDAETSPERLAELIEKLRLIQSFAISKTSGLRVRLVCEPASSTQNESVLQRWVTGLPKVPSPTSQPQRFDLSTPSKKAFYDLPYKVYYSGLALPTVPFTHSSSATLSVLSQLLTHNYLHPEIREKGGAYGAGASNGPVKGLFAFTSYRDPNPANTLKVFKNSGVFARDRAWSDREINEAKLGIFQGLDAPVSVDEEGSRYFLNGITHEMDQRWREQVLDVTAKDVNEVAQTFLVDGTRRSVCLLGEKKDWAESEGWEVRKLSMNPNGSNIPSGDAA

SEQ ID NO: 4459 - DNA, 3105 bp, Candida albicans SC5314
  CDS (1)..(3105): transl_table=12
atgttgaaaactagattaaaacaaagcagggccataagtcgggttgtaagaagatatgcatgctcacaccccatttctcccaatcttgataagtacccagttggtctaaaattgcatggttacgaagttacccaaacatcacctatcccagaattttccctcactgctgtatcattaaaacacacagagagtggtgcaactcacttacatttggattcccctaatgacagtaataatgtatttctgattgccttcaaaacaaatcctccagataatactggggttccccatattttagaacatacaactttgtgtggtagtaaaaagtttccggtccgtgatccattttttaaaatgaccaacaggtcgttgagtaactttatgaatgcaatgacaggccatgattacacattttatccatttgctaccaccaattcaaaggattttgaaaacctaatggatgtgtatttatcgtcagtgtttgaaccgcaattaaaccataccgatttcttgcaagaaggatggagaatagaaaatcaaaatgttcatgacatatcgtccaagcttgaattcaagggagttgtatataatgaaatgaagggccagtattcgaactctgcatactacttttatatcaagttccttgagagtatatatccatccttgaataattcagggggtgatcccaagaaaattgttgatttgctgtacgagggtttactagagtttcacctgaaaaattatcatccatcaaatgcaaaaacatttacttatggaaaattaccattggaagacagtttaagtaaaataagcaaatactatgaatcattcgaaaaaaaggtgtcttcagttgacgtcaaacaacctatattttctacagataaatcagaaatctttgatgtcaccatcccgggtccagttgatacaatgaatggtaaagagacttcagaacagtactgcacatctatcacctggaacttgggtaatccattggatccaaacatgcagtatgatatttttaaatggaaaatattgagctcattattgtttgatggacacaactctcctttctatcaagagttaattgaaagtggatacggtgacgatttttctgcaaatactgggttggactcaaccaccgcgttgctttcgtttactgttggtctcaactacttaaccaagcaaaaagttgataattttaatgaaaaagttatggaaatcattaataataaaatcattcccgaattaagtaacgaagagtcctcttcatatcatggtagaattgatgctatattgcatcaaatagaaataggattcaaaagacacaagcccgattttggatttggattattgagctctattgttccgtcatgggtgaatggagttgatccaattgacaccttgcaagtggaaaagatattgtcgcattttaaagaagattataaacaaaatggtttaaggatctttaaagaattattagaaaagacattgtgtaaccctcattcgcaaaaatttaaattcaccatggagccaagagaagattttaccaaacaattggtaaaagatgagaatttgatgatcgagaaaagagtaagtgaactcacagaagataacaagaaggcaatctatgagcaaaacttggaattagctaaattacaattggaggatcaaaatacagaagttttacccacattgactattgatgacattccaaagagaggtgatttttatgccattgatttgggccaagtaaataagaaagttgtacatgaaagggtagttgataccaatggcttggtttatgccaacgctttaaaagatatttcctatttacccaccaaactttacaagtaccttccattgtttaacaactgtttgacgaaccttgctggaacagaaaacacacccattacggagttggaaactaaaatacaaatgttaactggcgggataacatttagttctaaaatatcgactgacccctataatattgagcaactaaaattacagtatgtgttaagtggaatggctttgaaagaaaagtcatcctcagtttatgatttatggttggagattttaactactaccaaattcgacaccagtgatgaggtattagaaaagttgtcagttttgattaaaaacatgggacaaaaccaaatcaataatattgctgatcgcggtcattcttatgcggctgctgtgagctcactgaaattgacaccgctgaaatacatcagtgacatcgtttcaggtttgagtcaagttcaatttgtaatggagttgaactccaaattagaatcagaagggaaagagtacttggccaaagagattattccgatattgcaagaaatacaaaagtatgtattgcaaggtgaattcaggtatagactagttggaaatcaagagattattgttgaaaacgaaaagcttattgagaaatttgataaggatatttcttcgaacagaccaactttatcgttaacagtaacagatggtttactggcattgttgaactcattcaattacaatcatacaagtgaaaatgtcttagttaacttaccatttcaagtgggatactcttcattaggtaagattggctcttcgtattcatcaaaggatggtgcttctttacaaatattatctcagttatattcctttaaaaatctacattccaaaataagagaaagcaatggtgcatatggaggtggtttgacatatgatgggttgaacgggacattaaacttttattcgtatcgtgatcctaatcctgttaagtcgattcaaacttttagagattccttactgtatggacttgatgctaattggaacgataaggatttacaagaggctaagttgcgggttttccaaagcgtcgatgctccaattaatatctcttctcagggtgctagtgccttctttgaaaatatagatgattacttgagacaggaaagaagagaaaactttttgggtaccactttaaaggatctcagagatgtgactgaaaagtatcttgttgataaccaaaacaaccttgtcactgttattggtgacaatgaaattttaaatgtcgataataaatggcaaattagaaattttcaagtatag

SEQ ID NO: 4460 - protein, 1034 aa, Candida albicans SC5314
MLKTRLKQSRAISRVVRRYACSHPISPNLDKYPVGLKLHGYEVTQTSPIPEFSLTAVSLKHTESGATHLHLDSPNDSNNVFSIAFKTNPPDNTGVPHILEHTTLCGSKKFPVRDPFFKMTNRSLSNFMNAMTGHDYTFYPFATTNSKDFENLMDVYLSSVFEPQLNHTDFLQEGWRIENQNVHDISSKLEFKGVVYNEMKGQYSNSAYYFYIKFLESIYPSLNNSGGDPKKIVDLSYEGLLEFHSKNYHPSNAKTFTYGKLPLEDSLSKISKYYESFEKKVSSVDVKQPIFSTDKSEIFDVTIPGPVDTMNGKETSEQYCTSITWNLGNPLDPNMQYDIFKWKILSSLLFDGHNSPFYQELIESGYGDDFSANTGLDSTTALLSFTVGLNYLTKQKVDNFNEKVMEIINNKIIPELSNEESSSYHGRIDAILHQIEIGFKRHKPDFGFGLLSSIVPSWVNGVDPIDTLQVEKILSHFKEDYKQNGLRIFKELLEKTLCNPHSQKFKFTMEPREDFTKQLVKDENLMIEKRVSELTEDNKKAIYEQNLELAKLQLEDQNTEVLPTLTIDDIPKRGDFYAIDLGQVNKKVVHERVVDTNGLVYANALKDISYLPTKLYKYLPLFNNCLTNLAGTENTPITELETKIQMLTGGITFSSKISTDPYNIEQLKLQYVLSGMALKEKSSSVYDLWLEILTTTKFDTSDEVLEKLSVLIKNMGQNQINNIADRGHSYAAAVSSSKLTPSKYISDIVSGLSQVQFVMELNSKLESEGKEYLAKEIIPILQEIQKYVLQGEFRYRLVGNQEIIVENEKLIEKFDKDISSNRPTLSLTVTDGLSALLNSFNYNHTSENVLVNLPFQVGYSSLGKIGSSYSSKDGASLQILSQLYSFKNLHSKIRESNGAYGGGLTYDGLNGTLNFYSYRDPNPVKSIQTFRDSLSYGLDANWNDKDLQEAKLRVFQSVDAPINISSQGASAFFENIDDYLRQERRENFLGTTLKDLRDVTEKYLVDNQNNLVTVIGDNEILNVDNKWQIRNFQV

SEQ ID NO: 4461 - DNA, 3198 bp, Aspergillus fumigatus Af293
  CDS (1)..(3198)
atgttgcgctctttctcaggggcaggtaaatgcaagtgccgaataccggtctcgaggcagccagtctgtggtcggtcgctgagaatcagcagcacactcactccatggaatcaatctcggagagctgcgtcgaccgtcactagcttggacagttttccgaatgtcggggagaaacttcatgggtttacagtccaggagaagaaacatgtgccagagttgcaccttacagcagtacggttaaagcacgacaagacagacgcagattaccttcatgtcgctagggaggataagaacaatgtctttggtattgggtttaagacgaaccccccagatgcgactggtgtaccacatattttggagcacaccacgttgtgtggaagtgaaaaatacccaattcgcgacccgttcttcaagatgcttccgcggtcattgtcgaattttatgaatgctttcacctccgccgaccacactacgtacccattcgccacaacaaatcggcaggactttcaaaacctactatcagtatatttggacgctaccctacacccattgctgaaagaagaagacttcagacaggagggttggcggctgggaccagaggaccctcgttctattctaacccagggagagcaatccaagggaaacctgcagtcagaagatgtggttttcaaaggtgtcgtctacaacgaaatgaagggacagatatcagatgccaattatctctactacatcaaataccgtgaaagtatctgcccgtcgctgaataactctggcggagaccctcagtacatcaccgatttgacgcaccagcagctggtagacttctccaagcggaattaccatcccagtaacgccaagatcttgacatacggagacatgcctctgagcgtacacttgaaacagatcggtgaggtactggatggttttgaaaagggacaggccgatacagatgtcaagctgcccttggacctgagtcgcgggcccctgaatgtcactgttcccggacccatcgacacattcgccagtgaggacaagcagtacaagacctccacctcttggtacatgggcgacactaccgacgtcgtcgagacgttctcggtcggaattctgtcttccttgctcctcgatggctatggttcgccaatgtatcgtgcgttgatcgagggtgggttagggtcttcttttactcccaacacgggccttgattcctctggtagagtgccaatcttttcagtcggtcttactggcgtgagcgaagcggacgcaccaaaggtcaagtcgactatcaaaagggttttcgaggagtctctttcctccgggttcaatgatgagaaagtccaaggcttccttcatcaacttgaactcgcgttgagacacaagacggctaattttggtattggtgtcatggagaaaaccctttcatcatggttcaatggttcgaaccctatgaaggagttgtcttggaatgaagtcatcgatgagttcaagaaaaaatatgaacaaggaggctaccttgagtcattaatgcaaaaatatcttatgaacgataactgcctgacatttacgatggtgggaactccctcgtataacaaagatctcgatgatcaggaaatggtgcgcaaggaaaagaaactaagtgagctcgttgaacgccatggctcagttgagcaggctgtctctgcgcttgctgaagaagagcttcagttgctcaagattcaagaagaggcgcaaaacgccgatttgagctgcttaccctctctacgcgttgaggatatctccagggagaaggaacgcaaacccgtgcgggagtccaagatggacgatatagacgtcgtctggcgcgaagccccaacaaatgggctcacatatttccaagcattgaattctttcgaggagctcccggatgacctgcgattgctattgccgctgttcaacgattgtatcatgcgactaggcactggagacaaaaccatggaacagtgggaagatctgataaagttgaagaccggcggaatcacaacatccactctccacacatcttctcctacggagttgggtaaattcagggagggcctgcagttctcaggatatgctctggacaacaacattccggatatgctgcagattcttactacactcgtcactgagacagatttcaccagcccgcatgcgcccgccatgatccaggaattactgcgcatgaccaccaacggcgcgttggacgctgttgccgggtcaggccatcgttacgccctgaatgcggcagcggctggtttgtctcggagtttttgggttcaggaacagcagtcaggcctggcgcaattgcaagctacggcgaacctcctccgcgacgcggagagttctccagaacgtcttgctgagctgatcgataagctccggctgatccagtcatttgctatttccaaaggctcaggcctccgtgttcgcatggtttgtgagcccagcagtgcatcgcagaacgagattgtgctccagaaatggctggcaggactacctcgtaataggtctcccacttcgccacttgatcataccagcgtgaattcagtagctaatcgggtgttctatgacctgccttacaaggtttactactctggacttgctatgcagacggtccctttcattgatccctctagtgcacctctcagcgtcctttctcaacttctgacacacaaatacctgcaccctgaaatccgagagaagggaggtgcgtatggcgcgggggccagcaacggccctatcaagggattcttcgcctttaccagctaccgggatcccaatccagtgaacagtctcaaagtcttccagaacagtgggatctttgctcgggatcgtgcctggtcagaccgcgaacttgctgaggccaagctgggcatcttccagggacttgatgctcctatgagtgtcgatgaggagggtgccaggtatttcatgagtggtgttacccatgaaatggaccaacgttggcgagagcaagtgctcgatgtgactgcaaaggatgtcaacgaggtcgctcagaagttcttggttgaaggctctcggcaatccatctgtctgctcggcgagaagaaggattgggctgattccgacgactgggaagttcggaagctctctatgaatgcctcaggcgagccggtaatcgatcccctgagccaagatggcgccgtggcgtcggcttaa

SEQ ID NO: 4462 - protein, 1065 aa, Aspergillus fumigatus Af293
MLRSFSGAGKCKCRIPVSRQPVCGRSLRISSTLTPWNQSRRAASTVTSLDSFPNVGEKLHGFTVQEKKHVPELHLTAVRLKHDKTDADYLHVAREDKNNVFGIGFKTNPPDATGVPHILEHTTLCGSEKYPIRDPFFKMLPRSLSNFMNAFTSADHTTYPFATTNRQDFQNLLSVYLDATLHPLLKEEDFRQEGWRLGPEDPRSILTQGEQSKGNLQSEDVVFKGVVYNEMKGQISDANYLYYIKYRESICPSLNNSGGDPQYITDLTHQQLVDFSKRNYHPSNAKILTYGDMPLSVHLKQIGEVLDGFEKGQADTDVKLPLDLSRGPLNVTVPGPIDTFASEDKQYKTSTSWYMGDTTDVVETFSVGILSSLLLDGYGSPMYRALIEGGLGSSFTPNTGLDSSGRVPIFSVGLTGVSEADAPKVKSTIKRVFEESLSSGFNDEKVQGFLHQLELALRHKTANFGIGVMEKTLSSWFNGSNPMKELSWNEVIDEFKKKYEQGGYLESLMQKYLMNDNCLTFTMVGTPSYNKDLDDQEMVRKEKKLSELVERHGSVEQAVSALAEEELQLLKIQEEAQNADLSCLPSLRVEDISREKERKPVRESKMDDIDVVWREAPTNGLTYFQALNSFEELPDDLRLLLPLFNDCIMRLGTGDKTMEQWEDLIKLKTGGITTSTLHTSSPTELGKFREGLQFSGYALDNNIPDMLQILTTLVTETDFTSPHAPAMIQELLRMTTNGALDAVAGSGHRYALNAAAAGLSRSFWVQEQQSGLAQLQATANLLRDAESSPERLAELIDKLRLIQSFAISKGSGLRVRMVCEPSSASQNEIVLQKWLAGLPRNRSPTSPLDHTSVNSVANRVFYDLPYKVYYSGLAMQTVPFIDPSSAPLSVLSQLLTHKYLHPEIREKGGAYGAGASNGPIKGFFAFTSYRDPNPVNSLKVFQNSGIFARDRAWSDRELAEAKLGIFQGLDAPMSVDEEGARYFMSGVTHEMDQRWREQVLDVTAKDVNEVAQKFLVEGSRQSICLLGEKKDWADSDDWEVRKLSMNASGEPVIDPLSQDGAVASA

SEQ ID NO: 4463 - DNA, 3078 bp, Aspergillus oryzae
  CDS (1)..(3078)
atggctgcagatgacattgtcggctgttaccaagtagataaggcgagacgaagtttaaccaacgttgagagctaccctaaggtgggagaacaacttcacgggttcactgttcaggagaagaaacatgttccagagctacacctcactgcggtccggttaaagcatgacaaaacagatgcggattaccttcacgtggcaagggaagacaagaataatgtgtttggggtgggatttaagaccaatcctcctgatgcgacgggcgttcctcatattttggaacatactacactatgcggtagcgaaaaatatcctgtccgtgatcccttcttcaagatgctcccccggtctctttcgaattttatgaatgctttcacctccgccgaccatactacttacccattcgcgacaacgaatcagcaagatttccaaaaccttctatcagtttatctggatgctacacttcacccactgcttaaggaggaagatttcagacaggaaggatggcgactggggcccgaagacccccgtgctagtgacgcgctggacgggaaaccggaagatgtcttgttcaaaggcgtcgtgtataacgaaatgaagggccagatatcggatgcaaactacctttactatatcaagtatcgggagagcattttcccagcgcttaacaactctggaggagatccccagtatatcactgacttgacacacaagcaactggtcgaattctctaagcgaaactatcatccaagtaacgccaaattcttgacctacggtgatatgcctctcagtactcatttgaagcagattggtgatgtattggacggttttggcaagggagaggccgacacctccgtcaagctccccattgaccttagccgcggaccttcgaacgtaactgttccaggacctattgatacattcgccgacgcagataaacaatataagacttcaacttcctggtatcttggagatacaagcgaggttgttgaaacattctcggccggcatcctgtcctccttgctgctagatggctatggctctccgatgtaccgagcattgatcgagagcggtttgggctcgtcatttacacctaataccggccttgatacctctggaagagtgcctgtattatctgtcggcctcactggtgttagcgaggaggatgctccgaaagtcaaagaagctattcagaaggtctaccaggacagtctttctgctgggttcagtgacgagaaagttcaaggcttcctccaccagttagaactcgcgctgagacacaaaacagcaaacttcggtattggtgtcatggagaagaccatttcctcatggttcaacggtgtagacccaatgaaggagcttgcttggaatgatgtcatcaacgaattcaagaggagatatcagcaaggaggctatcttgagtcattgatgcagaagtacttgatgaacgaccgttgtctgacgtttaccatggttggtacgcctacgtttcaccaagaactagaccagcaggaaatggtccggaaggaaaagaagctcagtcaacttgttgagcaacatggatcaatggagaaggctatctctagtctccgggagcaggaactgcagttgctcaagacacaagaagaggcacaacatgccgaccttgggtgcttaccttccctgcgtgtcgaggacatttcgcgagagaaagagcgcaagccggtacgggagtcaaaggtcgacgacgtcgatgttgtctggcgtgaggccccaaccaatggcctgacgtatttccaagcattgaatgccttcgaagaccttccggacgaccttcgactgctcatgcccttgttcaacgacagcgtcatgcgtttgggcactgcgaataagaccatggaacaatgggaagatctgattaagttgaagaccggtggggtttcatcatccgcattccacacttcgtctccaactgaactaggcaagtttaatgaggggcttcagttctccggtttcgctttggataagaatattcccgacatgttagaaatcttgaccactcttatcacggagacggactttactagtccctatgcgccagctatgatccaggaattactgcgattgactaccaatggcgcgctggatagtgttgccgcatcaggtcatcgttttgcactcaatgctgctgctgcaggtctttctcgcagcttttgggtacaggagcagcagtccggtctggcacagctacaagccactgctaatctcctgcgcgatgctgagacttcacccgaacggctggcagaattgattgaaaaacttcgtttaatccaatctttcgccatttccaaatcatctagtctccgtgttcgcatggtgtgtgaaccgagcagcgcacatcagaacgaagtcgttcttcagaaatggctggctggtttgccacagatccgctcacctacatctgtggatgccaggtcaatgcagcaagtttctagcaaagcattttatgatatgccttacaaggtttattactcggggctggctatgcaaacagtcccgttcgtccacaaatctagcgcaccacttagcgtgctctctcaactccttacacataactatcttcatccagagattcgggagaagggaggtgcgtatggtgcagcagccagcaacggtccagtcaagggtatttttgccttgaccagctaccgggacccgaaccccctcaatactttgaaggtgttccagaacagcggcatcttcgcccgtgaccgttcctggtctgagcgggaattgaatgaggccaaactgggtattttccaaggcctcgacgccccagtgagtgttgatgaggagggatccagatattttatgagtggcgtcacgcatgaaatggatcagcgctggagagagcagctcctcgatgtcactgcgagggatgttaacgaggttgcacagacttttttggtggacggccctcggcaatctgtgtgcttgttgggcgagaagaaggactgggcagaggattgggatgtgcggaagctttccatgaacgctggtgaagctgaagcatatcccgaggacgcctctactaccgcctaa

SEQ ID NO: 4464 - protein, 1025 aa, Aspergillus oryzae
MAADDIVGCYQVDKARRSLTNVESYPKVGEQLHGFTVQEKKHVPELHLTAVRLKHDKTDADYLHVAREDKNNVFGVGFKTNPPDATGVPHILEHTTLCGSEKYPVRDPFFKMLPRSLSNFMNAFTSADHTTYPFATTNQQDFQNLLSVYLDATLHPLLKEEDFRQEGWRLGPEDPRASDALDGKPEDVLFKGVVYNEMKGQISDANYLYYIKYRESIFPALNNSGGDPQYITDLTHKQLVEFSKRNYHPSNAKFLTYGDMPLSTHLKQIGDVLDGFGKGEADTSVKLPIDLSRGPSNVTVPGPIDTFADADKQYKTSTSWYLGDTSEVVETFSAGILSSLLLDGYGSPMYRALIESGLGSSFTPNTGLDTSGRVPVLSVGLTGVSEEDAPKVKEAIQKVYQDSLSAGFSDEKVQGFLHQLELALRHKTANFGIGVMEKTISSWFNGVDPMKELAWNDVINEFKRRYQQGGYLESLMQKYLMNDRCLTFTMVGTPTFHQELDQQEMVRKEKKLSQLVEQHGSMEKAISSLREQELQLLKTQEEAQHADLGCLPSLRVEDISREKERKPVRESKVDDVDVVWREAPTNGLTYFQALNAFEDLPDDLRLLMPLFNDSVMRLGTANKTMEQWEDLIKLKTGGVSSSAFHTSSPTELGKFNEGLQFSGFALDKNIPDMLEILTTLITETDFTSPYAPAMIQELLRLTTNGALDSVAASGHRFALNAAAAGLSRSFWVQEQQSGLAQLQATANLLRDAETSPERLAELIEKLRLIQSFAISKSSSLRVRMVCEPSSAHQNEVVLQKWLAGLPQIRSPTSVDARSMQQVSSKAFYDMPYKVYYSGLAMQTVPFVHKSSAPLSVLSQLLTHNYLHPEIREKGGAYGAAASNGPVKGIFALTSYRDPNPLNTLKVFQNSGIFARDRSWSERELNEAKLGIFQGLDAPVSVDEEGSRYFMSGVTHEMDQRWREQLLDVTARDVNEVAQTFLVDGPRQSVCLLGEKKDWAEDWDVRKLSMNAGEAEAYPEDASTTA

SEQ ID NO: 4465 - DNA, 3243 bp, Arabidopsis thaliana
  CDS (1)..(3243)
atgctccggtcattaacttgttcctcgaccattacttcgacctctctcttcttccgctctttccgccagctccctcgctcttacttgtctccctcatcgtcaacgaccgtcgtcggtgcctccggccgcaacattcgccggctttctactctagaagctgctgggagacggctatttctacgacgaggcttgaaactactctccgccgcgagtcgtggtctcaatggacagttctctcgcttatctattcgcgccgtcgctacacaatccgcaccttcttcttatcccggtcaagatgaggctgagaagcttggatttgagaaagtctctgaagagtttatctcagagtgtaaatctaaggctgttctcttcaaacacaagaaaactggttgcgaggtgatgtctgtttctaacgatgatgagaacaaggtgtttggcattgttttcaggactcctccgaaggattccactggcattcctcacatactggaacatagcgtattatgtgggtcaagaaagtacccgatgaaagaaccatttgtcgaattattaaagggaagtttgcatactttcctaaacgcattcacatatcctgataggacttgttacccagttgcttccacaaataaaaaggatttctacaatcttgtcgatgtatacttggacgctgtattcttccccaagtgtgtggatgatgttcacacttttcagcaggagggttggcattatgagcttaacgatccttcagaggacatatcttacaaaggcgttgtttttaatgagatgaaaggtgtctattcacagcctgataatatactagggcgggttactcaacaggcattatgtccagaaaatacatacggtgttgacagtggaggtgatccaaaagatatccccaagcttacgttcgagaaatttaaggagttccaccgtcagtattatcaccctagcaatgccaggatatggttctatggagatgacgatccagttcaccgccttcgcgtcttgagtgaatacttggacatgtttgatgcaagtccagctcgagatagttcaaaggttgaaccacaaaagcttttctctagacctcgtaggattgttgaaaaataccctgctggtgaagatggtgaccttaagaagaagcatatggtgtgccttaactggcttctctctgacaagccactggacttacaaactcaactcgcacttgggtttttggatcatctaatgcttgggactcctgcctccccattgagaaaaatcttattggaaagcggtttaggagaagctcttgttaatagtgggatggaagatgaacttctccagccccaattcagtataggtttgaaaggtgtttccgatgataatgtccaaaaagttgaagagttggtcatgaatactctgagaaagttggcagatgaggggtttgacactgatgctgttgaagcatccatgaataccattgagttttctctgagagaaaacaatacagggtcgtcccctcgtggtttatcacttatgcttcaatcaattgcgaaatggatatacgacatggatccttttgagccattaaagtatgaggaaccattgaagtccctgaaagctagaatagctgagaaaggatccaagtctgtcttttctccgctgatagaggagtatattttgaacaaccctcattgtgttactatagagatgcagcctgatccagaaaaagcttctctagaggaagcggaggagaaaagtattctagaaaaagttaaagcaagtatgacagaagaggatcttacagaactagcgcgtgccacagaggagttgagattgaagcaagagactcctgaccctcctgacgcactgaaatgcgttccaagtttaaatttgagtgacattccaaaagaacctatatatgttcccactgaggttggagatattaatggcgtgaaggtgttgcggaatgatctctttacaaataatatactctacactgaagtagtctttgatatgggctcagtaaagcatgagcttcttcaactgatacccctcttctgtcaatcattactagagatgggcacgcaagatttgacttttgtacaacttaatcagttaattggaagaaagacaggagggatatcagtttatccccttacatcctctgtgtatggtagggatgatccatgtagcaaaatcattgtgcgtggaaaatccatggttggacgcgctgaagaccttttcaatttgatgaactgtgtgctgcaagaggttcgatttaccgatcaacagcggtttaaacaattcgtttctcagagtagagcacgaatggagaaccgattgaggggaagtggtcaaggaattgctgctgcgaggatggatgcaatgttgaacgttgctggatggatgtctgaacagatgggtggtctcagttaccttgaatttctacacactcttgaacagaaggtggatcaagactgggaaggaatttcatcctcacttgaggaaatcagaagatctttcctttccaggaatggttgcatagttaatatgactgctgatgggaagtccctcacaaacacggaaaaatatgttggaaaatttcttgatttactccctgaaaatccgtctggtgaactcgtcacttgggatgctcgacttcctttgagaaatgaagctatagtaataccaacccaggtgaactatgtgggaaaagcgggaaatatatacagcagtggctacaaacttgatgggagttcatatgttatatcaaagcatattagtaacacatggttatgggatcgtgttcgtgtaagtggtggtgcatatggaggttcctgtgattttgattcacattcgggagtattttcgttcttatcttaccgtgatcccaacctattaaagactctagacatatatgatggaactggggatttcttacgtggcctcgatgtcgatgaagacacccttaccaaagcaattattgggacaattggcgatgtcgattcataccaactccctgatgccaaaggttataccagtttgttgaggcatttacttaatgtaaccgacgaagagaggcaaataaggcgtgaagagatattatctacaagtttgaaggacttcaaggaattcgcagaggcaatagactctgttagtgataaaggcgttgcagtggccgtggcatcacaagaagacattgatgcagcaaacagagaacgctcaaattttttcgaggtgaagaaagcagctctctga

SEQ ID NO: 4466 - protein, 1080 aa, Arabidopsis thaliana [sequence omitted]

SEQ ID NO: 4467 - DNA, 3243 bp, Arabidopsis thaliana
  CDS (1)..(3243)
atgctccgaaccgtctcttgtttagcttcgcgcagctcgtcctctctattctttcgcttctttcgtcagttccctcgctcttacatgtctctcacatcgtcgacggcagctctccgtgtccccagtcgcaatcttcgccgaatttcctctccctcagtcgccggtagacgtcttttgctccgacgaggtttgaggattccctccgccgcagttcgcagtgtcaatgggcagttctctcgcctctctgttcgcgccgtcgccacacaacccgctccactttatcctgatgtaggtcaagatgaggctgagaagcttggatttgaaaaagtgtcggaagaattcatctcagagtgtaaatcaaaggcgatactcttcaaacacaagaaaactggttgcgaggtgatgtctgtgtcaaatgaggatgagaacaaggtcttcggtgttgttttcagaactcctccgaaggattccactggcattccgcacatactggaacatagcgttctatgtgggtcaagaaagtacccggtaaaagagccatttgttgaactactcaagggaagtttgcatacttttctaaatgcattcacatatcctgataggacctgctacccagttgcttccaccaatacaaaggatttttacaatcttgtcgatgtatatttggatgctgtcttcttccccaagtgtgtggatgacgctcacacctttcagcaagagggctggcactatgaacttaatgatccctcggaagacatatcttacaaaggtgttgtttttaatgagatgaaaggggtctattcacagcctgataatattttagggcgaattgctcaacaggccttatccccagaaaatacatatggtgttgacagtggaggtgatccaaaagatattcctaatctgacatttgaggaattcaaggagttccaccgtcaatattatcacccaagcaacgccaggatctggttctatggagatgatgatcccgttcaccgcctccgtgtcttgagtgaatacttggatatgtttgaagcaagtccatctcccaatagttcaaagattaaatttcaaaagctattctctgagcctgtcagactggttgagaaatatcctgctggtcgagatggtgaccttaaaaagaagcatatgttgtgcgttaactggctattgtctgagaagcccttggacttgcaaactcaacttgcacttggcttcttggatcatcttatgctggggactcctgcttcaccactaagaaagatcttattggaaagcggtttaggagaagctcttgtcagtagtgggttgtcagacgaactcttgcagccccagttcggtattggtttgaaaggtgtgtccgaagagaatgttcaaaaggttgaagagttgatcatggatactctgaaaaagttggcagaagaagggtttgacaatgatgctgtggaggcatccatgaatacaattgagttttctttgagggaaaacaacacaggatctttccctcgtggtttatcacttatgctccaatctatttcaaaatggatatacgatatggatccttttgagccattaaagtatacggaaccattgaaggccctgaaaaccagaatagctgaggagggatccaaggctgtcttttccccactgatagagaagcttatcttgaacaactcgcatcgtgttaccatagagatgcagcctgatcctgaaaaagctactcaagaggaagtggaagagaaaaatatcctggaaaaagttaaagcagctatgacagaagaagatcttgcagagctagcacgtgctacagaggagctgaaattgaaacaagaaactcctgaccctcctgaagcattgagatgtgtcccaagtttgaacttgggtgacattccaaaagaacctacttatgttcccaccgaggttggagatattaatggtgtgaaggttttgcggcatgaccttttcaccaatgatattatctatactgaagtagtctttgatattggttcgctgaaacatgagcttcttccactagtaccacttttctgtcaatcattactggagatgggcacaaaagatttgacttttgttcaacttaatcagttgattggaaggaaaacgggagggatatcagtttatccccttacatcatcagtgaggggtaaggatgaaccatgcagcaaaattatcgtacgcggaaaatccatggctgggcgtgctgacgacctttttaacctgatgaactgcttgttgcaagaggttcaatttacagatcagcagaggtttaaacagtttgtctctcaaagcagagcacggatggagaaccgattgaggggaagtggtcatggaattgctgcggcgaggatggatgcaatgttgaacattgctggatggatgtctgaacagatgggtggtctcagctatcttgaatttttacatactcttgaaaagaaagtggatgaagactgggaaggaatttcatcctcgcttgaggagatcagaagatctctccttgctagaaacggttgcatagttaatatgactgctgatgggaagtctctcacaaatgtcgaaaaatctgttgcaaaatttctagatttactccctgagaacccgtctggtgggcttgtcacttgggatggtcgacttcctctgagaaatgaagccattgtaataccaacccaggtaaactatgttggaaaagcgggtaacatatacagcaccgggtatgagcttgatggcagtgcgtatgttatatcaaagcatattagcaatacatggttatgggatcgtgttcgtgtaagtggtggtgcatatggaggtttctgtgatttcgattcgcattcaggagtattttcttacttatcgtaccgggatccaaacttgttgaagacacttgatatatatgatggaactggagatttcttacgtggccttgatgtggatcaagaaacactcactaaagctattattggcaccatcggtgatgttgattcataccaattacctgatgccaaaggttatagcagtttgttgaggcatttactcggagtaactgacgaagaacgacaaagaaagcgtgaagagatactaacaacaagtttgaaggacttcaaggatttcgcacaagcaatagatgtggttagagataaaggtgttgcggtggctgtggcatccgcggaagacattgatgcagcgaacaatgaacgctccaactttttcgaggtgaagaaagctctctaa

SEQ ID NO: 4468 - protein, 1080 aa, Arabidopsis thaliana
MLRTVSCLASRSSSSLFFRFFRQFPRSYMSLTSSTAALRVPSRNLRRISSPSVAGRRLLLRRGLRIPSAAVRSVNGQFSRLSVRAVATQPAPLYPDVGQDEAEKLGFEKVSEEFISECKSKAILFKHKKTGCEVMSVSNEDENKVFGVVFRTPPKDSTGIPHILEHSVLCGSRKYPVKEPFVELLKGSLHTFLNAFTYPDRTCYPVASTNTKDFYNLVDVYLDAVFFPKCVDDAHTFQQEGWHYELNDPSEDISYKGVVFNEMKGVYSQPDNILGRIAQQALSPENTYGVDSGGDPKDIPNLTFEEFKEFHRQYYHPSNARIWFYGDDDPVHRLRVLSEYLDMFEASPSPNSSKIKFQKLFSEPVRLVEKYPAGRDGDLKKKHMLCVNWLLSEKPLDLQTQLALGFLDHLMLGTPASPLRKILLESGLGEALVSSGLSDELLQPQFGIGLKGVSEENVQKVEELIMDTLKKLAEEGFDNDAVEASMNTIEFSLRENNTGSFPRGLSLMLQSISKWIYDMDPFEPLKYTEPLKALKTRIAEEGSKAVFSPLIEKLILNNSHRVTIEMQPDPEKATQEEVEEKNILEKVKAAMTEEDLAELARATEELKLKQETPDPPEALRCVPSLNLGDIPKEPTYVPTEVGDINGVKVLRHDLFTNDIIYTEVVFDIGSLKHELLPLVPLFCQSLLEMGTKDLTFVQLNQLIGRKTGGISVYPLTSSVRGKDEPCSKIIVRGKSMAGRADDLFNLMNCLLQEVQFTDQQRFKQFVSQSRARMENRLRGSGHGIAAARMDAMLNIAGWMSEQMGGLSYLEFLHTLEKKVDEDWEGISSSLEEIRRSLLARNGCIVNMTADGKSLTNVEKSVAKFLDLLPENPSGGLVTWDGRLPLRNEAIVIPTQVNYVGKAGNIYSTGYELDGSAYVISKHISNTWLWDRVRVSGGAYGGFCDFDSHSGVFSYLSYRDPNLLKTLDIYDGTGDFLRGLDVDQETLTKAIIGTIGDVDSYQLPDAKGYSSLLRHLLGVTDEERQRKREEILTTSLKDFKDFAQAIDVVRDKGVAVAVASAEDIDAANNERSNFFEVKKAL

SEQ ID NO: 4469 - DNA, 23 bp, Artificial sequence
  primer
atgttgcggtttcagcgatttgc

SEQ ID NO: 4470 - DNA, 24 bp, Artificial sequence
  primer
ctacagttccttcacctcccaatt

SEQ ID NO: 4471 - protein, 1015 aa, Artificial sequence
  consensus sequence
  Variant (2)..(10): Xaa in position 2 to 10 is any amino acid
  Variant (13)..(16): Xaa in position 13 to 16 is any amino acid
  Variant (18)..(21): Xaa in position 18 to 21 is any amino acid
  Variant (23)..(23): Xaa in position 23 is any amino acid
  Variant (24)..(24): Xaa in position 24 is any or no amino acid
  Variant (27)..(35): Xaa in position 27 to 35 is any amino acid
  Variant (36)..(36): Xaa in position 36 is any or no amino acid
  Variant (38)..(38): Xaa in position 38 is any amino acid
  Variant (40)..(40): Xaa in position 40 is any amino acid
  Variant (43)..(45): Xaa in position 43 to 45 is any amino acid
  Variant (47)..(47): Xaa in position 47 is any amino acid
  Variant (49)..(49): Xaa in position 49 is any amino acid
  Variant (51)..(51): Xaa in position 51 is any amino acid
  Variant (53)..(53): Xaa in position 53 is any amino acid
  Variant (56)..(56): Xaa in position 56 is any amino acid
  Variant (63)..(64): Xaa in position 63 to 64 is any amino acid
  Variant (69)..(69): Xaa in position 69 is any amino acid
  Variant (73)..(75): Xaa in position 73 to 75 is any amino acid
  Variant (78)..(80): Xaa in position 78 to 80 is any amino acid
  Variant (82)..(83): Xaa in position 82 to 83 is any amino acid
  Variant (86)..(87): Xaa in position 86 to 87 is any amino acid
  Variant (89)..(89): Xaa in position 89 is any amino acid
  Variant (92)..(92): Xaa in position 92 is any amino acid
  Variant (94)..(95): Xaa in position 94 to 95 is any amino acid
  Variant (97)..(97): Xaa in position 97 is any amino acid
  Variant (99)..(99): Xaa in position 99 is any amino acid
  Variant (102)..(102): Xaa in position 102 is any amino acid
  Variant (104)..(104): Xaa in position 104 is any amino acid
  Variant (107)..(108): Xaa in position 107 to 108 is any amino acid
  Variant (111)..(111): Xaa in position 111 is any amino acid
  Variant (114)..(115): Xaa in position 114 to 115 is any amino acid
  Variant (120)..(123): Xaa in position 120 to 123 is any amino acid
  Variant (125)..(130): Xaa in position 125 to 130 is any amino acid
  Variant (131)..(132): Xaa in position 131 to 132 is any or no amino acid
  Variant (134)..(134): Xaa in position 134 is any amino acid
  Variant (139)..(151): Xaa in position 139 to 151 is any amino acid
  Variant (152)..(166): Xaa in position 152 to 166 is any or no amino acid
  Variant (171)..(171): Xaa in position 171 is any amino acid
  Variant (177)..(178): Xaa in position 177 to 178 is any amino acid
  Variant (180)..(194): Xaa in position 180 to 194 is any amino acid
  Variant (196)..(199): Xaa in position 196 to 199 is any amino acid
  Variant (200)..(202): Xaa in position 200 to 202 is any or no amino acid
  Variant (208)..(209): Xaa in position 208 to 209 is any amino acid
  Variant (211)..(212): Xaa in position 211 to 212 is any amino acid
  Variant (214)..(220): Xaa in position 214 to 220 is any amino acid
  Variant (223)..(225): Xaa in position 223 to 225 is any amino acid
  Variant (232)..(235): Xaa in position 232 to 235 is any amino acid
  Variant (238)..(244): Xaa in position 238 to 244 is any amino acid
  Variant (246)..(261): Xaa in position 246 to 261 is any amino acid
  Variant (262)..(267): Xaa in position 262 to 267 is any or no amino acid
  Variant (269)..(276): Xaa in position 269 to 276 is any amino acid
  Variant (277)..(303): Xaa in position 277 to 303 is any or no amino acid
  Variant (305)..(320): Xaa in position 305 to 320 is any amino acid
  Variant (321)..(323): Xaa in position 321 to 323 is any or no amino acid
  Variant (325)..(326): Xaa in position 325 to 326 is any amino acid
  Variant (329)..(333): Xaa in position 329 to 333 is any amino acid
  Variant (336)..(339): Xaa in position 336 to 339 is any amino acid
  Variant (341)..(341): Xaa in position 341 is any amino acid
  Variant (343)..(343): Xaa in position 343 is any amino acid
  Variant (344)..(344): Xaa in position 344 is any or no amino acid
  Variant (346)..(346): Xaa in position 346 is any amino acid
  Variant (348)..(353): Xaa in position 348 to 353 is any amino acid
  Variant (354)..(354): Xaa in position 354 is any or no amino acid
  Variant (356)..(367): Xaa in position 356 to 367 is any amino acid
  Variant (369)..(393): Xaa in position 369 to 393 is any amino acid
  Variant (394)..(397): Xaa in position 394 to 397 is any or no amino acid
  Variant (399)..(410): Xaa in position 399 to 410 is any amino acid
  Variant (411)..(415): Xaa in position 411 to 415 is any or no amino acid
  Variant (417)..(426): Xaa in position 417 to 426 is any amino acid
  Variant (427)..(429): Xaa in position 427 to 429 is any or no amino acid
  Variant (431)..(440): Xaa in position 431 to 440 is any amino acid
  Variant (442)..(445): Xaa in position 442 to 445 is any amino acid
  Variant (448)..(450): Xaa in position 448 to 450 is any amino acid
  Variant (452)..(467): Xaa in position 452 to 467 is any amino acid
  Variant (469)..(472): Xaa in position 469 to 472 is any amino acid
  Variant (473)..(475): Xaa in position 473 to 475 is any or no amino acid
  Variant (477)..(490): Xaa in position 477 to 490 is any amino acid
  Variant (491)..(492): Xaa in position 491 to 492 is any or no amino acid
  Variant (494)..(506): Xaa in position 494 to 506 is any amino acid
  Variant (508)..(542): Xaa in position 508 to 542 is any amino acid
  Variant (543)..(550): Xaa in position 543 to 550 is any or no amino acid
  Variant (552)..(554): Xaa in position 552 to 554 is any amino acid
  Variant (556)..(556): Xaa in position 556 is any amino acid
  Variant (558)..(560): Xaa in position 558 to 560 is any amino acid
  Variant (563)..(583): Xaa in position 563 to 583 is any amino acid
  Variant (584)..(587): Xaa in position 584 to 587 is any or no amino acid
  Variant (590)..(592): Xaa in position 590 to 592 is any amino acid
  Variant (594)..(611): Xaa in position 594 to 611 is any amino acid
  Variant (612)..(612): Xaa in position 612 is any or no amino acid
  Variant (616)..(622): Xaa in position 616 to 622 is any amino acid
  Variant (624)..(624): Xaa in position 624 is any amino acid
  Variant (626)..(636): Xaa in position 626 to 636 is any amino acid
  Variant (638)..(640): Xaa in position 638 to 640 is any amino acid
  Variant (644)..(666): Xaa in position 644 to 666 is any amino acid
  Variant (667)..(668): Xaa in position 667 to 668 is any or no amino acid
  Variant (670)..(691): Xaa in position 670 to 691 is any amino acid
  Variant (693)..(716): Xaa in position 693 to 716 is any amino acid
  Variant (717)..(721): Xaa in position 717 to 721 is any or no amino acid
  Variant (724)..(725): Xaa in position 724 to 725 is any amino acid
  Variant (727)..(733): Xaa in position 727 to 733 is any amino acid
  Variant (735)..(745): Xaa in position 735 to 745 is any amino acid
  Variant (747)..(755): Xaa in position 747 to 755 is any amino acid
  Variant (757)..(770): Xaa in position 757 to 770 is any amino acid
  Variant (771)..(775): Xaa in position 771 to 775 is any or no amino acid
  Variant (777)..(838): Xaa in position 777 to 838 is any amino acid
  Variant (839)..(858): Xaa in position 839 to 858 is any or no amino acid
  Variant (860)..(860): Xaa in position 860 is any amino acid
  Variant (863)..(863): Xaa in position 863 is any amino acid
  Variant (865)..(885): Xaa in position 865 to 885 is any amino acid
  Variant (887)..(893): Xaa in position 887 to 893 is any amino acid
  Variant (895)..(898): Xaa in position 895 to 898 is any amino acid
  Variant (900)..(901): Xaa in position 900 to 901 is any amino acid
  Variant (908)..(915): Xaa in position 908 to 915 is any amino acid
  Variant (917)..(917): Xaa in position 917 is any amino acid
  Variant (919)..(921): Xaa in position 919 to 921 is any amino acid
  Variant (928)..(931): Xaa in position 928 to 931 is any amino acid
  Variant (933)..(951): Xaa in position 933 to 951 is any amino acid
  Variant (952)..(958): Xaa in position 952 to 958 is any or no amino acid
  Variant (960)..(961): Xaa in position 960 to 961 is any amino acid
  Variant (963)..(970): Xaa in position 963 to 970 is any amino acid
  Variant (972)..(979): Xaa in position 972 to 979 is any amino acid
  Variant (981)..(988): Xaa in position 981 to 988 is any amino acid
  Variant (989)..(991): Xaa in position 989 to 991 is any or no amino acid
  Variant (993)..(993): Xaa in position 993 is any amino acid
  Variant (995)..(996): Xaa in position 995 to 996 is any amino acid
  Variant (998)..(999): Xaa in position 998 to 999 is any amino acid
  Variant (1002)..(1003): Xaa in position 1002 to 1003 is any amino acid
  Variant (1005)..(1009): Xaa in position 1005 to 1009 is any amino acid
  Variant (1011)..(1014): Xaa in position 1011 to 1014 is any amino acid
GXXXXXXXXXPEXXXXAXXXXHXXTGXXXXXXXXXXDXNXVFXXXFXTXPXDXTGXPHILEHXXLCGSXKYPXXXPFXXXLXXSLXXFXNAXTXXDXTXYPXAXTNXXDFXNLXXVYLDXXXXPXXXXXXXXFXQEGWXXXXXXXXXXXXXXXXXXXXXXXXXXXXKGVVXNEMKGXXSXXXXXXXXXXXXXXXPXXXXXXXSGGDPXXIXXLXXXXXXXFHXXXYHPSNAXXXXYGXXXXXXXLXXXXXXXXXXXXXXXXXXXXXXPXXXXXXXXXXXXXXXXXXXXXXXXXXXXXXXXXXXWXXXXXXXXXXXXXXXXXXXLXXLLXXXXXSPXXXXLXEXXGXGXXXXXXXGXXXXXXXXXXXXGXXXXXXXXXXXXXXXXXXXXXXXXXXXXXFXXXXXXXXXXXXXXXXXEXXXXXXXXXXXXXGXXXXXXXXXXWXXXXDPXXXLXXXXXXXXXXXXXXXXGXXXXXXXLXXXXXXXXXXXXXXXXMXXXXXXXXXXXXXEXXXXXXXXXXXXXXXXXXXXXXXXXXXXXXXXXXXXXXXXXXXLXXXPXLXXXDIXXXXXXXXXXXXXXXXXXXXXXXXXTNXXXYXXXXXXXXXXXXXXXXXXXPLFXXXXXXXGXTXXXXXXXXXXXIXXXTGGXXXXXXXXXXXXXXXXXXXXXXXXXGXXXXXXXXXXXXXXXXXXXXXXFXXXXXXXXXXXXXXXXXXXXXXXXXXXXXGHXXAXXXXXXXLXXXXXXXXXXXGXXXXXXXXXLXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXPXQVXYXXXXXXXXXXXXXXXXXXXXXSXXXXXXXLXXXXRXXGGAYGGXXXXXXXXGXFXXXSYRDPNXXXXLXXXXXXXXXXXXXXXXXXXXXXXXXXLXXAXXXXXXXXDXXXXXXXXGXXXXXXXXXXXTXEXXQXXREXXLXXXXXDXXXXA

SEQ ID NO: 4472 - protein, 61 aa, Artificial sequence
  protein pattern
  Variant (2)..(2): Xaa in position 2 is Lys or Arg
  Variant (4)..(4): Xaa in position 4 is any or no amino acid
  Variant (7)..(7): Xaa in position 7 is any or no amino acid
  Variant (9)..(9): Xaa in position 9 is any amino acid
  Variant (12)..(12): Xaa in position 12 is Ile, Leu or Val
  Variant (19)..(19): Xaa in position 19 is Ser or Thr
  Variant (20)..(20): Xaa in position 20 is Thr or Val
  Variant (25)..(25): Xaa in position 25 is any amino acid
  Variant (28)..(28): Xaa in position 28 is Pro or Gln
  Variant (29)..(29): Xaa in position 29 is Ile, Leu, Met or Val
  Variant (30)..(30): Xaa in position 30 is Lys or Arg
  Variant (31)..(31): Xaa in position 31 is Asp or Glu
  Variant (34)..(34): Xaa in position 34 is Phe or Val
  Variant (35)..(35): Xaa in position 35 is Glu or Lys
  Variant (36)..(36): Xaa in position 36 is Leu or Met
  Variant (38)..(39): Xaa in position 38 to 39 is any amino acid
  Variant (40)..(40): Xaa in position 40 is Ser or Thr
  Variant (42)..(42): Xaa in position 42 is any amino acid
  Variant (43)..(43): Xaa in position 43 is Asn or Thr
  Variant (45)..(45): Xaa in position 45 is Leu or Met
  Variant (48)..(48): Xaa in position 48 is Phe or Met
  Variant (50)..(51): Xaa in position 50 to 51 is any amino acid
  Variant (53)..(53): Xaa in position 53 is any amino acid
  Variant (55)..(55): Xaa in position 55 is any amino acid
  Variant (56)..(56): Xaa in position 56 is Phe or Tyr
  Variant (58)..(59): Xaa in position 58 to 59 is any amino acid
  Variant (60)..(60): Xaa in position 60 is any or no amino acid
FXTXPPXDXTGXPHILEHXXLCGSXKYXXXXPFXXXLXXXLXXFXNAXTXXDXTXXPXXXT

SEQ ID NO: 4473 - protein, 37 aa, Artificial sequence
  protein pattern
  Variant (4)..(4): Xaa in position 4 is Asp or Asn
  Variant (6)..(7): Xaa in position 6 to 7 is any amino acid
  Variant (8)..(8): Xaa in position 8 is Ile or Met
  Variant (9)..(9): Xaa in position 9 is Pro, Thr or Val
  Variant (10)..(10): Xaa in position 10 is any amino acid
  Variant (12)..(12): Xaa in position 12 is any amino acid
  Variant (13)..(13): Xaa in position 13 is Phe or Tyr
  Variant (14)..(14): Xaa in position 14 is Glu, Gly or Gln
  Variant (15)..(15): Xaa in position 15 is any amino acid
  Variant (16)..(16): Xaa in position 16 is Phe or Leu
  Variant (17)..(18): Xaa in position 17 to 18 is any amino acid
  Variant (21)..(22): Xaa in position 21 to 22 is any amino acid
  Variant (23)..(24): Xaa in position 23 to 24 is any or no amino acid
  Variant (26)..(27): Xaa in position 26 to 27 is any or no amino acid
  Variant (31)..(31): Xaa in position 31 is Ala or Ser
  Variant (32)..(32): Xaa in position 32 is Lys or Arg
  Variant (33)..(33): Xaa in position 33 is any amino acid
  Variant (34)..(34): Xaa in position 34 is Phe or Trp
  Variant (35)..(35): Xaa in position 35 is any amino acid
SGGXPXXXXXLXXXXXXXFHXXXXHXXPSNXXXXXYG

SEQ ID NO: 4474 - protein, 41 aa, Artificial sequence
  protein pattern
  Variant (2)..(6): Xaa in position 2 to 6 is any or no amino acid
  Variant (8)..(8): Xaa in position 8 is His or Trp
  Variant (9)..(9): Xaa in position 9 is any amino acid
  Variant (10)..(10): Xaa in position 10 is Glu or Arg
  Variant (11)..(11): Xaa in position 11 is Ile or Val
  Variant (13)..(14): Xaa in position 13 to 14 is any amino acid
  Variant (20)..(20): Xaa in position 20 is Ala or Gly
  Variant (21)..(21): Xaa in position 21 is any amino acid
  Variant (22)..(22): Xaa in position 22 is Ala, Cys or Ser
  Variant (23)..(25): Xaa in position 23 to 25 is any amino acid
  Variant (26)..(26): Xaa in position 26 is Ala, Pro, Ser or Thr
  Variant (27)..(28): Xaa in position 27 to 28 is any amino acid
  Variant (30)..(30): Xaa in position 30 is any amino acid
  Variant (32)..(32): Xaa in position 32 is Ala, Gly, Asn or Ser
  Variant (33)..(34): Xaa in position 33 to 34 is any amino acid
  Variant (40)..(40): Xaa in position 40 is any amino acid
  Variant (41)..(41): Xaa in position 41 is Ala, Leu or Pro
HXXXXXLXXXXRXXGGAYGXXXXXXXXXGXFXXXSYRDPXX

SEQ ID NO: 4475 - protein, 18 aa, Artificial sequence
  protein pattern
  Variant (5)..(5): Xaa in position 5 is Phe or Tyr
  Variant (11)..(13): Xaa in position 11 to 13 is any or no amino acid
  Variant (15)..(15): Xaa in position 15 is any amino acid
  Variant (16)..(16): Xaa in position 16 is Asp or Ser
  Variant (17)..(17): Xaa in position 17 is Asp or Asn
  Variant (18)..(18): Xaa in position 18 is Ala or Ile
KGVVXNEMKGXXXQXXXX

SEQ ID NO: 4476 - protein, 19 aa, Artificial sequence
  protein pattern
  Variant (2)..(3): Xaa in position 2 to 3 is any amino acid
  Variant (6)..(6): Xaa in position 6 is any amino acid
  Variant (9)..(9): Xaa in position 9 is any amino acid
  Variant (10)..(10): Xaa in position 10 is Asp, Gly or Ser
  Variant (14)..(14): Xaa in position 14 is Asp, Asn or Ser
  Variant (15)..(15): Xaa in position 15 is Ala or Ser
  Variant (16)..(16): Xaa in position 16 is Thr or Val
  Variant (17)..(17): Xaa in position 17 is Phe, Leu or Met
  Variant (18)..(18): Xaa in position 18 is any amino acid
NXXDFXNLXXVYLXXXXXP

SEQ ID NO: 4477 - protein, 24 aa, Artificial sequence
  protein pattern
  Variant (2)..(6): Xaa in position 2 to 6 is any amino acid
  Variant (7)..(7): Xaa in position 7 is any or no amino acid
  Variant (9)..(9): Xaa in position 9 is any or no amino acid
  Variant (11)..(11): Xaa in position 11 is any amino acid
  Variant (12)..(12): Xaa in position 12 is Glu, Gln or Arg
  Variant (13)..(13): Xaa in position 13 is Phe, Ile, Leu or Val
  Variant (15)..(15): Xaa in position 15 is Asp, Ser or Thr
  Variant (16)..(16): Xaa in position 16 is Thr or Val
  Variant (17)..(17): Xaa in position 17 is Ala, Asn, Ser or Thr
  Variant (18)..(19): Xaa in position 18 to 19 is any amino acid
  Variant (20)..(20): Xaa in position 20 is Asp or Gln
  Variant (21)..(21): Xaa in position 21 is Phe, Ile, Leu or Val
  Variant (22)..(23): Xaa in position 22 to 23 is any amino acid
  Variant (24)..(24): Xaa in position 24 is Phe or Val
TXXXXXXRXRXXXLXXXXXXXXXX

SEQ ID NO: 4478 - protein, 24 aa, Artificial sequence
  protein pattern
  Variant (2)..(2): Xaa in position 2 is Phe or Tyr
  Variant (3)..(3): Xaa in position 3 is Glu, Asn or Thr
  Variant (4)..(5): Xaa in position 4 to 5 is any amino acid
  Variant (6)..(6): Xaa in position 6 is Glu, Gln, Arg or Ser
  Variant (7)..(9): Xaa in position 7 to 9 is any amino acid
  Variant (10)..(10): Xaa in position 10 is Ile or Val
  Variant (11)..(11): Xaa in position 11 is Asp, Pro or Ser
  Variant (13)..(16): Xaa in position 13 to 16 is any amino acid
  Variant (18)..(19): Xaa in position 18 to 19 is any or no amino acid
  Variant (21)..(21): Xaa in position 21 is any amino acid
  Variant (22)..(23): Xaa in position 22 to 23 is any or no amino acid
GXXXXXXXXXXEXXXXAXXLXXXH

SEQ ID NO: 4479 - protein, 41 aa, Artificial sequence
  protein pattern
  Variant (2)..(2): Xaa in position 2 is Phe, Ile, Leu or Met
  Variant (3)..(3): Xaa in position 3 is Ala, Gly, Gln or Ser
  Variant (4)..(4): Xaa in position 4 is Ile, Leu, Met or Val
  Variant (5)..(5): Xaa in position 5 is Ile, Leu or Met
  Variant (6)..(9): Xaa in position 6 to 9 is any amino acid
  Variant (10)..(10): Xaa in position 10 is Ala, Gly, Pro, Ser or Thr
  Variant (11)..(11): Xaa in position 11 is any amino acid
  Variant (13)..(14): Xaa in position 13 to 14 is any amino acid
  Variant (15)..(16): Xaa in position 15 to 16 is any or no amino acid
  Variant (18)..(19): Xaa in position 18 to 19 is any or no amino acid
  Variant (21)..(21): Xaa in position 21 is Phe, Ile, Leu or Met
  Variant (22)..(22): Xaa in position 22 is Asp, Glu or Lys
  Variant (23)..(23): Xaa in position 23 is any amino acid
  Variant (25)..(26): Xaa in position 25 to 26 is any amino acid
  Variant (27)..(27): Xaa in position 27 is Asp, Glu, Asn or Thr
  Variant (28)..(29): Xaa in position 28 to 29 is any amino acid
  Variant (30)..(30): Xaa in position 30 is Ile or Leu
  Variant (31)..(32): Xaa in position 31 to 32 is any amino acid
  Variant (33)..(33): Xaa in position 33 is Phe or Leu
  Variant (34)..(35): Xaa in position 34 to 35 is any amino acid
  Variant (36)..(36): Xaa in position 36 is Asp, Glu, Lys or Arg
  Variant (37)..(40): Xaa in position 37 to 40 is any amino acid
  Variant (41)..(41): Xaa in position 41 is Gly, Asn or Pro
GXXXXXXXXXXWXXXXDXXPXXXLXXXXXXXXXXXXXXXXX

SEQ ID NO: 4480 - protein, 22 aa, Artificial sequence
  protein pattern
  Variant (3)..(3): Xaa in position 3 is any amino acid
  Variant (4)..(4): Xaa in position 4 is Asp, Asn or Thr
  Variant (5)..(5): Xaa in position 5 is any amino acid
  Variant (6)..(6): Xaa in position 6 is Asp, Glu, Asn, Pro, Ser or Thr
  Variant (7)..(8): Xaa in position 7 to 8 is any amino acid
  Variant (9)..(9): Xaa in position 9 is Ala, Glu, Gln or Thr
  Variant (10)..(10): Xaa in position 10 is any amino acid
  Variant (11)..(11): Xaa in position 11 is Asp, Glu or Asn
  Variant (12)..(12): Xaa in position 12 is Asp, Glu, Asn or Gln
  Variant (13)..(13): Xaa in position 13 is any amino acid
  Variant (15)..(16): Xaa in position 15 to 16 is any or no amino acid
  Variant (18)..(19): Xaa in position 18 to 19 is any or no amino acid
GTXXXXXXXXXXXIXXKXXTGG

SEQ ID NO: 4481 - protein, 45 aa, Artificial sequence
  protein pattern
  Variant (2)..(5): Xaa in position 2 to 5 is any or no amino acid
  Variant (7)..(9): Xaa in position 7 to 9 is any amino acid
  Variant (11)..(14): Xaa in position 11 to 14 is any amino acid
  Variant (15)..(15): Xaa in position 15 is Ala, Asp, Glu, Asn or Ser
  Variant (16)..(16): Xaa in position 16 is Ala, Gly or Ser
  Variant (17)..(25): Xaa in position 17 to 25 is any amino acid
  Variant (26)..(26): Xaa in position 26 is Asp, Glu, Asn or Gln
  Variant (27)..(28): Xaa in position 27 to 28 is any amino acid
  Variant (29)..(29): Xaa in position 29 is Gly, Asn or Ser
  Variant (31)..(31): Xaa in position 31 is Ile, Leu or Val
  Variant (32)..(32): Xaa in position 32 is Ala, Glu, Gly or Ser
  Variant (33)..(39): Xaa in position 33 to 39 is any amino acid
  Variant (41)..(44): Xaa in position 41 to 44 is any amino acid
  Variant (45)..(45): Xaa in position 45 is Asp, Glu or Asn
SXXXXGXXXAXXXXXXXXXXXXXXXXXXXGXXXXXXXXXLXXXXX

SEQ ID NO: 4482 - protein, 28 aa, Artificial sequence
  protein pattern
  Variant (2)..(2): Xaa in position 2 is any amino acid
  Variant (5)..(5): Xaa in position 5 is any amino acid
  Variant (7)..(7): Xaa in position 7 is any amino acid
  Variant (8)..(8): Xaa in position 8 is Ala, Gly or Ser
  Variant (9)..(9): Xaa in position 9 is any amino acid
  Variant (10)..(10): Xaa in position 10 is Ala, Cys, Gly or Ser
  Variant (11)..(16): Xaa in position 11 to 16 is any amino acid
  Variant (17)..(17): Xaa in position 17 is Gly, Ser or Thr
  Variant (18)..(20): Xaa in position 18 to 20 is any amino acid
  Variant (21)..(21): Xaa in position 21 is Asp, Gly, Asn or Ser
  Variant (22)..(22): Xaa in position 22 is Ala, Gly or Ser
  Variant (23)..(25): Xaa in position 23 to 25 is any amino acid
  Variant (26)..(26): Xaa in position 26 is Ile or Val
  Variant (27)..(27): Xaa in position 27 is Ile, Leu or Met
  Variant (28)..(28): Xaa in position 28 is Ala or Ser
PXQVXYXXXXXXXXXXXXXXXXXXXXXX

SEQ ID NO: 4483 - protein, 28 aa, Artificial sequence
  protein pattern
  Variant (2)..(2): Xaa in position 2 is any amino acid
  Variant (3)..(4): Xaa in position 3 to 4 is any or no amino acid
  Variant (6)..(6): Xaa in position 6 is Ala, Ile or Leu
  Variant (7)..(7): Xaa in position 7 is any amino acid
  Variant (8)..(8): Xaa in position 8 is Ile or Val
  Variant (9)..(9): Xaa in position 9 is any amino acid
  Variant (10)..(10): Xaa in position 10 is Gln or Thr
  Variant (11)..(11): Xaa in position 11 is any amino acid
  Variant (12)..(12): Xaa in position 12 is Gly, Leu or Val
  Variant (14)..(21): Xaa in position 14 to 21 is any amino acid
  Variant (22)..(23): Xaa in position 22 to 23 is any or no amino acid
  Variant (25)..(27): Xaa in position 25 to 27 is any amino acid
  Variant (28)..(28): Xaa in position 28 is Phe, Leu or Met
LXXXKXXXXXXXDXXXXXXXXXXGXXXX

SEQ ID NO: 4484 - protein, 10 aa, Artificial sequence
  protein pattern
  Variant (2)..(2): Xaa in position 2 is any amino acid
  Variant (3)..(3): Xaa in position 3 is Glu, Asn or Ser
  Variant (5)..(5): Xaa in position 5 is any or no amino acid
  Variant (8)..(8): Xaa in position 8 is Gly or Ser
  Variant (9)..(9): Xaa in position 9 is Ile or Val
  Variant (10)..(10): Xaa in position 10 is Ala, Gly or Val
DXXNXVFXXX

SEQ ID NO: 4485 - DNA, 852 bp, Saccharomyces cerevisiae
  CDS (1)..(852)
atgtctcaaagaataattcaaccaagcgcatctgaccaacaattcccaggtaaatctgatggatatgaatatactgttgggcctaagcaagcgataacaagcgaagcttcaacaacatacattccctctagaatatactcagagtctctacttttcaaaaggcaagaagcgtctttatcagcaatggctttcttgttccaggaaatgatttcacagttgcatagaacatgtaaaactgcaggcgattttgaaactaaattaagtgactatggccacaatattggaattcgtctattagaactgctgaattttagggcttctgtatctcctagttctcttcccagagcatctgctttcctttcacaaaatgaatcttcttcaaagttatcaaatgcgtcaaattccccgggcatgttggctaactccagcacagcgacttctgcatctgccaatgaacgactccaagaaaagcaaacagaatcattgtctaactacattacaaagatgaggcgccgtgatctgaaaattctcgatatactgcagtttatccacggtaccctatggtcatatctttttaatcacgtaagtgatgatttggttaaatcttcagaacgtgacaatgaatatatgatagtagataacttccccactttaacccaatttatcccaggtgagaacgtttcttgtgagtacttcgtttgcggcattatcaaaggattccttttcaatgctggatttccatgtggcgtgacagcacatcgaatgccccaaggcggacatagtcaacgaaccgtttatttgatccaatttgacaggcaagtgcttgacagggaaggtttgagatttggctga

SEQ ID NO: 4486 - protein, 283 aa, Saccharomyces cerevisiae
MSQRIIQPSASDQQFPGKSDGYEYTVGPKQAITSEASTTYIPSRIYSESLLFKRQEASLSAMAFLFQEMISQLHRTCKTAGDFETKLSDYGHNIGIRLLELLNFRASVSPSSLPRASAFLSQNESSSKLSNASNSPGMLANSSTATSASANERLQEKQTESLSNYITKMRRRDLKILDILQFIHGTLWSYLFNHVSDDLVKSSERDNEYMIVDNFPTLTQFIPGENVSCEYFVCGIIKGFLFNAGFPCGVTAHRMPQGGHSQRTVYLIQFDRQVLDREGLRFG

SEQ ID NO: 4487 - DNA, 501 bp, Oryza sativa
  CDS (1)..(501)
atgatcggcgtcgggaaggcgaagcagtacgccaacgtgctcgacaagcccctcagccgcggcaggcaggaggtcagtttgagtgcatttgcgttcctgttctcagagttggttcaatacaaccagacacaggttgataacattgctgagctggaaagaaggctggaagatgctggttatgctgttggtgcaagagttcttgaactactctgtcacagagagaaggtggctgactcacttgagaaaggaacagaacatgaggatgaatacatgattagtgaaaaggagcttcttgttaaccggttcatttcggtgcccaaggacatgggagcattcaattgtggagcttttgttgcaggaatcggtgtactggaaaatgctggctttcctgcggtagttactgcacactttgtgccaattgagggccaacaaaggccaaggacaacaatcttgataaaatttgctgaagaggttttacagcgagaagctagatttggctaa

SEQ ID NO: 4488 - protein, 166 aa, Oryza sativa
MIGVGKAKQYANVLDKPLSRGRQEVSLSAFAFLFSELVQYNQTQVDNIAELERRLEDAGYAVGARVLELLCHREKVADSLEKGTEHEDEYMISEKELLVNRFISVPKDMGAFNCGAFVAGIGVLENAGFPAVVTAHFVPIEGQQRPRTTILIKFAEEVLQREARFG

SEQ ID NO: 4489 - DNA, 888 bp, Oryza sativa
  CDS (113)..(697)
agagctcgactactccgctccgcccggccacagcccaattcacgccacccgctccgcctctcgccgcctcgaccgcggccggcggccaccgctccggaggagggtgggcaagatgatcggcgtcgggaaggcgaagcagtacgccaacgtgctcgacaagcccctcagccgcggcaggcaggaggtcagtttgagtgcatttgcgttcctgttctcagagttggttcaatacaaccagacacaggttgataacattgctgagctggaaagaaggctggaagatgctggttatgctgttggtgcaagagttcttgaactactctgtcacagagagaaggggaataggcgagagactcgactgctaggtatattatcgttcattcacagcactgtatggaaagttttgtttgggaaggtggctgactcacttgagaaaggaacagaacatgaggatgaatacatgattagtgaaaaggagcttcttgttaaccggttcatttcggtgcccaaggacatgggagcattcaattgtggagcttttgttgcaggaatcgtaaggggtgtactggaaaatgctggctttcctgcggtagttactgcacactttgtgccaattgagggccaacaaaggccaaggacaacaatcttgataaaatttgctgaagaggttttacagcgagaagctagatttggctagattttatcatatgttcacacttctttctgatcaattggtgaagatactgttgaaatgtttttttgtggctgactccacatgatttgtgtaccagtagttgcgaatagaagcgaaggagaaatcgttttgtttggaactgtaaaacatttgcttggatttacctcgtatataatgaatattcaagaattctt

SEQ ID NO: 4490 - protein, 194 aa, Oryza sativa
MIGVGKAKQYANVLDKPLSRGRQEVSLSAFAFLFSELVQYNQTQVDNIAELERRLEDAGYAVGARVLELLCHREKGNRRETRLLGILSFIHSTVWKVLFGKVADSLEKGTEHEDEYMISEKELLVNRFISVPKDMGAFNCGAFVAGIVRGVLENAGFPAVVTAHFVPIEGQQRPRTTILIKFAEEVLQREARFG

SEQ ID NO: 4491 - DNA, 666 bp, Candida glabrata CBS 138
  CDS (1)..(666)
atgaacaccatatacaatgagtctctcatcttcaagaagaaagaagtctcgctgagtgcaatgacgttcctgtaccaggagatgatatcgaatattcacaacgattgtaaggatataaatgagtttgagacaaggctgagtaagatgggctacaacataggcttgagattgatagagctgctgaactttagagcctctgccacttttacttcaaagaacttcttgtcgtcgggatcaaacacaagcaacggtagctcagacgctaccatcacggcctctgaccaagaatcctccctaacaagctttatcaatcgtatgaggaggagagatttgaagatactagatgtattgcaattcatacacgggtccctgtggtcttacctttttggccatgtaagtaacgacttggtcaaatcatcagagcgcgaaaatgaatatatgatcgtggacaacaaacctaaactaacccaattcatatcagggaagaatgtctcttgcgactattttgtttgtggtataatacacggttacttaacatcagcaggtttcccatgcaaagttactccacactcaatgccacaggatggccacgataacagagtagttttcctgatccaattcgataagcaagtgcttgaaagggaaggcctgaggatttctcagtga

SEQ ID NO: 4492 - protein, 221 aa, Candida glabrata CBS 138
MNTIYNESLIFKKKEVSLSAMTFLYQEMISNIHNDCKDINEFETRLSKMGYNIGLRLIELLNFRASATFTSKNFLSSGSNTSNGSSDATITASDQESSLTSFINRMRRRDLKILDVLQFIHGSLWSYLFGHVSNDLVKSSERENEYMIVDNKPKLTQFISGKNVSCDYFVCGIIHGYLTSAGFPCKVTPHSMPQDGHDNRVVFLIQFDKQVLEREGLRISQ

SEQ ID NO: 4493 - DNA, 741 bp, Kluyveromyces lactis NRRL Y-1140
  CDS (1)..(741)
atggcagaacaaataattaaccctagtacaacacactcaactaaagtcgctggccaaggttacgattataccatcggacctacacaaacgcttcccaacacatctacagccactacttcaggcactggatttgtggtaccgaccacaggaatatatggtcaatcgcttatttccaaagagaaacaggtctctctatcagcatatgcattcttatttcaatcaattgtatcctatcatcgtgattcttccaaaaacgtacaggaaatcgaacggaaattaaacagctcaggatataccattggtatgagactcacagaaatacttaatttcagagattcagtaccaaataaaacaggccttacaaacatggacagtgtcgctgggacgataacaaacatgaaacgtcgcaatctaaagattctcgaaactttacagtacatccatttgaccgtttggcaatacctcttctctaggcccagcaatgacttagtaaaatcatcagaacgtgacaatgagtacatgatcattgacaatgagccaacaatttcacagttcattcagcacacttcagttcaatgtgaatccttcacttgtggaatcatcgaaggtttcctagatatggctggattcccatgtcacgtgacatctcatttcgttgaagagacgggcttctcaaatagaacagtttacctgatacaattcgataaggctgtagtggaaagagagaacctcaggcaatga

SEQ ID NO: 4494 - protein, 246 aa, Kluyveromyces lactis NRRL Y-1140
MAEQIINPSTTHSTKVAGQGYDYTIGPTQTLPNTSTATTSGTGFVVPTTGIYGQSLISKEKQVSLSAYAFLFQSIVSYHRDSSKNVQEIERKLNSSGYTIGMRLTEILNFRDSVPNKTGLTNMDSVAGTITNMKRRNLKILETLQYIHLTVWQYLFSRPSNDLVKSSERDNEYMIIDNEPTISQFIQHTSVQCESFTCGIIEGFLDMAGFPCHVTSHFVEETGFSNRTVYLIQFDKAVVERENLRQ

SEQ ID NO: 4495 - DNA, 588 bp, Arabidopsis thaliana
  CDS (1)..(588)
atgatcggagtcgggaaaatgaaacagtactccaacgtccttgacaagcctctcagcaaaggcaagcaagaggtgagcttgaccgcatttgctttcttattctcggagctcgttcagtacaatcaaacccaggttgacaatatagctgaacttgaaagaagactagaggatgctgggtatgcagttggatctcgagttctagagcttctttgcaaccgggaaaagggaaacagaagagagacacggttactgggaattctgtctttcgttcacagtactgtgtggaaagtgttgtttggaaaggttgctgattcacttgaaaaaggaacagaacatgaagatgagtacatgatcagtgaaaaggagcttcttgttaacaggttcatttcgattccaaaagacatgggaacattcaactgcggagcgtttgttgctggcatagtgaagggagttctggataacgcagggtttcctgctgtggtaacggctcattttgtacccattgaaggacaacaacgtcctcgaactactattttgatcaagtttgctgatgaggtgcttaagagagaggcacggctaagccaatga

SEQ ID NO: 4496 - protein, 195 aa, Arabidopsis thaliana
MIGVGKMKQYSNVLDKPLSKGKQEVSLTAFAFLFSELVQYNQTQVDNIAELERRLEDAGYAVGSRVLELLCNREKGNRRETRLLGILSFVHSTVWKVLFGKVADSLEKGTEHEDEYMISEKELLVNRFISIPKDMGTFNCGAFVAGIVKGVLDNAGFPAVVTAHFVPIEGQQRPRTTILIKFADEVLKREARLSQ

SEQ ID NO: 4497 - DNA, 26 bp, Artificial sequence
  primer
atgtctcaaagaataattcaaccaag

SEQ ID NO: 4498 - DNA, 24 bp, Artificial sequence
  primer
tcagccaaatctcaaaccttccct

SEQ ID NO: 4499 - protein, 267 aa, Artificial sequence
  consensus sequence
  Variant (2)..(15): Xaa in position 2 to 15 is any amino acid
  Variant (16)..(30): Xaa in position 16 to 30 is any or no amino acid
  Variant (32)..(36): Xaa in position 32 to 36 is any amino acid
  Variant (43)..(43): Xaa in position 43 is any amino acid
  Variant (48)..(48): Xaa in position 48 is any amino acid
  Variant (50)..(62): Xaa in position 50 to 62 is any amino acid
  Variant (64)..(64): Xaa in position 64 is any amino acid
  Variant (66)..(67): Xaa in position 66 to 67 is any amino acid
  Variant (69)..(71): Xaa in position 69 to 71 is any amino acid
  Variant (74)..(75): Xaa in position 74 to 75 is any amino acid
  Variant (77)..(77): Xaa in position 77 is any amino acid
  Variant (79)..(80): Xaa in position 79 to 80 is any amino acid
  Variant (84)..(85): Xaa in position 84 to 85 is any amino acid
  Variant (87)..(88): Xaa in position 87 to 88 is any amino acid
  Variant (89)..(151): Xaa in position 89 to 151 is any or no amino acid
  Variant (154)..(157): Xaa in position 154 to 157 is any amino acid
  Variant (159)..(160): Xaa in position 159 to 160 is any amino acid
  Variant (162)..(164): Xaa in position 162 to 164 is any amino acid
  Variant (166)..(168): Xaa in position 166 to 168 is any amino acid
  Variant (170)..(171): Xaa in position 170 to 171 is any amino acid
  Variant (174)..(175): Xaa in position 174 to 175 is any amino acid
  Variant (177)..(179): Xaa in position 177 to 179 is any amino acid
  Variant (181)..(181): Xaa in position 181 is any amino acid
  Variant (183)..(184): Xaa in position 183 to 184 is any amino acid
  Variant (186)..(188): Xaa in position 186 to 188 is any amino acid
  Variant (193)..(201): Xaa in position 193 to 201 is any amino acid
  Variant (204)..(209): Xaa in position 204 to 209 is any amino acid
  Variant (210)..(213): Xaa in position 210 to 213 is any or no amino acid
  Variant (215)..(216): Xaa in position 215 to 216 is any amino acid
  Variant (219)..(219): Xaa in position 219 is any amino acid
  Variant (222)..(223): Xaa in position 222 to 223 is any amino acid
  Variant (225)..(225): Xaa in position 225 is any amino acid
  Variant (227)..(228): Xaa in position 227 to 228 is any amino acid
  Variant (233)..(234): Xaa in position 233 to 234 is any amino acid
  Variant (237)..(237): Xaa in position 237 is any amino acid
  Variant (239)..(240): Xaa in position 239 to 240 is any amino acid
  Variant (242)..(243): Xaa in position 242 to 243 is any amino acid
  Variant (245)..(247): Xaa in position 245 to 247 is any amino acid
  Variant (248)..(248): Xaa in position 248 is any or no amino acid
  Variant (251)..(252): Xaa in position 251 to 252 is any amino acid
  Variant (255)..(255): Xaa in position 255 is any amino acid
  Variant (257)..(259): Xaa in position 257 to 259 is any amino acid
  Variant (262)..(262): Xaa in position 262 is any amino acid
  Variant (265)..(265): Xaa in position 265 is any amino acid
  Variant (266)..(266): Xaa in position 266 is any or no amino acid
GXXXXXXXXXXXXXXXXXXXXXXXXXXXXXLXXXXXEVSLSAXAFLFXEXXXXXXXXXXXXXEXEXXLXXXGYXXGXRXXELLXXRXXXXXXXXXXXXXXXXXXXXXXXXXXXXXXXXXXXXXXXXXXXXXXXXXXXXXXXXXXXXXXXXXRRXXXXLXXLXXXHXXXWXXLFXXVXXXLXKXXEXXXEYMIXXXXXXXXXFIXXXXXXXXXXCXXFVXGIXXGXLXXAGFPXXVTXHXXPXXGXXXXRTXXLIXFXXXVLXREXXR

SEQ ID NO: 4500 - protein, 31 aa, Artificial sequence
  protein pattern
  Variant (2)..(2): Xaa in position 2 is Ala or Ser
  Variant (3)..(3): Xaa in position 3 is Asp or Asn
  Variant (4)..(4): Xaa in position 4 is Asp or Ser
  Variant (6)..(6): Xaa in position 6 is any amino acid
  Variant (8)..(8): Xaa in position 8 is Gly or Ser
  Variant (9)..(9): Xaa in position 9 is Ser or Thr
  Variant (11)..(11): Xaa in position 11 is any amino acid
  Variant (12)..(13): Xaa in position 12 to 13 is any or no amino acid
  Variant (15)..(16): Xaa in position 15 to 16 is any or no amino acid
  Variant (20)..(20): Xaa in position 20 is Ser or Val
  Variant (21)..(21): Xaa in position 21 is Asp or Glu
  Variant (22)..(23): Xaa in position 22 to 23 is any amino acid
  Variant (24)..(24): Xaa in position 24 is Leu or Pro
  Variant (25)..(25): Xaa in position 25 is any amino acid
  Variant (26)..(26): Xaa in position 26 is Leu or Val
  Variant (27)..(27): Xaa in position 27 is Asn or Thr
  Variant (28)..(28): Xaa in position 28 is Gln or Arg
  Variant (31)..(31): Xaa in position 31 is Pro or Ser
VXXXLXKXXEXXXEXXYMIXXXXXXXXXFIX

SEQ ID NO: 4501 - protein, 54 aa, Artificial sequence
  protein pattern
  Variant (2)..(6): Xaa in position 2 to 6 is any amino acid
  Variant (8)..(8): Xaa in position 8 is Ala or Val
  Variant (11)..(11): Xaa in position 11 is Ser or Thr
  Variant (13)..(14): Xaa in position 13 to 14 is any or no amino acid
  Variant (17)..(17): Xaa in position 17 is Phe or Tyr
  Variant (18)..(18): Xaa in position 18 is Gln or Ser
  Variant (20)..(20): Xaa in position 20 is Leu or Met
  Variant (21)..(21): Xaa in position 21 is Ile or Val
  Variant (22)..(22): Xaa in position 22 is Gln or Ser
  Variant (23)..(26): Xaa in position 23 to 26 is any amino acid
  Variant (27)..(27): Xaa in position 27 is Asp, Gln or Thr
  Variant (28)..(28): Xaa in position 28 is Cys or Val
  Variant (29)..(29): Xaa in position 29 is Asp or Lys
  Variant (30)..(30): Xaa in position 30 is Asp, Asn or Thr
  Variant (31)..(31): Xaa in position 31 is Ala or Ile
  Variant (32)..(32): Xaa in position 32 is Ala, Gly or Asn
  Variant (33)..(33): Xaa in position 33 is Asp or Glu
  Variant (34)..(34): Xaa in position 34 is Phe or Leu
  Variant (36)..(36): Xaa in position 36 is any amino acid
  Variant (37)..(37): Xaa in position 37 is Lys or Arg
  Variant (39)..(39): Xaa in position 39 is Glu or Ser
  Variant (40)..(40): Xaa in position 40 is Asp or Lys
  Variant (41)..(41): Xaa in position 41 is any amino acid
  Variant (43)..(43): Xaa in position 43 is His or Tyr
  Variant (44)..(44): Xaa in position 44 is Ala or Asn
  Variant (45)..(45): Xaa in position 45 is Ile or Val
  Variant (47)..(47): Xaa in position 47 is any amino acid
  Variant (49)..(49): Xaa in position 49 is Leu or Val
  Variant (50)..(50): Xaa in position 50 is Ile or Leu
  Variant (54)..(54): Xaa in position 54 is Cys or Asn
LXXXXXEXSLXAXXFLXXEXXXXXXXXXXXXXXXEXXLXXXGXXXGXRXXELLX

SEQ ID NO: 4502 - protein, 22 aa, Artificial sequence
  protein pattern
  Variant (2)..(2): Xaa in position 2 is any amino acid
  Variant (4)..(4): Xaa in position 4 is any amino acid
  Variant (5)..(5): Xaa in position 5 is Asn or Ser
  Variant (10)..(10): Xaa in position 10 is any amino acid
  Variant (11)..(11): Xaa in position 11 is any or no amino acid
  Variant (13)..(13): Xaa in position 13 is any or no amino acid
  Variant (15)..(15): Xaa in position 15 is Ala or Pro
  Variant (17)..(17): Xaa in position 17 is any amino acid
  Variant (18)..(18): Xaa in position 18 is Met or Val
  Variant (20)..(20): Xaa in position 20 is any amino acid
  Variant (21)..(21): Xaa in position 21 is Asp, Glu or Gly
GXLXXAGFPXXVXTXHXXPXXG

SEQ ID NO: 4503 - protein, 19 aa, Artificial sequence
  protein pattern
  Variant (2)..(3): Xaa in position 2 to 3 is any or no amino acid
  Variant (5)..(5): Xaa in position 5 is any amino acid
  Variant (6)..(6): Xaa in position 6 is any or no amino acid
  Variant (9)..(9): Xaa in position 9 is any amino acid
  Variant (11)..(11): Xaa in position 11 is Ala or Asp
  Variant (12)..(12): Xaa in position 12 is Asp, Glu, Lys or Arg
  Variant (13)..(13): Xaa in position 13 is Ala, Glu or Gln
  Variant (15)..(15): Xaa in position 15 is Leu or Val
  Variant (16)..(16): Xaa in position 16 is any amino acid
  Variant (19)..(19): Xaa in position 19 is Ala, Gly or Asn
RXXTXXLIXFXXXVXXREX

SEQ ID NO: 4504 - protein, 8 aa, Artificial sequence
  protein pattern
  Variant (2)..(2): Xaa in position 2 is Asp, Glu or Gly
  Variant (3)..(3): Xaa in position 3 is any amino acid
  Variant (6)..(6): Xaa in position 6 is Ala or Cys
CXXFVXGI

SEQ ID NO: 4505 - protein, 15 aa, Artificial sequence
  protein pattern
  Variant (2)..(2): Xaa in position 2 is Asp, Glu or Gly
  Variant (3)..(3): Xaa in position 3 is any amino acid
  Variant (5)..(5): Xaa in position 5 is Gln or Ser
  Variant (6)..(6): Xaa in position 6 is Phe or Tyr
  Variant (7)..(7): Xaa in position 7 is Ile or Val
  Variant (9)..(9): Xaa in position 9 is any amino acid
  Variant (10)..(10): Xaa in position 10 is Ser or Thr
  Variant (11)..(11): Xaa in position 11 is Leu or Val
  Variant (13)..(14): Xaa in position 13 to 14 is any amino acid
LXXLXXXHXXXWXXL

SEQ ID NO: 4506 - DNA, 1755 bp, Saccharomyces cerevisiae
  CDS (1)..(1755)
atgggaatacacataccatatctcacgtcaaagacatcgcaatcaaatgttggtgatgccgttggcaacgctgatagtgtagagttcaacagtgagcatgactcaccttcaaagagaggtaaaattacacttgagtcacatgaaatacagagggctcccgctagcgatgatgaagataggattcaaattaaacccgtgaacgacgaggatgacacgtcggtcatgatcacttttaaccaatctctttcgcccttcatcatcactctgacttttgtcgcatccatatccggtttcatgtttggttacgacactggttatatatccagtgcgctgatctcgatcggcacagatctggaccacaaggtacttacttatggggagaaggaaattgtcactgcggctacctctctgggagctttgattaccagtattttcgccggtactgcagctgacatatttggtaggaaacgttgtttaatgggttcgaatctgatgtttgtcattggcgcaatcttacaggtctccgcacacacattctggcaaatggctgttggtagactgatcatgggtttcggtgtcggtatcggctccttgatcgcgccacttttcatcagtgaaattgctcccaaaatgatcagagggagactaactgtcatcaattccttatggttgactggtggtcaattagtcgcttacggttgcggtgctgggttaaactacgtcaacaatggttggagaattcttgttggattgtcactaattcccactgctgtgcaattcacatgcctgtgctttttacctgacactccaagatactacgttatgaagggcgacttggcaagggctactgaggtgttgaagagaagttacactgacacttcggaggaaatcattgaacgtaaggtggaagaacttgttactttgaatcaatctattcctggtaagaatgtccctgaaaaagtctggaataccatcaaagaattgcacacagtaccatctaatctaagggctttgatcattggttgtggtttacaagcaattcaacagtttaccggttggaattcgttgatgtatttctctggtaccatcttcgaaactgtcggtttcaaaaattcttccgctgtttcaatcatcgtgtccggtaccaattttattttcactttagttgcctttttttccattgacaaaataggccgtagaaccatattattgattggattaccaggcatgaccatggctttagtcgtgtgctctattgctttccattttctaggtattaagtttgatggcgctgtcgctgtggtggtttcctccggtttctcctcttggggtattgtgatcatcgtatttattatcgtatttgctgcgttctacgctcttggtatcggtactgttccatggcaacaatcggaactattcccccaaaacgtgagaggtattgggacttcatatgcaactgctacaaactgggctggttcactggttattgcatccacatttttgaccatgttacagaatatcactcctgcaggtacatttgcctttttcgcgggattgtcgtgcttatcaaccattttctgctacttctgttatccagaattatcgggattggagttagaagaggtacaaactattttgaaggacgggttcaacatcaaagcctcgaaagctttggccaagaagagaaaacagcaagttgccagagttcatgaattgaaatatgaaccaactcaagagattatagaggatatatag

SEQ ID NO: 4507 - protein, 584 aa, Saccharomyces cerevisiae
MGIHIPYLTSKTSQSNVGDAVGNADSVEFNSEHDSPSKRGKITLESHEIQRAPASDDEDRIQIKPVNDEDDTSVMITFNQSLSPFIITLTFVASISGFMFGYDTGYISSALISIGTDLDHKVLTYGEKEIVTAATSLGALITSIFAGTAADIFGRKRCLMGSNLMFVIGAILQVSAHTFWQMAVGRLIMGFGVGIGSLIAPLFISEIAPKMIRGRLTVINSLWLTGGQLVAYGCGAGLNYVNNGWRILVGLSLIPTAVQFTCLCFLPDTPRYYVMKGDLARATEVLKRSYTDTSEEIIERKVEELVTLNQSIPGKNVPEKVWNTIKELHTVPSNLRALIIGCGLQAIQQFTGWNSLMYFSGTIFETVGFKNSSAVSIIVSGTNFIFTLVAFFSIDKIGRRTILLIGLPGMTMALVVCSIAFHFLGIKFDGAVAVVVSSGFSSWGIVIIVFIIVFAAFYALGIGTVPWQQSELFPQNVRGIGTSYATATNWAGSLVIASTFLTMLQNITPAGTFAFFAGLSCLSTIFCYFCYPELSGLELEEVQTILKDGFNIKASKALAKKRKQQVARVHELKYEPTQEIIEDI

SEQ ID NO: 4508 - DNA, 1865 bp, Oryza sativa
  CDS (137)..(1693)
atccctcttctttgtctgatcgatcgattgcttctccctcctctcgctactagactagagagtaggtagagctagctttctagctcgtggatcgttaagtttgtagtcctgcccgggcgccggcggtgaggtcgcgatggccggcggcgcggtggtgagcacgggggcaggcaaggactaccctggcaagctcaccctcttcgtcttcttcacatgcgtcgtcgccgccaccggtggtctcatcttcggatatgacatcggtatatcaggtggtgtgacgtccatggacccgttcctgaggaagttcttcccggaggtgtatcggaagaagcagatggcggacaagaacaaccagcactgcaagtacgacaaccagctgctgcagaccttcacctcgtcgctctacctcgccgccctcgtctcctccttcttcgccgccaccgtcacccgcgtcctcggccgcaagtggtccatgttcgccggcggcctcaccttcctcatcggcgccgccctcaacggcgccgccgagaacgtcgccatgctcatcgtcggtcgtatcctcctcggtgtcggcgtcggcttcgccaatcagtcggtgccggtgtacttgtcggagatggcgccggctcggctgcgggggatgctgaacatcgggttccagctgatgatcaccatcggcatcctggcggcggagctgataaactacgggacggcgaagatcaaggccgggtggggatggcgggtgagcctggcgctggccgccgtccccgccgccatcatcaccctcggctccctcttcctcccggacacccccaactcgctcatcgacaggggccacccggaggcggcggagcgcatgctccggcgcatccgcggctccgacgtggacgtgtcggaggagtacgcggacctggtggcggcgagcgaggagtcgaagctggtgcagcacccgtggcgcaacatcctccgccgcaagtaccgcgcccagctcaccatggccatctgcatccccttcttccagcagctcaccgggatcaacgtcatcatgttctacgcccccgtgctgttcgacaccctgggcttcaagagcgacgcgtcgctcatgtccgccgtcatcacgggcctcgtcaacgtcttcgccacgctggtgtccatcttcaccgtggaccgcctcggccgccgcaagctgttcctgcagggcggggcgcagatggtggtgtgccaggtggtggtggggacgctgatcgccgtcaagttcgggacgagcggcatcggcgacatccccaaggggtacgcggcggtggtggtgctcttcatctgcatgtacgtggcagggttcgcgtggtcgtggggcccactggggtggctcgtccccagcgagatcttcccgctggagatccggccggcggggcagagcatcaacgtgtcggtgaacatgctcttcaccttcgtcatcgcgcaggccttcctcaccatgctctgccacatgaagttcggcctcttctacttcttcgccggatgggtcgtcatcatgaccgtcttcatcgccctcttcctccccgagaccaagaacgtccccatcgaggagatggtgctcgtctggaagtcccactggttctggcgccgattcatcggagaccacgacgtccacgtcggcgccaaccacgtctccaacaataagctccaaccataatccgctcacgaatatcgtcgtccatgtctccgtcacgccctatattcttcttcttgtgttcatccccgtgtacagtagatgccttttattagtttgttttgttttgcctagtcagtcttcaatcttaatgtacgtgtgtttcttgtttggccaaattgatcttaattgctgt

SEQ ID NO: 4509 - protein, 518 aa, Oryza sativa
MAGGAVVSTGAGKDYPGKLTLFVFFTCVVAATGGLIFGYDIGISGGVTSMDPFLRKFFPEVYRKKQMADKNNQHCKYDNQLLQTFTSSLYLAALVSSFFAATVTRVLGRKWSMFAGGLTFLIGAALNGAAENVAMLIVGRILLGVGVGFANQSVPVYLSEMAPARLRGMLNIGFQLMITIGILAAELINYGTAKIKAGWGWRVSLALAAVPAAIITLGSLFLPDTPNSLIDRGHPEAAERMLRRIRGSDVDVSEEYADLVAASEESKLVQHPWRNILRRKYRAQLTMAICIPFFQQLTGINVIMFYAPVLFDTLGFKSDASLMSAVITGLVNVFATLVSIFTVDRLGRRKLFLQGGAQMVVCQVVVGTLIAVKFGTSGIGDIPKGYAAVVVLFICMYVAGFAWSWGPLGWLVPSEIFPLEIRPAGQSINVSVNMLFTFVIAQAFLTMLCHMKFGLFYFFAGWVVIMTVFIALFLPETKNVPIEEMVLVWKSHWFWRRFIGDHDVHVGANHVSNNKLQP

SEQ ID NO: 4510 - DNA, 2157 bp, Oryza sativa
  CDS (216)..(1961)
gcttttgctcgtcgtccgtggtggaggcgcggtggggtggggaaggagtgtgtttcgtgtgctgtgctgggctcgcgcggctctcgtcccgggctcccggcagcctggggtttctctccccgtttctgtttctcggtgaggacaatttatgtttcattcctgcgtgaccaatctaatctgaacctacgttgggtgcgcaaaagcccttgaatgcaatggaagggggtgcaactctagctgataaggctgaatttaaggaatgtctgcggctgacctggagccagccttacattcttcagcttgttttctctgccggcatcggtggtcttcttttcggatatgatacaggtgtcatatctggagcacttctgtatattcgagatgattttactgcggtcgaaaagagcactgtacttagggaaacgatagtgagtatggctgtagctggagccatagttggagcaggatttggtggctggatgaacgacaagtttggaaggaagccttccatcttgatcgccgattccctgttcctcgcaggtgccttgatcatggcccttgccccaacaccgtttgtcatcattattgggaggatctttgttggtcttggggttggaatggcttccatgacagcacctttgtacatttctgaagcctctccagctagaatcagaggtgcacttgtgagcacaaatggacttcttattaccggagggcagttcatggcatacctcattaatctggccttcactaaggtaaagggaacatggaggtggatgcttggcattgcaggtcttcctgcttttattcagttcatattgatgtgtatgctacctgaatcaccaaggtggctatacagacaggataggaaagaggaggctgaagccatattaaggaagatttaccccgcggctgaggttgaagaagagatcgattcgatgcgccgatcaattgaacatgagaaacaactggagggctccatcggcgagcagagtctggttggcaagctgacgaaggcactgagcagcaaggtcgtccgccgtgggctcatggccggcgtcatcgcgcaggtcgcccagcagttcgtcggcatcaacaccgtcatgtactacagcccgacgatcgtccagctggccggcttcgcgtcgaacaacacggccatggcgctgtccctcatcacctcggacctcaacgccatcgggtccatcgtcagcatgttcttcgtggacagggccggccgccgtcgcctgatgatcatcagcctcgtcggcatcgtcctgtggctcgccgtgctcggcggcacgttcctcggcgccgcgcaccacgcgccgccggtcagcgacctggagacgcgggtgttcgccaaccagacgtgcccggagtacagcccgagcgcccgctggaactgcatgaactgcctcaaggcccagtccacctgcggcttctgcgcccacggaggaaacaagctcctccccggcgcgtgcctggcggcgggcgaagcgtcgcggcggacgtgccacgcggggaaccgggagttctacacggaagggtgccccaacaacttcgggtggctggcgctggtggcgctcggcgcgtacatcgtctcctactccccgggcatgggcaccgtgccatggatcgtcaactcggagatctacccgctgcggttcaggggcgtctgcggcggcatcgcggcggtggccaactgggtgtccaacctcatcgtcacgcagacgttcctgagcctcaccaaggcgctgggcacgtcggccaccttcttcctcttctgcgccgtctccttcttcgcgctcgtcgtcgtcttcttcaccgtgccggagaccaagggactgcagttcgaggaggtggagaagatgctcggggagaaggactacaagccgtggaagagataccgtcccgacgtgtcgtccaaagggcgcgacatcggcctctctgttccatgaaaggaagaagaacagtgtttggtttcaagttatttgggttttaactagcaataatctgtactcagtttacatgtagagtggccgttgccaatagaaattaatcagttgtttcattgtgtgacacattttagagccttttcccctgtgcttagaacgtttgatgatttttatataagtaaattgcgtcttggtcacc

SEQ ID NO: 4511 - protein, 581 aa, Oryza sativa
MEGGATLADKAEFKECLRLTWSQPYILQLVFSAGIGGLLFGYDTGVISGALLYIRDDFTAVEKSTVLRETIVSMAVAGAIVGAGFGGWMNDKFGRKPSILIADSLFLAGALIMALAPTPFVIIIGRIFVGLGVGMASMTAPLYISEASPARIRGALVSTNGLLITGGQFMAYLINLAFTKVKGTWRWMLGIAGLPAFIQFILMCMLPESPRWLYRQDRKEEAEAILRKIYPAAEVEEEIDSMRRSIEHEKQLEGSIGEQSLVGKLTKALSSKVVRRGLMAGVIAQVAQQFVGINTVMYYSPTIVQLAGFASNNTAMALSLITSDLNAIGSIVSMFFVDRAGRRRLMIISLVGIVLWLAVLGGTFLGAAHHAPPVSDLETRVFANQTCPEYSPSARWNCMNCLKAQSTCGFCAHGGNKLLPGACLAAGEASRRTCHAGNREFYTEGCPNNFGWLALVALGAYIVSYSPGMGTVPWIVNSEIYPLRFRGVCGGIAAVANWVSNLIVTQTFLSLTKALGTSATFFLFCAVSFFALVVVFFTVPETKGLQFEEVEKMLGEKDYKPWKRYRPDVSSKGRDIGLSVP

SEQ ID NO: 4512 - DNA, 1961 bp, Oryza sativa
  CDS (77)..(1609)
gacagaaggcgagctctcgaccgccactactgtacacggcccagagcgagcctcctcctcctctgcaccaccggagatggcttccgccgcgctgccggaggccgtcgcgccgaagaagaagggcaacgtccggttcgccttcgcctgcgccatcctcgcctccatgacctccatcctcctcggctacgatatcggggtgatgagcggggcgtcgctgtacatcaagaaggacttcaacatcagtgacgggaaggtggaggttctcatgggcatactgaacctctactcgctcatcggctccttcgcggcggggcggacgtcggactggatcggccggcggtacaccatcgtgttcgccgccgtcatattcttcgcgggggcgttcctcatggggttcgccgtcaactacgccatgctcatgttcggccgcttcgtggccggcatcggcgtgggctacgcgctcatgatcgcgccggtgtacaccgccgaggtgtcgccggcgtcggcgcgtggcttcctgacgtcgttcccggaggtgttcatcaacttcggcatcctgctcgggtacgtctcgaactatgctttctcccgcttgccgctgaacctcgggtggcgcatcatgctcggcatcggcgcggcgccgtccgtgctgctcgcgctcatggtgctcggcatgccggagtcgccgcggtggctggtcatgaagggacgcctcgcggacgccaaggtggtgctggagaagacctccgacacggcggaggaggccgcggagcgcctggccgacatcaaggccgccgccggcatccccgaggagctcgacggcgacgtggtgaccgtccccaagagagggagcggaaacgagaagcgggtgtggaaggagctcatcctgtccccgaccccggccatgcggcgcatcctgctgtcgggcatcggcatccacttcttccagcaggcgtcgggcatcgactccgtcgtgctctacagcccgcgcgtgttcaagagcgccggcatcaccgacgacaaacacctcctcggcaccacctgcgccgtcggtgtcaccaagacgctcttcatcctcgtggcgaccttcttcctcgaccgcgtcgggcggcggccgctgctgctgagcagcacgggcgggatgatcctctccctcatcggcctcggcgccgggctcaccgtcgtcggccagcaccccgacgccaagataccttgggccatcggcctaagcatcgcctccaccctcgcctacgtcgccttcttctccatcggccttggccccatcacgtgggtgtacagctcggagatcttcccgctccaggtgcgcgcgctgggctgctcgctcggcgtcgccgccaaccgcgtcaccagcggcgtcatctccatgaccttcctgtcgctgtccagggccatcaccatcggcggcagcttcttcctctactccggcatcgccgcgctcgcctgggtgttcttctacacctacctcccggagacccgcggccggacgctggaggagatgagcaagctgttcggcgacacggccgccgcctcggaatcagacgagccagccaaggagaagaagaaggtggaaatggccgccactaactgatcaaactaaccgcaaaatcaccaaatcctaagggttttcttgcaaaaacgtgtgctgtactggctagctagcaagtagtagcagcaacgtgggaagattcgctgatccggcgttgctggagagcgacggccggcgacgacaaagctgagctccagctcgagacttcttaaaatcatcttcaagtacatggattttattttgctctttgctttgtccgtaaaagttgtactatgcgatgaagaataccagtatgtagcaaggctgaggttgtgtgtagctactagaagtgtcagtcacgttgttcttgtaagaaatgtttaactgttaattaagcagtattgttgcagtaatc

SEQ ID NO: 4513 - protein, 510 aa, Oryza sativa
MASAALPEAVAPKKKGNVRFAFACAILASMTSILLGYDIGVMSGASLYIKKDFNISDGKVEVLMGILNLYSLIGSFAAGRTSDWIGRRYTIVFAAVIFFAGAFLMGFAVNYAMLMFGRFVAGIGVGYALMIAPVYTAEVSPASARGFLTSFPEVFINFGILLGYVSNYAFSRLPLNLGWRIMLGIGAAPSVLLALMVLGMPESPRWLVMKGRLADAKVVLEKTSDTAEEAAERLADIKAAAGIPEELDGDVVTVPKRGSGNEKRVWKELILSPTPAMRRILLSGIGIHFFQQASGIDSVVLYSPRVFKSAGITDDKHLLGTTCAVGVTKTLFILVATFFLDRVGRRPLLLSSTGGMILSLIGLGAGLTVVGQHPDAKIPWAIGLSIASTLAYVAFFSIGLGPITWVYSSEIFPLQVRALGCSLGVAANRVTSGVISMTFLSLSRAITIGGSFFLYSGIAALAWVFFYTYLPETRGRTLEEMSKLFGDTAAASESDEPAKEKKKVEMAATN

SEQ ID NO: 4514 - DNA, 2371 bp, Glycine max
  CDS (187)..(1869)
aagtcgagcttgggtaatctgatcgtccagacttaatatcacatgttaaggggatcattacttttcaacatttacacacagataacaaagctaagatgattccacattcctgattccactcacaattcacagttcatagttcatagtccatattcatacaccgtttctttgttctcgctgcctagcatggcatcaacttctctcttcaacttcagactccctctgttcaacttcaacccactgcaccatcgacggataaagaggccaaaatctctgctctcctctcctcgcaacagtccacgcctcgtttcttccattaacgaccatttggcgctcacacgtgtcacatatccgcttctccaatctcactctgctccgaagcgcagattccacgttggtgtacagaaagagtattctgatggggaaagctctgagtcgattgtttctgacgctacataccaagaggaattttcctggtcttctgtagttcttccgtttctattccccgcattgggtggcttgttatttggttatgatattggtgccacctctggcgctacaatctcactgcagtcacctgagcttagcggtatatcatggttcaatctttctgccattcagcttggactagtggttagtggttccctatacggggctcttcttggctcgcttgttgcatttgcgatagctgatttccttgggaggaagaaacaactcattactgcagcactgttgtatttgtttggtggtgtgattactgcctatgcaccagaacttggtgttctcttaccaggaaggctgatttatggacttggtatgggtttgagcatgcatggggctcctttatatattgcggagacttgcccatcacaaatccgtgggacattagtatcattaaaagaactcttcattgtccttgggattctgcttggttattttgtgggaagctttctgattgagacagttggaggatggcggttcatgtacggatttagtgctccagttgctgtattaatggggcttggaatgtggactctccccaattctccacggtggttgcttctcagagcagtgcaaggaaaaggttcttttcaagatttgaaggaacaggcaattgcttccctgagcaaattaaggggccgaccacctggtgacaaagaatctgagaagcaaatagaagagacccttgtctcattgaaatctgtctatgcagaccaggaatccgaggggaatttcttagaggtgtttcagggtcccaatctgaaagctttcataattggtggggggctagtcctatttcaacagataacaggtcaaccaagtgttctgtattatgcaggcccaattcttcagagtgctggattttctgctgcatctgatgctacaaaagtttcagttgttattggcctattcaagttactaatgacttggattgctgtcctgaaaggggatgatttggggagaagacctctgctgattggaggtgtcagtggcattgccctttctctagttctcctttctgcttattataaatttcttggaggttttccacttgttgctgttggagctttacttctttatgttggttgctaccagatatcatttgggccaataagttggctaatggtatcagaggtcttcccacttcgcactagaggcaaggggattagtctggctgttcttaccaacttcgcttcaaatgctgttgttacctttgcattctccccgctaaaggagtttctaggagctgaaaatctttttctcctttttggggctattgctactctatcacttttgttcattatcttttctgttccagagacaaaaggcatgagtttagaagatatagaatccaaaatcttgaagtgacaacttaatctcgcaccttttgatgtgaatgctgtatattttgtattcatgatgaattgcaacgagggctaccatgctaatggaggacttatagctgggcaccaatcttttgaagacatatattaccagtttaccacagtccacagtgctaatgtgctacatgttagtatggcacccctctttgtgctttgctagcagtatttatcagtggtaaacatgagcagacatttgtgactaattttattctcaagattgaagatagcatagcatggcttttggggagtttatgcattgaccgagaaaattgttcattaattcctaatcttctgatggcgaacttgtatttcctctaatattggaggtcaaatttaaccaattaattggggattatgttgaaaaataagtagtgcttgttcggctttgcttcttagttcttgatttgcttgtgtaatgcagctgctgttttgatgctgacttgctccaacacgaaaactttgtttta

SEQ ID NO: 4515 - protein, 560 aa, Glycine max
MASTSLFNFRLPLFNFNPLHHRRIKRPKSLLSSPRNSPRLVSSINDHLALTRVTYPLLQSHSAPKRRFHVGVQKEYSDGESSESIVSDATYQEEFSWSSVVLPFLFPALGGLLFGYDIGATSGATISLQSPELSGISWFNLSAIQLGLVVSGSLYGALLGSLVAFAIADFLGRKKQLITAALLYLFGGVITAYAPELGVLLPGRLIYGLGMGLSMHGAPLYIAETCPSQIRGTLVSLKELFIVLGILLGYFVGSFLIETVGGWRFMYGFSAPVAVLMGLGMWTLPNSPRWLLLRAVQGKGSFQDLKEQAIASLSKLRGRPPGDKESEKQIEETLVSLKSVYADQESEGNFLEVFQGPNLKAFIIGGGLVLFQQITGQPSVLYYAGPILQSAGFSAASDATKVSVVIGLFKLLMTWIAVLKGDDLGRRPLLIGGVSGIALSLVLLSAYYKFLGGFPLVAVGALLLYVGCYQISFGPISWLMVSEVFPLRTRGKGISLAVLTNFASNAVVTFAFSPLKEFLGAENLFLLFGAIATLSLLFIIFSVPETKGMSLEDIESKILK

SEQ ID NO: 4516 - DNA, 1956 bp, Glycine max
  CDS (98)..(1666)
tggacgcgtgggtcgcccacgcgtccgggccaacattcactccctctctcttgtcttttcctctacgttcctgcattgctcgtctcaaacgctaaccatggccggcggaggtttcaccagcggcggcggcgccggagatttcgaggccaaaatcactcccatcgtcatcatttcatgtatcatggctgccaccggaggtctcatgttcggctacgacgtcggcgtttcaggtggtgtgacgtctatgcccccgttcttgaagaagttttttccgacggtatacagaaagacagtggaagagaaaggactggacagtaattactgcaaatacgacaaccaaggattacagcttttcacgtcgtctctgtatctggctggtttgacttcgacgttctttgcttcatacacgactcgtaggttgggaagaaggctgaccatgttgattgctggggtattcttcatctgtggagttgtccttaatgctgctgctcaagaccttgccatgctcatcgttggcagaatcttacttggctgtggtgttggcttttgctatcaggccgtgccagtgttcctctctgagatagcaccttcaagaatacgagggagcattgatatatttgtccagctcaatgtcacaattggcattctatttgctaaccttgtcaactacggcaccaacaaaatcaaaggtgggtggggttggaggctatctcttgggttggctggtatcccagcagttctgctaactttgggagccttgttcgtggtggacacccccaacagtttgattgaacgtggccgcttggaagaaggaaaaacagtgcttaaaaagattcgtggcactgacaacattgaacttgagttccaggaattgcttgaggccagtcgtgtggctaaagaggtcaagcatccattcaggaatcttctcaagcgcaggaaccgaccccaacttgtcatttccgttgccctacagatattccagcaattcacaggcatcaacgcaatcatgttttatgccccggtgctgttcaacacgttaggattcaagaacgatgcatccctgtattctgctgtgataactggggctgtgaacgtgctctccactgttgtatcgatctactcagtggacaaagtgggacgtcgcattctgttgctggaagctggtgtgcagatgttcttgtctcaagtggtgattgcaatcatactgggaataaaggtgacggaccattctgatgacctttcaaaaggcattgcaattctggtggttgtgatggtctgcactttcgtgtcttcctttgcatggtcttggggtcctcttgggtggcttatccccagtgagactttcccattggagactcgttccgctggtcagagtgtcaccgtttgtgttaacctgctcttcaccttcgtcattgcacaagccttcctctctatgctctgccacttcaagtttggtatcttcttgttcttctctggctgggtcctcgtcatgtctgtcttcgtgcttttcctgttgcccgagactaagaatgtccccatcgaagagatgaccgagagagtgtggaagcagcattggttctggaagaggtttatcgatgatgccgcggatgagaaagtagcccatgtctctaatggtaatggatttgatccaacctccaggttgtaaatcatttgcattgagtattttagactctagagtaagtacagtacatgcttatgtgggttagtaacaaattaagcaagttatttttttatttcccccaccccatccatgttggtggcctaggcctgcaacaacattctaatcagttaatccaacattgattatcctgttttgcaagccatataagatacagttttttccacccacccttttctttttgtaaattgtttctttgaaaggaataatatatattgatttccaatttaaaaaaaaaaaaaaaaaaaaaaaaagaa

SEQ ID NO: 4517 - protein, 522 aa, Glycine max
MAGGGFTSGGGAGDFEAKITPIVIISCIMAATGGLMFGYDVGVSGGVTSMPPFLKKFFPTVYRKTVEEKGLDSNYCKYDNQGLQLFTSSLYLAGLTSTFFASYTTRRLGRRLTMLIAGVFFICGVVLNAAAQDLAMLIVGRILLGCGVGFCYQAVPVFLSEIAPSRIRGSIDIFVQLNVTIGILFANLVNYGTNKIKGGWGWRLSLGLAGIPAVLLTLGALFVVDTPNSLIERGRLEEGKTVLKKIRGTDNIELEFQELLEASRVAKEVKHPFRNLLKRRNRPQLVISVALQIFQQFTGINAIMFYAPVLFNTLGFKNDASLYSAVITGAVNVLSTVVSIYSVDKVGRRILLLEAGVQMFLSQVVIAIILGIKVTDHSDDLSKGIAILVVVMVCTFVSSFAWSWGPLGWLIPSETFPLETRSAGQSVTVCVNLLFTFVIAQAFLSMLCHFKFGIFLFFSGWVLVMSVFVLFLLPETKNVPIEEMTERVWKQHWFWKRFIDDAADEKVAHVSNGNGFDPTSRL

SEQ ID NO: 4518 - DNA, 1898 bp, Glycine max
  CDS (150)..(1655)
gctgcgagaagacgacagaagatggaagaaaaaaggaagggtaagtaaattgggaatggtggtggtagtgccaggtgtctgtctgaggagaaaatagaataaaaagctatgaaattttggcacaaggtctgattgtagaattgaagaagatgactggggggggtatcactatgcaatcgacgccgggaagctcaggatacttggatttgtatccagagcggaagatgtcctttttcaaaaatccttacattctcggactggctgctgtcgccggcatcggtggtctcctcttcggctacgacactggtgtgatatcaggggctcttttatacattaaggatgattttgaggaggttagaaacagcaatcttctccaggaaacaatagtcagcatggctattgccggggcaatcgtgggagcagcattgggtggttggattaatgatgcctatggtcgaaagaaggccaccctctttgccgatgttatctttaccgccggagcaataatcatggcttctgctccagatccttatgttctcattttgggacgccttctggttggtttgggtgtgggcatagcttctgtcactgctcccgtttatattgcagaagcatcaccttccgaaataaggggttcattagtcagcacaaatgtcctcatgataaccggtggacagtttctttcctatcttgttaacctcgcttttactggtgttcctggtacttggcgatggatgcttggtgtttctggtgtgcctgctgttgttcagtttgttctcatgctcttcctccctgaatccccaagatggctttttgtcaagaataggaaaaatgaagccgttgatgtgctttctaagatctttgacgttgctcgcttagaagacgaagtcgatttcctcactgctcaatccgagcaagagcgccaaagaaggtcaaatatcaaattctgggatgtttttagatccaaagaaatcagactggcattcctcgtcggtgccgggcttctggcttttcagcagttcacgggaattaacacagtcatgtactacagcccgacaattgtccaaatggcagggttccatgctaatgaattggctcttcttctatcccttatagttgccggcatgaatgcagccggaacaattcttggcatttaccttatcgaccatgctggacgaaaaaaattagctctttctagtctgggaggagtaattgtatctttggtcatcttggcctttgcattttataagcaatcatccacgtcaaatgagttgtatggatggcttgcagttgtaggcttagccttgtatattggttttttctcgccaggaatggggcctgtgccatggactctgagttcagagatatatccggaagaatatcgaggtatctgtgggggcatgtcagctactgtgtgttgggtctcaaatttgattgtctcagagacctttctttcaattgcggagggtatagggattggttcaacttttctgattattggtgtcatagctgtggttgcatttgtatttgtgcttgtttatgttccagagaccaaaggattgacctttgatgaagtggaagtaatatggagggagagagcttggggcaagaaccccaacacacaaaaccttcttgagcagggaagtagttcctaattaataaagtgtgagcttgttggcctaaatagatgtatcgtgtgggtacatttcacataagcattttattatgactttatatatcatactgtttgatttggttcgcatcaaaaaattgcctcataatataagtgaatggaatgggaatagttgtgtagttccatcgatcggcaccatcattaaaatgctgtagttccatcgtccatggttatttcaactcattttgtggagtttcacttttac

SEQ ID NO: 4519 - protein, 501 aa, Glycine max
MTGGGITMQSTPGSSGYLDLYPERKMSFFKNPYILGLAAVAGIGGLLFGYDTGVISGALLYIKDDFEEVRNSNLLQETIVSMAIAGAIVGAALGGWINDAYGRKKATLFADVIFTAGAIIMASAPDPYVLILGRLLVGLGVGIASVTAPVYIAEASPSEIRGSLVSTNVLMITGGQFLSYLVNLAFTGVPGTWRWMLGVSGVPAVVQFVLMLFLPESPRWLFVKNRKNEAVDVLSKIFDVARLEDEVDFLTAQSEQERQRRSNIKFWDVFRSKEIRLAFLVGAGLLAFQQFTGINTVMYYSPTIVQMAGFHANELALLLSLIVAGMNAAGTILGIYLIDHAGRKKLALSSLGGVIVSLVILAFAFYKQSSTSNELYGWLAVVGLALYIGFFSPGMGPVPWTLSSEIYPEEYRGICGGMSATVCWVSNLIVSETFLSIAEGIGIGSTFLIIGVIAVVAFVFVLVYVPETKGLTFDEVEVIWRERAWGKNPNTQNLLEQGSSS

SEQ ID NO: 4520 - DNA, 2190 bp, Oryza sativa
  CDS (128)..(1918)
gcacgaggcacctctatgcagaattgcagatatacttatactagtcagaggccaacttgtgctgcgtcatttctaagcattgggatgcaaaggataaggggggagagattagattagagagatagccatggagggaggtgttcatgagttcgatggctcaaccttcagagagtgcttctccctctcatggaggaacccttatgtccttaggctcgccttctccgccggcatcggtggcctcctcttcggctacgacaccggtgtgatttcaggagctctgctttacatccgtgacgatttcccttcagttgacaagaacacatggcttcaggagatgatcgtgagcatggcggtggccggcgcgatcatcggggcggcgatcggcgggtgggcgaacgaccggtacggccgccggacgtcgatcctggtggccgacgcgctcttcttcgccggcgcggcggtgatggcgtcggcgacggggccggcgcagctggtggtggggcgggtgttcgtcgggctcggcgtcgggacggcgtccatgacgtcgccgctgtacatctcggaggcgtcgccggcgaggatacgcggcgcgctggtgagcaccaacggcctcctcatcaccggcgggcagttcttgtcgtacctcatcaacctcgccttcaccaaggcccccgggacgtggcggtggatgctcggcgtcgccgccatccccgccgtcgtccagttcttcctcatgctcttcctccccgagtcgccgagatggctctaccgaaaggggagggaggaggaagcagaggcgatcttgaggaagatatactcggcggaggaggtggagagggagaaggaggagttgaaggagtcggtggaggcggaggcgcgggagaggagctcgtcggagaagacgagcctggtggcgctgctgatgacgacggcgacggtgcggcgggggctggtcgccggcgtcgggctgcaggtgttccagcagctggtggggatcaacacggtgatgtactacagccccaccatcgtgcagctcgccgggttcgcctccaaccagacggcgctcgcgctgtccctcgtcaccgccggcctcaacgccgccggctccctcgtcagcatctacttcatcgaccgcaccgggcggcgcaagctgctcgtcatcagcctcgccggcgtcatcctctccctcgccctcctctccgccgtgttccacgaggccacctcccactccccgcccgtcggcgccgccgagaccgcccacttccacggcggcgcgctcacatgcccggactactcctcccgctcgtcgtcgtcgttctgggactgcacgaggtgtctcaaggcagcggcggcgtcggcggggtgtgggttctgcgcggcgggcggcggcgacaagctgcgcgccggggcgtgcctggcggcggcggcggcggcgtcgaacgccacggctcgcgacgcgtgccgcggcgaggggagggagtggtacacgcgggggtgcccgagcaggtacgggtggctggcgatggcggggctggcgctgtacatcgccgccttctcgccggggatggggacggtgccgtggatcgtgaactcggaggtctacccgctgcggcaccgcggcgtgtgcggcggcgcggcggcgacggcgaactgggtgtcgaacctggcggtggcgcagtcgttcctgtcgctgacggacgccatcggggcggcgtggacgttcctcatcttcggcgggctgtccgtggcggcactcgcgttcgtgctcgtctgcgtgccggagaccaagggcctccccatcgaggaggtggagaagatgctcgagggaagggagctccgcctcaggttctgggccaagcgccgccaccaccacggcggcgacggcgacggcggcggagaaaagaccggcggcgtgtgacacgacacgaggcctgtttatttagcgttttgatgactgattcgttgcaaatgaacgaaggagtgtggatttggtccgatcacgcacaaacatgtagtcataaatatttaagtttattaaggtaaaatttagataaacttttgaaactttgatcactgatttcatatcagatcaagtttataaaatcgatggcgtttgcgtttggtgatttgtgaacggagccccattgactggcctaataaatcaaagcaaaagccaacatttaaattttt

SEQ ID NO: 4521 - protein, 596 aa, Oryza sativa
MEGGVHEFDGSTFRECFSLSWRNPYVLRLAFSAGIGGLLFGYDTGVISGALLYIRDDFPSVDKNTWLQEMIVSMAVAGAIIGAAIGGWANDRYGRRTSILVADALFFAGAAVMASATGPAQLVVGRVFVGLGVGTASMTSPLYISEASPARIRGALVSTNGLLITGGQFLSYLINLAFTKAPGTWRWMLGVAAIPAVVQFFLMLFLPESPRWLYRKGREEEAEAILRKIYSAEEVEREKEELKESVEAEARERSSSEKTSLVALLMTTATVRRGLVAGVGLQVFQQLVGINTVMYYSPTIVQLAGFASNQTALALSLVTAGLNAAGSLVSIYFIDRTGRRKLLVISLAGVILSLALLSAVFHEATSHSPPVGAAETAHFHGGALTCPDYSSRSSSSFWDCTRCLKAAAASAGCGFCAAGGGDKLRAGACLAAAAAASNATARDACRGEGREWYTRGCPSRYGWLAMAGLALYIAAFSPGMGTVPWIVNSEVYPLRHRGVCGGAAATANWVSNLAVAQSFLSLTDAIGAAWTFLIFGGLSVAALAFVLVCVPETKGLPIEEVEKMLEGRELRLRFWAKRRHHHGGDGDGGGEKTGGV

SEQ ID NO: 4522 - DNA, 2019 bp, Zea mays
  CDS (185)..(1738)
cctcgaggccggccgggccgggagctacctacctacggacacacgcgattcacgcaagcacacgcagccgctccttccgtcctcaaaccacaggcggaccctgacgagacgtacaagaacctccaccaggccattgagcccttgaccgtgtacgcaaacgaacacgaagcctagctcctccccaatggcctcccatcctcctcctgcggagccgtcttctaagtcaaacaaggggcagagcgagcacgaggagatccacgtctcctcgggcggcgttctggcttacaccgacgacgatgactgcgagagcaggcgccccttgctgctcaggactcccgcctccgccgagtgctactccgtctccgccgccgtcttcccgtttctctttccagctttgggaggccttctgtatggctatgacattggggcaacatccggtgcaaccatatcgctcaagtcgtcgacattcagtggtactacttggtacaatttgtcatctgtgcaaacgggtcttgtggtcagtggctcactgtatggtgctttgatcggctccgtcttggcatatacaattgcagattttttaggacgacgtaaagagcttatccttgcttctatctcatattttattggagcctttctgacagcagtagcacccaatttcgctatcatggtggttggccgctttttatatggcataggaattggattggctatgcatgctgctccaatgtatattgcagagactgcaccgagccagataagaggcatgctcatttctctaaaggagttctttattgttcttgggatgcttcttggttatatagcaggaaatctctatgttgaagtggtttctggttggcgttacatgtatgcctccagtacaccattatgtctcataatgggagttggaatgtgctggttaccctcatcacctaggtggctcctgttatgtgccatacaagggaaggggaatctgccagagacaaaagaaaatgcaacccggtgcttatgtcggttgcggggtcaagcttcacctgatttggtctcagagcagattgacttgattctagaggaactttcatatattgatcaagagaagcaagctagcttcggtgagatctttcaaggaaaatgtcttacagcactgataattggatgtggtttggtgttctttcagcaggtcactggtcaacctagcgttctatactatgctgctacaatttttcagagtgctggattctctggggcatctgatgccactcgtgtgtcaattcttcttggcttactgaagctaatcatgaccggagtagcagtccttgtggtcgacagacttggcaggagaccattgcttattggaggtgtcagtggaattactgttgccttatttttgctgtcctcctactacactttactgaaagatgcctcctatgtggctgtaatagcgcttctactatatgttggttgttatcagctctcatttggtcctattggctggcttatgatctcagaggttttcccgctgaggctgcgagggcgtggactgggcgttgctgttcttgtcaattttgcgtccaacgctctggtcacctttgctttctctccactggaggatttgattggaacgggagcgctcttctctggattcggggtgattgcagtggcatctcttgcattcatattctggatcgtccctgagacaaaaggactcaccctggaagagattgaagcgagtttgtagttgactgatccagacgtcacgttcttccgtcctagtttcactgaactgaagggacttctggtatccttctgtagtttgctgccgtagttagccttctataaacgttctacaagctgttgtagcaataatacttctttccttccgggtataaaccgagatggtcggttgctgcaaagtgtgttctttaccgcagttcatccgattagtcacaattaattttcctgatcgccccctgcacttaactaggcaccatgactcaatcagagcgacgttgattattc

SEQ ID NO: 4523 - protein, 517 aa, Zea mays
MASHPPPAEPSSKSNKGQSEHEEIHVSSGGVLAYTDDDDCESRRPLLLRTPASAECYSVSAAVFPFLFPALGGLLYGYDIGATSGATISLKSSTFSGTTWYNLSSVQTGLVVSGSLYGALIGSVLAYTIADFLGRRKELILASISYFIGAFLTAVAPNFAIMVVGRFLYGIGIGLAMHAAPMYIAETAPSQIRGMLISLKEFFIVLGMLLGYIAGNLYVEVVSGWRYMYASSTPLCLIMGVGMCWLPSSPRWLLLCAIQGKGNLPETKENATRCLCRLRGQASPDLVSEQIDLILEELSYIDQEKQASFGEIFQGKCLTALIIGCGLVFFQQVTGQPSVLYYAATIFQSAGFSGASDATRVSILLGLLKLIMTGVAVLVVDRLGRRPLLIGGVSGITVALFLLSSYYTLLKDASYVAVIALLLYVGCYQLSFGPIGWLMISEVFPLRLRGRGLGVAVLVNFASNALVTFAFSPLEDLIGTGALFSGFGVIAVASLAFIFWIVPETKGLTLEEIEASL

SEQ ID NO: 4524 - DNA, 2143 bp, Zea mays subsp. mays
  CDS (316)..(1845)
acaaattaagacgggcgtcgttggcttcaaatactggtctctcccctgtccaaaagtctctcgaatctccaccctggttccgcaccggttccagaattttctcccatttccagggtctccccgtttctgtccggcggttctgccgttccactgcttttgatttcggagtgtgagcttacatcttgctggacaataaagattggattttaagcgatttggggggtgcttgcctgatctccccctgcgaggtactgccgggggattggatttcggggaagttttggtggtttgatattcggcttggccggagcaggaatgacgatcgacatgtccattcccaggagctccgggctgctgaacgctgcggggaagagggacatgaagttcttcagcaacccctacgtgcttgcgctcacgggcgctgcaggaatcggtggattcctctttggctacgatacaggtgtcatatctggagcccttctgtatatccgcgatgattttccagcggtcaaggacaattacttcttacaggaaacgattgttagcatggccttagtcggagctatgattggagctgctgggggtggttggatcaatgatgcatacggtcgcaagaagtctactcttcttgctgatttgatgtttgctcttggctcacttgtcatgtgtgctgctgctggtccttacattctaattatcggaaggctcctcgttggtttgggtgtgggtgttgcatcagtcacagcaccggtatacattgctgaagctgctccttcagaaatcaggggaggtttggtgtcaactaatgtactcatgattaccggtggccaattcttctcctatcttatcaatcttggctttactgaggtgcctggaacatggcgctggatgcttggtgttgctgctgttcctgccattatacagtttgtgctgatgctattcctgccagaatctccgcgttggctttactggaaggatgagaaggcaaaagctattgccgtccttgagaggatctatgaatcggaccgcttggaggaagaggtagagctgcttgctacatcctccatgcatgaattccagtccaacaataccggaagctatctggatgtcttcaagtcgaaagaattgaggctagctttctttgctggggctggccttcaggccttccagcaatttactgggatcaacaccgtgatgtattacagccccacgatagtccagatggctggtttctcctccaacaggctggccttgctcctctccctgatcgtggcggccatgaacgccgccggaaccatcgtcgggatctacctaatcgaccgttgcggccgccgccgcctggccctcacaagcttggccggggtcgtggtctccctggccatcctcgccacggccttcatactgcagtcatcatccggcctctgcgcgagcgccgccagcggcacgtgccagggcgcgctaggctggttcgcggtggccggcctcgctctgtacatcgccttcttctccccgggcatggggcccgtgccgtgggccgtgaactcggagatctaccccgaggcgtaccgtgggatgtgcggcggcatgtcggccaccgtgaactgggtctctaacctcgtcgtggcacagacgttcctgtcgatcgtggggctggtcgggaccggcccgacgttcctgatcgtcgccgggatcgcggtgctggccttcgtcttcgtggccacgtacgtgccggagacgaagggcctgacttttgagcaggtggagcagatgtggagggagagagcgtgggggaacagcggcggcaactgcgagagccttttggcgggtactgcttctgcgccgtaggctacccgttgtcagcactggtcaagcgcgtcagttttagtatggccgcgctgggcttgatcggctccgtcctggcattagttggaagaaagtaaaaaacaaattggagatgcagatgcaaactgttgtatgtggtggtgctttatattgctatcctgttgcctgattgtacgtgttgtcatcgtggcaaatgtgcagtgggtgtaaaatatgaggtcataccgtaacgtcaaactaaggcaaaagggcagttgtatgacccagatgggtgattataattatttgtacagtttccggc

SEQ ID NO: 4525 - protein, 509 aa, Zea mays subsp. mays
MTIDMSIPRSSGLLNAAGKRDMKFFSNPYVLALTGAAGIGGFLFGYDTGVISGALLYIRDDFPAVKDNYFLQETIVSMALVGAMIGAAGGGWINDAYGRKKSTLLADLMFALGSLVMCAAAGPYILIIGRLLVGLGVGVASVTAPVYIAEAAPSEIRGGLVSTNVLMITGGQFFSYLINLGFTEVPGTWRWMLGVAAVPAIIQFVLMLFLPESPRWLYWKDEKAKAIAVLERIYESDRLEEEVELLATSSMHEFQSNNTGSYLDVFKSKELRLAFFAGAGLQAFQQFTGINTVMYYSPTIVQMAGFSSNRLALLLSLIVAAMNAAGTIVGIYLIDRCGRRRLALTSLAGVVVSLAILATAFILQSSSGLCASAASGTCQGALGWFAVAGLALYIAFFSPGMGPVPWAVNSEIYPEAYRGMCGGMSATVNWVSNLVVAQTFLSIVGLVGTGPTFLIVAGIAVLAFVFVATYVPETKGLTFEQVEQMWRERAWGNSGGNCESLLAGTASAP

SEQ ID NO: 4526 - DNA, 2143 bp, Zea mays subsp. mays; identical to SEQ ID NO: 4524
  CDS (328)..(1845)

SEQ ID NO: 4527 - protein, 505 aa, Zea mays subsp. mays
MSIPRSSGLLNAAGKRDMKFFSNPYVLALTGAAGIGGFLFGYDTGVISGALLYIRDDFPAVKDNYFLQETIVSMALVGAMIGAAGGGWINDAYGRKKSTLLADLMFALGSLVMCAAAGPYILIIGRLLVGLGVGVASVTAPVYIAEAAPSEIRGGLVSTNVLMITGGQFFSYLINLGFTEVPGTWRWMLGVAAVPAIIQFVLMLFLPESPRWLYWKDEKAKAIAVLERIYESDRLEEEVELLATSSMHEFQSNNTGSYLDVFKSKELRLAFFAGAGLQAFQQFTGINTVMYYSPTIVQMAGFSSNRLALLLSLIVAAMNAAGTIVGIYLIDRCGRRRLALTSLAGVVVSLAILATAFILQSSSGLCASAASGTCQGALGWFAVAGLALYIAFFSPGMGPVPWAVNSEIYPEAYRGMCGGMSATVNWVSNLVVAQTFLSIVGLVGTGPTFLIVAGIAVLAFVFVATYVPETKGLTFEQVEQMWRERAWGNSGGNCESLLAGTASAP

SEQ ID NO: 4528 - DNA, 2143 bp, Zea mays subsp. mays; identical to SEQ ID NO: 4524
  CDS (379)..(1845)

SEQ ID NO: 4529 - protein, 488 aa, Zea mays subsp. mays
MKFFSNPYVLALTGAAGIGGFLFGYDTGVISGALLYIRDDFPAVKDNYFLQETIVSMALVGAMIGAAGGGWINDAYGRKKSTLLADLMFALGSLVMCAAAGPYILIIGRLLVGLGVGVASVTAPVYIAEAAPSEIRGGLVSTNVLMITGGQFFSYLINLGFTEVPGTWRWMLGVAAVPAIIQFVLMLFLPESPRWLYWKDEKAKAIAVLERIYESDRLEEEVELLATSSMHEFQSNNTGSYLDVFKSKELRLAFFAGAGLQAFQQFTGINTVMYYSPTIVQMAGFSSNRLALLLSLIVAAMNAAGTIVGIYLIDRCGRRRLALTSLAGVVVSLAILATAFILQSSSGLCASAASGTCQGALGWFAVAGLALYIAFFSPGMGPVPWAVNSEIYPEAYRGMCGGMSATVNWVSNLVVAQTFLSIVGLVGTGPTFLIVAGIAVLAFVFVATYVPETKGLTFEQVEQMWRERAWGNSGGNCESLLAGTASAP

SEQ ID NO: 4530 - DNA, 2127 bp, Glycine max
  CDS (160)..(1902)
attcggctcgagatttcaccaatttctattttcataactttctctgcagtctcttcacctttatgttaatgatattatgtgtttagagagaaagagaacaagcatagttgagcttgattgtgttcttcaacattagaacaagaaaagaaagacaacaacatggaaggaggaggagtagaagttgatgcctctgctttcagagaatgcttgtctctgtcatggaaaaatccttacgttcttcgccttgctttttctgctggaattggtggccttctctttggctatgacactggagtcatatctggggctattttatatatcagagatgatttcaaagcagtggataggaagacttggcttcaggaagccatagtgagtatggctcttgctggagcaatcgtaggagctgcagttggtgggtggattaacgatcgatttggaaggagaaaagctattcttcttgcagacacactcttctttattggctctgctgtcatggctgccgctaccaatccatctattctcattgttggtcgagttttcgttggccttggtgttggaatggcctcaatggcatctcccttatacatctctgaagcttctccaactagagttcgaggtgctttagttagtctcaatggctttctcataactggaggacaattcctctcctacctcatcaacttggccttcacaaaagcaccaggaacatggagatggatgttaggagcagcagtagtaccagccctgatacaaatcgtattaatgatgatgctgccagaatcaccgcgttggctgttccgaaagggaagagaagaagagggtaaagaaattctaaggaagatttatccaccccaggaagttgaagcagaaattaatactttgagggaatcagttgaaatagaaatcaaggaagcagaggccacagataacatcagcatagtcaaaatgctgaaaactaaaactgtgagaagaggtttgtatgcaggaatgggccttcaaattttccaacagtttgtggggatcaacactgtgatgtactacagtcctaccatagttcagttagctggttttgcatccaaccgaacagcacttcttctgtcactagtcacatctggtctcaatgcatttggttctattttgagtatatacttcatagacagaacagggaggaaaaagcttgtgttgttcagtttgtgtggtgttgtgttctcccttgttgttctaaccgttgtgttccatcagagtacaactcactccccaatggttagtgcactcgaaacctctcacttcaataacacttgcccggattaccattcagctgcgaaccctggtggatgggattgcatgaagtgcctgaaggcttctccaaattgtggcttctgtgcttctggagccaataagctcttacctggggcatgtttgatctccaatgacaccacaaaagatcagtgccatgaagaagatagactatggtacaccgtggggtgtcctagtaaatttggatggcttgcaatagtagggcttgcactctacatcatattcttctcacctgggatgggaactgtgccatgggttgtcaactctgagatttatcccctaagatatcgaggaatatgtggaggaatggcatccacatccaattgggtctcaaatcttattgttgctcagtccttcctatcattgacacaagctattgggacctcatggacatttatgatatttatattcatcaccatagctgccattatctttgttattattttcgtgcccgaaaccaaaggacttccaatggaagaagtggagaagatgttggaaggaagagatctcaacttcaagttttggcagagaagttctcactgtggagaagaagtaccaccacaaaagactcaatcaaattaagtctattgtgttgcatcatttgtaatattggagtattaactaaagaagtataggtaataaaatcgtagaatgtagctattagattctaagtatatacaataaaatcgtagaatgtagctattagattctaagtatatacaatatcttgtttgtgtgaatttttttcttatcaacaaatattattttgttaattttgttacaaattaaaaaaaaaaaaaaaaaagg

SEQ ID NO: 4531 - protein, 580 aa, Glycine max
MEGGGVEVDASAFRECLSLSWKNPYVLRLAFSAGIGGLLFGYDTGVISGAILYIRDDFKAVDRKTWLQEAIVSMALAGAIVGAAVGGWINDRFGRRKAILLADTLFFIGSAVMAAATNPSILIVGRVFVGLGVGMASMASPLYISEASPTRVRGALVSLNGFLITGGQFLSYLINLAFTKAPGTWRWMLGAAVVPALIQIVLMMMLPESPRWLFRKGREEEGKEILRKIYPPQEVEAEINTLRESVEIEIKEAEATDNISIVKMLKTKTVRRGLYAGMGLQIFQQFVGINTVMYYSPTIVQLAGFASNRTALLLSLVTSGLNAFGSILSIYFIDRTGRKKLVLFSLCGVVFSLVVLTVVFHQSTTHSPMVSALETSHFNNTCPDYHSAANPGGWDCMKCLKASPNCGFCASGANKLLPGACLISNDTTKDQCHEEDRLWYTVGCPSKFGWLAIVGLALYIIFFSPGMGTVPWVVNSEIYPLRYRGICGGMASTSNWVSNLIVAQSFLSLTQAIGTSWTFMIFIFITIAAIIFVIIFVPETKGLPMEEVEKMLEGRDLNFKFWQRSSHCGEEVPPQKTQSN

SEQ ID NO: 4532 - DNA, 2051 bp, Zea mays
  CDS (146)..(1747)
catcgacatcctctcacctccctcgcactccattggatttgggggagctcggggggcgcgggccactgatgatccccggaacgagcaccgatccgtggcgaggaaactccaccgggtagccggcccgggagcgcggggcacggcgatggcgggcgccggggcagcggccaatggcggcaggaacaagtacgcggttctcgatcggagcgaggagcgacagacggacgctaggacggagcggcggaggaggccgttggcgcccgagagcgagagggggagaagggagcggttcgtgtacgcctgcgcggtcttcgcctccctcaacgccgtcctgctcggctacgatgttggcgtaatgagtggcgcgatcatctacatgcagaaagacctccacataaccgagtttcagcaagaaatcctagtaggctgtctgagcgtggtctcactcttgggaagcctatcaggggggcgaacatctgacgcaattggcagaaaatggacaatgggcctcggtgcaattgtgttccagataggcgcgaccatcatgacgtttgctccatcattcactgtgcttatgatagggaggctccttgctggggttggcattggctttggtgccatggtatctggagtgtacattgctgagatctcccccgcaggtgcccgagggacgctcacatcccttcctgagatctgcatcaattttgggatccttcttggctacgtttccaattatgccttctcaggcctttctgagcacatcaattggaggattatgcttggtgtcggtatcctcccatcagtcttcattggctttgcgcttttcgtgatcccggagtcccctaggtggttgatgatggagaagagagtttcagaagcaagggcagtgctgctgcagattagcgagtctgaagctgaagctgaagaacggctggctgagatcgaggaagccgcaggtctgatgaaatcaatgaaatctgaggacaaagaagtgtggagggaacttttgaacccgtctcccgccgtccgtcggatgctgtacgctggttgcggtattcagttgttccaacagatcacaggaattgatgctactgtctattacagcccaacaattttcaaagatgctggcatcaagtctgatcaggagcttctcgctgcaactgttgctgtgggtttcactaagacagtgttcatcttggttgcaattttcctaattgatagagttggacggaagccacttctttatgtgagcaccattggcatgaccatctgcttatttctcttgggggttgcacttacactgcaaaaccatgcggtggggcttatgtctccacgtgttggtatcgacctagcaattttcgcagtttgtggcaacgtggcattcttttcaattggcatgggaccaatatgttgggtcttgtcctcagaggtatttcctttaagattacgagctcaagggtcagcgcttggtcaagtaggtggtagagtgagcagtggtttggtttccatgtcattcctttctatggcccgtgctatatcagtggcaggaatgttcttcgtctttgctgcaatatccactatctctgtactgtttgtgtacttttgtgtgccagaaacaaaagggaaaacactggagcagatcgaaatgatgtttgaaagtggggacgaatggggaggaggtgaaattgagcttgaggatacacagcatttaataccgagtatcaagaagtctgtgcctcttggttgatatttgtagcatcaataaaattcttattagctccatgtttcaatgacgagccaaccaaaccagctggattctgaactttggtttcgagtgatctggccacactgagccacgaccgatctgataaaagataagcttgatagacataggtgcaacgtagaagattaattgtgatgttagttcaaaatgtcaatgattttactgggaggcggtctgtaatgtatgatcttacatctcttgtaccttcttacatctctcgtacctcccagcggaagaatatactcgcagaaaagttttctaaaaaaaa

SEQ ID NO: 4533 - protein, 533 aa, Zea mays
MAGAGAAANGGRNKYAVLDRSEERQTDARTERRRRPLAPESERGRRERFVYACAVFASLNAVLLGYDVGVMSGAIIYMQKDLHITEFQQEILVGCLSVVSLLGSLSGGRTSDAIGRKWTMGLGAIVFQIGATIMTFAPSFTVLMIGRLLAGVGIGFGAMVSGVYIAEISPAGARGTLTSLPEICINFGILLGYVSNYAFSGLSEHINWRIMLGVGILPSVFIGFALFVIPESPRWLMMEKRVSEARAVLLQISESEAEAEERLAEIEEAAGLMKSMKSEDKEVWRELLNPSPAVRRMLYAGCGIQLFQQITGIDATVYYSPTIFKDAGIKSDQELLAATVAVGFTKTVFILVAIFLIDRVGRKPLLYVSTIGMTICLFLLGVALTLQNHAVGLMSPRVGIDLAIFAVCGNVAFFSIGMGPICWVLSSEVFPLRLRAQGSALGQVGGRVSSGLVSMSFLSMARAISVAGMFFVFAAISTISVLFVYFCVPETKGKTLEQIEMMFESGDEWGGGEIELEDTQHLIPSIKKSVPLG

SEQ ID NO: 4534 - DNA, 1810 bp, Triticum aestivum
  CDS (148)..(1632)
aaacctcgccttcctcgtgctagcctagccggttggttggtttggtaccaaaccctcttcctctccgggtctttcttcagcacagcgcgctagtactaactacttctagcacggaacagaacagcgcagtatcgaggatcgacattaatggcgtccaagggcgagagggatgtggagatccacgtctcttccccgccgcccgacgaccgcgacgccgccaggcccttgctgcccgccgcctgcgaggcctactccgtctccgccgcaatcctccccttcttcttcccagctctgggtgggcttctctatggctatgacatcggggcaacatctggtgccaccatatcgctcaagtcccccacatccagtggtacagcatggtacctgtcatcagtgcaaactggcctcgtggtcagcggctcactctacggtgctttgatcggatccgccacggcattcaccattgcggattttctaggaaggcgcagagagcttgttgtttcttctatcatgtatttgattggagctcttctcacagcagtggctcctaacttccttatcatggtggttggtcgctttttatatggcataggaattggattggctatgcacgctgctcccatgtatattgctgagactgctccaagtcagattagaggcatgctcatttctctcaaggagttctttattgttcttgggatgcttcttggttatatagtaggcaatctctttgttgaagtgatttctggttggcgctacatgtattccgccagtgctccgatatgtgtcattatgggcatcggaatgtgctggttaccttgttcacctaggtggcttctgttatgtgccacacaaggaaaaggagatctgcgggagacaaaagaaaatgctacacgttgcttatgtcgattgaggggtcaagcgtcacctgatttggtttcggagcaggttaatttgattctggaagaactgtcatacgttggtgaagagaaaaaagcaggattcagtgagatctttcaaggaaagtgtctcaaagcaatgataattggatgtggtttggtgttctttcagcaggtcactggtcaaccaagtgtgctatattatgctgcgacaatttttcagagtgctggattctctggagcatctgatgccactcgtgtatcaattcttcttggcgtgctgaagctgattatgactggagttgccgttcttgtggttgacaaacttggtagaagaccattactaattggtggtgttagtggaattgctgtctccctattcttattgtcttcatactataccttgtttacgggtgctccttatgtggctgtaatagcacttctactgtatgttggctgctaccagttatcatttggtccgattggctggcttatgatttcagaggttttcccgctgaagctgcgtggccgtggattgagtgttgctgttcttgtgaactttgcctccaacgcgcttgtcacttttgctttctccccactagaggacttgattggcactggggttctctttgcttcgttcggggtgattgcggtggcgtctctcacattcatattctgcattgtgcccgaaacaaaagggctcaccctggaagaaatcgaagccaaactgtagatccaactatctgtagtctcatcttagttagcatcttctttactgctcttattactcagctattttgtaagcgtagtattacattgagaaactacttatttttctctgaataagatatatatctaaatagaaggtgtccaagtggaagcgtcttcatgagggaaaaaaaaaaaaaaaa

SEQ ID NO: 4535 - protein, 494 aa, Triticum aestivum
MASKGERDVEIHVSSPPPDDRDAARPLLPAACEAYSVSAAILPFFFPALGGLLYGYDIGATSGATISLKSPTSSGTAWYLSSVQTGLVVSGSLYGALIGSATAFTIADFLGRRRELVVSSIMYLIGALLTAVAPNFLIMVVGRFLYGIGIGLAMHAAPMYIAETAPSQIRGMLISLKEFFIVLGMLLGYIVGNLFVEVISGWRYMYSASAPICVIMGIGMCWLPCSPRWLLLCATQGKGDLRETKENATRCLCRLRGQASPDLVSEQVNLILEELSYVGEEKKAGFSEIFQGKCLKAMIIGCGLVFFQQVTGQPSVLYYAATIFQSAGFSGASDATRVSILLGVLKLIMTGVAVLVVDKLGRRPLLIGGVSGIAVSLFLLSSYYTLFTGAPYVAVIALLLYVGCYQLSFGPIGWLMISEVFPLKLRGRGLSVAVLVNFASNALVTFAFSPLEDLIGTGVLFASFGVIAVASLTFIFCIVPETKGLTLEEIEAKL

SEQ ID NO: 4536 - DNA, 1659 bp, Glycine max; identical to SEQ ID NO: 112
  CDS (1)..(1659)

SEQ ID NO: 4537 - protein, 552 aa, Glycine max; identical to SEQ ID NO: 113

SEQ ID NO: 4538 - DNA, 1749 bp, Medicago truncatula
  CDS (1)..(1749)
atggccgaaggtggtcatcaattagcagacaaaacagagttcacagaatgttggcgaagaacaaccgaatcaccgtatctcatgcgtcttgctttatcagctggtattggtggtcttttatttggttacgatacaggtgtgatttctggtgctttgttatatatccgtgatgagtttgatcaagttgataagaaaacatggcttcaggaaaccattgttagtatggctgttgcaggagctatagttggtgcagcatttggaggatatatgaatgacaagatgggaaggaagaaaactattttaatggcagatgtggtgttcgttgcaggtgcattagttatggctgctgctccagctccttgggttatcattatcggaagagttttagttggcttaggagttggtgttgcatccatgactgctcctctatacatctcagaagcttcccctgctaagattagaggagcattggtttgcaccaatggtttacttataacaggaggtcaatttctctcttacctcatcaatttggcatttaccaaggctccaggaacatggcgttggatgcttggagtggcagcaatccccgctatagtgcagttcgtattgatgttgtccctccctgagtcacctagatggctctacaggcagagcaaggaggaggaagcaaagattattctgacaaaaatctatcgccccggtgaagttgcagacgaaatgaaagccatgcatgaatccattgaagccgagaaggcagaggaaggcttgatcggtcatagtcttgcacaaaaactaaagggtgcttggtctaatgacgtagttcgaagaggactctacgcaggcattactgtccaagttgttcaacaatttgtcggtattaatacagtcatgtattacagcccaactatagttcagtttgcaggaattgcctccaactccacagcacttgcactctccttagttacttctggtttgaatgccgttggcactatattgagcatgattttaattgatagatttggaaggagaaagttgatgctaatctccttgattggtatctgtgtttcacttgtaatgttaagtgttacattcaacatagcatctcaccatgcacctgcaatcagtaaacatgattcccttagttttggtgggaactctacatgcaatgcttatgcaacggcccctaatttctcgtcgtggaattgcatgaaatgtttgcatgaagactgtgccttttgtgctaatacccaaagtgaatttcaaccaggagcatgcttggcagcaggaaagaatatccgaggcatgtgtcgtgcacaaaaacgtgtatggttttcccaaggttgtccaagcagaattggaatccttgcagttgtaatccttggactatacatcatagcatatgctcctggaattggaacagtgccttgggttctaaactcggagatttatccattgcggttcagaggaataggtggaggtatagcagcagttttcaactggtgtgccaatctaattgtgagtgagtcattcttgagcatgataaaggctctaggaactaccggaacattcctcctctttgcagggttctctttgattggccttgtagccatttatttgttagtgcctgaaaccaaaggccttcagtttgaggaggttgagaaattgcttcaaaaagggtttagacctttcccatttaacaagaaaaaggatgacgacaaagggaaggagaaagtgcaagagatggcttga

SEQ ID NO: 4539 - protein, 582 aa, Medicago truncatula
MAEGGHQLADKTEFTECWRRTTESPYLMRLALSAGIGGLLFGYDTGVISGALLYIRDEFDQVDKKTWLQETIVSMAVAGAIVGAAFGGYMNDKMGRKKTILMADVVFVAGALVMAAAPAPWVIIIGRVLVGLGVGVASMTAPLYISEASPAKIRGALVCTNGLLITGGQFLSYLINLAFTKAPGTWRWMLGVAAIPAIVQFVLMLSLPESPRWLYRQSKEEEAKIILTKIYRPGEVADEMKAMHESIEAEKAEEGLIGHSLAQKLKGAWSNDVVRRGLYAGITVQVVQQFVGINTVMYYSPTIVQFAGIASNSTALALSLVTSGLNAVGTILSMILIDRFGRRKLMLISLIGICVSLVMLSVTFNIASHHAPAISKHDSLSFGGNSTCNAYATAPNFSSWNCMKCLHEDCAFCANTQSEFQPGACLAAGKNIRGMCRAQKRVWFSQGCPSRIGILAVVILGLYIIAYAPGIGTVPWVLNSEIYPLRFRGIGGGIAAVFNWCANLIVSESFLSMIKALGTTGTFLLFAGFSLIGLVAIYLLVPETKGLQFEEVEKLLQKGFRPFPFNKKKDDDKGKEKVQEMA

SEQ ID NO: 4540 - DNA, 1395 bp, Salmonella enterica subsp. enterica serovar Typhi
  CDS (1)..(1395)
atgcctgacaataaaaaacaagggcgttccaacaaggccatgacattttttgtctgctttcttgcagccctggcaggattactttttggcctggatatcggcgttatcgccggtgctttacccttcattaccgacgagtttcagattaccgcacacactcaggaatgggtggtcagctccatgatgtttggcgcggccgtcggcgctgtcggcagcggctggctctcctttaagctgggtcgtaaaaaaagcctgatgatcggcgctatcctgttcgtcgccggttcgctgttctccgctgcggcgcctaacgttgaagtcctgattatttctcgcgtgctgctgggtctggccgtcggcgtcgcttcctacactgcaccgttgtacctgtccgagatcgcgccggaaaaaattcgcggcagtatgatctcaatgtaccaactcatgatcaccatcgggattctgggcgcttatctgtccgataccgcgttcagctacagcggcgcatggcgctggatgctcggcgtgatcatcatcccggctattctgctgctgatcggcgtcttcttcctgccggacagcccgcgctggtttgcggcgaaacgccgtttccatgatgctgaacgcgtcctgttgcgcctgcgtgacaccagtgcggaagcaaaacgtgagctcgatgaaattcgcgaaagtttgcaggttaaacagagcggttgggcgctgttcaaagagaacagcaacttccgccgcgccgtgtttcttggcattttgttgcaggtcatgcagcaatttaccgggatgaacgtcatcatgtattacgcgccgaaaatcttcgaactggcggggtacacgaataccacggagcagatgtggggcaccgttattgttggtctgactaacgtgctggcaaccttcatcgctatcggcctggttgaccgctggggccgcaagccgaccctgacgctgggcttcctggtcatggcgattggtatggggattctgggtacgatgatgcacatcggcatccattcgccgtctgcgcaatacttcgctatcgctatgctgctgatgttcatcattggatttgcgatgagcgctggtccgctgatttgggtactgtgctccgaaatccagccgctgaaaggccgcgatttcggcatcacctgctccaccgcgaccaactggatcgccaatatgatcgtcggcgcaacgttcctgaccatgctgaacaatctgggtaacgccaacaccttctgggtctatgcgggcctgaacgtactgtttatcctgctgaccctgtggctggtgccggaaaccaaacacgtttcgctggaacacattgaacgtaacctgatgaaaggtcgtaaactgcgcgaaatcggcgcccacgactaa

SEQ ID NO: 4541 - protein, 464 aa, Salmonella enterica subsp. enterica serovar Typhi
MPDNKKQGRSNKAMTFFVCFLAALAGLLFGLDIGVIAGALPFITDEFQITAHTQEWVVSSMMFGAAVGAVGSGWLSFKLGRKKSLMIGAILFVAGSLFSAAAPNVEVLIISRVLLGLAVGVASYTAPLYLSEIAPEKIRGSMISMYQLMITIGILGAYLSDTAFSYSGAWRWMLGVIIIPAILLLIGVFFLPDSPRWFAAKRRFHDAERVLLRLRDTSAEAKRELDEIRESLQVKQSGWALFKENSNFRRAVFLGILLQVMQQFTGMNVIMYYAPKIFELAGYTNTTEQMWGTVIVGLTNVLATFIAIGLVDRWGRKPTLTLGFLVMAIGMGILGTMMHIGIHSPSAQYFAIAMLLMFIIGFAMSAGPLIWVLCSEIQPLKGRDFGITCSTATNWIANMIVGATFLTMLNNLGNANTFWVYAGLNVLFILLTLWLVPETKHVSLEHIERNLMKGRKLREIGAHD

SEQ ID NO: 4542 - DNA, 2568 bp, Saccharomyces cerevisiae
  CDS (461)..(2299)
ctcgaggagaacttctagtatattctgtatacctaatattatagcctttatcaacaatggaatcccaacaattatctcaacattcacccatttctcaccttcagctcaaatcctcatcccggaaccttttttcttatttgttccctcttctactacaagagctttcaaattgtagtcaaaaacccgctttactaaaaaaacatcgccaaaaaaatttccaaaatcgctcgtcttgccactaaaagtatgcaaaatattatgtgaagcaaagttatttcgtgtcttccgcctaacagaacgtaagcagttgaccatactttagtatagagtacgaaaaaacacaaagaataccttaataaaataaacattgtcgttcgctaggaaaacggtaacgaaaacaaaaaactaaaagaagaaaagaggcaggacgcagtaaaagcaagaaaactgcttttttttcatggctgaaatgaagaattcgacagctgctagttccagatggacgaagagtcgtctctcccatttctttccctcgtacactaatagcagtggtatgggggccgcctcaactgatcaatcttctacgcagggagaagaactgcaccataggaagcactgtgaagaagacaatgatggtcaaaaaccgaaaaagtctcccgtatccacctctacaatgcaaataaaatctagacaggatgaggacgaggatgacggtcgaattgtcattaaaccagttaacgatgaagatgatacatcagtgattataactttcaatcagtcaatatccccttttattattacattgacattcgttgcgtccatttctgggttcatgtttggttatgatactggttacatatcgagtgcgctaatttctatcaatagagatttagacaacaaagttttaacttatggagaaaaagaattaattacggccgccacatcattgggcgctttgattacaagtgtgggcgctggtactgctgctgatgtgtttggaagaagaccatgtttaatgttctccaatctgatgtttttgatcggagcaattttacaaattaccgcgcacaagttttggcaaatggcggccggtagactgattatgggtttcggtgtcggtattggttctttgatttctcctctttttattagtgaaattgctcctaagatgatcaggggtaggttaaccgttataaattccctatggctgacaggtggtcaattgattgcttacggttgtggtgcgggcctgaaccacgtcaaaaacggttggagaatcttagttggtttgtccttgatacctactgttttgcagttttcttttttctgttttttgccggatacaccaagatactacgtaatgaaaggcgatttaaagagagcaaaaatggttctcaaacgaagttacgtaaacactgaagatgaaataattgatcaaaaagttgaagaattatctagcttaaatcaatcgataccaggaaaaaatccaataacaaaattctggaatatggtcaaggaattgcacactgtgccttcaaatttcagagctttgattattggttgtggtctacaagccattcaacaattcacaggttggaattccttaatgtatttctccggtacaatatttgaaactgttggattcaaaaattcttctgccgtttctattattgtctcaggtactaattttgtgttcacattaatagcatttttctgtattgataaaatcggccgtaggtacattttactgattggactacctggtatgactgtggcgctggttatatgtgctatagcgttccatttcctaggtattaagtttaacggtgctgatgcagtagtggcatctgatggattttcatcttggggcattgtcattatcgtatttattattgtgtatgcagccttttatgccctcggtatcggcactgttccatggcaacaatcggaattatttccacaaaacgtcagaggtgtagggacatcctacgctactgccaccaattgggcaggttctttagtcattgcgtctacgttcttgactatgttacaaaatattacaccaacgggtacattttcattctttgccggtgtagcatgtttatcaaccattttttgttacttttgttatccagaactatcaggattggagttagaggaagttcaaacaattttaaaggacggattcaatatcaaagcctctaaagctctagctaaaaagaggaaacaacaggtggccgaaggtgctgcccatcataaactcaaattcgaacctacacaggaaattgtagaaagttagactgctacaccaacaaaaaataaaagataaagaacaaaaaagaaggaagaaagctataaaagggagacaattcatttcatctaatcttaaaagtttttatttaaatatataagtaagagcgaagtatttaaaaataaaaattcataaaagttgagcttgatgaaagttatatcttttcgagcggtatgtttctttcgtgtaaaattcttcttaaagtatctaacttctcctcatctttcaagtttcctttaactacaactttttggatc

SEQ ID NO: 4543 - protein, 612 aa, Saccharomyces cerevisiae
MAEMKNSTAASSRWTKSRLSHFFPSYTNSSGMGAASTDQSSTQGEELHHRKHCEEDNDGQKPKKSPVSTSTMQIKSRQDEDEDDGRIVIKPVNDEDDTSVIITFNQSISPFIITLTFVASISGFMFGYDTGYISSALISINRDLDNKVLTYGEKELITAATSLGALITSVGAGTAADVFGRRPCLMFSNLMFLIGAILQITAHKFWQMAAGRLIMGFGVGIGSLISPLFISEIAPKMIRGRLTVINSLWLTGGQLIAYGCGAGLNHVKNGWRILVGLSLIPTVLQFSFFCFLPDTPRYYVMKGDLKRAKMVLKRSYVNTEDEIIDQKVEELSSLNQSIPGKNPITKFWNMVKELHTVPSNFRALIIGCGLQAIQQFTGWNSLMYFSGTIFETVGFKNSSAVSIIVSGTNFVFTLIAFFCIDKIGRRYILLIGLPGMTVALVICAIAFHFLGIKFNGADAVVASDGFSSWGIVIIVFIIVYAAFYALGIGTVPWQQSELFPQNVRGVGTSYATATNWAGSLVIASTFLTMLQNITPTGTFSFFAGVACLSTIFCYFCYPELSGLELEEVQTILKDGFNIKASKALAKKRKQQVAEGAAHHKLKFEPTQEIVES

SEQ ID NO: 4544 - DNA, 1644 bp, Arabidopsis thaliana (mouse-ear cress)
  CDS (1)..(1644)
atgatgaagaatcttccggaggttggtaatggcggtggctcgggttttccggcggtctctgtcggaaataagaagaataagtatcagagaatggactccgacgcggaggaatcgcagaatcatcgtgaagcagaggctagaaacagtagaaccagaaaatacgttatggcttgtgccttttttgcatccttgaacaatgttcttctcggctacggtcggttttacttatataatcggattcttcttcttcttctttactttgttgacttacaaaaagatgttggggtaatgagcggtgcggtgttgttcatacagcaggatctcaaaataacggaggtgcagacggaagtgctcattggtagccttagcatcatctcactctttggcagcttagccggcggcagaacctctgactctatcggtagaaaatggaccatggccttggctgctctcgtcttccagactggtgctgccgtgatggctgtcgctccgtctttcgaggttttgatgatagggagaactttagccggcattgggattgggcttggtgtcatgatcgctcctgtctacatcgccgagatatcccccaccgtagctagaggatttttcacttcgttccctgagatcttcataaatctagggatcttgctgggctatgtttcgaactacgctttctcggggctttccgtgcatatcagctggaggatcatgcttgcagttgggattcttccttcggtgttcataggatttgcgctgtgtgtgatccctgagtcgccgaggtggctggtgatgaaaggccgagtggacagtgcacgagaggtgctcatgaaaacgaatgagcgagatgacgaagcggaagagcggcttgcagagatacaactggcggctgcacatacagaaggcagcgaggacaggcccgtgtggcgtgagcttcttagcccatctcctgttgtacggaaaatgctgattgttggatttggaatccagtgtttccagcagatcacaggaattgacgccacagtctactatagtccagagatcctgaaagaggctgggatacaagacgagaccaaactgctcgctgcaactgtcgctgttggtgtcacgaaaacagtgttcatactatttgccaccttcctgattgatagtgttggccggaaaccgctgctttatgtgagcacaataggaatgactctgtgtctcttttgtctaagctttacgctcacattcctcggccaaggaacgcttgggataaccttggcgcttctctttgtttgtggaaacgttgccttcttctccataggaatgggacctgtttgctgggtcttgacatcagagatctttccattacgattaagagcccaggcatctgcgcttggggcggttgggaacagggtgtgcagcggtctggtggccatgtccttcctctctgtgtcacgtgccatcactgttggaggaaccttcttcgttttctccctcgtgtctgcactctcagttatcttcgtgtatgtgctagtccccgagacaagcgggaagtcactggagcagatagagttgatgtttcagggtgggctggaaagaaaagacggtgaagttgagcttggagatgctgagcgtcttgtgcgcaaggaacaggagttttga

SEQ ID NO: 4545 - protein, 547 aa, Arabidopsis thaliana (mouse-ear cress)
MMKNLPEVGNGGGSGFPAVSVGNKKNKYQRMDSDAEESQNHREAEARNSRTRKYVMACAFFASLNNVLLGYGRFYLYNRILLLLLYFVDLQKDVGVMSGAVLFIQQDLKITEVQTEVLIGSLSIISLFGSLAGGRTSDSIGRKWTMALAALVFQTGAAVMAVAPSFEVLMIGRTLAGIGIGLGVMIAPVYIAEISPTVARGFFTSFPEIFINLGILLGYVSNYAFSGLSVHISWRIMLAVGILPSVFIGFALCVIPESPRWLVMKGRVDSAREVLMKTNERDDEAEERLAEIQLAAAHTEGSEDRPVWRELLSPSPVVRKMLIVGFGIQCFQQITGIDATVYYSPEILKEAGIQDETKLLAATVAVGVTKTVFILFATFLIDSVGRKPLLYVSTIGMTLCLFCLSFTLTFLGQGTLGITLALLFVCGNVAFFSIGMGPVCWVLTSEIFPLRLRAQASALGAVGNRVCSGLVAMSFLSVSRAITVGGTFFVFSLVSALSVIFVYVLVPETSGKSLEQIELMFQGGLERKDGEVELGDAERLVRKEQEF

SEQ ID NO: 4546 - DNA, 1560 bp, Caulobacter crescentus
  CDS (1)..(1560)
atggtcgtcagaaccaccgcttgcgcgctgataccggtaacactaatgtcgccggcaaccaaaggtccgacaaggaccagtagggcatcaacgggccggtacggccccatggggaggacacctgtggcttcagtatccaacgccggtcccagcgccggcatgagcgcggacggcgggaaggtcaacatgaccttcgtcgccgcgatcgtcgccgtcgccacgatcggcggcttcatgttcggctacgacagcggcgtcatcaacggcacgcaagagggcctggaaagcgccttcaatctcagcaagctgggcaccggcctgaatgtcggcgccatcctgatcggctgcgccatcggcgccttcgccgccggccgcctggccgacgtgtggggccgccgcacggtgatgatcatctcggccctgctgttcgtgatcagcgccatcggcaccggcgcggccgagagctcgatcgtgttcatcatcttccgcctgatcggcggtctgggcgtcggcgccgccagcgtgctgtgcccggtctacatctcggaagtcacgcccgcgaacatccgcggccgcctgtcgtccgtgcagcagatcatgatcatcaccggcctgaccggcgccttcgtggccaactacgccctggcccacaccgccggcagctcgacggccgagttctggctgggcctgcccgcctggcgctggatgttctggatgcagatcattcccgccggcgtgttcttcctctgcctgctgggcattcccgaaagcccccgctacctcgtggccaagggcaaggacgcccaggccgaagcgatcctctcgcgcctgttcggcgcgggccagggcgccaagaaggtcgaggaaatccgcgcctcgctgtcggccgatcacaagcccacgttctcggaccttctggatccgacgaccaagaagctgcgcgtcatcctgtgggcgggcctcgtcttggccgtgttccagcagctggtgggcatcaacatcgtcttctactacggctcggtgctgtggcagtcggtgggcttcaccgaggacgacagcctgaagatcaacatcctgtcgggcacgctgtcgatcctggcctgtctgctggccatcggcctgatcgacaagatcggccgcaagccgctgctgctgatcggttcggccggcatggccgtgacgcttggcgtgctgacctggtgcttctcgaccgccaccacggtcaacggcgccctgaccctgggcgaccagatcggcctgaccgcccttatcgccgccaacctctacgtgatcttcttcaacctctcgtggggtccggtcatgtgggtgatgctgggcgagatgttccccaaccagatgcgcggctcggccctggccgtctgcggcttcgcccagtggatcgccaacttcgccatctcggtcagcttcccggccctggccgcggccagcctgccgatgacctacggcttctatgcgctgagcgctgtcgtctcgttcttcctggtccagaagctggtccacgaaacgcgcggcaaggaactggaagcgatgcaggggtga

SEQ ID NO: 4547 - protein, 519 aa, Caulobacter crescentus
MVVRTTACALIPVTLMSPATKGPTRTSRASTGRYGPMGRTPVASVSNAGPSAGMSADGGKVNMTFVAAIVAVATIGGFMFGYDSGVINGTQEGLESAFNLSKLGTGLNVGAILIGCAIGAFAAGRLADVWGRRTVMIISALLFVISAIGTGAAESSIVFIIFRLIGGLGVGAASVLCPVYISEVTPANIRGRLSSVQQIMIITGLTGAFVANYALAHTAGSSTAEFWLGLPAWRWMFWMQIIPAGVFFLCLLGIPESPRYLVAKGKDAQAEAILSRLFGAGQGAKKVEEIRASLSADHKPTFSDLLDPTTKKLRVILWAGLVLAVFQQLVGINIVFYYGSVLWQSVGFTEDDSLKINILSGTLSILACLLAIGLIDKIGRKPLLLIGSAGMAVTLGVLTWCFSTATTVNGALTLGDQIGLTALIAANLYVIFFNLSWGPVMWVMLGEMFPNQMRGSALAVCGFAQWIANFAISVSFPALAAASLPMTYGFYALSAVVSFFLVQKLVHETRGKELEAMQG

SEQ ID NO: 4548 - DNA, 1386 bp, Bacillus subtilis
  CDS (1)..(1386)
atgaagaaagacacaaggaaatatatgatctactttttcggcgctttagggggactgctatatggttacgatacaggtgttatctccggagcactcctgtttatcaataacgatattcctttaacgacattgacagaaggattggttgtcagcatgctgctccttggcgcgattttcggttctgccttgagcggcacatgctcagaccgctggggcaggagaaaggttgtatttgtcctttccatcatttttattatcggtgcgctcgcttgcgcattttctcaaacaatcggcatgctgattgcatctagggtgatactcgggttggccgtcggcggttcaacggcacttgtgcccgtgtatctttccgaaatggcaccgacgaaaattcgcgggacactcggcacaatgaacaacttaatgattgtcaccgggattttgctcgcctatatcgttaactacctgttcacaccgtttgaagcgtggcgctggatggtcggtctggctgcagtgcctgccgtgcttctattaatcggcatcgccttcatgccggaatcgccaagatggctcgtgaagcgcggcagcgaagaagaagcgagacgcatcatgaacatcactcatgaccccaaagacatcgaaatggaattggcagagatgaagcaaggggaagcggagaaaaaagaaacgacacttggcgtgctgaaagccaagtggattcgccctatgcttctgattggcgtcggccttgccattttccagcaggcagtcggcattaacacggtcatctactacgcgccaaccatttttacgaaggccggtcttggcacatcagcttcggcgctcggcacaatgggaatcggcatcctcaacgtcatcatgtgtatcactgccatgatcttaattgaccgtgtcggccgcaaaaaacttctgatctggggaagtgtcggcatcacactgagccttgctgctttatcaggcgtgctcctgacactggggctttccgcatcaacagcgtggatgacagtagtctttctcggtgtctatatcgtcttttaccaggcgacatggggtccggtagtgtgggtgctcatgcctgagctcttcccgtccaaagcacgcggagccgcgacagggttcacgactttggtgttatcggcggctaacctgatcgtgtcgcttgtcttcccgctgatgctaagcgcgatgggcatcgcatgggtctttatggttttctcagtcatttgtcttctctcatttttcttcgcgttctacatggtaccggaaaccaaagggaaaagcttggaggaaattgaagcaagcctgaaaaaacggtttaaaaagaagaaaagcacccaaaaccaagtgctgaatgagcgtacattataa

SEQ ID NO: 4549 - protein, 461 aa, Bacillus subtilis
MKKDTRKYMIYFFGALGGLLYGYDTGVISGALLFINNDIPLTTLTEGLVVSMLLLGAIFGSALSGTCSDRWGRRKVVFVLSIIFIIGALACAFSQTIGMLIASRVILGLAVGGSTALVPVYLSEMAPTKIRGTLGTMNNLMIVTGILLAYIVNYLFTPFEAWRWMVGLAAVPAVLLLIGIAFMPESPRWLVKRGSEEEARRIMNITHDPKDIEMELAEMKQGEAEKKETTLGVLKAKWIRPMLLIGVGLAIFQQAVGINTVIYYAPTIFTKAGLGTSASALGTMGIGILNVIMCITAMILIDRVGRKKLLIWGSVGITLSLAALSGVLLTLGLSASTAWMTVVFLGVYIVFYQATWGPVVWVLMPELFPSKARGAATGFTTLVLSAANLIVSLVFPLMLSAMGIAWVFMVFSVICLLSFFFAFYMVPETKGKSLEEIEASLKKRFKKKKSTQNQVLNERTL

SEQ ID NO: 4550 - DNA, 1743 bp, Arabidopsis thaliana (mouse-ear cress)
  CDS (1)..(1743)
atggtggaagaagcatcgaaatcagagcagataaatatcacagaggtgtggacgacgacatgggagacaccttacattatgcggctggctctctctgccggtattggaggactcctcttcggatacaacacgggagtcatcgcaggggctcttctctatataaaagaggagtttggtgaggtagacaacaagacatggcttcaggagatcattgtgagcatgaccgtggctggagccattgttggagcagctataggaggatggtacaacgataagtttggtaggaggatgtctgttcttatagcggatgtgctcttcctgctgggtgccctggtgatggtgattgctcatgcgccgtgggtcatcatcctcggcagactcttggtgggttttggggttggtatggcttctatgacctcaccgctttacatctctgagatgtctcctgcgagaatcagaggcgccttggtcagcaccaacggacttctcatcaccggaggacagtttctatcttatctcatcaaccttgccttcgtccatacaccgggtacatggaggtggatgttgggagtctcggcgattccagcgatcattcagttctgcctcatgctaacgctgccagagtctccacggtggctctatagaaatgataggaaagccgagtcaagagacatcctcgagagaatatacccggcagagatggttgaagcggagatagctgcactcaaggagtctgtccgggcagagacggctgacgaggatattatcggccataccttctctgataagctcagaggcgctctctcgaatccagttgtccgccacggtctggccgcaggtatcaccgtccaggtcgcccagcagtttgtgggaatcaacacagtcatgtactacagtcctactattctgcagtttgcaggttacgcatccaacaagacagccatggctcttgctctcataacctccggtctcaatgcagtggggtctgtagtaagcatgatgtttgtagaccgttatggtcggcgcaagcttatgatcatttccatgttcgggatcataacttgccttgtcattttggctgccgttttcaatgaagcctcaaaccacgctccaaagatcgataagagagactccagaaacttcgcaaaaaatgctacttgtcccgcatttgccccattcacagcctcccgttctcctccctccaactggaattgtatgaagtgtcttcaatacgattgcggattctgctccaacggagcacaggagtacgcacctggagcatgcattgttcagtctgctgatatgaaggcattgtgccactcgaaaggcagaaccttcttcaaagacggatgccccagcaagttcgggtacctggccattgtcttccttggcctctacatcattgtgtacgcgcccggtatgggcacagttccatggattgtcaactcagagatctatcctcttcgctacagagggctcgcgggaggaatcgctgcagtctcaaactggatgtcaaatctcgtagtgagtgagacgttcctgacattgacaaacgcagtcgggtcatcgggaacattccttctatttgcagggtcatccgcagtcgggctgttcttcatctggctgcttgtgcctgagaccaaagggcttcagtttgaggaagtggaaaagttgctagaaggagggtttaggcctagtttattgcggccaacgaccaaggaaaatcaagtggaaacgccttag

SEQ ID NO: 4551 - protein, 580 aa, Arabidopsis thaliana (mouse-ear cress)
MVEEASKSEQINITEVWTTTWETPYIMRLALSAGIGGLLFGYNTGVIAGALLYIKEEFGEVDNKTWLQEIIVSMTVAGAIVGAAIGGWYNDKFGRRMSVLIADVLFLLGALVMVIAHAPWVIILGRLLVGFGVGMASMTSPLYISEMSPARIRGALVSTNGLLITGGQFLSYLINLAFVHTPGTWRWMLGVSAIPAIIQFCLMLTLPESPRWLYRNDRKAESRDILERIYPAEMVEAEIAALKESVRAETADEDIIGHTFSDKLRGALSNPVVRHGLAAGITVQVAQQFVGINTVMYYSPTILQFAGYASNKTAMALALITSGLNAVGSVVSMMFVDRYGRRKLMIISMFGIITCLVILAAVFNEASNHAPKIDKRDSRNFAKNATCPAFAPFTASRSPPSNWNCMKCLQYDCGFCSNGAQEYAPGACIVQSADMKALCHSKGRTFFKDGCPSKFGYLAIVFLGLYIIVYAPGMGTVPWIVNSEIYPLRYRGLAGGIAAVSNWMSNLVVSETFLTLTNAVGSSGTFLLFAGSSAVGLFFIWLLVPETKGLQFEEVEKLLEGGFRPSLLRPTTKENQVETP

SEQ ID NO: 4552 - DNA, 1774 bp, Arabidopsis thaliana (mouse-ear cress)
  CDS (1)..(1743)
atggagggaggaataatacatggaggagcagatgaatcagctttcaaagaatgtttctctctaacatggaagaatccttatgttcttcgtcttgctttctctgccggaatcggtggtcttctctttggttacgacaccggagtgatatcaggtgctctgctttatatcagagatgatttcaagtctgttgacagaaatacttggttacaggagatgatagtgagcatggcagttgcaggagccatcgttggagccgccataggaggttgggcgaacgacaaattagggaggagaagcgcgattctcatggcggatttcctctttttattaggagctatcattatggcggctgctcctaacccgtccctccttgtcgttggccgtgtttttgtgggcctcggggtcgggatggcctcgatgaccgctcctctatacatctcagaagcttcgcctgctaagatcagaggagctttggtcagtactaatgggtttctcattaccggaggacagttcttgtcttacctcataaacttagcctttactgatgtgaccggaacgtggagatggatgctcggaatcgccggaattccagctcttttacagtttgtcttaatgtttacactcccggagtcacctcgatggttataccgcaagggaagagaagaagaggctaaagcgattctaagaagaatatactcagcagaagatgtagaacaagagatacgtgcacttaaagactcagttgaaacagagatacttgaagaagggtcttccgagaaaatcaacatgatcaaactatgcaaagctaaaaccgttagacgaggactaatagctggtgttggtctccaagtgtttcaacagttcgttgggatcaacacagttatgtattacagtccaaccattgttcagcttgccggtttcgcttcaaacagaacagctcttctcttgtctctagttaccgcaggacttaatgcatttggttctataattagcatttacttcattgatagaatcggaaggaaaaagcttttgatcattagccttttcggagtcattatctcgctaggaatactaaccggtgttttttatgaagcggctactcacgctcctgcgattagctcactcgagacacaaaggttcaataatattagttgtccggattataagtcagctatgaataccaatgcttgggattgtatgacttgtttgaaagcttcttctccatcttgtggctattgttcctctcccattggaaaggaacatcccggggcatgttggatctctgatgattcggttaaggacttatgtcataacgaaaaccggctttggtacacgagaggatgtcctagcaattttggttggtttgctcttcttggattgggactttatatcatcttcttctctcctggaatggggactgttccatggatagttaactcagagatttatccattgagattcagaggaatatgtggaggaatagctgcaactgcaaattggatatcaaatttgattgtggctcaatcttttttgtcattgaccgaagctattgggacttcttggacttttctcatctttggagtgatctcagtcattgctcttctctttgttatggtttgtgttccggagacaaaaggaatgccaatggaggagattgagaagatgcttgaacgaagatcgatggagtttaagttttggaagaaaaaatcaaaacttgttgagaaacaaaaccagagtgcatgagagaaactcttaaaggaagcataatcaatga

SEQ ID NO: 4553 - protein, 580 aa, Arabidopsis thaliana (mouse-ear cress)
MEGGIIHGGADESAFKECFSLTWKNPYVLRLAFSAGIGGLLFGYDTGVISGALLYIRDDFKSVDRNTWLQEMIVSMAVAGAIVGAAIGGWANDKLGRRSAILMADFLFLLGAIIMAAAPNPSLLVVGRVFVGLGVGMASMTAPLYISEASPAKIRGALVSTNGFLITGGQFLSYLINLAFTDVTGTWRWMLGIAGIPALLQFVLMFTLPESPRWLYRKGREEEAKAILRRIYSAEDVEQEIRALKDSVETEILEEGSSEKINMIKLCKAKTVRRGLIAGVGLQVFQQFVGINTVMYYSPTIVQLAGFASNRTALLLSLVTAGLNAFGSIISIYFIDRIGRKKLLIISLFGVIISLGILTGVFYEAATHAPAISSLETQRFNNISCPDYKSAMNTNAWDCMTCLKASSPSCGYCSSPIGKEHPGACWISDDSVKDLCHNENRLWYTRGCPSNFGWFALLGLGLYIIFFSPGMGTVPWIVNSEIYPLRFRGICGGIAATANWISNLIVAQSFLSLTEAIGTSWTFLIFGVISVIALLFVMVCVPETKGMPMEEIEKMLERRSMEFKFWKKKSKLVEKQNQSA

SEQ ID NO: 4554 - DNA, 1518 bp, Bacillus subtilis
  CDS (16)..(1389)
aagggagtcatctttatgaaaaagcagtcaaatatatggctttattttttcggagctcttggaggcgcgttatatggctatgataccggagtgatttccggagctattttatttatgaaaaaggagttaggcttaaacgcgtttacagaaggtcttgttgtcagctccttgctggttggggcgatattgggctcaggagcggccggcaagctgactgaccgtttcggaagaaaaaaagcaattatggcagccgcgctgctgttttgtataggcggtcttggtgtggcactggccccaaatacaggagtcatggtgctgtttcgcatcattttgggacttgcagtcggaacatcgacgacaatcgtacccctttatttatctgaactggcgccaaaacataaacgcggggcgctgtcatcactgaatcagctgatgatcacggtcggcatccttctttcttacattgtcaattacatatttgccgatgccgaagcgtggcgctggatgcttggattggctgctgtgccgtcattgctcttgcttattggcattttgtttatgccggagagcccgcgctggctgttcacgaatggcgaagaaagcaaagcgaagaaaattcttgaaaaattgcgtggcacaaaagatattgatcaggaaatacatgatataaaagaagcggaaaagcaggatgaaggcggtctgaaggagctgttcgatccatgggtgcgcccagcgcttattgcaggtttgggactcgcttttttgcagcaatttatcggaacgaatacgatcatctactatgcgccaaagacctttacaaacgtcggattcggaaactccgcttcgattttaggcacggtcggaatcggcacagtcaatgttctcatgacattagtagcgattaaaatcatcgacaagattggaagaaagccgttactgctattcgggaatgcgggcatggtgatcagcttgatcgttctcgctttagtaaatctctttttcaataacactccggctgcctcatggacgaccgtcatttgtttaggcgtgtttatcgttgtctttgcggtcagctggggaccggttgtgtgggtgatgcttcctgaattgttcccgcttcacgtcagaggaatcgggaccggtgtttcgaccttaatgttgcacgttgggacactgattgtttcattaacctatccaatattaatggaagcgatcggaatcagttatttattcctgatttatgccgcgatcggtatcatggcgttcttatttgtccgatttaaagtgacagagacaaagggaagaagccttgaagaaattgagcaggatttacgggacaaaaacggacagggaggagcggccggaaaacagcagactgtcggaacataaaaaagggtgcgcgatcatgcgcacccttttgattgcttactttcccaccgtgccaaagttaatgattttaaaagaaatatcgtacttaaaatcagtctcagaaaatatttcatcccaatgcccttttac

SEQ ID NO: 4555 - protein, 457 aa, Bacillus subtilis
MKKQSNIWLYFFGALGGALYGYDTGVISGAILFMKKELGLNAFTEGLVVSSLLVGAILGSGAAGKLTDRFGRKKAIMAAALLFCIGGLGVALAPNTGVMVLFRIILGLAVGTSTTIVPLYLSELAPKHKRGALSSLNQLMITVGILLSYIVNYIFADAEAWRWMLGLAAVPSLLLLIGILFMPESPRWLFTNGEESKAKKILEKLRGTKDIDQEIHDIKEAEKQDEGGLKELFDPWVRPALIAGLGLAFLQQFIGTNTIIYYAPKTFTNVGFGNSASILGTVGIGTVNVLMTLVAIKIIDKIGRKPLLLFGNAGMVISLIVLALVNLFFNNTPAASWTTVICLGVFIVVFAVSWGPVVWVMLPELFPLHVRGIGTGVSTLMLHVGTLIVSLTYPILMEAIGISYLFLIYAAIGIMAFLFVRFKVTETKGRSLEEIEQDLRDKNGQGGAAGKQQTVGT

SEQ ID NO: 4556 - DNA, 1695 bp, Arabidopsis thaliana (mouse-ear cress)
  CDS (12)..(1475)
agaatcaaaagatgagtttcagggatgataatgaggaggctaggaatgatttgcgtcggccgtttattcacaccggaagctggtaccggatgggttcgagacaatcgagtatgatgggttcctctcaagttattcgagacagctctatctctgttcttgcatgtgttttgatcgttgctcttggccctattcaattcggattcacttgtggttattcatctccaactcaagctgcaatcaccaaggatctcggtttaacagtatctgagtactctgtgtttggttctctttccaatgtgggtgctatggttggtgcaattgccagtggtcagattgcagaatacattggacgaaaagggtctcttatgattgctgcaattcccaatatcattggatggctttgcatatcatttgcaaaagatacttcttttctttacatgggaagacttttagaaggctttggcgttgggatcatctcttacactgtacctgtatatatcgctgagatagctccacaaaatatgagaggaggattgggttcggttaaccagctttctgtgacaattggaataatgttggcgtatttacttggcctctttgttccatggagaattcttgcagttctggggatattgccgtgtacattattgataccaggtctctttttcatccccgaatcccctcgctggctggcaaaaatgggtatgacagatgaatttgaaacttcattacaagttcttcgaggatttgagactgatattaccgttgaagttaatgaaatcaagagatctgtggcatcatctacaaagcgaaatacagttcggtttgtagatctcaaacgcaggagatactatttcccacttatggttggtatagggttgcttgtacttcaacaacttggtggaattaatggtgtcctattctattccagtacaatatttgaatctgcaggagttacatcgagtaacgcagcaacatttggggtcggggctattcaggtagtagcgactgcaatatccacttggttggtggacaaagcaggtcgtcggcttctgcttactatctcttcggttgggatgacgattagccttgtaattgttgcagctgctttctatcttaaggaatttgtgtctcctgattcagacatgtacagttggctgagcatattgtcagtagttggagttgtggcaatggttgtctttttctcattgggaatgggaccaataccgtggctcattatgtctgagatccttcctgtgaacataaagggtttagctggaagtattgcaactctagccaattggttcttttcttggttgatcaccatgacagcaaatttgctgttagcctggagcagtggaggaactttcactctgtatggattggtttgtgcattcacagtggtgttcgtgactctatgggttcctgagaccaaaggcaaaactcttgaagaacttcaatccttgttcagatgaacaaattgaaacaacttcattctttgtcaccctctctctccctctctgttttggccaagaacaagaagaaacaagagattttccagctttgttaattgggctgagaacgttactaagatttgtttgtttgttcgttgtgtgtcaataatcgcattatcttctatcacatgtatatcaacatactacattcaagtatttgtaattttattgaactctttac

SEQ ID NO: 4557 - protein, 487 aa, Arabidopsis thaliana (mouse-ear cress)
MSFRDDNEEARNDLRRPFIHTGSWYRMGSRQSSMMGSSQVIRDSSISVLACVLIVALGPIQFGFTCGYSSPTQAAITKDLGLTVSEYSVFGSLSNVGAMVGAIASGQIAEYIGRKGSLMIAAIPNIIGWLCISFAKDTSFLYMGRLLEGFGVGIISYTVPVYIAEIAPQNMRGGLGSVNQLSVTIGIMLAYLLGLFVPWRILAVLGILPCTLLIPGLFFIPESPRWLAKMGMTDEFETSLQVLRGFETDITVEVNEIKRSVASSTKRNTVRFVDLKRRRYYFPLMVGIGLLVLQQLGGINGVLFYSSTIFESAGVTSSNAATFGVGAIQVVATAISTWLVDKAGRRLLLTISSVGMTISLVIVAAAFYLKEFVSPDSDMYSWLSILSVVGVVAMVVFFSLGMGPIPWLIMSEILPVNIKGLAGSIATLANWFFSWLITMTANLLLAWSSGGTFTLYGLVCAFTVVFVTLWVPETKGKTLEELQSLFR

SEQ ID NO: 4558 - DNA, 1780 bp, Arabidopsis thaliana (mouse-ear cress)
  CDS (1)..(1749)
atggtggaaggaggaattgcgaaagcagacaaaacagagttcacagagtgttggagaacaacatggaagacaccttacatcatgcgacttgctctctccgccggaatcggaggtcttctcttcggttacgataccggagtcatttccggagctcttcttttcatcaaagaagattttgatgaagttgataagaaaacatggcttcagtcaactattgttagtatggcagtggctggagccatcgtcggagcagcagtcggaggttggatcaatgataagtttggtaggaggatgtcgattcttatcgccgatgttcttttcttgatcggtgcgattgtgatggcatttgctccggctccttgggttatcatcgttggaagaatctttgttgggtttggtgttggtatggcttcgatgacgtctccgttgtatatctctgaagcttctccggcgaggattagaggtgcacttgttagtaccaatggtcttctcatcactggtggacaattcttctcgtacctcatcaatcttgcttttgtccatactccgggaacatggagatggatgttgggtgttgcgggagttccagctattgttcagtttgtgcttatgttgtcgctacctgagtctccaaggtggttatatagaaaggacaggattgcggaatccagagcgattcttgagaggatttacccggctgacgaagtggaggcggagatggaagctttgaaactgtcagtggaggcagagaaagcagacgaggcaatcattggagatagcttctctgcaaagctgaaaggagctttcgggaatcccgttgttcgacgtggactcgctgctggtatcacggtgcaagtggctcagcagtttgtggggatcaacactgtcatgtactacagtccttctattgtgcaatttgctggttacgcctctaacaagacagctatggccttgtctcttattacttccggtttgaatgctttgggttctattgtgagcatgatgtttgtcgatcggtacgggagaaggaagctcatgatcatctctatgtttgggatcatagcatgtcttatcatcttagccacggtgttctcacaagcggccatccacgcccccaagatcgatgcgtttgagtcaaggacgtttgcaccaaatgctacttgttcagcatatgcccctctcgcagccgaaaatgctcctccctcgaggtggaactgcatgaagtgtctcaggtccgaatgtggattctgcgccagcggggtacagccgtacgcaccaggagcatgtgtggtgttgtcagatgacatgaaagcaacttgcagctcaagaggaagaacattcttcaaagatggatgtccaagcaagtttgggttcttagctatagtgtttttggggctttacatcgtagtctacgcaccaggtatgggcactgtcccgtggatcgtcaactctgagatctatccgctcagatacagaggtcttggtggaggaatagccgccgtctcgaattgggtctccaacctgatagtgagtgagagcttcctctcactcacccatgctctcggctcctctggtaccttccttctctttgctggcttctccacgatcgggctcttcttcatttggttgctcgttcctgagaccaaagggcttcagtttgaggaggtcgagaagttgctcgaggtcggcttcaagcccagtctcttgcggcggagggagaagaagggcaaagaagtcgatgctgcttaagacgatgatgatcacttatctctctctttct

SEQ ID NO: 4559 - protein, 582 aa, Arabidopsis thaliana (mouse-ear cress)
MVEGGIAKADKTEFTECWRTTWKTPYIMRLALSAGIGGLLFGYDTGVISGALLFIKEDFDEVDKKTWLQSTIVSMAVAGAIVGAAVGGWINDKFGRRMSILIADVLFLIGAIVMAFAPAPWVIIVGRIFVGFGVGMASMTSPLYISEASPARIRGALVSTNGLLITGGQFFSYLINLAFVHTPGTWRWMLGVAGVPAIVQFVLMLSLPESPRWLYRKDRIAESRAILERIYPADEVEAEMEALKLSVEAEKADEAIIGDSFSAKLKGAFGNPVVRRGLAAGITVQVAQQFVGINTVMYYSPSIVQFAGYASNKTAMALSLITSGLNALGSIVSMMFVDRYGRRKLMIISMFGIIACLIILATVFSQAAIHAPKIDAFESRTFAPNATCSAYAPLAAENAPPSRWNCMKCLRSECGFCASGVQPYAPGACVVLSDDMKATCSSRGRTFFKDGCPSKFGFLAIVFLGLYIVVYAPGMGTVPWIVNSEIYPLRYRGLGGGIAAVSNWVSNLIVSESFLSLTHALGSSGTFLLFAGFSTIGLFFIWLLVPETKGLQFEEVEKLLEVGFKPSLLRRREKKGKEVDAA

SEQ ID NO: 4560 - DNA, 1566 bp, Arabidopsis thaliana (mouse-ear cress)
  CDS (1)..(1566)
atgacattgacgatcccaaacgcacctgggagctccgggtacttggatatgttcccagagagaaggatgtcgtattttgggaattcttacattctgggtttgactgtcactgccggaatcggtggccttctgttcggttatgatacaggtgtaatttccggtgcccttttgtacattaaggatgatttcgaagttgttaagcagagcagtttcttacaggtatataatgtttctagctttacctcttccaagctggaaactattgtaagtatggctttagttggtgccatgattggtgctgcagctggaggttggatcaatgactactacggtcgtaaaaaggcgactctttttgcagatgttgtctttgcagctggagctatcgttatggctgctgctcctgatccgtatgttttgatatcgggtcgtctcttggtcggtttaggagttggtgttgcttctgtgactgctccggtttatatagcggaagcatctccatcggaagttagaggtggacttgtgagcaccaacgtattgatgatcactggtggacagtttctttcatatctcgttaattctgctttcacacaggttccaggaacatggagatggatgcttggtgtttcaggcgttcccgctgtgattcagttcatcctcatgcttttcatgccagaatcccctcgatggcttttcatgaaaaatcgtaaagcggaagccatccaagtgctcgccagaacctatgacatctcgcggttagaagacgagattgatcatctttcagcggctgaagaggaagaaaaacaaaggaagcgcactgttggctacttggatgttttcagatccaaagaattgagacttgcatttcttgccggagcaggacttcaggcgtttcagcagttcactggtatcaatacagttatgtactacagccctacgatagtccaaatggctggatttcactcaaaccagctcgctttgttcctgtctctcattgttgctgccatgaatgctgctggaacagtcgtggggatttacttcatcgatcattgtggaaggaaaaagctagctctctcaagtttatttggcgtcattatatcactcttaatcctctcagtctcgtttttcaaacaatctgagacatcatctgatggagggctctatggttggctcgctgtgcttggcttagctctatacattgttttctttgcaccgggaatgggaccagtcccatggacggtgaactcagagatataccctcaacaataccgaggcatatgcggaggcatgtcagctacagttaactggatcagcaatttgattgtggcacaaacattcttgacaatcgcggaagctgctggaacaggaatgactttcttgattttggcgggaattgcggttcttgctgtaatctttgtgattgtgtttgtccctgagactcaagggctaacgttttcggaagttgaacagatttggaaagaaagagcttatggaaatatcagtggctggggcagtagcagtgatagcaacaacatggaagggttactcgagcagggatctcaatcttaa

SEQ ID NO: 4561 - protein, 521 aa, Arabidopsis thaliana (mouse-ear cress)
MTLTIPNAPGSSGYLDMFPERRMSYFGNSYILGLTVTAGIGGLLFGYDTGVISGALLYIKDDFEVVKQSSFLQVYNVSSFTSSKLETIVSMALVGAMIGAAAGGWINDYYGRKKATLFADVVFAAGAIVMAAAPDPYVLISGRLLVGLGVGVASVTAPVYIAEASPSEVRGGLVSTNVLMITGGQFLSYLVNSAFTQVPGTWRWMLGVSGVPAVIQFILMLFMPESPRWLFMKNRKAEAIQVLARTYDISRLEDEIDHLSAAEEEEKQRKRTVGYLDVFRSKELRLAFLAGAGLQAFQQFTGINTVMYYSPTIVQMAGFHSNQLALFLSLIVAAMNAAGTVVGIYFIDHCGRKKLALSSLFGVIISLLILSVSFFKQSETSSDGGLYGWLAVLGLALYIVFFAPGMGPVPWTVNSEIYPQQYRGICGGMSATVNWISNLIVAQTFLTIAEAAGTGMTFLILAGIAVLAVIFVIVFVPETQGLTFSEVEQIWKERAYGNISGWGSSSDSNNMEGLLEQGSQS

SEQ ID NO: 4562 - DNA, 2890 bp, Saccharomyces cerevisiae
  CDS (818)..(2443)
aaaaagaaatattattcattactatcaagataccgtagaaaagaaaaagaaccggggatgaataataacaaaacgggctgctttttctttttctctttctttttcatttggtccctctccactctttctccacgtggctttgcttcccgtatttttcttcgtcagagagactacatgatagtccaaagaaaagaaacaggggggacgaagaagaggagaggaaaaaccaaaatataattttccgtgaaatagattctttttctccactgcacgacttcttctcctcccacaaaaaatgacgcctcatagacagccccgcagcttcacttttaagtttctttttctcctcacggcgcaaccgctaacttaagctaatccttatgaatccggagaaaagcggggtcttttaactcaataaaattttccgaaatcctttttcctacgcgttttcttcgggaactagataggtggctcttccacctgtttttccatcattttagtttttcgcaagccatgcgtgccttttcgtttttgcgatggcgaacgagggctggaaaaattaacggtacgccgcctaacgatagtaataggccacgcaactggcgtggacgacaacaataagtcgcccattttttatgttttcaaaacctagcaacccccaccaaacttgtcatcgttcccggattcacaaatgatataaaaagcgattacaattctacattctaaccagatttgagatttcctctttctcaattcctcttatattagattataagaacaacaaattaaattacaaaaagacttataaagcaacataatgtctgaattcgctactagccgcgttgaaagtggctctcaacaaacttctatccactctactccgatagtgcagaaattagagacggatgaatctcctattcaaaccaaatctgaatacactaacgctgaactcccagcaaagccaatcgccgcatattggactgttatctgtttatgtctaatgattgcatttggtgggtttgtctttggttgggatactggtaccatctctggttttgttaatcaaaccgatttcaaaagaagatttggtcaaatgaaatctgatggtacctattatctttcggacgtccggactggtttgatcgttggtatcttcaatattggttgtgcctttggtgggttaaccttaggacgtctgggtgatatgtatggacgtagaattggtttgatgtgcgtcgttctggtatacatcgttggtattgtgattcaaattgcttctagtgacaaatggtaccaatatttcattggtagaattatctctggtatgggtgtcggtggtattgctgtcctatctccaactttgatttccgaaacagcaccaaaacacattagaggtacctgtgtttctttctatcagttaatgatcactctaggtattttcttaggttactgtaccaactatggtactaaagactactccaattcagttcaatggagagtgcctttgggtttgaactttgccttcgctattttcatgatcgctggtatgctaatggttccagaatctccaagattcttagtcgaaaaaggcagatacgaagacgctaaacgttctttggcaaaatctaacaaagtcaccattgaagatccaagtattgttgctgaaatggatacaattatggccaacgttgaaactgaaagattagccggtaacgcttcttggggtgagttattctccaacaaaggtgctattttacctcgtgtgattatgggtattatgattcaatccttacaacaattaactggtaacaattacttcttctattatggtactactattttcaacgccgtcggtatgaaagattctttccaaacttccatcgttttaggtatagtcaacttcgcatccactttcgtggccttatacactgttgataaatttggtcgtcgtaagtgtctattgggtggttctgcttccatggccatttgttttgttatcttctctactgtcggtgtcacaagcttatatccaaatggtaaagatcaaccatcttccaaggctgccggtaacgtcatgattgtctttacctgtttattcattttcttcttcgctattagttgggccccaattgcctacgttattgttgccgaatcctatcctttgcgtgtcaaaaatcgtgctatggctattgctgttggtgccaactggatttggggtttcttgattggtttcttcactcccttcattacaagtgcaattggattttcatacgggtatgtcttcatgggctgtttggtattttcattcttctacgtgtttttctttgtctgtgaaaccaagggcttaacattagaggaagttaatgaaatgtatgttgaaggtgtcaaaccatggaaatctggtagctggatctcaaaagaaaaaagagtttccgaggaataagagattatacttaaactagcactgatttttttaaggctaatggctactaatactttaatagatgatcttcatacttttttatttaacgatttttaatgatgtttttatttgtaccactcatttatctagatttttttaatactgatcaaatcttacggactcgacgttaaaaagttcctacatacgtctggtacttgaaacgctgcttcgaggtattgacactataagaatacgatccaaatacttacaccgcatgtaaaaatatgccgacaatatgaatacttgttgatgaatgatatttgattttaatccggcaatttacctcctttatataatccaataattgttgataattagtggttaggttgcagtactaataagaattaagacaaatattcttctactatataaaaggtgcaaacaaaacacacgccgatcggccatact

SEQ ID NO: 4563 - protein, 541 aa, Saccharomyces cerevisiae
MSEFATSRVESGSQQTSIHSTPIVQKLETDESPIQTKSEYTNAELPAKPIAAYWTVICLCLMIAFGGFVFGWDTGTISGFVNQTDFKRRFGQMKSDGTYYLSDVRTGLIVGIFNIGCAFGGLTLGRLGDMYGRRIGLMCVVLVYIVGIVIQIASSDKWYQYFIGRIISGMGVGGIAVLSPTLISETAPKHIRGTCVSFYQLMITLGIFLGYCTNYGTKDYSNSVQWRVPLGLNFAFAIFMIAGMLMVPESPRFLVEKGRYEDAKRSLAKSNKVTIEDPSIVAEMDTIMANVETERLAGNASWGELFSNKGAILPRVIMGIMIQSLQQLTGNNYFFYYGTTIFNAVGMKDSFQTSIVLGIVNFASTFVALYTVDKFGRRKCLLGGSASMAICFVIFSTVGVTSLYPNGKDQPSSKAAGNVMIVFTCLFIFFFAISWAPIAYVIVAESYPLRVKNRAMAIAVGANWIWGFLIGFFTPFITSAIGFSYGYVFMGCLVFSFFYVFFFVCETKGLTLEEVNEMYVEGVKPWKSGSWISKEKRVSEE

SEQ ID NO: 4564 - DNA, 1704 bp, Kluyveromyces marxianus var. lactis, Candida sphaerica
  CDS (1)..(1704)
atgtctaatcaaatgacagatagtacgagtgctggaagtggcactgaacattccgtcgacactaataccgcattaaaagccggtagtcccaatgaccttaaggtatcgcatgaagaggatttgaatgaccttgaaaagacagccgaagaaaccttacaacaaaagccagcaaaggaatacatatttgtttcattatgttgtgttatggttgcctttggtggtttcgttttcggttgggatactggtaccatttctggttttgttaaccaaactgatttccttagaagattcggtcaagaaaaggccgatggttctcactacttgtccaatgttagaactggtttgattgtttccattttcaatattggttgtgccgttggtggtattgttttgtctaacatcggtgatagatggggtcgtagaattggtttgattaccgttattataatctatgttattggtatcattattcaaattgcatctgtggacaaatggtaccaatatttcattggtagaattatttctggtttaggtgttggtggtatcacagttttgtcgccaatgttgatttcggaaaccgctcctaaacatttaagaggtactttggtctcatgttaccaattgatgattacttttggtattttcttgggttactgtactaactacggtaccaagaactactctaactctgtccaatggagagttccattaggtctatgtttcgcttgggccatctttatggttcttggtatgatgtttgttccagaatctgcaagattcttggttgaaactgatcaaattgaagaggccagaaaatctttggcaaagaccaacaaagtttctattgacgatcctgttgtgaaatatgagctcctaaagatccaatccagtatcgaattggaaaaggctgcaggtaacgcatcatggggtgaattgattaccggtaagccaagtatgttcagacgtactttaatgggtattatgattcaatctctgcaacaattgactggtgataactatttcttctattacggtaccacaattttccaatctgtcggtatggacgattctttcgaaacttcgatcgtcttgggtatcgtgaacttcgcttctaccttctttgctttatacacagttgatcatttcggtcgtcgtaactgtctattatacggttgtgttggtatggttgcatgttacgttgtttatgcatctgttggtgttacaagattatggccagacggtccagatcatcctgatatttcttccaagggtgctggtaactgtatgattgtctttgcgtgcttttatatcttctgtttcgctactacttgggctccaatcgcatacgtggttatctccgaatcctatccacttagagttaagggtaaggcaatggctatcgcttccgcctcgaactggatctggggtttcctgattgggttcttcacaccatttattacatctgctattcacttctactacggttacgtctttatgggttgtatggtattcgccttcttctacgtctacttcttcgttcctgaaaccaagggtctaactttggaagaagttaatgaaatgtactctgaaggtgtcctaccatggaaatcttcatcatgggtcccatcttcaagaagaggtgcagagtacgatgtcgatgctttgcaacatgacgacaagccatggtacaaggctatgttgtaa

SEQ ID NO: 4565 - protein, 567 aa, Kluyveromyces marxianus var. lactis, Candida sphaerica
MSNQMTDSTSAGSGTEHSVDTNTALKAGSPNDLKVSHEEDLNDLEKTAEETLQQKPAKEYIFVSLCCVMVAFGGFVFGWDTGTISGFVNQTDFLRRFGQEKADGSHYLSNVRTGLIVSIFNIGCAVGGIVLSNIGDRWGRRIGLITVIIIYVIGIIIQIASVDKWYQYFIGRIISGLGVGGITVLSPMLISETAPKHLRGTLVSCYQLMITFGIFLGYCTNYGTKNYSNSVQWRVPLGLCFAWAIFMVLGMMFVPESARFLVETDQIEEARKSLAKTNKVSIDDPVVKYELLKIQSSIELEKAAGNASWGELITGKPSMFRRTLMGIMIQSLQQLTGDNYFFYYGTTIFQSVGMDDSFETSIVLGIVNFASTFFALYTVDHFGRRNCLLYGCVGMVACYVVYASVGVTRLWPDGPDHPDISSKGAGNCMIVFACFYIFCFATTWAPIAYVVISESYPLRVKGKAMAIASASNWIWGFLIGFFTPFITSAIHFYYGYVFMGCMVFAFFYVYFFVPETKGLTLEEVNEMYSEGVLPWKSSSWVPSSRRGAEYDVDALQHDDKPWYKAML

SEQ ID NO: 4566 - DNA, 1853 bp, Nicotiana tabacum (common tobacco)
  CDS (103)..(1674)
atttctacagtttacgattacagttctctctcaacttttttcttttttcttgatcatttcttgtgccacaagttgttcttgttttgtgatcagctcagaaagatggctggtggtggtggtattggtcccggcaacgggaaagaatatcccggcaatttaactctttatgttaccgttacgtgcattgtcgctgccatgggtggtctcattttcggttacgatattggaatttctggaggtgtgacatcaatggactcattcttgagcagatttttcccatctgtgttcaggaagcaaaaggcagatgattcaacaaatcaatactgcaaatttgacagccaaacattgacgatgttcacgtcgtcattgtacttggctgctcttttgtcgtctctggtggcatctactgtcaccagaaaacttggacggagactttctatgctctgtggaggtgtcctcttctgtgctggagctttgatcaatggctttgctcagaatgttgctatgctcattgttggtcgtattttactaggttttggtattggattcgccaatcagtctgttccactatacctatctgaaatggctccatacaagtacagaggagcactcaacctaggttttcaactgtccattacaattggtatacttgtagcaaatgtgttgaactatttctttgccaagattcattggggatggagattaagcttaggaggtgctatggtacctgcattgatcatcacaataggctcacttttccttcccgagacaccaaactccatgatcgaacgtggcaatcacgacgaagccaaagctaggcttaaaagaatcagaggcattgatgatgtagacgaagagttcaatgatttagtcgtggcgagtgaggcttctaggaaaattgagaacccttggagaaatttgttgcaaaggaaatataggccacatctcacaatggcaattatgatcccatttttccagcaacttactggaatcaatgtgattatgttctatgcaccagttttgtttaagactattggttttggtgctgatgcttcccttatgtctgctgttattactggtggagtcaatgtacttgcaactgttgtttctatttactatgttgataaattgggaagaagattcttgttccttgaaggtggcattcaaatgctcatctgccaaatagcggtgtcaatttgcatagctataaaatttggagtgaatggaactccaggggatttaccaaagtggtacgcgatagtagtggtgatattcatctgtgtttatgtagctggatttgcttggtcctggggacctctaggatggttggtacctagtgaaattttcccacttgaaattcgatcagctgctcaaagtatcaatgtttcagtgaacatgatcttcacatttatagtggcacaagtattcttgacaatgttgtgtcatttgaagtttggattgttcctcttctttgcattctttgttgtgattatgactgtcttcatttacttcttcttgcctgagacaaagaatatcccaattgaagagatggtgattgtgtggaaagagcattggttctggtctaagttcatgactgaagtggactatcctggaactaggaatggaacaagtgttgaaatgtcaaaagggagtgctggttacaaaatagtatgacctaattaaagaagatgtttggatttattttaattttatttgttgttgtataatgttttagtgggatgatattgttagatttgaactgtttctcttgtctctattgcatagaaaatacatactttactgtgttcaatttcaacctctcaacaattaatataagatttgtcagagcaaaa

SEQ ID NO: 4567 - protein, 523 aa, Nicotiana tabacum (common tobacco)
MAGGGGIGPGNGKEYPGNLTLYVTVTCIVAAMGGLIFGYDIGISGGVTSMDSFLSRFFPSVFRKQKADDSTNQYCKFDSQTLTMFTSSLYLAALLSSLVASTVTRKLGRRLSMLCGGVLFCAGALINGFAQNVAMLIVGRILLGFGIGFANQSVPLYLSEMAPYKYRGALNLGFQLSITIGILVANVLNYFFAKIHWGWRLSLGGAMVPALIITIGSLFLPETPNSMIERGNHDEAKARLKRIRGIDDVDEEFNDLVVASEASRKIENPWRNLLQRKYRPHLTMAIMIPFFQQLTGINVIMFYAPVLFKTIGFGADASLMSAVITGGVNVLATVVSIYYVDKLGRRFLFLEGGIQMLICQIAVSICIAIKFGVNGTPGDLPKWYAIVVVIFICVYVAGFAWSWGPLGWLVPSEIFPLEIRSAAQSINVSVNMIFTFIVAQVFLTMLCHLKFGLFLFFAFFVVIMTVFIYFFLPETKNIPIEEMVIVWKEHWFWSKFMTEVDYPGTRNGTSVEMSKGSAGYKIV

SEQ ID NO: 4568 - DNA, 2114 bp, Saccharomyces cerevisiae
  CDS (373)..(2076)
ggatcggtaactctgattatcacagagaaagcttcgtggagaatttttccagattttccgctttccccgatgttggtatttccggaggtcattatactgaccgccattataatgactgtacaacgaccttctggagaaagaaacaactcaataacgatgtgggacattgggggcccactcaaaaaatctggggactatatccccagagaatttctccagaagagaagaaaagtcaaagttttttttcgcttgggggttgcatataaatacaggcgctgttttatcttcagcatgaatattccataattttacttaatagcttttcataaataatagaatcacaaacaaaatttacatctgagttaaacaatcatgaattcaactccagatttaatatctccacaaaagtcaagtgagaattcgaatgctgacctgccttcgaatagctctcaggtaatgaacatgcctgaagaaaaaggtgttcaagatgatttccaagctgaggccgaccaagtacttaccaacccaaatacaggtaaaggtgcatatgtcactgtgtctatctgttgtgttatggttgccttcggtggtttcgttttcggttgggatactggtaccatttctggtttcgtcgcccaaactgatttcttgagaagattcggtatgaagcataaagatggtagttattatttgtctaaggttagaactggtttaattgtctccattttcaacattggttgtgccattggtggtattattttggctaaattgggtgatatgtacggtcgtaaaatgggtttgattgtcgttgttgttatctacatcatcggtattattattcaaattgcatccatcaacaaatggtaccaatatttcatcggtagaattatttccggtttgggtgttggtggtattgccgttttatctcctatgttgatttctgaagtcgctcctaaggaaatgagaggtactttagtctcctgttaccaactgatgattaccttgggtattttcttgggttactgtaccaacttcggtactaagaactactccaactctgtgcaatggagagttccattaggtttgtgttttgcctgggctttgtttatgatcggtggtatgactttcgttccagaatccccacgttatttggttgaagctggtcaaattgacgaagcaagagcatctctttccaaagttaacaaggttgccccagaccatccattcattcaacaagagttggaagttattgaagctagtgttgaagaagctagagctgctggttcagcatcatggggtgagttgttcactggtaagccggccatgtttaagcgtactatgatgggtatcatgatccaatctctacaacaattgactggtgataactatttcttctactatggtactaccgtttttaacgctgttggtatgagtgattctttcgaaacttctattgttttcggtgtcgtcaacttcttctctacttgttgttctttgtacactgtcgatcgttttggacgtcgtaactgtttgttatatggtgccattggtatggtctgctgttatgtagtttacgcttctgttggtgtcaccagactatggccaaatggtgaaggtaatggttcatccaagggtgctggtaactgtatgattgtctttgcctgtttctatattttctgttttgctaccacttgggctccaattgcttatgttgttatttctgaaactttcccattgagagtcaagtctaaggctatgtctattgctacagctgctaattggttgtggggtttcttgattggtttcttcactccatttattactggtgctattaacttctactacggttacgttttcatgggctgtatggttttcgcctacttctacgttttcttctttgtgccagaaactaagggtttgactttggaagaagtcaatgatatgtacgctgaaggtgttctaccatggaagtctgcttcatgggttccaacatctcaaagaggtgctaactacgatgctgatgcattgatgcatgatgaccagccattctacaagaaaatgttcggcaagaaataatttcacgctaaaccgtagtgctgaataatagtgtattt

SEQ ID NO: 4569 - protein, 567 aa, Saccharomyces cerevisiae
MNSTPDLISPQKSSENSNADLPSNSSQVMNMPEEKGVQDDFQAEADQVLTNPNTGKGAYVTVSICCVMVAFGGFVFGWDTGTISGFVAQTDFLRRFGMKHKDGSYYLSKVRTGLIVSIFNIGCAIGGIILAKLGDMYGRKMGLIVVVVIYIIGIIIQIASINKWYQYFIGRIISGLGVGGIAVLSPMLISEVAPKEMRGTLVSCYQLMITLGIFLGYCTNFGTKNYSNSVQWRVPLGLCFAWALFMIGGMTFVPESPRYLVEAGQIDEARASLSKVNKVAPDHPFIQQELEVIEASVEEARAAGSASWGELFTGKPAMFKRTMMGIMIQSLQQLTGDNYFFYYGTTVFNAVGMSDSFETSIVFGVVNFFSTCCSLYTVDRFGRRNCLLYGAIGMVCCYVVYASVGVTRLWPNGEGNGSSKGAGNCMIVFACFYIFCFATTWAPIAYVVISETFPLRVKSKAMSIATAANWLWGFLIGFFTPFITGAINFYYGYVFMGCMVFAYFYVFFFVPETKGLTLEEVNDMYAEGVLPWKSASWVPTSQRGANYDADALMHDDQPFYKKMFGKK

SEQ ID NO: 4570 - DNA, 2160 bp, Saccharomyces cerevisiae
  CDS (216)..(1928)
gaaactccaccattatctaatgtagcaaaatatttcttaacacccgaagttgcgtgtccccctcacgtttttaatcatttgaattagtatattgaaattatatataaaggcaacaatgtccccataatcaattccatctggggtctcatgttctttccccaccttaaaatctataaagatatcataatcgtcaactagttgatatacgtaaaatcatgaattcaactcccgatctaatatctcctcagaaatccaattcatccaactcatatgaattggaatctggtcgttcaaaggccatgaatactccagaaggtaaaaatgaaagttttcacgacaacttaagtgaaagtcaagtgcaacccgccgttgcccctccaaacaccggaaaaggtgtctacgtaacggtttctatctgttgtgttatggttgctttcggtggtttcatatttggatgggatactggtaccatttctggttttgttgctcaaactgattttctaagaagatttggtatgaagcaccacgacggtagtcattacttgtccaaggtgagaactggtttaattgtctctatttttaacattggttgtgccattggtggtatcgtcttagccaagctaggtgatatgtatggtcgtagaatcggtttgattgtcgttgtagtaatctacactatcggtatcattattcaaatagcctcgatcaacaagtggtaccaatatttcattggtagaattatctctggtttaggtgtcggtggtatcacagttttatctcccatgctaatatctgaggtcgcccccagtgaaatgagaggcaccttggtttcatgttaccaagtcatgattactttaggtattttcttaggttactgtaccaattttggtaccaagaattactcaaactctgtccaatggagagttccattaggtttgtgtttcgcctgggccttatttatgattggtggtatgatgtttgttcctgaatctccacgttatttggttgaagctggcagaatcgacgaagccagggcttctttagctaaagttaacaaatgcccacctgaccatccatacattcaatatgagttggaaactatcgaagccagtgtcgaagaaatgagagccgctggtactgcatcttggggcgaattattcactggtaaaccagccatgtttcaacgtactatgatgggtatcatgattcaatctctacaacaattaactggtgataactatttcttctactacggtaccattgttttccaggctgtcggtttaagtgactcttttgaaacttctattgtctttggtgtcgtcaacttcttctccacttgttgttctctgtacaccgttgaccgttttggccgtcgtaactgtttgatgtggggtgctgtcggtatggtctgctgttatgttgtctatgcctctgttggtgttaccagattatggccaaacggtcaagatcaaccatcttcaaagggtgctggtaactgtatgattgttttcgcatgtttctacattttctgtttcgctactacctgggccccaattgcttacgttgttatttcagaatgtttcccattaagagtcaaatccaagtgtatgtctattgccagtgctgctaactggatctggggtttcttgattagtttcttcaccccatttattactggtgccatcaacttctactacggttacgttttcatgggctgtatggttttcgcttacttttacgtctttttcttcgttccagaaactaaaggtttatcattagaagaagttaatgatatgtacgccgaaggtgttctaccatggaaatcagcttcctgggttccagtatccaagagaggcgctgactacaacgctgatgacctaatgcatgatgaccaaccattttacaagagtttgtttagcaggaaataaactaaacaagctcaatatgcatattttaatgacttatacagtatttaatttctcagtaaattttataaaggtgatattatattggtgttaaaacaaaattcttgtcaaattcataaacagatgttcttttctttgctagttcttgaccttcaccaaggaacaagaaatttcattctggcactcttccgaggaaaaattttatatgatatagtatgggttaataccacatagg

SEQ ID NO: 4571 - protein, 570 aa, Saccharomyces cerevisiae
MNSTPDLISPQKSNSSNSYELESGRSKAMNTPEGKNESFHDNLSESQVQPAVAPPNTGKGVYVTVSICCVMVAFGGFIFGWDTGTISGFVAQTDFLRRFGMKHHDGSHYLSKVRTGLIVSIFNIGCAIGGIVLAKLGDMYGRRIGLIVVVVIYTIGIIIQIASINKWYQYFIGRIISGLGVGGITVLSPMLISEVAPSEMRGTLVSCYQVMITLGIFLGYCTNFGTKNYSNSVQWRVPLGLCFAWALFMIGGMMFVPESPRYLVEAGRIDEARASLAKVNKCPPDHPYIQYELETIEASVEEMRAAGTASWGELFTGKPAMFQRTMMGIMIQSLQQLTGDNYFFYYGTIVFQAVGLSDSFETSIVFGVVNFFSTCCSLYTVDRFGRRNCLMWGAVGMVCCYVVYASVGVTRLWPNGQDQPSSKGAGNCMIVFACFYIFCFATTWAPIAYVVISECFPLRVKSKCMSIASAANWIWGFLISFFTPFITGAINFYYGYVFMGCMVFAYFYVFFFVPETKGLSLEEVNDMYAEGVLPWKSASWVPVSKRGADYNADDLMHDDQPFYKSLFSRK

SEQ ID NO: 4572 - DNA, 2209 bp, Saccharomyces cerevisiae
  CDS (213)..(1925)
aaaaggaggaaaatacaaaatatactagaactgaaaaaaaaaaagtataaatagagacgatatatgccaatacttcacaatgttcgaatctattcttcatttgcagctattgtaaaataataaaacatcaagaacaaacaagctcaacttgtcttttctaagaacaaagaataaacacaaaaacaaaaagtttttttaattttaatcaaaaaatgtcacaagacgctgctattgcagagcaaactcctgtggagcatctctctgctgttgactcagcctcccactcggttttatctacaccatcaaacaaggctgaaagagatgaaataaaagcttatggtgaaggtgaagagcacgaacctgtcgttgaaattccaaagagaccagcttctgcctatgtcactgtctctattatgtgtatcatgatcgcctttggtggtttcgttttcggttgggatactggtaccatttctggtttcatcaatcaaaccgatttcatcagaagatttggtatgaagcataaagatggtactaattatttgtctaaggttagaactggtttgattgtctccattttcaacattggttgtgccattggtggtattattctttccaaattgggtgatatgtacggtcgtaaggtgggtttgattgtcgttgttgtcatctacatcatcggtattattattcaaattgcatctatcaacaaatggtaccaatatttcatcggtagaattatttccggtttgggtgttggtggtattgccgttttatctcctatgttgatttctgaagtatccccaaagcatttaaggggtactttagtctcttgctaccaattgatgattactgccggtattttcttgggttactgtaccaacttcggtactaagaactactccaactctgtgcaatggagagttccattaggtttgtgttttgcctgggctttgtttatgattggtggtatgacatttgttccagagtctccacgttatttggctgaagtcggtaagatcgaagaagccaaacgttctattgccgtttctaacaaggttgctgttgatgatccatctgttttggctgaagtcgaagctgtcttggctggtgtagaggcagagaaattagctggtaatgcatcctggggtgaattgtttagtagcaagacaaaggtccttcagcgtttgatcatgggtgctatgattcaatctctacaacaattgacaggtgataactatttcttctactatggtactactattttcaaggctgttggtttgagtgactctttcgaaacctctattgtcttgggtattgttaactttgcttccacctttgttggtatttacgttgttgagagatatggtcgtcgtacttgtttgctatggggtgctgcatccatgactgcttgtatggttgtctatgcttccgtgggtgtcaccagattatggccaaatggtcaagaccaaccatcttccaagggtgctggtaactgtatgattgtctttgcctgtttctatattttctgttttgctactacatgggctccaattccttatgtcgttgtttctgaaactttcccattgagagtcaagtctaaggctatgtctattgctacagctgctaattggttgtggggtttcttgattggtttcttcactccatttattactggtgctattaacttctactacggttacgttttcatgggctgtttggtcttcatgttcttctatgttttgttagttgttccagaaactaagggtttgactttggaagaagtcaacaccatgtgggaagaaggtgttctaccatggaagtctgcctcatgggttccaccatccagaagaggtgccaactacgacgctgaagaaatgactcacgatgacaagccattgtacaagagaatgttcagcaccaaataatttgcgaacacttttattaattcatgatcacgctctaatttgtgcatttgaaatgtactctaattctaattttatatttttaatgatatcttgaaaagtaaatacgtttttaatatataccaaaataatacagtttaattttcaagtttttgatcatttgttctcagaaagttgagtgggacggagacaaagaaactttaaagagaaatgcaaagtgggaagaagtcagttgtttaccgaccgcactgttattcacaaatattccaattttgcctgcaggtcga

SEQ ID NO: 4573 - protein, 570 aa, Saccharomyces cerevisiae
MSQDAAIAEQTPVEHLSAVDSASHSVLSTPSNKAERDEIKAYGEGEEHEPVVEIPKRPASAYVTVSIMCIMIAFGGFVFGWDTGTISGFINQTDFIRRFGMKHKDGTNYLSKVRTGLIVSIFNIGCAIGGIILSKLGDMYGRKVGLIVVVVIYIIGIIIQIASINKWYQYFIGRIISGLGVGGIAVLSPMLISEVSPKHLRGTLVSCYQLMITAGIFLGYCTNFGTKNYSNSVQWRVPLGLCFAWALFMIGGMTFVPESPRYLAEVGKIEEAKRSIAVSNKVAVDDPSVLAEVEAVLAGVEAEKLAGNASWGELFSSKTKVLQRLIMGAMIQSLQQLTGDNYFFYYGTTIFKAVGLSDSFETSIVLGIVNFASTFVGIYVVERYGRRTCLLWGAASMTACMVVYASVGVTRLWPNGQDQPSSKGAGNCMIVFACFYIFCFATTWAPIPYVVVSETFPLRVKSKAMSIATAANWLWGFLIGFFTPFITGAINFYYGYVFMGCLVFMFFYVLLVVPETKGLTLEEVNTMWEEGVLPWKSASWVPPSRRGANYDAEEMTHDDKPLYKRMFSTK

SEQ ID NO: 4574 - DNA, 3025 bp, Saccharomyces cerevisiae
  CDS (510)..(2288)
ctgcagttgatccgcattccccgtggctgtgcacattaggggacagtaagtaattcactttctgatcccgcactcatagcgatggaataatataccggatttcacaccttgttattgagtgaagtactgcttggtgaaatgatatctttatgttcaatattaatggtcgtgtggatgaatatatgggcatgggttaattagttttaggggcacggagtaaacaagaaaggagggccagaatcattagtagagtacctcaagtttggtttctttttgatttcacgtataaaagagtctctctcttttcttttcatgctagtcgaacggttctccctctaagaataagaaactatcaaaagaaagagaaaagtcgattgaataatttttctatatataatatacgcaaacaagattcgctttcactttgcaattttacttcatagctttgttaaaaccagcaaaaaatattatttttctagaaaaaagaatatattagaggtaaagaaagaatgtcggaacttgaaaacgctcatcaaggccccttggaagggtctgctactgtgagcacaaattctaactcatacaacgagaagtcaggaaactcgactgctcctggtaccgccggttacaacgataatttggcacaagctaaacccgtctcaagttacatttcccatgaaggccctcccaaagacgaactggaagagcttcagaaggaggttgacaaacaactagagaagaaatcgaagtcggatttactatttgtatccgtctgctgtttgatggttgcttttggtgggttcgtgtttgggtgggatactggtactatatctggttttgtcaggcaaacagacttcattaggcgatttggcagcacccgtgcaaacgggactacctatctttccgatgtcagaaccggtttgatggtttctattttcaacatcggctgcgctatcggaggtatagttttgtcaaagctcggtgatatgtatggacgtaagattggtctgatgactgttgtcgtcatttactcaattgggatcatcatccaaatcgcctccattgacaaatggtatcaatatttcattggaagaatcatctcaggactgggcgttggtggtattacagttttggcgcctatgctaatttctgaagtgtcgcctaagcagttgcgtggtactctggtttcatgttaccaattaatgatcactttcggtatctttttgggatattgtactaattttggtaccaagaattactcaaactctgtccaatggagggtaccattaggcttatgctttgcatggtctatttttatgattgttggtatgacgttcgttcctgaatccccacgttatctggtagaagtgggaaaaattgaagaggccaagcggtccttagcaagagctaacaaaaccactgaagactctcctttagtaactttagaaatggagaactatcagtcttctattgaagctgagagattggcgggctctgcttcttggggggaattggttactggtaagccccagatgttcagacgtacactaatgggtatgatgattcaatctttacaacagctgacaggtgacaattacttcttttactatggtactacaattttccaggctgttggtttggaagattcatttgaaactgctattgttttgggtgttgttaattttgtttcgacttttttctcgctatataccgtcgatcgttttggtcgtcgtaattgtttgttatggggctgtgtaggtatgatttgttgctatgtcgtctatgcctctgttggtgttaccagattatggccaaacggtcaagatcaaccatcttcaaagggtgctggtaactgtatgattgttttcgcatgtttctacattttctgtttcgctaccacttgggcccccgttgcctatgtccttatctctgagtcgtatcccttaagagtacgtggtaaagcaatgtcgattgcaagtgcctgtaactggatttgggggttcttgatcagttttttcactccatttattacttcagcaatcaatttctattatggctatgtctttatgggttgtatggtgttcgcatacttttatgtgttcttctttgttccagagacaaagggcttaacattagaagaagtcaacgaaatgtatgaagaaaatgtgctaccttggaagtctaccaaatggatcccaccatctaggagaacaacagattatgacctagacgctactagaaatgatccgagaccattttataaaaggatgttcactaaagaaaaataatctcttgtagtgtaggatcaactattttcgcatacttgcaatgttcagcattgcaccatttcaaattttaatattaatattaatcgttttcgttcatatgttcattcatagtttacaaataatgcaatcatatgcagagatattttgtccgtggttaatagggctgcctgttattcctttaattcaactaaattacgtatgtctaataatatcaaaatcatcatgacgtttttgttttttttctttattttaagtaggatcaaaccaggggagaaagggttgctacgcctaacaacaagaacttgtatatcgtttcttgttacttatacttttctgcccacttctctcttacaactgctcgagctcatccttggtaataaaacagtgaggacggttactcgaggtttcaacaggggaaaataaatttatatgatgaatcaagagccccgttcttttaccgtattatccttcatactacatactagggaaagaactgaaaactccgctacctgctgtaacagcgcataataaaaagcaagaatatagacagttactgttgtttacgttctttgatgacatcattctcatcagacatacagaaacacatcctttttgtctaccccgtatttattccaacttcaaagtataggtaccgtccggttatactctcatatactttgtggcagtttgcttctttaaaccttgttaacccagaatattttcagtgcaaaaagctt

SEQ ID NO: 4575 - protein, 592 aa, Saccharomyces cerevisiae
MSELENAHQGPLEGSATVSTNSNSYNEKSGNSTAPGTAGYNDNLAQAKPVSSYISHEGPPKDELEELQKEVDKQLEKKSKSDLLFVSVCCLMVAFGGFVFGWDTGTISGFVRQTDFIRRFGSTRANGTTYLSDVRTGLMVSIFNIGCAIGGIVLSKLGDMYGRKIGLMTVVVIYSIGIIIQIASIDKWYQYFIGRIISGLGVGGITVLAPMLISEVSPKQLRGTLVSCYQLMITFGIFLGYCTNFGTKNYSNSVQWRVPLGLCFAWSIFMIVGMTFVPESPRYLVEVGKIEEAKRSLARANKTTEDSPLVTLEMENYQSSIEAERLAGSASWGELVTGKPQMFRRTLMGMMIQSLQQLTGDNYFFYYGTTIFQAVGLEDSFETAIVLGVVNFVSTFFSLYTVDRFGRRNCLLWGCVGMICCYVVYASVGVTRLWPNGQDQPSSKGAGNCMIVFACFYIFCFATTWAPVAYVLISESYPLRVRGKAMSIASACNWIWGFLISFFTPFITSAINFYYGYVFMGCMVFAYFYVFFFVPETKGLTLEEVNEMYEENVLPWKSTKWIPPSRRTTDYDLDATRNDPRPFYKRMFTKEK

SEQ ID NO: 4576 - DNA, 1463 bp, Klebsiella oxytoca
  CDS (27)..(1445)
gtcttacttcgtctggcaggaaaaaaatgaccactctcagtcacgactctacaaccatgccgcgtacgcagcgcgatacccggcgcatgaatcagtttgtctccattgccgccgcggtggcagggttgctgtttggcctcgatatcggggtgattgccggggcgctgccctttattaccgaccattttgttttatccagccgcctgcaggagtgggtggtgagcagcatgatgctgggagccgccatcggcgcgttatttaacggctggctctctttccgcctcgggcgcaaatacagcctgatggtgggcgcggtgctgttcgttgccggctccgtgggctccgcgtttgcgaccagcgtcgaaatgctgctggtggcaaggatcgttctcggggtcgccgtggggatcgcctcttataccgcgccgctgtacctgtcggaaatggcgagcgaaaacgtgcgcggcaagatgatcagcatgtatcagctgatggtgacgctgggtatcgtgatggcgtttctctccgacaccgcgttcagctacagcggcaactggcgggcgatgcttggcgtactggcgctgccggcggtggtgctgattattctggtgatcttcctgccgaacagcccgcgctggctggcggaaaaagggcgtcacgtggaagcggaagaggtgctgcggatgctgcgcgacacgtcagaaaaagcccgtgacgagctcaacgagatccgcgaaagcctgaagctgaagcagggcggctgggcgctgtttaaggtcaaccgcaacgtgcggcgggcggtattcctcggcatgctgttgcaggcgatgcagcagtttaccggtatgaatatcatcatgtactacgcgccgcgcatctttaaaatggcgggcttcaccaccaccgaacagcagatggtcgcgaccctggtggttggcctgacctttatgttcgccacctttatcgccgtctttaccgtcgataaggccggacgtaagccggcgctgaaaatcggttttagcgtgatggccatcggcacgctggtgctgggctactgtctgatgcagtttgataacggcaccgcctccagcggtctctcctggctgtcggtggggatgaccatgatgtgtatcgccggctatgcgatgagcgccgcgccggtggtgtggatcctgtgttcggaaattcagccgctgaagtgccgcgatttcggcatcacctgctcaaccaccaccaactgggtgtcgaacatgattatcggcgcgaccttcctgacgctgctggacgcgatcggcgcggcaggaaccttctggctttataccgcgctgaacgtcgcctttatcggcgtgacgttctggctgatcccggaaaccaaaaacgtcaccctggagcatattgaacgcaggctgatgtccggcgagaagctgcgcaatatcggcaattaattacaacgactcgcgcgg

SEQ ID NO: 4577 - protein, 472 aa, Klebsiella oxytoca
MTTLSHDSTTMPRTQRDTRRMNQFVSIAAAVAGLLFGLDIGVIAGALPFITDHFVLSSRLQEWVVSSMMLGAAIGALFNGWLSFRLGRKYSLMVGAVLFVAGSVGSAFATSVEMLLVARIVLGVAVGIASYTAPLYLSEMASENVRGKMISMYQLMVTLGIVMAFLSDTAFSYSGNWRAMLGVLALPAVVLIILVIFLPNSPRWLAEKGRHVEAEEVLRMLRDTSEKARDELNEIRESLKLKQGGWALFKVNRNVRRAVFLGMLLQAMQQFTGMNIIMYYAPRIFKMAGFTTTEQQMVATLVVGLTFMFATFIAVFTVDKAGRKPALKIGFSVMAIGTLVLGYCLMQFDNGTASSGLSWLSVGMTMMCIAGYAMSAAPVVWILCSEIQPLKCRDFGITCSTTTNWVSNMIIGATFLTLLDAIGAAGTFWLYTALNVAFIGVTFWLIPETKNVTLEHIERRLMSGEKLRNIGN

SEQ ID NO: 4578 - DNA, 1695 bp, Saccharomyces cerevisiae
  CDS (1)..(1695)
atgtctagtgcgcaatcctctattgatagcgatggagatgttcgagatgctgatattcatgtcgcaccacccgtggaaaaagagtggtcagatggatttgatgacaacgaagtcataaacggggataacgttgagccaccaaaaagagggctcataggttatcttgtcatttacttactgtgttatccaatatcctttgggggtttcctgcctggttgggatagtggtatcacagcaggtttcattaacatggacaactttaaaatgaacttcggttcttacaagcatagcactggtgaatattatttgagcaacgtgcgtatgggtcttcttgtggctatgttcagtattggatgtgccataggtggccttatttttgcccgtcttgctgatactttaggtagaaggctggcaattgtgatcgtggtgttggtatatatggttggtgcaattattcagatcagttcaaatcacaaatggtaccagtactttgtcggtaagatcatctacggtcttggtgctggtggctgttcggtgttgtgtccaatgcttttgtctgaaatagcccccacagatttgagaggtggactggtctcattgtaccaactgaacatgacgttcggtattttcttgggttattgtagcgtttatggtacgagaaaatacgataacactgcacaatggagagtcccccttgggctttgctttttatgggctttgattatcatcattggtatgttattggttccagagtccccaagatatctgattgaatgtgagagacacgaagaggcccgtgcttccattgccaaaatcaacaaggtttcaccagaggatccatgggtactcaaacaggctgatgaaatcaacgccggtgtccttgcccaaagggaactaggagaagcttcatggaaagaacttttctctgtaaaaactaaagtccttcaacgtttgatcacaggtattcttgtgcaaacctttttgcaacttactggtgaaaactacttcttcttctacggaactaccatttttaaatcagtcggtcttactgatgggtttgagacgtcgatcgtcctaggtacagtgaacttcttctccactattattgctgttatggtcgtagacaaaattggccgtcgtaaatgtctgttatttggtgcagctgggatgatggcttgtatggtcatatttgcaagtatcggggtgaaatgtctttaccctcatggccaggacggtccttcttcgaaaggtgcaggtaatgccatgattgtgttcacttgtttctatatattctgctttgcaacgacatgggctcctgttgcttatattgtggttgccgagtcgttcccttcgaaggtcaagtctagagccatgtcgatttcaactgcatgcaactggttatggcaatttttgatcggttttttcacaccattcattactgggtctatccacttctattatggttatgtgttcgtaggttgtttggttgctatgtttttgtacgttttcttctttttaccagaaacgattggtctatctttggaggaaatccaattactatacgaagaaggtataaaaccatggaaatctgcatcttgggtcccaccttctaggagaggtatttcttccgaagaaagtaagaccgagaagaaggattggaagaaatttttgaagttctcaaagaattctgattga

SEQ ID NO: 4579 - protein, 564 aa, Saccharomyces cerevisiae
MSSAQSSIDSDGDVRDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWALIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGISSEESKTEKKDWKKFLKFSKNSD

SEQ ID NO: 4580 - DNA, 3277 bp, Saccharomyces cerevisiae
  CDS (802)..(2505)
gaaaagaacaaagtaaatttaggatctggaaggagtgctgtatgtaaacgaagctttcagttttaggtaatgtttgcacaacctacatgatataagatggtatgttctgcaacagcgtgcctgtcacttggcccgttatagcagattataccatctgcaagcagaccccattattgcattgcctccgcagccttgcgtatacatagccctaagacaaaatacggagcgtaaacaaccctcgatccccgcaacaattacataaccatttctccgcggaattacataatcatttctccgggaaaattacataatcatttctccgtgcgagttataagtgcttttctcgtgcatttccctgacacttcacaaaaccttctttttcttttttctttatttcaggggaaatcagtgcaaaactaaaaagaaagaaattttgtgaaatgtaaactccaggtgtcaaaaaataaattatatccgtggaaaatcaggcgtcggaaattgtagatgaatccgcctcctccacaataaaaatgctgaccacacgagcaatgcatacactcggacaccttcgttcaaagtatcagtagcagttcgacacaccctatactacttagctcttaaggtctaggctcatctttctcagttcctctttttcgctaaataaaggtatataatgtcacagctgtgtaactaaagaacactgttgttcctatctttttcttcttctttttttggtatgagttggaaaaaataatcattgcacaattgagtactaaaagctttcgtatcttacccaatatcatgtccggtgttaataatacatccgcaaatgatttatccactaccgagtctaactctaactcagtagcaaatgcaccatctgtaaaaactgagcataatgactctaaaaactccctcaacctggatgccactgaaccacctattgacttacctcaaaaacccctctctgcatataccaccgtcgcaatcctgtgtttgatgattgcatttggcggcttcatctttggttgggataccggtaccatttctggttttgttaacctttctgatttcatcagaaggttcggtcaaaaaaatgacaagggaacctactacttatcgaaagtaagaatgggtttgatcgtctcaatattcaacattggctgcgccataggcggaattgtcttgtcaaaagtcggtgatatatatggtcgtcgtattggattgattacagttactgccatttacgttgtaggcatcctaatccaaataacttccataaacaagtggtaccaatacttcattggaagaattatttctggcctaggagtgggaggcattgctgtcctttccccaatgttgatatctgaagttgctcccaaacaaatcagaggaaccctggtccaattgtaccagctgatgtgtacgatgggtatttttctaggatactgtaccaattacggtaccaagaactatcacaacgccactcaatggagagtcggccttggtctttgctttgcctggactacattcatggttagtggaatgatgtttgtaccagaatcaccacgttacctgattgaggttggtaaagatgaggaagcgaaacgttcactttcgaaatccaacaaagtctcagtcgacgatccagccttgttagcagaatatgacactataaaggcgggaatcgaacttgaaaagctggcaggtaacgcatcatggtctgaactactctccactaaaacaaaggtctttcagcgtgttctcatgggagtgatgatccaatcgctgcagcaattaaccggtgataactacttcttttactacggcaccaccatcttcaaatctgtcggtctaaaggactcctttcagacttcgatcattatcggtgtggttaattttttctcttcattcatagcggtatacaccattgagaggtttggacgccgtacgtgtctattgtggggtgctgcttctatgctatgctgctttgctgtgtttgcctccgtcggtgtgacaaagttgtggcctcaaggaagcagtcaccaagacattacttctcagggcgccggtaactgtatgattgtgtttactatgttcttcattttttcgttcgccaccacttgggcaggcggctgttacgttattgtctcagagacgtttcctcttagggtcaaatcaagaggaatggcaatcgcaacagctgcaaactggatgtggggtttcctgattagtttctttaccccattcattaccggggcaatcaacttttactacggttatgtattcttaggctgtctggtttttgcatacttttatgtctttttctttgtcccagaaacaaaaggcctgacgctggaggaggtgaatactatgtggctggaaggtgtgccagcatggaaatcagcctcatgggtgccaccagaaagaagaaccgcagattacgatgctgacgccatagaccatgacgatagaccaatctacaagaggttcttttccagctaatcttccggtttttagtaactggaaaaaaatacatgaacttaattatttattatatacaatatttacttttttacgccttaatccttaacggactatttgttatgccttatagaactagaaattatatgataaacatgagctacacgagttgacagggtgaacagattactatagcatctttctctcatgaataatttttaaaatgtataaattttgtaacgttccgaagggtggagtgaaattccattcaagaaaccaagcattgagacagaacagtacagagttcagttgttgcggaccgagaattgtaacaagtagccccagaaacattcatatgacgtctgtttcaaattaagcttagtaaaagtacacatttaccataaaaaaatagtaccaagtcggtggcctgatatccttattttccttctgccaattgggcaagttggtactaatattttaggtgacactgccactttattgttatggattgaaatttcttaaatgttctcacaatcggccataacgctatttctccgacgtaacctcctgtcatagtgtgccgtgcctgaataacttaaaaaattaaagttttcaatgtgcccaaaaaaattcacaaatagtacgcgctcgttaaacaccctgtgacgctgggccaggcactatttagcattacttcgaaaagacgcaagtataaagagtgagatctcacgtactacaacaagaacatagagaagcattctaataagcatataaacaaggcttctagagaaaa

SEQ ID NO: 4581 - protein, 567 aa, Saccharomyces cerevisiae
MSGVNNTSANDLSTTESNSNSVANAPSVKTEHNDSKNSLNLDATEPPIDLPQKPLSAYTTVAILCLMIAFGGFIFGWDTGTISGFVNLSDFIRRFGQKNDKGTYYLSKVRMGLIVSIFNIGCAIGGIVLSKVGDIYGRRIGLITVTAIYVVGILIQITSINKWYQYFIGRIISGLGVGGIAVLSPMLISEVAPKQIRGTLVQLYQLMCTMGIFLGYCTNYGTKNYHNATQWRVGLGLCFAWTTFMVSGMMFVPESPRYLIEVGKDEEAKRSLSKSNKVSVDDPALLAEYDTIKAGIELEKLAGNASWSELLSTKTKVFQRVLMGVMIQSLQQLTGDNYFFYYGTTIFKSVGLKDSFQTSIIIGVVNFFSSFIAVYTIERFGRRTCLLWGAASMLCCFAVFASVGVTKLWPQGSSHQDITSQGAGNCMIVFTMFFIFSFATTWAGGCYVIVSETFPLRVKSRGMAIATAANWMWGFLISFFTPFITGAINFYYGYVFLGCLVFAYFYVFFFVPETKGLTLEEVNTMWLEGVPAWKSASWVPPERRTADYDADAIDHDDRPIYKRFFSS

SEQ ID NO: 4582 - DNA, 1701 bp, Kluyveromyces marxianus var. lactis, Candida sphaerica
  CDS (1)..(1701)
atgtctgaattagagacaggaacagccgctcacggcactcctgtggagaacaagtctgtttccagttcgcaagcgtccactccaaccaatgtcggttccagagacgacttgaaggttgatgacgacaaccattctgttgacgccattgagcttccaaagaaaccacgttccgcttacatcaccgtttccatcttatgtttgatggttgcctttggtggtttcgttttcggttgggatactggtaccatttccggtttcgttaaccaaactgattttattagaagattcggtcaagaaaaggccgatggttctcactacttgtccaatgttagaactggtttgattgtttccattttcaatattggttgtgctatcggtggtattatcttgtccaagctaggtgacatgtacggtcgtcgtattggtttgatgattgttgtgttgatttacgttgttggtatcattattcaaattgcttccatcgacaaatggtaccaatacttcattggtagaattatctctggtctaggtgttggtggtatctctgtgttatccccaatgttgatttctgaaaccgctccaaaacatatcagaggtactttggtctctttctaccaattgatgattactttcggtattttcttgggttactgtactaactacggtaccaagacttactctaactctgttcaatggagagttccattaggtctatgtttcgcttgggccatctttatgatcactggtatgttgttcgttccagaatctccaagattcttggttgaaaaggacagaattgatgaggccaagagatccattgctaagtctaacaaggtttcctacgaagatccagctgttcaagctgaagtcgatttgatttgcgccggtgtcgaagctgaaagattggctggtagtgcttccatcaaagaattgttctctactaagaccaaggttttccaacgtttaatcatgggtatgttaatccaatctttccaacaattgactggtaacaattatttcttctactatggtaccaccattttcaactctgtcggtatggatgattctttcgaaacttccattgtcttgggtattgttaactttgcttctactttcgttgccatttatgtcgttgataagtttggtcgtcgtaaatgtttgttgtggggtgccgctgctatgactgcttgtatggttgtttttgcttctgtcggtgtcaccagattatggccagatggtgcaaaccatcctgaaactgcttccaagggtgctggtaactgtatgattgtcttcgcttgtttctacattttctgtttcgctacgtcgtgggctccaattgcttacgtcgtcgtcgctgaatcttacccattgagagttaaggctaagtgtatggctattgctactgcttccaactggatctggggtttccttaacggtttcttcacaccatttattacatctgctattcacttctactacggttacgtctttatgggttgtttggttgccatgttcttctacgtcttcttctttgttcctgaaactaagggtctaactttggaagaagtccaagaaatgtgggaagaaggtgtcctaccatggaaatcttcatcctgggtcccatcttccagaagaaacgctggttatgatgttgatgctttgcaacatgacgaaaagccatggtacaaggctatgttgtaa

SEQ ID NO: 4583 - protein, 566 aa, Kluyveromyces marxianus var. lactis, Candida sphaerica
MSELETGTAAHGTPVENKSVSSSQASTPTNVGSRDDLKVDDDNHSVDAIELPKKPRSAYITVSILCLMVAFGGFVFGWDTGTISGFVNQTDFIRRFGQEKADGSHYLSNVRTGLIVSIFNIGCAIGGIILSKLGDMYGRRIGLMIVVLIYVVGIIIQIASIDKWYQYFIGRIISGLGVGGISVLSPMLISETAPKHIRGTLVSFYQLMITFGIFLGYCTNYGTKTYSNSVQWRVPLGLCFAWAIFMITGMLFVPESPRFLVEKDRIDEAKRSIAKSNKVSYEDPAVQAEVDLICAGVEAERLAGSASIKELFSTKTKVFQRLIMGMLIQSFQQLTGNNYFFYYGTTIFNSVGMDDSFETSIVLGIVNFASTFVAIYVVDKFGRRKCLLWGAAAMTACMVVFASVGVTRLWPDGANHPETASKGAGNCMIVFACFYIFCFATSWAPIAYVVVAESYPLRVKAKCMAIATASNWIWGFLNGFFTPFITSAIHFYYGYVFMGCLVAMFFYVFFFVPETKGLTLEEVQEMWEEGVLPWKSSSWVPSSRRNAGYDVDALQHDEKPWYKAML

SEQ ID NO: 4584 - DNA, 1704 bp, Saccharomyces cerevisiae
  CDS (1)..(1704)
atggcaagcgaacagtcctcaccagaaattaatgcagataatctaaacagtagtgcagctgacgttcatgtacagccacccggagagaaagaatggtcagacgggttttatgacaaagaagtcattaatggaaatacgccagacgcaccgaagagaggctttttaggttaccttattatctacttactatgctatcctgtatcctttggcggttttttacctggttgggatagtggtattactgcaggcttcatcaatatggataactttaaaatgaattttggttcttacaagcacagtactggtgagtattatttgagcaacgtgcgtatgggtcttctcgtggccatgttcagtgtaggatgttccattggcggtgttgcttttgcgagacttgctgatactttaggtagaaggctagcaattgtaatcgtggttttggtatatatggttggtgcaattattcagatcagttcgaatcacaaatggtaccaatactttgtcggtaagatcatctacggtcttggtgctggtggctgttcggtgttgtgtccaatgcttttatctgaaatagcccccacagatttgagaggtggacttgtctcattgtaccaacttaacatgaccttcggtattttcttgggttattgtagcgtttatggaacaaggaagtatagtaatactgcgcaatggaggattcctgtgggactatgctttctgtgggctctaattatcatcgttggcatgttattagttccagagtccccaagatatctgattgaatgtgagagacatgaagaggcctgtgtctccatcgccaagatcgacaaggtttcaccagaggatccatgggtactcaaacaggctgatgaaatcaacgccggtgtccttgcccaaagagaactaggggaagcctcatggaaagaacttttctccgtcaaaacaaaagtccttcaacgtttgatcacaggtattcttgtgcaaacctttttgcaacttactggtgaaaactacttcttcttctacggaactaccattttcaaatcagttgggcttactgatgggtttgagacttcgatcgtcctaggtacagtgaatttcttctccactattattgctgttatggtcgtagacaaaataggccgtcgtaaatgtctgttattcggagcggcttcaatgatggcttgtatggtcatatttgcaagtatcggggtaaaatgtctttaccctcatggccaggatggtccatcctcgaaaggtgcaggtaatgccatgattgtgttcacatgcttctatatattctgctttgcaacgacatgggcccctgttgcttatattgtggttgccgagtcattcccttcgaaggtcaaatctaaagcaatgtcaatttcgactgcattcaactggttatggcaattcttgattggttttttcacaccattcattactgggtctatccacttctattatggttatgtgttcgtaggttgtttggttgctatgtttttgtacgttttcttctttttaccagaaacaattggtctatctttggaggaaacccagttactatatgaagaaggtataaaaccatggaaatctgcatcttgggtaccaccctcaaggagaggagcttcttccagggaaactgaggctaagaagaaaagctggaaagaagttttgaagttcccaaagagttttaattga

SEQ ID NO: 4585 - protein, 567 aa, Saccharomyces cerevisiae
MASEQSSPEINADNLNSSAADVHVQPPGEKEWSDGFYDKEVINGNTPDAPKRGFLGYLIIYLLCYPVSFGGFLPGWDSGITAGFINMDNFKMNFGSYKHSTGEYYLSNVRMGLLVAMFSVGCSIGGVAFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYSNTAQWRIPVGLCFLWALIIIVGMLLVPESPRYLIECERHEEACVSIAKIDKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAASMMACMVIFASIGVKCLYPHGQDGPSSKGAGNAMIVFTCFYIFCFATTWAPVAYIVVAESFPSKVKSKAMSISTAFNWLWQFLIGFFTPFITGSIHFYYGYVFVGCLVAMFLYVFFFLPETIGLSLEETQLLYEEGIKPWKSASWVPPSRRGASSRETEAKKKSWKEVLKFPKSFN

SEQ ID NO: 4586 - DNA, 3323 bp, Saccharomyces cerevisiae
  CDS (1189)..(2883)
ttcgctgtttgttatctgttttgattttttttttcactgcttatcatacaaactgatcaattgagctatcaaacttcaacttatctctgtatttatatgctgaaagtatagagtgtacataaaaatgtatcacatgtctattacatattacgacacccccacaatattttaactgatcttaataacacggggtaggaagtttatttcatcataccactcaatgagctaagctgccaaaggctcctgttcacttccttgtggttcgtaggctattcagtggcaacgtaataaacaagaaaagaaaaaatttcaacacctttattctaaatgttgtcagaagtaattatagtgggggtattgcagatgtaaatgaaatacgacgtactgtggggggcttttctttttcaagaatcctaaactattccaatgggattgcgtgattatgtttcgttagagtttttttctatatctccgttcttatttcttaagtccgccccttgctgtaaccagcccggctattatttgacgaatttttcacatcttcattccttgccgagaaagaagcttttgcctccctggggttattataaaatatatctgacgtcactggtttgcagccaaaaagtttaattattttaacttcaagggttcgtttcggagtaaatagtcaatgcacaaaataggaaggtggaggtggggtatgcatttttgtgcatagagtggcggggtattaagaataatgcacatataggcacataggcacaaatgcgtgggatgacttgactgtgcaaagaccgttagcaacctagaatgtggaatagtatcccaaatgatgacgtaaacgttcgaggataatattagataatataatattagtatcctcgtctaaaaacaggcaaaatagcacggaatctattcaaaagaaggcggcaagcagtatcaattgagataagtgtatacgaacggtgaaacctccttggcacagaattttatcgttcaagtggtaggatagcattgctgccataacaccctccttaatcacaggataatatggtgaacgagatatataaagcgataagtttaggtgtgatatttttctttcgttgtgcaagtgttgtgtaaattctttctcatttgataaatcaaaaaaaaaaaaaaaaaaaagaaaagaaaagaaaaattaataaaatgcaatcatccactgaaagtgatagagatattcaggatggtcctgatgctgatattcacgtcgcaccacccgtggaaaaagagtggtcagatggatttgatgacaacgaagtcataaacggggataacgttgagccaccaaaaagagggctcataggttatcttgtcatttacttattgtgttatccaatatccttcgggggtttcctgcctggttgggatagtggtatcacagcaggtttcattaacatggacaactttaaaatgaacttcggttcttacaagcatagcactggtgaatattatttgagcaacgtgcgtatgggtcttcttgtggctatgttcagtattggatgtgccataggtggtcttatttttgcccgtcttgctgatactttaggtagaaggctggcaattgtaatcgtggtgttggtatatatggttggtgcaattattcagatcagttcgaatcacaaatggtaccaatacttcgttggtaagattatctatggtcttggtgctggtggctgttcggtgttgtgtccaatgcttttgtctgaaatagctcctacagatttgagaggtggacttgtctcattgtaccaacttaacatgaccttcggtattttcttgggttattgtagcgtttatggtacgagaaaatacgataacactgcacaatggagagtcccacttgggctttgctttttatggactttgattatcatcattggtatgttattggttccagagtccccaagatatcttattgaatgtgagagacacgaagaggcccgtgcttccattgccaaaatcaacaaggtttcaccagaggatccatgggtactcaaacaggctgatgaaatcaacgccggtgtccttgcccaaagagaactaggagaagcttcatggaaagaacttttctccgtcaaaactaaagtccttcaacgtttgatcacaggtattcttgtgcaaacctttttgcaacttactggtgaaaactactttttcttctacggaactaccattttcaaatcagtcggtcttactgatgggtttgagacgtcgatcgttctaggtacagtgaacttcttttccactattattgctgttatggtcgtagacaaaattggccgtcgtaaatgtcttttatttggtgcagctgggatgatggcttgtatggtcatatttgcaagtatcggggtgaaatgtctttaccctcatggccaggatggtccatcctcaaaaggtgcaggtaatgccatgattgtgttcacttgcttctatatattttgctttgcaacgacatgggctcctgttgcttatattgtggttgccgagtcgttcccttcgaaggtcaaatctagggccatgtcgatttcgactgcatgcaactggttgtggcaatttttgatcgggtttttcacaccattcattactgggtctatccacttctattatggttatgtgttcgtaggttgtttggttgcaatgtttctgtacgttttcttctttttaccagaaacgattggtctatctttggaggaaatccaattactatatgaagaaggtataaaaccatggaaatctgcatcttgggtcccaccttctaggagaggtattccttccgaagaaagtaagaccgagaagaaggattggaagaaatttttgaagttctcaaagggttctgattgatcatagagtgcatatgcttgtcttgataggcaacattgtatattatattttacataataatgtgtaattctaatttgtcacgaatttatgaagattcttggagctatgaagatcaacatatgtagaaactggtatgtgtcataggtaaaaagtattcattaagacaaaattgtgtctaattcttagtcatttattcaattttttttttttttttttacgtaaagcggggtggagtgacatgatatggtgatggtgatgagaaactctaaatggatccatttgactatcgattgaaaatcatgaaagatgcgcttgaaggaacataacacgttactatttgtctaaataaaacaatatacaaaaatacgacattatatatactctacccaagatatttagtcattactatcgagggcgcgtagatcagatcacctttaaaa

SEQ ID NO: 4587 - protein, 564 aa, Saccharomyces cerevisiae
MQSSTESDRDIQDGPDADIHVAPPVEKEWSDGFDDNEVINGDNVEPPKRGLIGYLVIYLLCYPISFGGFLPGWDSGITAGFINMDNFKMNFGSYKHSTGEYYLSNVRMGLLVAMFSIGCAIGGLIFARLADTLGRRLAIVIVVLVYMVGAIIQISSNHKWYQYFVGKIIYGLGAGGCSVLCPMLLSEIAPTDLRGGLVSLYQLNMTFGIFLGYCSVYGTRKYDNTAQWRVPLGLCFLWTLIIIIGMLLVPESPRYLIECERHEEARASIAKINKVSPEDPWVLKQADEINAGVLAQRELGEASWKELFSVKTKVLQRLITGILVQTFLQLTGENYFFFYGTTIFKSVGLTDGFETSIVLGTVNFFSTIIAVMVVDKIGRRKCLLFGAAGMMACMVIFASIGVKCLYPHGQDGPSSKGAGNAMIVFTCFYIFCFATTWAPVAYIVVAESFPSKVKSRAMSISTACNWLWQFLIGFFTPFITGSIHFYYGYVFVGCLVAMFLYVFFFLPETIGLSLEEIQLLYEEGIKPWKSASWVPPSRRGIPSEESKTEKKDWKKFLKFSKGSD

SEQ ID NO: 4588 - DNA, 3143 bp, Saccharomyces cerevisiae
  CDS (962)..(2686)
gctcttgtgtctttgttatatgggtacaagatataagaaacataactattacatacgaaaatgtgcatgttatctatatccttctttatatagatgctgttaacttctttttttttttttgggaaaatcaactgttaaacgcgacagtaaaagcagcaaaacattaattttgcttccaagacgacagtaatatgtctcctacaataccagtttcgctgcagaaggcacatctattacatttactgagcataacgggctgtactaatccaaggaggtttacggaccaggggaactttccagattcagatcacagcaatataggactagaaaatatcaggtagccgcactcaacttgtaactggcaactactttgcatcaaactccaattaaatgcggtagaatcttttcacaaaaggtactcaacgtcaattcggaaagcttccttccggaatggcttaagtaggttgcaatttctttttctattagtagctaaaaatgggtcacgtgatctatattcgaaaggggcggttgcctcaggaaggcaccggcggtctttcgtccgtgcggagatatctgcgccgttcaggggtccatgtgccttggacgatattaaggcagaaggcagtatcggggcggatcactccgaaccgagattagttaagcccttcccatctcaagatggggagcaaatggcattatactcctgctagaaagttaactgtgcacatattcttaaattatacaacattctggagagctattgttcaaaaaacaaacatttcgcaggctaaaatgtggagataggataagttttgtagacatatataaacaatcagtaattggattgaaaatttggtgttgtgaattgctcttcattatgcaccttattcaattatcatcaagaatagtaatagttaagtaaacacaagattaacataataaaaaaaataattctttcataatggcagttgaggagaacaatatgcctgttgtttcacagcaaccccaagctggtgaagacgtgatctcttcactcagtaaagattcccatttaagcgcacaatctcaaaagtattctaatgatgaattgaaagccggtgagtcagggtctgaaggctcccaaagtgttcctatagagatacccaagaagcccatgtctgaatatgttaccgtttccttgctttgtttgtgtgttgccttcggcggcttcatgtttggctgggataccggtactatttctgggtttgttgtccaaacagactttttgagaaggtttggtatgaaacataaggatggtacccactatttgtcaaacgtcagaacaggtttaatcgtcgccattttcaatattggctgtgcctttggtggtattatactttccaaaggtggagatatgtatggccgtaaaaagggtctttcgattgtcgtctcggtttatatagttggtattatcattcaaattgcctctatcaacaagtggtaccaatatttcattggtagaatcatatctggtttgggtgtcggcggcatcgccgtcttatgtcctatgttgatctctgaaattgctccaaagcacttgagaggcacactagtttcttgttatcagctgatgattactgcaggtatctttttgggctactgtactaattacggtacaaagagctattcgaactcagttcaatggagagttccattagggctatgtttcgcttggtcattatttatgattggcgctttgacgttagttcctgaatccccacgttatttatgtgaggtgaataaggtagaagacgccaagcgttccattgctaagtctaacaaggtgtcaccagaggatcctgccgtccaggcagagttagatctgatcatggccggtatagaagctgaaaaactggctggcaatgcgtcctggggggaattattttccaccaagaccaaagtatttcaacgtttgttgatgggtgtgtttgttcaaatgttccaacaattaaccggtaacaattattttttctactacggtaccgttattttcaagtcagttggcctggatgattcctttgaaacatccattgtcattggtgtagtcaactttgcctccactttctttagtttgtggactgtcgaaaacttgggacatcgtaaatgtttacttttgggcgctgccactatgatggcttgtatggtcatctacgcctctgttggtgttactagattatatcctcacggtaaaagccagccatcttctaaaggtgccggtaactgtatgattgtctttacctgtttttatattttctgttatgccacaacctgggcgccagttgcctgggtcatcacagcagaatcattcccactgagagtcaagtcgaaatgtatggcgttggcctctgcttccaattgggtatgggggttcttgattgcatttttcaccccattcatcacatctgccattaacttctactacggttatgtcttcatgggctgtttggttgccatgtttttttatgtctttttctttgttccagaaactaaaggcctatcgttagaagaaattcaagaattatgggaagaaggtgttttaccttggaaatctgaaggctggattccttcatccagaagaggtaataattacgatttagaggatttacaacatgacgacaaaccgtggtacaaggccatgctagaataatgcgtttgaagtgagacgctccatcatctctcttaatttttcatgactgacgttttttcttcattttaattatcatagtatttgtttgaaaaaaaaaaaaaaaaatttcccttatcaatgatatccttacgattatataaattccttacctaaacctattatttgtgtacatatatcagagtattattacatatataacctttttctctaaaacaggaaaaaaaaaagaaaacgataacatgctctgccatcctttgttcaccgagcaaaattaaaaacgcaaaatgaattgtccctatgaaattattaaaggaccacatcaccagacttatctctggggggtcctctagaaaataagtcaggtacttgcctggactttcttccagttgaattcctgagctaacatacaattaatggagtgagaatgttcgaacgatccaggagttgcttttttcag

SEQ ID NO: 4589 - protein, 574 aa, Saccharomyces cerevisiae
MAVEENNMPVVSQQPQAGEDVISSLSKDSHLSAQSQKYSNDELKAGESGSEGSQSVPIEIPKKPMSEYVTVSLLCLCVAFGGFMFGWDTGTISGFVVQTDFLRRFGMKHKDGTHYLSNVRTGLIVAIFNIGCAFGGIILSKGGDMYGRKKGLSIVVSVYIVGIIIQIASINKWYQYFIGRIISGLGVGGIAVLCPMLISEIAPKHLRGTLVSCYQLMITAGIFLGYCTNYGTKSYSNSVQWRVPLGLCFAWSLFMIGALTLVPESPRYLCEVNKVEDAKRSIAKSNKVSPEDPAVQAELDLIMAGIEAEKLAGNASWGELFSTKTKVFQRLLMGVFVQMFQQLTGNNYFFYYGTVIFKSVGLDDSFETSIVIGVVNFASTFFSLWTVENLGHRKCLLLGAATMMACMVIYASVGVTRLYPHGKSQPSSKGAGNCMIVFTCFYIFCYATTWAPVAWVITAESFPLRVKSKCMALASASNWVWGFLIAFFTPFITSAINFYYGYVFMGCLVAMFFYVFFFVPETKGLSLEEIQELWEEGVLPWKSEGWIPSSRRGNNYDLEDLQHDDKPWYKAMLE

SEQ ID NO: 4590 - DNA, 1668 bp, Saccharomyces cerevisiae
  CDS (1)..(1668)
atgtctacagatgaaagtgaagacgtttattctgatctgtattccattatctcccaggtaacatccaatactgccaatgacatcgagcaactcccatatgctttaacgttcaaaacgtcgttaatcttcgttggtgctaccattggtgggcttttattcggctatgatactggtgttatatcaggtgttctgctttctttaaagcccgaagatctatctttggtagttttaacggatgttcagaaggagctgataacttccagtacaagcgtcggatcattttttggctctattctggcatttcctttagcagataggtatggaagaagaattactctcgcaatctgctgttcaatttttatcctagctgcaattggaatggctatagcaagaacattgacgtttttgatttgtgggagattgctggttgggatcgctgttggagtgtctgcccagtgcgtccctctatttctgagtgaaatttcaccttccagaatcaggggttttatgttgacattgaacattattgccatcactggaggtcaattggtttcctatgtgattgcgtcccttatgaaagagattgataattcatggagatatttgttcgcactttctgctattccagctattctgttcctttcaatactggattttatccctgaatcgccacgatggtccatttccaagggagacattctatataccagggattctctaagaatgctatatcctactgcatctacatatcatgtgaatagtaaaattaagcagctgataattgaactcgataagttacgactatacgaagatgcaagtgaacctttactagtacagtcccaatcggttattcgatacatggatagttcaacctcaggaactcttagcccacctaacattaaaagactttcctcgaacacagaaagaactagcaacacaatgtcctcctcatcagcatatctatcggcgttgcgaggcccagctccaaacggtgccctggcatctaacaaaaagaaaagacacagaatggagccacgcacaataagagcgttaatagtaggttgcatgttaatgtttttccagcaaatcactggctttaatgcttttatgtactatgcggcaataatattttccaaatttaatataaaaaaccctctactgcctccaattttgattgcctcaacgaacttcatattcacttttttcgccatgtacaccatggactctttgggaagaagagccattcttttgagaacaattttgattatgactgttgggttacttctttgcagtgtaggtttcggtcatgaccaagtcaatttacttttaatttctgttgtaatttatgttgcagcatatgcttctgcgatgggcagcgttccatggacctgtgtggaatttctccccttgaacaggagatcatttggggcatcatgtatagcctgcacaaattggttgaccaatgcatttgtttcaatgacatatctgagcactattaacaccattggtgatgaaaatacaatgctcatttttgcttttttcacagtttgtgcctggtttttcgtatatttttggtatccagaagtcaaaggtttgtcactggaagaggttggaagggtttttgataatggaattgatgttcattatgtctttcgtacctaccattga

SEQ ID NO: 4591 - protein, 555 aa, Saccharomyces cerevisiae
MSTDESEDVYSDLYSIISQVTSNTANDIEQLPYALTFKTSLIFVGATIGGLLFGYDTGVISGVLLSLKPEDLSLVVLTDVQKELITSSTSVGSFFGSILAFPLADRYGRRITLAICCSIFILAAIGMAIARTLTFLICGRLLVGIAVGVSAQCVPLFLSEISPSRIRGFMLTLNIIAITGGQLVSYVIASLMKEIDNSWRYLFALSAIPAILFLSILDFIPESPRWSISKGDILYTRDSLRMLYPTASTYHVNSKIKQLIIELDKLRLYEDASEPLLVQSQSVIRYMDSSTSGTLSPPNIKRLSSNTERTSNTMSSSSAYLSALRGPAPNGALASNKKKRHRMEPRTIRALIVGCMLMFFQQITGFNAFMYYAAIIFSKFNIKNPLLPPILIASTNFIFTFFAMYTMDSLGRRAILLRTILIMTVGLLLCSVGFGHDQVNLLLISVVIYVAAYASAMGSVPWTCVEFLPLNRRSFGASCIACTNWLTNAFVSMTYLSTINTIGDENTMLIFAFFTVCAWFFVYFWYPEVKGLSLEEVGRVFDNGIDVHYVFRTYH

SEQ ID NO: 4592 - DNA, 2118 bp, Lycopersicon esculentum (tomato)
  CDS (93)..(1664)
aattcggcacgagttttcttatataaaaaacatatcatcttcttattgttattttaactaccacatttgaagccggaaaacttagtaacacgatggccggtggaggatttacgacctccggtaacggagcacgcatttcgaggctaaaatcacaccaattggttatcatatcttgtattatggctgctaccggaggtctcatgtttggttatgatgttggagtttctggtggtgttacatcaatggatccatttttaaaaaaattctttccaacagtttataagagaacaaaggagccaggattagacagtaattactgtaaatacgataatcaagggttacaattatttacttcatcgttatacctagctggtttaacggcgacgttttttgcttcttacactacaagaaaacttggccggagattaactatgttaatcgccggttgttttttcattattggagttgtactaaatgctgctgctcaagatttagctatgcttattattggaagaattctccttggttgtggcgttggtttcgccaatcaggctgttccattatttttatcagaaatagcacctacaagaattcgtggaggacttaacattttgttccaacttaacgtaactattggtattctttttgccaatctcgtcaactacggaacagccaagattagtggaggatggggatggagattatcattagggttagctggatttccagcagtattgttgactttgggcgcattatttgttgttgaaaccccaaacagtttgattgaaagaggttacttagaagaaggcaaagaagtacttcgaaaaatcagaggtaccgacaacattgaacctgaattcttggaacttgttgaggctagtcgtgttgctaaacaagtcaaacaccctttcagaaatttactccaacgtaaaaatagacctcaattaatcatctctgttgccctccagatattccaacaatttacaggaatcaacgctattatgttctacgcacctgttttattttcaacactagggtttggaaacagcgcagctctttactcagctgtcatcaccggagcagtcaacgttctctccaccgttgtctcagtctactccgttgacaagctcggacgacgagtcctcctcctggaagctggggtccaaatgttactatctcaaataataatcgctataatcctaggtatcaaagttactgatcattcagacaaccttagccatggttggggaatcttcgtagtagttctgatctgtacatatgtatcggctttcgcatggtcatggggcccacttggatggttaattcctagcgagacgttccctttggaaactcgttcagctggtcaaagtgtaacagtgtgtgttaacttgcttttcacgtttgttatggcacaagcatttctctcaatgctttgtcatttcaagtatgggatattcttgttcttctcggggtggatttttgtgatgtcgttgttcgttttcttcttggtgcctgagacgaagaatgttcctattgaggagatgacggagagggtgtggaagcaacattggctgtggaagaggtttatggtgaatgaagatgatgttgatatgattaaaaagaatggacatgctaacggatatgatcccacttctcggttgtaaaataaaaaataaaagaatattagcggtgttttacgttgattttatcatagtaaagatgcgtagaaataaatcaaacatgcaagagagagatcagagtctactgtctagtctagtgatatcgataagtgtttctcacaaaataggtgtgcatttggattttttttactgcttgttttcctcctttatatcgttcaatgtagtagaaattgtttagccaaagtgtaagagatgcaatatggtgataatttatgtaaccatatagcctatgtatattagagatttggtataattcattttgggaaagcactttgatatgtttaatttcttgttatgtatgtatgacaaggtgtctagttataatgataaggcccaatagaggtttgcatgttgagtattgagacacaaaaatgaaaaaaaattacgctcaatgatcttgaaaaaaaaaaaaaaaaaa

SEQ ID NO: 4593 - protein, 523 aa, Lycopersicon esculentum (tomato)
MAGGGFTTSGNGARISRLKSHQLVIISCIMAATGGLMFGYDVGVSGGVTSMDPFLKKFFPTVYKRTKEPGLDSNYCKYDNQGLQLFTSSLYLAGLTATFFASYTTRKLGRRLTMLIAGCFFIIGVVLNAAAQDLAMLIIGRILLGCGVGFANQAVPLFLSEIAPTRIRGGLNILFQLNVTIGILFANLVNYGTAKISGGWGWRLSLGLAGFPAVLLTLGALFVVETPNSLIERGYLEEGKEVLRKIRGTDNIEPEFLELVEASRVAKQVKHPFRNLLQRKNRPQLIISVALQIFQQFTGINAIMFYAPVLFSTLGFGNSAALYSAVITGAVNVLSTVVSVYSVDKLGRRVLLLEAGVQMLLSQIIIAIILGIKVTDHSDNLSHGWGIFVVVLICTYVSAFAWSWGPLGWLIPSETFPLETRSAGQSVTVCVNLLFTFVMAQAFLSMLCHFKYGIFLFFSGWIFVMSLFVFFLVPETKNVPIEEMTERVWKQHWLWKRFMVNEDDVDMIKKNGHANGYDPTSRL

SEQ ID NO: 4594 - DNA, 1672 bp, Vicia faba (fava bean)
  CDS (18)..(1568)
cttcatcggagaaaaaaatgcctgcagccggaatccccatcggagcggggaacaaggagtaccccggaaacttaactcctttcgtcaccataacatgtgttgttgcagccatgggtggtttgatctttggttacgatataggaatttcaggtggtgttacttcaatgaatccgtttcttgagaaattttttccggcggtgtaccggaagaaaaacgcgcaacattcgaagaatcagtactgtcaatacgacagtgagacactgaccttgttcacatcctcgttgtacctggccgcgcttttgtcgtcggtggttgcttcaacgatcactagaaggtttggtcggaaactctccatgcttttcggaggcttgctttttctggtcggtgctctcattaatggccttgctcaaaacgttgcgatgttgatcgtcggtcggatcttgctcggattcggtatcgggtttgcgaatcagtctgtgccattatacttgtctgagatggctccatacaagtacagaggagcgttgaatattggatttcaattgtcaattacaattggaatacttgtggccaatattttgaactacttttttgccaaaatcaaaggtggatggggatggagattgagtttaggtggtgctatggtccctgcacttataataaccattggttcgctaatcctacccgacacgccaaattccatgatcgagcgtggggatcgagatggtgccaaggcacagcttaagagaattcgcggagttgaagatgttgatgaagagtttaatgatcttgtggctgctagtgaaacgtcgatgcaggttgaaaatccttggaggaatttgttgcagagaaaatatagacctcagcttactatggctgtgttgattccgttcttccaacagtttactggaattaacgttattatgttttacgcgcctgtgttgtttaactcgattgggtttaaggatgatgcttcacttatgtcagctgttatcaccggtgttgttaacgttgttgctacttgtgtctcaatttatggagttgataagtgggggagaagagctctttttctcgaaggtggtgttcaaatgcttatttgtcaggttgcagttgcagtttcaattgcggccaagtttggaacaagtggagaacctggtgatttaccaaagtggtatgctatagtagttgtgcttttcatatgcatttacgttgctggatttgcttggtcatggggtcctcttggttggttggtgcctagtgagatttttccattggagatccgttctgctgcgcagagtgtcaacgtgtcggtcaacatgctcttcaccttcttagttgcacagattttcttgaccatgctttgtcacatgaagtttggattgttcctcttctttgccttctttgtggtggtgatgacaatttatatatacactatgctgcctgaaactaagggaataccaattgaagagatggatagagtatggaaatcacacccatattggtctagatttgttgaacatgatgacaatggtgttgagatggccaagggaggtgttaaaaatgtataatttatcagtcttgcttttatttttatttttgttactaattagttttatttttattttgcttgtgaagcttggtattgaattgtccttaaaaaaaaaaaaaaaaa

SEQ ID NO: 4595 - protein, 516 aa, Vicia faba (fava bean)
MPAAGIPIGAGNKEYPGNLTPFVTITCVVAAMGGLIFGYDIGISGGVTSMNPFLEKFFPAVYRKKNAQHSKNQYCQYDSETLTLFTSSLYLAALLSSVVASTITRRFGRKLSMLFGGLLFLVGALINGLAQNVAMLIVGRILLGFGIGFANQSVPLYLSEMAPYKYRGALNIGFQLSITIGILVANILNYFFAKIKGGWGWRLSLGGAMVPALIITIGSLILPDTPNSMIERGDRDGAKAQLKRIRGVEDVDEEFNDLVAASETSMQVENPWRNLLQRKYRPQLTMAVLIPFFQQFTGINVIMFYAPVLFNSIGFKDDASLMSAVITGVVNVVATCVSIYGVDKWGRRALFLEGGVQMLICQVAVAVSIAAKFGTSGEPGDLPKWYAIVVVLFICIYVAGFAWSWGPLGWLVPSEIFPLEIRSAAQSVNVSVNMLFTFLVAQIFLTMLCHMKFGLFLFFAFFVVVMTIYIYTMLPETKGIPIEEMDRVWKSHPYWSRFVEHDDNGVEMAKGGVKNV

SEQ ID NO: 4596 - DNA, 1674 bp, Schizosaccharomyces pombe
  CDS (1)..(1674)
atggatttcaacaatattccccttgcgaccattaagtccagcgatgataagggtaaagactttatcgtggaaatgaccactcgtccttctgaaaccaagaagaaggttcctttttctgaggacatgcgtgaaatcccttctttaccgaacgaggaagaagcgaatgcaacggatccacaagccaacgaggtcgctgatgaaaacggtgaaggatttgaagctgaaaaaatcagtagttggatttgggtgctgtcggctgttgcaggtatttctggtttgctgttcggttatgacactggtgttatttcaggcgctctcgctgtcctcggtagcgatcttggtcacgtccttagctctggccaaaaagaattgattacctctgccacttccttcgccgcccttatatctgcaaccacttcaggatggcttgctgattgggtcggtcgcaaacggcttttgctatgtgcagatgcaatttttgtcatcggatctgttattatggctgcttcgcggaatgttgcaatgatggttgttggtcgttttattgtaggttatggaattggtcttacttctcttattgtcccaatgtatattactgagttggctcctgctcgtttgcgcggacgacttgtcatcatttacgtggtcttcattaccggtgggcagctgattgcctactcacttaatgctgcttttgaacatgtacatcaaggttggagaattatgtttggaattggtgcggcccccgccttaggtcagcttatttcgcttttctggactccggagtctccaaggtatttgcttagacataaccatgttgaaaaagtctacaagattttgtctcgaatccatcccgaagcaaagccagctgaaattgcatataaagtctcattgattcaagagggcgtcaaagttgattttcctgaagggaataagtttcaacatttctttcattctttaaaagtacttttcacggttccttcaaatagaagatccctttttattggttgcttccttcaatggttccaacaattttctggcactaatgcaattcaatatttctctgcaatcattttccaaagtgttggatttaaaaattctatctctgtcagtattgttgtcggtgctactaactttgttttcacaatagtcgcattcatgtttattgaccgtattggaagaagacgaattttgctttgtacttcagccgtgatgattgcaggtttggcgctttgtgcaatcgcttatcattttcttcctgcagacaccacccaaaacacaaacagtggttggcaatatgtcgtattagcatccatcattattttccttgctagctatgcttctggaatcggaaatattccctggcaacaagccgaattgtttcctatggaagtcagagcccttggtgctggattctcaactgctatcaactgggttggaaatctcatcattagtgcttcctttttgacaatgatggagtctatcacaccaacgggtacatttgcattgtttgctggattttgttttgttggactcgtgacaagctactttacttatcccgaacttgcaggaatgtctattgaaaatatacacaagctgcttgaaaaaggtttttggcaagctgtaaaggaaagtactaaacgcgttagaaaaggaagaatagatgaagcttga

SEQ ID NO: 4597 - protein, 557 aa, Schizosaccharomyces pombe
MDFNNIPLATIKSSDDKGKDFIVEMTTRPSETKKKVPFSEDMREIPSLPNEEEANATDPQANEVADENGEGFEAEKISSWIWVLSAVAGISGLLFGYDTGVISGALAVLGSDLGHVLSSGQKELITSATSFAALISATTSGWLADWVGRKRLLLCADAIFVIGSVIMAASRNVAMMVVGRFIVGYGIGLTSLIVPMYITELAPARLRGRLVIIYVVFITGGQLIAYSLNAAFEHVHQGWRIMFGIGAAPALGQLISLFWTPESPRYLLRHNHVEKVYKILSRIHPEAKPAEIAYKVSLIQEGVKVDFPEGNKFQHFFHSLKVLFTVPSNRRSLFIGCFLQWFQQFSGTNAIQYFSAIIFQSVGFKNSISVSIVVGATNFVFTIVAFMFIDRIGRRRILLCTSAVMIAGLALCAIAYHFLPADTTQNTNSGWQYVVLASIIIFLASYASGIGNIPWQQAELFPMEVRALGAGFSTAINWVGNLIISASFLTMMESITPTGTFALFAGFCFVGLVTSYFTYPELAGMSIENIHKLLEKGFWQAVKESTKRVRKGRIDEA

SEQ ID NO: 4598 - DNA, 2407 bp, Schizosaccharomyces pombe
  CDS (401)..(2128)
aaagattcattggttttattgttaagaagtgtgagacaaccattcttaattgctgacatttcaacactttctacttctctctttcgaaaattccggtcttatccgttgtaactgtttgttaacgtcttttttttcgtttaagaacagagttcctcggatacatcttttatctaagcggtaaatataacaagtttctgggttgtactgattgcatatcatagcaatcctttgaacatatcccttcgaatgctaaaaaattattagctttcgctcattatcgatttttacttcatctttaggtttcctgtcatacttacgatttatttgtttagtttgttaacgttaaaaaccattcctttaattataatcttattaatttacattcaaaagtttcagcaagatgtcaatctcttccaaggattttcaaaatgtaacgtcagcgggtttcgctgatgatactttcgctgccgatacatttgctgctgataaaaaaagtccatttgaatcctcggtttttgaaaacaaaacccaggtgcttcctgtggacagcgtgtctagattatctaacggagctcgaagtcgcagcaattctaacatttctttatctgagccacacgcacttaacgacactgttgaagatcaaccagttagcaaatgggtttgggtgcttgcttttgctgccggtatcggtggtctactgtttggctatgatacaggtgtcatttcaggtgctcttgtagttataggtactagcttgggcggacatgaattaacaaatggtggtaaagaatttatcacctctgcaacatctcttggtgcacttttaggagggataattgctggtgcccttgccgacttttttggtagaaaaccggtaattgcaatagctagtatcatcatcatagttggttccatagtacaggttacggctcaccatctttggcatatgattgtaggtcgctttgttatcggttggggcgttggcattgcatcacttattattcctttgtacctaagtgaaatcgctccgtctaaaatacgcggaaggttggttatcatatatgttttattaattacagctggtcaagtaattgcctatggaattgatacagcttttgaacacgtccataatggttggcgctggatggttggtttagcaatggttcctgcagctttccaattattcattcttatttggctacccgaatctcctcgtttgttagttaaaaaagaaagatctcaggaggcttataacactctggctcgaatctatcctactgctcacccttacgaaataaagactaagctctatttaattcaagaaggagttcgtgatcctttttcaggatctagatggcaaaagattgtgaaaacttttaaagaattatatttcaatccttcaaatttccgtgcattgatactggcttgcggactgcaagcgatgcaacaactttccggatttaattcattaatgtatttttctagtactatttttgaggttgttggctttaacaatcctactgctactggtcttatcattgcagctactaattttgtatttaccattgttgcctttggtgtgattgatttttttggtcgaagaatcttgctcctgttgaccgtatggggaatgattgctgctttaattgtatgcgcggtggcttttcattttttgccgaaagacgagaatggcaattatacttctggtcaatcaaatgcttgggctatcgttgttttaatttcgatgattgtttacgttgcgtcgtatgcctctggacttggaaatctcccttggcaacaatccgagctttttcctatgtccgttagaggtctaggcactggcatgtctactgctgttaactgggctggtaatcttggtataggtgcttcgttcttaacattgatgagtgaaataacacccacaggaacgtttgccctttatggaggcctttgctttttaggatggcttggtgcacttttctgctatcctgatttaaccgattataccatcgaagaaattggggagctgcttaaacatggatttggagttcgtgaaagtatgcgacatctcaaacgcgttcgacaagagcgagcttggtctcgtgaagataaagagcaaaataactagacagtctcttattttcatattattttttcatcacagtcaccattaggtgaaaactcatatatttaattgcgcttatcaaatcgagtaatactgtttcatagattttgtatcttaatatttatattaattgattacatatatacaaatatcttgtgccttgtgtgctatatgaactccagatgttgccgctaaagggttgaaagcagttaagctagacttaaattgtccattcacttcacgccgtaaatctatattttgcttccttactcgtatttattt

SEQ ID NO: 4599 - protein, 575 aa, Schizosaccharomyces pombe
MSISSKDFQNVTSAGFADDTFAADTFAADKKSPFESSVFENKTQVLPVDSVSRLSNGARSRSNSNISLSEPHALNDTVEDQPVSKWVWVLAFAAGIGGLLFGYDTGVISGALVVIGTSLGGHELTNGGKEFITSATSLGALLGGIIAGALADFFGRKPVIAIASIIIIVGSIVQVTAHHLWHMIVGRFVIGWGVGIASLIIPLYLSEIAPSKIRGRLVIIYVLLITAGQVIAYGIDTAFEHVHNGWRWMVGLAMVPAAFQLFILIWLPESPRLLVKKERSQEAYNTLARIYPTAHPYEIKTKLYLIQEGVRDPFSGSRWQKIVKTFKELYFNPSNFRALILACGLQAMQQLSGFNSLMYFSSTIFEVVGFNNPTATGLIIAATNFVFTIVAFGVIDFFGRRILLLLTVWGMIAALIVCAVAFHFLPKDENGNYTSGQSNAWAIVVLISMIVYVASYASGLGNLPWQQSELFPMSVRGLGTGMSTAVNWAGNLGIGASFLTLMSEITPTGTFALYGGLCFLGWLGALFCYPDLTDYTIEEIGELLKHGFGVRESMRHLKRVRQERAWSREDKEQNN

SEQ ID NO: 4600 - DNA, 1815 bp, Magnaporthe grisea 70-15
  CDS (1)..(1815)
atgtcaggggccgaagcgccgttgatagcaaacattgacgctaccggagaagtagagccggaaaacgcatcatcagaaggaattcacgaggatggcgccaatttacctagattaccagacgcgccaccaggcctgtttatctggctgctggtgctatcggcggggataagtggtcttctttttggatacgatacgggggtaatatcatctacgctggtctccatcggcgactccctctcgggccgtcaactcacatctctggacaagtcggtcatcacatcgtgcacctcgctatttgcactcttgatctccccgttttcctcatccattgccgacagcctgggccggaaacgcgtcatcctggtcgcagacttcctcttcgcggttggtgccatcttgcaggcatgcagcgacactgtggccgagatggtcgctggccggtccattgtcggggccggcgtcggggccgcatcctttgtagtgccactctacatcgccgagaccgccccagctgaccacaggggcaagctgatcaccattaacgtgctgtttatcacgctgggccaggtgatcgcctacgtgattggctggctttttgccgagtatggtgacaagtccagcggctggaggtggatggttgggctgggagctgttcctgctgtggtgcaggcggtgctcctcctcgggatgccagagactccacgttggttggtcaagtcaggccgggaagaagaggcactcgagattatccgtcgagtttccggtggcaaacacagatcgacctctgaccgggtggctcagcgagtccttgaggaaatccaggtcgagatccgtgaagagtccgaagcccgtagacggctcttggccagccgtgacgggatgcagtcatcgagaccagagtggatggaaagatggtcagaacttgtaaaggtgaggcggaacagacgagctctgactgttgcgtgccttctccaaggactacagcaactgtgtggatttaactccttgatgtatttctctgcatccatattcacaatggtcggtttcgcgacgccaaccctaacgtcattaacggttgccgttacaaactttgtcttcacggtgctggcacttttgctggtagaccgcattggcaggcgtcgaatactcttatattccctaccttttatgattgctggactactccttgcagcgtttgcattctcgttcatatcgatatcttcggcgccaacatcatcaccgatacctagcgctgccaagacgggggatgcgcagctgtcaccgcgggctgcggcagtgatgatactcataagcatcatgatatacgttgcatcctacgccattgggctcggcaacgttccgtggatgcaaagcgagctcttttcgttgagcgtgcgatcagtcggcagtggggtcgcgacagggaccaattggttggccaactttgtggtgggcttgacgtttttacccttgatggatgcatttggaccggctgcaacttttaccatgtacggggctgtctgtggtatcggtctcgtgctcatctggcggatctatccggagacgacgggattgagtctcgaggaggcggcaagcctgctggagggtagcgcctggggggtgcgagacaaccaggcctcgttcgggtgcaaaatttcgggtgccaactgggaccgagctagaaaccacttacgtgccacgatcggcacgctaaaagggggcgcgactggcggccccgaaagaattggtaagaccgataccgaggcacccgcgtgggatctcttgggagaagggattcggtactaccttgtgtaa

SEQ ID NO: 4601 - protein, 604 aa, Magnaporthe grisea 70-15
MSGAEAPLIANIDATGEVEPENASSEGIHEDGANLPRLPDAPPGLFIWLLVLSAGISGLLFGYDTGVISSTLVSIGDSLSGRQLTSLDKSVITSCTSLFALLISPFSSSIADSLGRKRVILVADFLFAVGAILQACSDTVAEMVAGRSIVGAGVGAASFVVPLYIAETAPADHRGKLITINVLFITLGQVIAYVIGWLFAEYGDKSSGWRWMVGLGAVPAVVQAVLLLGMPETPRWLVKSGREEEALEIIRRVSGGKHRSTSDRVAQRVLEEIQVEIREESEARRRLLASRDGMQSSRPEWMERWSELVKVRRNRRALTVACLLQGLQQLCGFNSLMYFSASIFTMVGFATPTLTSLTVAVTNFVFTVLALLLVDRIGRRRILLYSLPFMIAGLLLAAFAFSFISISSAPTSSPIPSAAKTGDAQLSPRAAAVMILISIMIYVASYAIGLGNVPWMQSELFSLSVRSVGSGVATGTNWLANFVVGLTFLPLMDAFGPAATFTMYGAVCGIGLVLIWRIYPETTGLSLEEAASLLEGSAWGVRDNQASFGCKISGANWDRARNHLRATIGTLKGGATGGPERIGKTDTEAPAWDLLGEGIRYYLV

SEQ ID NO: 4602 - DNA, 1554 bp, Gibberella zeae PH-1
  CDS (1)..(1554)
atggacagctcccaggcaccgctgattgcgggccatagtgacgaagaggaagagcttgaatatgcgagcgaagggtcaaggtctcccgaagaagcgggcaagacgggaagcggaatgcccagcgcatttgtcctggccctgacttttgctgctgacgacacgggcgtcgtttccgctaccctcgtttcaatagggacctcgctatcaaaccgcgaactcacctcgatggataaatcaatcattacttcttccacgtcgctattcgccctgataatatcgcccttttcctccgttctcgccgatcgccttggacgcaaacacgttattctctacgccgatattctctttgttacgggcgccctactacaagcatggagttctacggttccgatcatggttgcaggacggtgtattatcggcgcaggtgtaggtgcagccagtttcgttgtgccgctgtacattgctgaggtggcgcctgctgcgcatcgagggcgtttggttactttgaacattatgtttattaccctgggccaggtgatcgcgtatatcgtgggatgggccttttcgacatacagttccccagctacaggatggcgatggatggtgggcttaggcgcgttgcccgcggttttacaaggaggcatgattgcctttatgcccgagacaccgagatggttggtcaaggctggtagatccaacgcagccaaggaagttattcgtcgggcaaacggcgatacattacaacataatgcggatgcagttatcagggagatcgagctcgaagtgcgagaagagcacgaggcggaacgattgcgtgatcatcaggtatctgaccgatggacgtggctgggcaaatgggggcctcttgtcagtgaagggagaaaccgcagagccttggctattgcgtgcttgcttcaagggctgcaacagctttgcggatttaattcactgatgtacttctccgcgaccatctttacagttattggcttccaaagccctacgcttacctcgatggtagttgccgttacaaacttccttggtactgttgctgcgttgggactcgttgatcgcataggtcggaggagggtgcttctgtactcgataccgttcatgatcgtcggattgttgctgtcggcatatggcttttcgttcctttcactggcaactggaatcaacacgacggcctccgaacctcccgcaaccgccggacacgagatggcggccctcactatccttgtgagtatcatggtatacgttgcagcgtacgcgctgggtctcggtaacgtcccctggatgcaaagcgagctgttcccattggcggttcgatcacttggtagcggtgtagcaacagcgacaagctgggccgcgaattttgttgtagggttgacgttccttccattgatggacctgttgagtccatcttggacattcgttttgtatgcgattatatgtggtggtggatatttcttggtctggcgtatttatcctgagacggcggggttaagccttgaagaagcaacagctctgttggacaacggttggggcgtacgataa

SEQ ID NO: 4603 - protein, 517 aa, Gibberella zeae PH-1
MDSSQAPLIAGHSDEEEELEYASEGSRSPEEAGKTGSGMPSAFVLALTFAADDTGVVSATLVSIGTSLSNRELTSMDKSIITSSTSLFALIISPFSSVLADRLGRKHVILYADILFVTGALLQAWSSTVPIMVAGRCIIGAGVGAASFVVPLYIAEVAPAAHRGRLVTLNIMFITLGQVIAYIVGWAFSTYSSPATGWRWMVGLGALPAVLQGGMIAFMPETPRWLVKAGRSNAAKEVIRRANGDTLQHNADAVIREIELEVREEHEAERLRDHQVSDRWTWLGKWGPLVSEGRNRRALAIACLLQGLQQLCGFNSLMYFSATIFTVIGFQSPTLTSMVVAVTNFLGTVAALGLVDRIGRRRVLLYSIPFMIVGLLLSAYGFSFLSLATGINTTASEPPATAGHEMAALTILVSIMVYVAAYALGLGNVPWMQSELFPLAVRSLGSGVATATSWAANFVVGLTFLPLMDLLSPSWTFVLYAIICGGGYFLVWRIYPETAGLSLEEATALLDNGWGVR

SEQ ID NO: 4604 - DNA, 1596 bp, Gibberella zeae PH-1
  CDS (1)..(1596)
atgtccatcaaggaagatacaaaaggacatcttgagcatcttgagcacagcaactctccagactctatccaagaggtcaacatcgacgacctcgactccatcgagcagacccagacgggcaagttctcctggctcgtctccatcactgctgccattggtggtatgctctttggctatgatacgggcatcatatctgctgtcctcgtctatatccatcaagatctcggcaagactcttacgtctcaggagaaggaactcgtcacttcagttacttctggtggtgctttcatcggagccatctttgctggagccaccgcggatcgatatggtcgaaaagtagctatctatgttggctgcctcttattcaccgtcggtgctatcatccaagctgcttctttctcagtcgcccaaatgaccgttggccgtgtcgttgttggatttggagtaggctctgccgccatgattgtgcccttgtacatcgccgaatgctctccttcaaagtaccgaggacgcatgatcggccttgacaatatgagcatcactggtggccagcttgtatcatacggcgttggagctgccttcgctcatgtcagtagtggatggagatggatggtgggaatcggtgcctttcctgctattatcctagcctgccttctgcccttttgcccggaatctcctcgacagctgatttttcatggaaaaccagacgaggccgctgctgttatccgtcgaatcttccccaatggtaccgagcaacaggtacaggacaagatccagcacttgacttaccacgtcaacgaggccaaggccctcaatgctggaaagtctggttggtgggtgttcaagcagctctatgttatccctgccaacttccgcgctcttgtctctgcctgtggacttatggccatctctcagctcagcggttttaactccctcatgtactattcgcctcttctcttctcgcttgtcggcttttccaacccagtcgctgtcggtactattatcgctggaaccaacttcatcttcacttgggttaacctcatgctcgttgatcgtgctggccgacgaagaatcttattatgcactgtaccctttatgggcattttcttagtcattgctgctgtctgcttcaagttcatccctatcaaccacgatttgtctcttgcatctgatgccaagattggatggcccgccattgtcgttctcatttccatggtcttctttgttgggttctattcttcaggtatcggcaacaccgcctggctttcaagcgagttcttccctatggaagttcgcgccatgggaaccatgatgctcaccatgacctgctggggctcaaacatcatcgttgcctctacgttcctcacccagatggagaatactactccttcaggtgcctttggattctacgccgccatatgcattctcggctgggtttgcatctacttctgttatcccgaggtcaagggaatgacattggaagatatcagagacatcttccagcacggctttggcgttcaacgagcacgagaagtgcagaagcagatgaagatggccaataaggcaatcacctctgaagttctcaccagggcatag

SEQ ID NO: 4605 - protein, 531 aa, Gibberella zeae PH-1
MSIKEDTKGHLEHLEHSNSPDSIQEVNIDDLDSIEQTQTGKFSWLVSITAAIGGMLFGYDTGIISAVLVYIHQDLGKTLTSQEKELVTSVTSGGAFIGAIFAGATADRYGRKVAIYVGCLLFTVGAIIQAASFSVAQMTVGRVVVGFGVGSAAMIVPLYIAECSPSKYRGRMIGLDNMSITGGQLVSYGVGAAFAHVSSGWRWMVGIGAFPAIILACLLPFCPESPRQLIFHGKPDEAAAVIRRIFPNGTEQQVQDKIQHLTYHVNEAKALNAGKSGWWVFKQLYVIPANFRALVSACGLMAISQLSGFNSLMYYSPLLFSLVGFSNPVAVGTIIAGTNFIFTWVNLMLVDRAGRRRILLCTVPFMGIFLVIAAVCFKFIPINHDLSLASDAKIGWPAIVVLISMVFFVGFYSSGIGNTAWLSSEFFPMEVRAMGTMMLTMTCWGSNIIVASTFLTQMENTTPSGAFGFYAAICILGWVCIYFCYPEVKGMTLEDIRDIFQHGFGVQRAREVQKQMKMANKAITSEVLTRA

SEQ ID NO: 4606 - DNA, 1554 bp, Aspergillus nidulans FGSC A4
  CDS (1)..(1554)
atgaatagcagagaagatacggagctatctgccgcccatgctccgctcctcgcacaagagcctgtactgaggcaacatgacgaagaccagtcaaagcactcgagcggccggtttatttggtatttgaccttctctgctggtattagcggtcttctttttggatatgacaccggtgtcatatcgtccacgctcgtatctatcgactctgatctctcgaaccgcccccttacaactttggataagagtttaattacgtcgtgcacaagtctctttgctctcatcgcaagcccgctggcgggcattttggcagatagacttggtcggaaaagggttattcttgtcgcggacgtcctctttactgtagggtcattcatacaagctgctaccggtgaagtatggggtatgatcattgggagaagtattgttggctttgcggtcggcagtgctagcctggttacacctttgtatatatcggagctggcaccttcagatgcgcgagggagattggtcactatactgagtctttttatcactggtggtcaggttgtagcatacatcatcggctggctattctcctacgttggtggtgggtggcgctggatggttggcttgggaatgcttccggcagtgttccaactcattattgttgtggctttgcccaagacaccccgatggctggtacaagcaggttacgaggacaaggctcagaggattctgtcagaggttcatcaggacgaccagaccgcgaaacaaacactgcgggatatccaacaagaggttgccgaagagaattcttcgaataaaagtgcaggcttcaagcagcgctcgcacgacctgttcaaaatcgcgggcaatcgaagagctttgactatcgccgtgatgctccaggcattacagcagctctgtggcttcaacagcttgatgtatttctcagcaacaattttctcccttctgtcattctcgtcgcctacgcttacctcgttatccgtggccctgacgaacttcctcttcacactgcttgcgtttgtctatattgaccggattgggcgccgtcgcatcttgctatattcgatacccgtgatgatcatctcgctcttcgtctgtgctgtgacattctcctttgtggagttgccgaaagatacatcagaggcgcaagctcgtcaagccgcgacggatagttccgttatcccactgttaatccttctatgtctcacagtgtatacagcagcgtacgcctttggcctcggcaatgtcccttggcagcaatcagagctctttcctctgaatgtgcggtcgcttgggtctgcccttgcaaccgcaacaaactggggctcgaactttgttgtcgggcttactttcctcccgatgatggagttgttatctccgagtctggtttttgcgctctacggggtcgtttgtattgccggatggtttggcgtacgaactttctaccctgaaatgagcgggctcaatttagaagacgtaaaggcccttcttgcggatagctggggtgtaagagcgagcttgattggggttcggaatagatctgcttag

SEQ ID NO: 4607 - protein, 517 aa, Aspergillus nidulans FGSC A4
MNSREDTELSAAHAPLLAQEPVLRQHDEDQSKHSSGRFIWYLTFSAGISGLLFGYDTGVISSTLVSIDSDLSNRPLTTLDKSLITSCTSLFALIASPLAGILADRLGRKRVILVADVLFTVGSFIQAATGEVWGMIIGRSIVGFAVGSASLVTPLYISELAPSDARGRLVTILSLFITGGQVVAYIIGWLFSYVGGGWRWMVGLGMLPAVFQLIIVVALPKTPRWLVQAGYEDKAQRILSEVHQDDQTAKQTLRDIQQEVAEENSSNKSAGFKQRSHDLFKIAGNRRALTIAVMLQALQQLCGFNSLMYFSATIFSLLSFSSPTLTSLSVALTNFLFTLLAFVYIDRIGRRRILLYSIPVMIISLFVCAVTFSFVELPKDTSEAQARQAATDSSVIPLLILLCLTVYTAAYAFGLGNVPWQQSELFPLNVRSLGSALATATNWGSNFVVGLTFLPMMELLSPSLVFALYGVVCIAGWFGVRTFYPEMSGLNLEDVKALLADSWGVRASLIGVRNRSA

SEQ ID NO: 4608 - DNA, 1587 bp, Aspergillus nidulans FGSC A4
  CDS (1)..(1587)
atgactatcgacgaagacgagaagactgccccagtgcatctggagtacgacggccatgaagccgacgacgactccatcgagaatattgccaccagctggttcgtctggcttgtctcccttacagcatctattgcgggcagtctctttggctacgataccggtatcatctccgctgtcctggtctatctgggaagcgacctcgatggacgcccagcgtctgagaacgagaaacaattgatcaccagtttatgctccggcgggtcttttgtgggcgccattattgccggtcttactgccgacaagtttggtcgaaagcctgccatttatgtcgggtgcgtgctatttaccgtcggcgcagtcctccaaggcgcagcatacagtatcgcgcaaatgtcagtcggacgcctaattgtcggatttggtgtggggagcgcctcgatggtagtgcctctctatattgcagaactatcacccacaaaagtccgcggcagactcatcggtctcaataacatgtccatcaccggcggccaagtcatttcttatggtatcggagcagcgttcgcgcacgttccgcatggctggcggtatatggttgggcttggaggcgtcccctcaatcatcctggcatgcctcctccccttctgccctgaatccccgcgccagctcgtctaccacggcaagacacaagaggccgaaactgtgatccgcaaaatctacaagggtgcctcggatgcccaggttgcagcaaaagttcggttgattgttagggcatgcgatgaatcacgagaactcaacaaagactccacgcgctgggccaagatcaagctcctgcattcgaacccggcgtacttccgcgcgctggtgtgcgcctgcggctttgctgtcattgcccagatgtccgggttcaatactctgatgtactactccgccacgctgtttgatcttgttggcttctcagaccccgttgcagtgggaatagttgttgcgggaaccaatttcgtcatgacgtgggtgaacatgatgcttgtcgacccccttggccgccggcgcgtcgtcctcctaaccgcctggggcatgtctgcgggcctgattgctgtagctatcgcattcaagtttatccctgtagacacctcaactctcgaactcgaaaccgataccgtcagcccacctgccattgtcgtgctcatctttatcatttggttcgttttcttctacggcgcgtccatggggaacacagcctggatgaacacagatttcttccccatggaagtccgcgcaatcgggacgatgttccagacttgctgtacctggggctcgaatataattgtatccagcacgtttctgagcatgatgcaggggataacgccgtctggcgcgttcgggttttatgccgctatctgtgggtttgggtatatcctgatttatttcttttaccctgaggtctcgggattaagtattgaggagatcagggaagtcttccaacatggatttggggtggcctattcgaggaaacttcgaaagacaaggaaggctgcggccagggcagcgagtgccgcaggggaagaagtcgaagcgaagacggtttaa

SEQ ID NO: 4609 - protein, 528 aa, Aspergillus nidulans FGSC A4
MTIDEDEKTAPVHLEYDGHEADDDSIENIATSWFVWLVSLTASIAGSLFGYDTGIISAVLVYLGSDLDGRPASENEKQLITSLCSGGSFVGAIIAGLTADKFGRKPAIYVGCVLFTVGAVLQGAAYSIAQMSVGRLIVGFGVGSASMVVPLYIAELSPTKVRGRLIGLNNMSITGGQVISYGIGAAFAHVPHGWRYMVGLGGVPSIILACLLPFCPESPRQLVYHGKTQEAETVIRKIYKGASDAQVAAKVRLIVRACDESRELNKDSTRWAKIKLLHSNPAYFRALVCACGFAVIAQMSGFNTLMYYSATLFDLVGFSDPVAVGIVVAGTNFVMTWVNMMLVDPLGRRRVVLLTAWGMSAGLIAVAIAFKFIPVDTSTLELETDTVSPPAIVVLIFIIWFVFFYGASMGNTAWMNTDFFPMEVRAIGTMFQTCCTWGSNIIVSSTFLSMMQGITPSGAFGFYAAICGFGYILIYFFYPEVSGLSIEEIREVFQHGFGVAYSRKLRKTRKAAARAASAAGEEVEAKTV

SEQ ID NO: 4610 - DNA, 1665 bp, Candida albicans SC5314
  CDS (1)..(1665): transl_table=12
atgggaagttcaaccaataatacacaatcaaaagctacccccagtgtgttagaaaatgaagtcaatagctcaaaatcatcagttgtttcatcaacgtcttctgctaaagggttgctacgtgaaaccactaatcatggtactatggaaacatcctcggttcagatatctgaatcagaatctcgtccatcgaaaatggtacttgtattaacacttgcatcatcaatttctggatttatgtttgggtacgatactggttatatatcttcagcattagttcaaattggtacagatttatctaacaaaattctaacatcaggtgaaaaagaatttataacttctgccacatcgttaggagctcttcttggtgctgttgttggtggtgtattagcaaatttgattggtagacgtagagttttattgggctcaaatatcattttcgttgtggggacaataatacaattggctgctcgtactgtgtggactatgatagccgggcgatttgttttaggttggggtgttggtattgcatcattgattgctcctttaatgatttcagaattagctcctgctaaatatcgtggtagattaattgttaccaatgtcatatttattactggtggtcaattaatagcttatttcataaattggggtcttacaagagtaagtcatggttggagagtatctgttggtttatgtatggtaccaccagttttacaatttgttttattttggtttttaccagatacaccaagattttacgtgatgaatgggaactttgaaaaggcaagacaagttttgagaaaagtacacgttgatccttcagatgaatttgtaaatgctactattgatgaaatgattgcctctgattcaactgtcccaggtaatggacctttacaaaaggcatggaaatcgatcaagattattcacactactccaggaaattttagagctttgatacttgcatgtggtttacaaggtatacaacaattcactgggtttaattcattaatgtatttcagtgcaaccatttttgaaactattggtttccataacgctacagctgtttctattatcattgctgccacaaatttcgtgtttacagggatagccatttgtattattgataaagttggtagaagaagaattttattggtaggaatgccatgcatgtgtatctcattaattgtctgtgctgttgccttccattatttgaatgttgatttcagtactggtacagttgtatctagaggtattaatggttgggggattgttgtgattataggaatgatattgtatgttgcttcttatgccataggtattggtaatgctgcttgggtgggtgttgaattgttttcagatgtcaatgtacgttccattggggcaatgtatgctgcatgtacaaattgggctggttcattggtgattgcttcgacattcttgacaatgttggaaaatataaccccaactgggacattttcattctttgctggattatgttttattgcatttttctttgtttatttcttgttaccagatactgctggtttggaattggaagaaaccaccgatttcttatccaacgggttcaatgtgaaacaagctgcacaattgtcaaaggaaagaaagaagcattccaagtttgctaaatcgaaaccaaccgtatag

SEQ ID NO: 4611 - protein, 554 aa, Candida albicans SC5314
MGSSTNNTQSKATPSVLENEVNSSKSSVVSSTSSAKGLLRETTNHGTMETSSVQISESESRPSKMVLVLTLASSISGFMFGYDTGYISSALVQIGTDLSNKILTSGEKEFITSATSLGALLGAVVGGVLANLIGRRRVLLGSNIIFVVGTIIQLAARTVWTMIAGRFVLGWGVGIASLIAPLMISELAPAKYRGRLIVTNVIFITGGQLIAYFINWGLTRVSHGWRVSVGLCMVPPVLQFVLFWFLPDTPRFYVMNGNFEKARQVLRKVHVDPSDEFVNATIDEMIASDSTVPGNGPLQKAWKSIKIIHTTPGNFRALILACGLQGIQQFTGFNSLMYFSATIFETIGFHNATAVSIIIAATNFVFTGIAICIIDKVGRRRILLVGMPCMCISLIVCAVAFHYLNVDFSTGTVVSRGINGWGIVVIIGMILYVASYAIGIGNAAWVGVELFSDVNVRSIGAMYAACTNWAGSLVIASTFLTMLENITPTGTFSFFAGLCFIAFFFVYFLLPDTAGLELEETTDFLSNGFNVKQAAQLSKERKKHSKFAKSKPTV

SEQ ID NO: 4612 - DNA, 1665 bp, Candida albicans SC5314
  CDS (1)..(1665): transl_table=12
atgggaagttcaaccaataatacacaatcaaaagctacccccagtgtgttagaaaatgaagtcaatagctcaaaatcatcagttgtttcatcaacgtcttctgctaaagggttgctacgtgaaaccactaatcatggtactatggaaacatcctcggttcagatatctgaatcagaatctcgtccatcgaaaatggtacttgtattaacacttgcatcatcaatttctggatttatgtttgggtacgatactggttatatatcttcagcattagttcaaattggtacagatttatctaacaaaattctaacatcaggtgaaaaagaatttataacttctgccacatcgttaggagctcttcttggtgctgttgttggtggtgtattagcaaatttgattggtagacgtagagttttattgggctcaaatatcattttcgttgtggggacaataatacaattggctgctcgtactgtgtggactatgatagccgggcgatttgttttaggttggggtgttggtattgcatcattgattgctcctttaatgatttcagaattagctcctgctaaatatcgtggtagattaattgttaccaatgtcatatttattactggtggtcaattaatagcttatttcataaattggggtcttacaagagtaagtcatggttggagagtatctgttggtttatgtatggtaccaccagttttacaatttgttttattttggtttttaccagatacaccaagattttacgtgatgaatgggaactttgaaaaggcaagacaagttttgagaaaagtacacgttgatccttcagatgaatttgtaaatgctactattgatgaaatgattgcctctgattcaactgtcccaggtaatggacctttacaaaaggcatggaaatcgatcaagattattcacactactccaggaaattttagagctttgatacttgcatgtggtttacaaggtatacaacaattcactgggtttaattcattaatgtatttcagtgcaaccatttttgaaactattggtttccataacgctacagctgtttctattatcattgctgccacaaatttcgtgtttacagggatagccatttgtattattgataaagttggtagaagaagaattttattggtaggaatgccatgcatgtgtatctcattaattgtctgtgctgttgccttccattatttgaatgttgatttcagtactggtacagttgtatctagaggtattaatggttgggggattgttgtgattataggaatgatattgtatgttgcttcttatgccataggtattggtaatgctgcatgggtgggtgttgaaatgttttcagatgtcaatgtacgttccattggggcaatgtatgctgcatgtacaaattgggctggttcattggtaattgctacgacattcttgacaatgttggaaaatataaccccaactgggacattttcattctttgctggattatgttttattgcatttttctttgtttatttcttgttaccagatactgctggtttggaattggaagaaaccaccgatttcttatccaacgggttcaatgtgaaacaagctgcacaattgtcaaaggaaagaaagaagcattccaagtttgctaaatcgaaaccaaccgtatag

SEQ ID NO: 4613 - protein, 554 aa, Candida albicans SC5314
MGSSTNNTQSKATPSVLENEVNSSKSSVVSSTSSAKGLLRETTNHGTMETSSVQISESESRPSKMVLVLTLASSISGFMFGYDTGYISSALVQIGTDLSNKILTSGEKEFITSATSLGALLGAVVGGVLANLIGRRRVLLGSNIIFVVGTIIQLAARTVWTMIAGRFVLGWGVGIASLIAPLMISELAPAKYRGRLIVTNVIFITGGQLIAYFINWGLTRVSHGWRVSVGLCMVPPVLQFVLFWFLPDTPRFYVMNGNFEKARQVLRKVHVDPSDEFVNATIDEMIASDSTVPGNGPLQKAWKSIKIIHTTPGNFRALILACGLQGIQQFTGFNSLMYFSATIFETIGFHNATAVSIIIAATNFVFTGIAICIIDKVGRRRILLVGMPCMCISLIVCAVAFHYLNVDFSTGTVVSRGINGWGIVVIIGMILYVASYAIGIGNAAWVGVEMFSDVNVRSIGAMYAACTNWAGSLVIATTFLTMLENITPTGTFSFFAGLCFIAFFFVYFLLPDTAGLELEETTDFLSNGFNVKQAAQLSKERKKHSKFAKSKPTV

SEQ ID NO: 4614 - DNA, 1803 bp, Ustilago maydis 521
  CDS (1)..(1803)
atggccgacccagctggtcagggtgtggacgtaagcgatgctgcgaacggacctacgagaaaaagaaagccagaccagctagccaatctggaccgatacaactttctgcgcccctcaagaggcggtaacgatgacgatgacgcggcagaagaggaggatgagctcctcccactggaccactcggagctcagttcggctagctacctagcacggctcactggtgtagcctgtctcggcggtctccagtttggctgggatacgggaatcgcgagcggaatgcttgttgcgatccattccgatctgggacacgagctgaacgagggagagcaggaactgatcgtaagcgctacgacggtcggagcgattcttggatccattgttgccggtaggatggctgactggctaggccgcaaaaaggtgatgatcggcagcggcgtcctgtttctcctcggtgcgctagagcaagcagcatcacaggtggttagagagctcgtgctcggtagagtcctcgtcggtctgggtgtaggcatggcgagcatggtggtgccgacgtacctggcagaagtggcgcctaccaaggtgcgcgggaggatcgtaggaatcaacagtcttcttgtcacaggtggtcaagtgattgcatacttgattgatgcagccttttacaacttgcctcacggatggagatggatggtgctggcgggcggtgtccccgccgtacttcagctagtcgggatgatctatttggacgagtctccgcgctggctcgttgcgcgcggtcggatcatccgagcccgaagagtgctacagcgcatctatccacatgcaagtgtacatacgatcgataacgagattgaccgcatatcgcgcagtatgcaaggcgctacacagcacgactcggtcgatccagatgcttgccacacagccgttcaacaggcagaggaggtgcaacatgatttgtcagcaacgctgggcagagttaccgctgctcctgcacagctgacctcgacagcacgtcagacgacgacacgtgtcaagagcaagctcgacatgctcctccaagatcgcacacatcgacgggcgctgttgattgcgtgtgtgctgcagtttttccaacaggctacgggagccaacagtctactctactactcatcgcgcttgctcatgatggccggctttgttgtcaacccgaacgccgcggcgatcgggatagcgattgctaactttggaggaacggtgattgcggtgcggtacatagattcgtggggtcgcagaaagcttttgctgtatacgaccgcggccatgactttgtgccttgcgctcgtcgccatcggattcagtcagatcgatctggggcctgtcactggcacgtccgagcagggagaacctgtctccacttcatggccctattggacgttggtgtttatgatcatgttcactctcagctatgcattggggctcggaatcgtgccgtggctggtacagtctgagattttttccggtcaagttcgcggtgtgggagcagggttggcgacggcaaccaactggagcacgaatctgttgatatcctcgacgtttctgcatctcgtcaaactgatacatccacaaggctgttttgcgcttttcagcgcggtatcagcactcagctgcgcttttacttactggctgctccccgagaccgctggtgtcagcttgaacgacgtttcgggtgctttgccctcgaccgaccgtccaggcacgcacgctcacgctgcgcaggcatatcaagcgattccttcgacagaggacgcggatgcactagagtag

SEQ ID NO: 4615 - protein, 600 aa, Ustilago maydis 521
MADPAGQGVDVSDAANGPTRKRKPDQLANLDRYNFLRPSRGGNDDDDAAEEEDELLPLDHSELSSASYLARLTGVACLGGLQFGWDTGIASGMLVAIHSDLGHELNEGEQELIVSATTVGAILGSIVAGRMADWLGRKKVMIGSGVLFLLGALEQAASQVVRELVLGRVLVGLGVGMASMVVPTYLAEVAPTKVRGRIVGINSLLVTGGQVIAYLIDAAFYNLPHGWRWMVLAGGVPAVLQLVGMIYLDESPRWLVARGRIIRARRVLQRIYPHASVHTIDNEIDRISRSMQGATQHDSVDPDACHTAVQQAEEVQHDLSATLGRVTAAPAQLTSTARQTTTRVKSKLDMLLQDRTHRRALLIACVLQFFQQATGANSLLYYSSRLLMMAGFVVNPNAAAIGIAIANFGGTVIAVRYIDSWGRRKLLLYTTAAMTLCLALVAIGFSQIDLGPVTGTSEQGEPVSTSWPYWTLVFMIMFTLSYALGLGIVPWLVQSEIFSGQVRGVGAGLATATNWSTNLLISSTFLHLVKLIHPQGCFALFSAVSALSCAFTYWLLPETAGVSLNDVSGALPSTDRPGTHAHAAQAYQAIPSTEDADALE

SEQ ID NO: 4616 - DNA, 1704 bp, Ustilago maydis 521
  CDS (1)..(1704)
atggccgaccgtgatcccagcctcactcccgacgaggacaaacctcactctctccagtctgacgacaagttctcgcccaaagcatccaacgaccacgctcagctccaccaacttcacctcgctactcgctctgttgtctccacagagggcatcatcgatgcagccgaacttgatcaagtcctggacgaagccgccatcgaggctgctggccagggcgagagcaacagtctctacctctggacactcaccttcttcgccaccattggcggtctcttgtttggctacgacactggtgccatatccagcgtgcttgtccaagtgggcactgatctagacaacaaagagctgaccgatggcaacaaggaattcatcacctcggcactcaccgtcggcgccatcatctctgccctttgcgccggtgtcgtggcagacaagttcggccgaaaatggacgcttgtcatttgtgatatcatgttcattgtaggcgccgtcattcaagctgctgcccacaagaagtgggacgttgtgggtggaagatttgttctcggtctcggaatcggcgcagctgctcagatcgtgcccgtatacatccaagaactggctccggctcgagcgcgaggtcgtctcacgtgcctaaatagcatcgccgtcacctttggccaggtcgtagctaccgccatcggcgccggttttgaacatgtctcttctggctggcgctggatcattgccctcggcgccttccctcctatcatccaactcattggtattcactttttcatgtcagagtccccgcgctatctcgtcaagcaacgaagagaggacgaagccgcgcgagccctcacccgtatctatcctctcgccacccccgagcagatcaacgcaaagcttggcgttctcaagaagcacatccaaaccgaggacgctcccctccgctaccgaatcgtcaaggtctggaccgatgtacccactcgtagagccgtcttcctaacttccatggttctagcctcacaacaactttcaggcttcaactccctcatgtacttttctggcaccttgttcaagtcggccgggctcaagcaaccgatcgcaaccagtctcatcgtcagcggagccaacttcctctgcactttcatccctctcaagtacattgatcgtttcggccgtcgccgcttccttctcgccacgatgccctgtgtcattattttcttggtttgcaccgccggaatctttgcaaagatgctccaacccaccaaccagcgcctcgtcgagggttatccgtatccaacgtcgtacacctcggccatgcttgtctttatggttctctacgtctgctcgtatgccaccggtcttggcaacgtaccttggcaacaaggcgagttcttctccaccgagacgcgcatgatcggtacctctatctctaccgcagtcaactgggcggccaacctcgtcatctcttcgaccttcttgagccttatgaatgccatcactccttccggtgcttttggcttctacgcaggcctcacatttgtcttccttctcattgtttacttcctttaccctgagacctcgctgttgtcgctcgaggaggtgcgtaccactctcaacggcggcttcaacgtcaaaaagagtctcaaggtacgaaaggagaagatcgccctttggaacactcagaagcaggctgctaaagccgagaccgccgcttag

SEQ ID NO: 4617 - protein, 567 aa, Ustilago maydis 521
MADRDPSLTPDEDKPHSLQSDDKFSPKASNDHAQLHQLHLATRSVVSTEGIIDAAELDQVLDEAAIEAAGQGESNSLYLWTLTFFATIGGLLFGYDTGAISSVLVQVGTDLDNKELTDGNKEFITSALTVGAIISALCAGVVADKFGRKWTLVICDIMFIVGAVIQAAAHKKWDVVGGRFVLGLGIGAAAQIVPVYIQELAPARARGRLTCLNSIAVTFGQVVATAIGAGFEHVSSGWRWIIALGAFPPIIQLIGIHFFMSESPRYLVKQRREDEAARALTRIYPLATPEQINAKLGVLKKHIQTEDAPLRYRIVKVWTDVPTRRAVFLTSMVLASQQLSGFNSLMYFSGTLFKSAGLKQPIATSLIVSGANFLCTFIPLKYIDRFGRRRFLLATMPCVIIFLVCTAGIFAKMLQPTNQRLVEGYPYPTSYTSAMLVFMVLYVCSYATGLGNVPWQQGEFFSTETRMIGTSISTAVNWAANLVISSTFLSLMNAITPSGAFGFYAGLTFVFLLIVYFLYPETSLLSLEEVRTTLNGGFNVKKSLKVRKEKIALWNTQKQAAKAETAA

SEQ ID NO: 4618 - DNA, 1422 bp, Bacillus megaterium
  CDS (1)..(1422)
atgaaacaaaatcgaaactcattatatattttttctattaccttagttgccgctatcggagggttactgtttggatatgacacagctgtaatatctggagctgaagaatcattaaaggtgtatcttattgacagcttagggttaggatctttagcacacggtgttactgtatcaagtgctttaataggatgtattattggaggattggtatctggttattttgcgacgaaactaggacgcaaacaatcacttatactagcagctattctttttatagtctcagcgttaggagcttcttatcctgagtttttatttttcacaaaaggggaaccgacactctctttgttactagcttttaacttctaccgcattataggtgggattggggttggcttagcatcagccatttgtcccatctatataggagaaattgcaccggcagatattcgcggcagattggtatcgttcaatcaatttatgattatttttggaatgttagtcgtttacttcgtgaattggggtattgcaaatggggaaaccttagaatggattaatgatgtaggttggagatacatgtttgcttcaggagctattccagctttactctttgcagcactcttgtttttagttcctgaaacgcctcgctacttagctatacagaatcaagatcaaaaagctttagccatactaactaaaattaatggatcttcagaagcgaaagcaattttagaagatattaaacaaacaatttctaccaatgtttcgtctgaaaaattattggcatatggaaaattagttatcgttgtaggtatactgctttctgtatttcaacagtttgtaggaatcaatgtagctctatattatgctccgcgtatttttgaaagcatgggagcagctaaaggttcttctatgctgcaaaccattattatgggattagtaaacgttatttttacagtaattgcaattttgacagttgatcggttgggaagaaaacctttattaataacagggtctatcggaatggccattggaatgttcggtgtagcaagcatggctttttcaaacatcattggtatagggacgcttgtatttatcattatttatacagcttcctttatgatgtcatggggaccaatttgttgggtgctcatttcagagatttttcctaataaaattagaggtcgtgctgtagctattgccgtagctgctcagtgggcggctaactattttatttcctctacatatcccgtgatgatggaatatagcggaggattaacatatggtttttacggtttaatgagtgtactttctgctttatttgtctggaaatttgttcctgaaacgaaaggtagaactctcgaacaaatggaaaatatgtggaggaaaaaacaaggggcttcaaagagtaagaaggccatataa

SEQ ID NO: 4619 - protein, 473 aa, Bacillus megaterium
MKQNRNSLYIFSITLVAAIGGLLFGYDTAVISGAEESLKVYLIDSLGLGSLAHGVTVSSALIGCIIGGLVSGYFATKLGRKQSLILAAILFIVSALGASYPEFLFFTKGEPTLSLLLAFNFYRIIGGIGVGLASAICPIYIGEIAPADIRGRLVSFNQFMIIFGMLVVYFVNWGIANGETLEWINDVGWRYMFASGAIPALLFAALLFLVPETPRYLAIQNQDQKALAILTKINGSSEAKAILEDIKQTISTNVSSEKLLAYGKLVIVVGILLSVFQQFVGINVALYYAPRIFESMGAAKGSSMLQTIIMGLVNVIFTVIAILTVDRLGRKPLLITGSIGMAIGMFGVASMAFSNIIGIGTLVFIIIYTASFMMSWGPICWVLISEIFPNKIRGRAVAIAVAAQWAANYFISSTYPVMMEYSGGLTYGFYGLMSVLSALFVWKFVPETKGRTLEQMENMWRKKQGASKSKKAI

SEQ ID NO: 4620 - DNA, 1711 bp, Amanita muscaria
  CDS (38)..(1600)
ataacctgccccccccaaattttctggcccttgaaccatgcctccagctgctacggggaatggcggcatagatcccaaaaacaaatttactggcatagccatgacagcattcagtgcttttggtggtatcctctacggttacgacactggcattatcagcggtatccttgcgatggacgatttcaagcgtacctttggtcaacaggcttctgatggcacatgttcccttccgctctcaagccaatccctgtttgtctctattctctcagctggaaccttcgtcggagctctctttggtgctcccatgggtgacattatcggcagaaaatggggtatcgtcatagctgctgcgatattctcgatcggtattgccttgcaaacagcctcagtaacggcagctcccttcgtcgttggtcgtgtcttcgccggtcttggtgtcggtctggtttcttgcctggttcctatgtatcagtccgaatgctcaccaaaatggatccgcggtgccgtagtatcattgtaccaatgggccattacgattggaatcttgcttgctgccgtcatcaacaacgccacccaaggccgtagcaaccactctgcctatcaaatccccatttctattcagtttgtctgggcatttatccttgggtttggcatgatgcttttgccggaatccccccgttttctcgttaggcaaggtcgcgacgaagatgctgccctgtccttgtcccgtcttacgaggctctcgcctgatgaccccgttgtcagaaatgaattggccgagattcgcaccaattttgaggctgaactggccctcggtgaaagctcgtacttggattgcttcagaccctcgcacaacaaaattttgttgcgtaccctgactggtattttcattcaagcttggcaacaacttacgggcatcaactttattttctactatggtacacaatacttccagaacgctggcatcaatcaagcattcctcattaccattgccaccggtatcgtcaacgtattcatgacattaccgggcttgtatggtgtcgaacgctatggtcgccgttccctcctccttattggtgcactaggcatgacgatttgcgagtttattgttgctatcgttggtgtcacgatccccgcctcgaatctagcaggtcagagagtgctaattgcattcgtttgcatttacatcgctttcttcgcatctacctggggtcctatgctttgggttatcgttggtgaaatctttcctctacaagtccgtgccaagggcatttcgctttctgttgccagcaactggttgtggaacttcggtattgcctttgctacaccttaccttgtaaatacccaagcgggatcagccggtctcgggtcaaaagtgttcttcatctggggcacaacatgtgcttgctgtcttgtctttacgtacttctgcgtgcccgagaccaagggcttgtctctcgaacagattgacgagatgtatcaggaagtaatgccattaaaatcctaccaataccgccgacgcctcgcgatagaaggcggatttaggacagaaaaggctgatatcatacacgaggaaacggcagaaaaggaaagcgggtaacagtttctacccttgtatcatgtttttctccacgtaattagttcttcagacttgtgatacaaaatgtcatcgtaagttacttgaagccgcccaaaaaaaaaaaaaaaaaaa

SEQ ID NO: 4621 - protein, 520 aa, Amanita muscaria
MPPAATGNGGIDPKNKFTGIAMTAFSAFGGILYGYDTGIISGILAMDDFKRTFGQQASDGTCSLPLSSQSLFVSILSAGTFVGALFGAPMGDIIGRKWGIVIAAAIFSIGIALQTASVTAAPFVVGRVFAGLGVGLVSCLVPMYQSECSPKWIRGAVVSLYQWAITIGILLAAVINNATQGRSNHSAYQIPISIQFVWAFILGFGMMLLPESPRFLVRQGRDEDAALSLSRLTRLSPDDPVVRNELAEIRTNFEAELALGESSYLDCFRPSHNKILLRTLTGIFIQAWQQLTGINFIFYYGTQYFQNAGINQAFLITIATGIVNVFMTLPGLYGVERYGRRSLLLIGALGMTICEFIVAIVGVTIPASNLAGQRVLIAFVCIYIAFFASTWGPMLWVIVGEIFPLQVRAKGISLSVASNWLWNFGIAFATPYLVNTQAGSAGLGSKVFFIWGTTCACCLVFTYFCVPETKGLSLEQIDEMYQEVMPLKSYQYRRRLAIEGGFRTEKADIIHEETAEKESG

SEQ ID NO: 4622 - DNA, 1893 bp, Petunia hybrida
  CDS (253)..(1785)
aagggaaaaaatattattacaaagagaaattacaaaagtttcaaaggtcgctctctcaataagagaaaaagcaaacaaatattgaaaacaagaaaagataaagaaaggcctttgcttcttatatatcccttgaaatcttgtgtatccacactatcattagtaaaagactaaaactcgcaaaaaattgtatttacatactatcgtataaataaaaagttagagatttaatttgctatcaacagttcaaacaagatggcaggaggctttgcagctggatctggaggaggtgactatgaaggaaaagtcacaacttttggtatcatgacatgtttggttgctgccacaggtggtctcctctttggttatgatattggtatctcaggaggagttacatctatggatgaattcttgctcaaattttttccaaatgtataccataaggagaaggccttgaaagcagggggcaaccaatattgcaaattcgatgatcatctattgcaactcttcacctcatcactttatttagcagcactagttgcttcatttgcagcttcaataaccaccaaggcctttggccgaaaaatctccatgcttattggaggtcttattttccttgttggtgctgtccttaatggtgctgccatgaatttggctgcactcatcattggtcgtttgttgcttggtgttggcattggctatgccaatcagtcagttccagtttatctctcagaaatggcaccacctaaacttagaggagcactcaatgtttgtttccaaatggctgtcacccttggtatttttgttgcaaatatggtcaactatggtacctcttcaatgaagaaaaatgggtggagagtttcacttgttctagcagctgttcctgcaattatcatgaccgtaggagcagtgttcttacccgatacccctaactccttaattgacagaggccagaaagagaaagccaaggccatgttgcaaaaaatccgtgggacaaataatgtagacaatgaatttgaggatcttataatagccagtgatatgtcaaagctagtgacagatccatgggggaacattatgaaacctaggtacagaccacaattgaccatagctgtcctcattcctttcttccaacaactcacaggtatcaatgtgatcatgttctatgcccctgtcctcttcaagactctgggatttggtgatgaggctgccttaatgaccgctgttatcactggacttgtcaatgtcttcgccacccttatctcaatattcactgttgatagatttggcagaagattcctgttcctcgcaggaggtctccttatgcttatctgccaggctgctgttggtagcgtcataggcagtgtgtttgggacggatggcttaggaacgttcagcaagggactcggaaacgtgacggtggggttgatctgtctgtatgtagcagcatttgcatggtcatgggggccattggggtggttggtgcctagtgaggttttcccaatggaaattcgatcagcagggcaatcaattacagtgtcagtgaacatgttcttcacattcgtgataggccaactcttccttaccatgctttgcgagatgaagtttggtctcttcttcttctttgctggatttgtggtactcatgacactcttcatcttcttcttcttgcctgagaccaaaggtatcccaattgaagaagtcaacagaatctggaagaatcattggttctggaaaagttacgtgccaaatgatgatgatgatcatcactctaaaaatcaagtttagaatgggcattaaaatgaaaaggaagattgtaaataattgtggccctcccggatgttactatgatattttttgttttcaatattaataaatacccactttttgcttgcc

SEQ ID NO: 4623 - protein, 510 aa, Petunia hybrida
MAGGFAAGSGGGDYEGKVTTFGIMTCLVAATGGLLFGYDIGISGGVTSMDEFLLKFFPNVYHKEKALKAGGNQYCKFDDHLLQLFTSSLYLAALVASFAASITTKAFGRKISMLIGGLIFLVGAVLNGAAMNLAALIIGRLLLGVGIGYANQSVPVYLSEMAPPKLRGALNVCFQMAVTLGIFVANMVNYGTSSMKKNGWRVSLVLAAVPAIIMTVGAVFLPDTPNSLIDRGQKEKAKAMLQKIRGTNNVDNEFEDLIIASDMSKLVTDPWGNIMKPRYRPQLTIAVLIPFFQQLTGINVIMFYAPVLFKTLGFGDEAALMTAVITGLVNVFATLISIFTVDRFGRRFLFLAGGLLMLICQAAVGSVIGSVFGTDGLGTFSKGLGNVTVGLICLYVAAFAWSWGPLGWLVPSEVFPMEIRSAGQSITVSVNMFFTFVIGQLFLTMLCEMKFGLFFFFAGFVVLMTLFIFFFLPETKGIPIEEVNRIWKNHWFWKSYVPNDDDDHHSKNQV

SEQ ID NO: 4624 - DNA, 1425 bp, Tetragenococcus halophilus
  CDS (1)..(1425)
atgaagtcacacccgcttacgcttactcaaaatattatgaataataaaggattaaatcgctatgttattacaattaccttaattgcaactttgggaggtctattattcggttatgatactgctgttatatctggtgctgaacaatctatccagaataatctagttaatggagtaggtttaggttcctttgctcacgggttaacagtttctagcgcacttattggttgtgtttttggaggtctattatctggaatattttcaaataatttggggagaagaaactctttaaaattagcaggtagcctctttttaatttccgcattggggtctgcgtacccagaatttttgttctttcaagccggtgatgcatcagttggtcttctaattgtatttaatttataccgcgttcttggtggtatcggtgttggaatggcttccggtatatctcccacatatattggtgaaattgctcctggaaaagttcgtggcagcctagtttcgtggtatcagtttgctattatttttggacaattagttgtatatttcgtaaattggggaattgccaccggacaatcaccagaatgggtgaatgatattggatggagatttatgtttgcttcagaagcaataccggctattttattttttgctttgttgttttatgtacctgaaacacctagatacttagtgttaaaaaataacgaagaaaaagcttttgacgttttatctaaaattaacaactctaaagaagaggcaaaagatatattaactgatattaaaggctctctaaatacaacagaaacgagtggtaagttattttcttatggtaaaactgtagtcattgtaggtgttttactctcaatatttcagcaattcataggtattaacgttgctttatattatgcaccaagaatatttgaaagtatgggcgccggccaaaatgcctcgatggtacagacaatcattatgggaattgttaacgtgacatttacctatgttgcgataagaactgtagataaatgggggagaagaccgttgttgttagttggatcaatagggatggctattggtatgttcgctgttgcgttgcttgcgaaaaatggtgtgttgggtatttggacgttagtctttatcatagtttatacggcctcctatatgatgtcgtggggaccgattgtttgggtgttactttctgaaatattccctaacaaaatcagaggacaagcaatggcatttgcagttgctgctcaatggctatcaaacttctttatttcatcaacctatcctgcaatgatagactttagtggaccgctaacttatggattttatggtttgatgtgtgttatttccgcaatttttgtatggaagatggtcccagaaacaaaaggaaagacgcttgaacaattagaaaatacttggttataa

SEQ ID NO: 4625 - protein, 474 aa, Tetragenococcus halophilus
MKSHPLTLTQNIMNNKGLNRYVITITLIATLGGLLFGYDTAVISGAEQSIQNNLVNGVGLGSFAHGLTVSSALIGCVFGGLLSGIFSNNLGRRNSLKLAGSLFLISALGSAYPEFLFFQAGDASVGLLIVFNLYRVLGGIGVGMASGISPTYIGEIAPGKVRGSLVSWYQFAIIFGQLVVYFVNWGIATGQSPEWVNDIGWRFMFASEAIPAILFFALLFYVPETPRYLVLKNNEEKAFDVLSKINNSKEEAKDILTDIKGSLNTTETSGKLFSYGKTVVIVGVLLSIFQQFIGINVALYYAPRIFESMGAGQNASMVQTIIMGIVNVTFTYVAIRTVDKWGRRPLLLVGSIGMAIGMFAVALLAKNGVLGIWTLVFIIVYTASYMMSWGPIVWVLLSEIFPNKIRGQAMAFAVAAQWLSNFFISSTYPAMIDFSGPLTYGFYGLMCVISAIFVWKMVPETKGKTLEQLENTWL

SEQ ID NO: 4626 - DNA, 2846 bp, Pichia stipitis
  CDS (175)..(1836)
gcatgcatcaccagacagcataaaaaaataaaaagtttttccgaaatgcaatgaggcagttttagcagcttatttttgttaggctcaaattataacttctataaatacaacagcatttctccccaagaaagattttttgaatacttgtctacataagttaaataactaattaaaatgtcttctcaagatattccttcaggtgttcaaacaccttcaaatgcttcctttttagaaaaggatgaagataagattgaagaagtaccccaaaaccatgatgcaaccttggtagccttggagtccaagggtatttctgaatatcttttgatttgtttcttctgtttgttagttgcttttggtggttttgtctttggtttcgacactggtaccatttctggatttgttaacatgtctgacttcttggaaaggtttggtcaaaccagagctgacggcactcactacttgtccaatgtcagagttggtttgcttgtgtctatcttcaatattggctgtgctattggtggtattttcttgtccaagattggtgacgtctacggtagaagagtcggtattatggcttccatggttatctacgtcgttggtatcatcgtccaaattgcttctcaacacgcttggtaccaagttatgattggtcgtgccattactggtttggctgttggtaccgtttctgtattgtctccattgttcattggtgaaagttctccaaagcacttaagaggtaccttggtttactgtttccaattgtgcattactttgggtatcttcattggttactgtgtcacctacggtactaaaagattatccgactctagacagtggagagtgccattaggcttgtgcttcctctgggctattttcttggttgttggtatgttggccatgccagaatctccaagatacttggttgaaaagaagagaatcgaagatgccaagaagtctgtcgctagatccaacaaattatccccagaagacccaagtgtctacactgaaatccaattgattcaagctggtattgacagagaggctattgctggatccgcttcctggactgaattgattaccggtaagcctgccattttcagaagagttgttatgggtatcatcatgcaatccttacaacaattgactggtgtcaactactttttctactacggaactaccattttccaagctgtcggattgaaggactctttccaaacctctattatcttgggtgttgtcaactttgctgctaccttcattggtatctgggccattgaaagatttggtagaagatcttgtttgttagttggttctgctggtatgtttgtttgtttcatcatttactctaccattggaagtttccacttgtacaaggatggtgaatacaacaacgacaacacctataaaccatccggtaacgctttgatcttcattacctgtttgttcattgttttctttgcctccacttgggccggtggtgtctacaccatcatctctgaaagttacccattgagaatcagatccaaggctatggccattgccactgctgctaactgggttttcggtttcttgatctcatttttcactccattcattgttagtgccattcatttcaagttcggttacgttttcagtggatgtttattattctccttcttctacgtctacttcttcgttgttgaaaccaagggtttgtccttggaagacgtagacgaattgtacgcttccaacgtggttccatggaaatccagcaagtgggttccaccatcgactgctgccatggctaccgaagctggttacgctgctgatgaaaagcctgttgacgaacatgtttaaatccctaatgtcttatgcatagcattctcacgataaaaaagttatagatagtttcccttaatgtttcatagacctaatgttataaaagattgaaatcgtacgtagttcttctatgctgactctattttgcttctagcgtaatgcaaaaattatttctcttggaacccagatatgcctctttctttgtaaatacctgaagtttctggtgccttttcccctgccagtcaaatagccaataggctaccttttttgcctcgtagtaaaacacttgcttgaatccaagacttgccattatcttttggaggatctcgttgtcaaagtaccgagagttggatatacatggcaatggtagaacaagaaacaaagaacttaaggtgtcctttgtaggctctctgaggaacttggttattcgaagaagcatgtctcctctttctttaggagatggcacaaaatttatcaccaacgaacacgatataagattgaatttttcagagttgtttctgggcaatggtctttccatgaagttctgttctagtataagaggactctgggagtttaaatctattctaacaatgctatcaaatatcccacatgtcgatatgagattgttgggacttaagcatccaatctctaaagcactattttggttcaatctagatttgtactcctctgtcttaagccattccaccaaccgtttagaagaatctcctcctctttttgcagtctggccctgagtcgaagcactctggtaggcttcgattccaccacgggcttcaatttcactatctatttctgccaaaagttgaaccaattgcgttgtggagagtgagtcgtctactttgacaaaggtggaattgttcttgactgacgaaagatcaaatttgtcaaaactttcttggaaaaccttctccaagttctttacatctttgattattgccttgtaattttcgatattaacttcagacaataccctactctttgtcgcctggagttttcgtattatagcatgc

SEQ ID NO: 4627 - protein, 553 aa, Pichia stipitis
MSSQDIPSGVQTPSNASFLEKDEDKIEEVPQNHDATLVALESKGISEYLLICFFCLLVAFGGFVFGFDTGTISGFVNMSDFLERFGQTRADGTHYLSNVRVGLLVSIFNIGCAIGGIFLSKIGDVYGRRVGIMASMVIYVVGIIVQIASQHAWYQVMIGRAITGLAVGTVSVLSPLFIGESSPKHLRGTLVYCFQLCITLGIFIGYCVTYGTKRLSDSRQWRVPLGLCFLWAIFLVVGMLAMPESPRYLVEKKRIEDAKKSVARSNKLSPEDPSVYTEIQLIQAGIDREAIAGSASWTELITGKPAIFRRVVMGIIMQSLQQLTGVNYFFYYGTTIFQAVGLKDSFQTSIILGVVNFAATFIGIWAIERFGRRSCLLVGSAGMFVCFIIYSTIGSFHLYKDGEYNNDNTYKPSGNALIFITCLFIVFFASTWAGGVYTIISESYPLRIRSKAMAIATAANWVFGFLISFFTPFIVSAIHFKFGYVFSGCLLFSFFYVYFFVVETKGLSLEDVDELYASNVVPWKSSKWVPPSTAAMATEAGYAADEKPVDEHV

SEQ ID NO: 4628 - DNA, 1593 bp, Aspergillus oryzae
  CDS (1)..(1593)
atggattctgattcactgcaaatctctgagaataaagcggagatcttccacgatgaggacctggtctcaatagccttagatgactccattgaggaaacccatcccgggaaagcagtatggctgattgtctgtgcggtgtccatgggtggctttcttttcggctatgacacgggggttatatcttctgtactcgtcaatctggggtcggacctggggaaaccactcagctccaatgaacaagaattaattacctctatcacctccggaggcgctctgataggctcagtagcggcgggcatgacagccgacaaatacggccggaaacttgccatttacgtaggctgtatcatcttcttcataggaagcataattcaggcagccgcatactcgctcccccagatgactgttggtcgcctcgttgtgggcttcggcgtcggcgaggccgcgatgattgtcccattgtacattggagaaatggccccggcgcggtttcgtggccgcctcatagtctttgacaatatatgtgtcactttcggtcagcttgtctcatatgcactcggcgccgcgttcacggatgtggcttctgggtggagatacatggtgggcctcggcgcagtacctgctttgttgctcgttgcgatgatgccattttgccctgagacacctcgtcagttggtcctacatggtcgactggaagaggctaggcgtgtgatttcgaagatattcccacgagccactgaccgacaggtcgatgcgaaggcgagactgatccgatattcaattgaagaagccaccgcgtcgatatctaataagagccttgcatggcagatgagacagctttttactgttggtcagaatgtgcgagctcttataactgcttgcgccgttatggcggtatcccaactcggaggcttcaattcgcttatgtactacgcctccacgctcttttcaatggttgggtttgacaagcccaccgtggtgtcaatagtggttggagccactaattttatatttggattcccaaacttcatcttcattgaccgcttcggccgacggcgtatgctcctggttaccatccttggaatggcaagcatccttttcaaaatatgcctatctttggtggttgcctctgtagccttccactggattccagtgaaccatgacctcacggccgttgagacgcgcgagatgggctggcctaatatcttgcttctcgtgtctctcatcgtatatattgccttctactcggcaggtgtcgccccgatctcttgggtggggacggagtttctacctctcgaagttcgtgcattggggaccatgatgaacagcgtaacctgctggggctgcaacatcattatatcatcaacctttctgtcgatgatgaagggaatgacccctagtggaacctttggtttctacgctggaatatgcttgcttggattcatctttgcgattttctgctatgcagaggttcataacatgcctctcgagtctgtccgagagatatataaccatggatttggagtcaagtatgcacgggaggtgcagaaagaacttcacgaggctagagatgcagaggggagcacggcgtga

SEQ ID NO: 4629 - protein, 530 aa, Aspergillus oryzae
MDSDSLQISENKAEIFHDEDLVSIALDDSIEETHPGKAVWLIVCAVSMGGFLFGYDTGVISSVLVNLGSDLGKPLSSNEQELITSITSGGALIGSVAAGMTADKYGRKLAIYVGCIIFFIGSIIQAAAYSLPQMTVGRLVVGFGVGEAAMIVPLYIGEMAPARFRGRLIVFDNICVTFGQLVSYALGAAFTDVASGWRYMVGLGAVPALLLVAMMPFCPETPRQLVLHGRLEEARRVISKIFPRATDRQVDAKARLIRYSIEEATASISNKSLAWQMRQLFTVGQNVRALITACAVMAVSQLGGFNSLMYYASTLFSMVGFDKPTVVSIVVGATNFIFGFPNFIFIDRFGRRRMLLVTILGMASILFKICLSLVVASVAFHWIPVNHDLTAVETREMGWPNILLLVSLIVYIAFYSAGVAPISWVGTEFLPLEVRALGTMMNSVTCWGCNIIISSTFLSMMKGMTPSGTFGFYAGICLLGFIFAIFCYAEVHNMPLESVREIYNHGFGVKYAREVQKELHEARDAEGSTA

SEQ ID NO: 4630 - DNA, 1638 bp, Aspergillus oryzae
  CDS (1)..(1638)
atggcccaagacaaagatgcaaaatcccaatctccaacgtccataatgaatgatcccaaaaaagcgagcctacccgaaaatgcacacatcgaagtggccgctgggagtctcaccacggaaactggcatcgacgacctcccaattagtatgttcgtatggcttgttgcctttaccgcttcgattgctggaatgttgtttggctacgatactgggattatcagtgctgttcttgtctacatccatgatgggttagacaaccgcacgctcaccagcaacgaaaaggaattgatcacgtccctctgctcgggtggggcgttcttcggatctattttggctggattgacggcggataagttgggacgcaaagcagcaatctatttcggttgcgcgttgtttacaatcggagctgtccttcaaggcgccgcatacacgattgctcaaatggccgtgggtcgcgttgtagttggctttggtgtggggtcagctgccatggtggtgcctttgtatatcgctgaagtagcacctgcgaaggcccgtggacgacttattggcttgaataacatgtcaatcaccggtggtcaggtaacctcctatgctatcggagctgcctttgccaatgtcaaccatggctggcggtacatggtagggctcggggcattgccagccctaatcctggccgctctgatgcctttctgccccgagtccccacgccacttggtatacaaccatcgccaggaggaggcccggggcgtgctccgtagaatctacgggcacccatccgacgttcagctggcttcagttttagcctcgatatccgccgcctgtgacgaagctcgggagatcaacgagggcgcgacgcggtggaccaaaatgaagcagcttcatgccgtacccagcaatctccgggcattgatcagcgcatgtggcttgatggtcatatcacaactctcgggtttcaatacgcttatgtactactcctcaacactatttgcattagtaggcttcgataatcccaccgcagtagggatcgtcgtcgctggaaccaacttcatcatgacctgggtcaacatgatggtgatcgacaagatgggtcgtcgccgactgctcttatccacagcctggggtatgtccgtcggtcttattgcgatagcggtagcattctcctttattccagtcgacctagatactctcgatttgaagagcaacagtgtctctcctccggcgattgtcgtcttggtgttcattatctggttcgtgcttttctatggcgtctcggtcggcaacacggcatggatgagcacggatttcttccctctggaggtccgcgcgatgggcactatgtggatcacctgctctagctggggaagcaatgtcattgtatccagtacgtttttgtccatgatgaagagtatgaccccgtctggagcatttgggttctatgcgggcatctgtggtgttgggtacgttttgatatactttttctatccggaggtgtctggtttgtcgttggaggagattaaggaggtattcaaacatgggtttggagtgagatacgctcggaatctgcgcaaagagcgaagggatattatccaggagaggttgaggatacaaggcaagacggctgttgtggggcactga

SEQ ID NO: 4631 - protein, 545 aa, Aspergillus oryzae
MAQDKDAKSQSPTSIMNDPKKASLPENAHIEVAAGSLTTETGIDDLPISMFVWLVAFTASIAGMLFGYDTGIISAVLVYIHDGLDNRTLTSNEKELITSLCSGGAFFGSILAGLTADKLGRKAAIYFGCALFTIGAVLQGAAYTIAQMAVGRVVVGFGVGSAAMVVPLYIAEVAPAKARGRLIGLNNMSITGGQVTSYAIGAAFANVNHGWRYMVGLGALPALILAALMPFCPESPRHLVYNHRQEEARGVLRRIYGHPSDVQLASVLASISAACDEAREINEGATRWTKMKQLHAVPSNLRALISACGLMVISQLSGFNTLMYYSSTLFALVGFDNPTAVGIVVAGTNFIMTWVNMMVIDKMGRRRLLLSTAWGMSVGLIAIAVAFSFIPVDLDTLDLKSNSVSPPAIVVLVFIIWFVLFYGVSVGNTAWMSTDFFPLEVRAMGTMWITCSSWGSNVIVSSTFLSMMKSMTPSGAFGFYAGICGVGYVLIYFFYPEVSGLSLEEIKEVFKHGFGVRYARNLRKERRDIIQERLRIQGKTAVVGH

SEQ ID NO: 4632 - DNA, 1623 bp, Aspergillus oryzae
  CDS (1)..(1623)
atgtcactgaataagtactgtggcgaggacgactcgtacgaaaaagaaaaagcagagcaagtagaacatgttgacacgatagatgccgaaaagggacatctccaggacgcctccgaactcagtggcattgaagacacggcggcatccaaagctgcgtggttgatctcaataacggtctcaatcggtggtcttttattcgggtacgacaccggctatatctcctcggtactcgtgacgattggaacgtccctcggtcatactttgagctccagtgaggaagaactcgtcacttcattaacgagcggtggtgctttgatcggcgcagtaggagctggtctgaccgcggatcgctttggtcgccgctggcccatctggggggcttgtattcttttcgtactaggaacagtgctgcagacatgttcttattccgtacctcagtttgcagtcggtcggttcgttgtgggccttggtgtcggcagtgctgccatggttgtacctctgtatatcggtgaaatagcacctgccaaatatcgtggtcgcatggtggcattcaacaacatgagcgttacctttggtcagctcctggcgagtgcgatcggggccggttttgcgcaagtgaagggagaagcatggcgagcaactgtcggaattggagctgcaccagccgttgcacttgctgcactcctcttgctatgcccggagtcgcctcgtcagctagtctcgcacggtgataatgcaagtgcagatgctgttctgcaacgcatctacccgggatctaccaccgaacagcgcgaggctaagatccggtcgattgaattgtccctgcaggaggcgacgcatgcgatgtccgaagactcaatctgggccacgatcaaacgtgtgttcaccaccccatcaaccggtcgtgccgtcctgactgcatgcgtggtcatggctatcagtcaactgggtgggttcaacacattgatgtactacgctgcgaagcttttcgctatcgttggtttcaacaaccctacggctgtcggtattaccgtgtcagggactaactttgtcttctcggtcgtcaacctcttggttgtggatcgatttggacgacggattatcctgaccactacagtgcttggcatgggcatctgtatgctcatcaccgcggtcgcgtttcactatattcccgtcaatctgcaaacattggaagtggaaaccaataatgttggctggccgggaattgtcgtcctggtcactatcatttgctatgtagcctgctattcgtctggtgttgcgaccattgcgtggattggaactgagttgattccacttgaggtccgagctgtaggaacgatgatgaacacggttacttgctggagcaccaacattatcatctcctctaccttcctgtccatgatgaagggtatcacaccgagcggtgcatttgggttctacaccggcatctgcttcactggctgggtatttgtggtgttctttttccctgaatgcaagggcatgcctttggaggccattcgtgaagtgtttagcgatggttttggagtgcgctattccaagaaatggcaaaaggaacataaaaatgaggctagggctgccacggtcacctcgtttgggcactaa

SEQ ID NO: 4633 - protein, 540 aa, Aspergillus oryzae
MSLNKYCGEDDSYEKEKAEQVEHVDTIDAEKGHLQDASELSGIEDTAASKAAWLISITVSIGGLLFGYDTGYISSVLVTIGTSLGHTLSSSEEELVTSLTSGGALIGAVGAGLTADRFGRRWPIWGACILFVLGTVLQTCSYSVPQFAVGRFVVGLGVGSAAMVVPLYIGEIAPAKYRGRMVAFNNMSVTFGQLLASAIGAGFAQVKGEAWRATVGIGAAPAVALAALLLLCPESPRQLVSHGDNASADAVLQRIYPGSTTEQREAKIRSIELSLQEATHAMSEDSIWATIKRVFTTPSTGRAVLTACVVMAISQLGGFNTLMYYAAKLFAIVGFNNPTAVGITVSGTNFVFSVVNLLVVDRFGRRIILTTTVLGMGICMLITAVAFHYIPVNLQTLEVETNNVGWPGIVVLVTIICYVACYSSGVATIAWIGTELIPLEVRAVGTMMNTVTCWSTNIIISSTFLSMMKGITPSGAFGFYTGICFTGWVFVVFFFPECKGMPLEAIREVFSDGFGVRYSKKWQKEHKNEARAATVTSFGH

SEQ ID NO: 4634 - DNA, 1629 bp, Aspergillus oryzae
  CDS (1)..(1629)
atgggcactagacatgaaaacgatacattggaccctaacgctcctctacttattctagatggacacactacccacgacccccaaaacaatgaagaagataggcacattgatagcgagtcaaactactcgggaactcaatttatatgggcattgacattctctgctggtcttagtgggctattatttggttatgacacaggggtgatttcctcaacgctcgtatcaatcggcacggatctctccgatcgcgatcttacaacactagacaaaagcctaataacatcttgcacaagcttgtttgctttggttgccagcccccttgcgggggttctggctgacaagttcggtcgccggaaggttatattcgttgcagatgcgctgttcgctctaggtgcttttgtgcaggcaatctccaatgaagtatggggcatgattgctggtagaagtattgttgggttagctgttggcggcgcgagcttggtaactccattatacatctccgaattggcaccatccaatatgaggggcagactggtgacgattctctccttgttcatcaccggtggccaagttgtagcatacatcgtgggttggctcttttccttaattgacggaggctggcgctggatcgttggccttggaatacttccggcactctttcagcttgttatcctcaccgctctacctgaaactccccgatggctggcacaagcaggattcgaaacaaatgctatagctgtcctgggaaaggtctaccagggtcatccagacagtgactgcatcactaaacgaattttacgggaaattcagcaggaggtagcagaagaacggttaggtcatcctggtggttcttctggggctggccaacagtggattcactacgtcttgcagcgtaccacagagctcttctacgttggtggcaatagaagagcgttgattatagcgatgatgctacaaggttcgcagcagctctcgggcttcaactgtcttatgtacttctctggcattatattttcatctctctccttttcgtcgccgacgctcacgtcgctgtcagtggccacgactaactttctttttacattgcttgcatttacctacatcgataggatcggccggcgccgaatcctcctctattctatacctatcatgacaatatctctcatcgtttgcgcactaaccttctctttggtgtcatcagatttgtcctcttttccactgacacgtgcagggtccagtgacaccgtgccagatgattcaatgctccctatcactattctcttgtgtttaacggtttacacggcttcttacgccttcgggcttggcaatgtaccctggcagcagtccgagctgtttcctttaagtgtacggtctctcgggtctgcattcgctacagcaacgaactgggcctcaaatttcgttgtcgggctcacttttcttcccatgatggaactattgtctccagggtggacctttgggacctatgcggtcgtctgtgcagttagctggtttgctgtgtgggcgatctaccctgagatgagtgggctcggtttagaagaggtcaaggaactcctcgcagatggctggggtgtcaaggaaagtctggcgaggacccgcaacgactcctag

SEQ ID NO: 4635 - protein, 542 aa, Aspergillus oryzae
MGTRHENDTLDPNAPLLILDGHTTHDPQNNEEDRHIDSESNYSGTQFIWALTFSAGLSGLLFGYDTGVISSTLVSIGTDLSDRDLTTLDKSLITSCTSLFALVASPLAGVLADKFGRRKVIFVADALFALGAFVQAISNEVWGMIAGRSIVGLAVGGASLVTPLYISELAPSNMRGRLVTILSLFITGGQVVAYIVGWLFSLIDGGWRWIVGLGILPALFQLVILTALPETPRWLAQAGFETNAIAVLGKVYQGHPDSDCITKRILREIQQEVAEERLGHPGGSSGAGQQWIHYVLQRTTELFYVGGNRRALIIAMMLQGSQQLSGFNCLMYFSGIIFSSLSFSSPTLTSLSVATTNFLFTLLAFTYIDRIGRRRILLYSIPIMTISLIVCALTFSLVSSDLSSFPLTRAGSSDTVPDDSMLPITILLCLTVYTASYAFGLGNVPWQQSELFPLSVRSLGSAFATATNWASNFVVGLTFLPMMELLSPGWTFGTYAVVCAVSWFAVWAIYPEMSGLGLEEVKELLADGWGVKESLARTRNDS

SEQ ID NO: 4636 - DNA, 1671 bp, Aspergillus oryzae
  CDS (1)..(1671)
atgaggattccctttctcagcgaccggcattgtgaaaacatatctcccttcacttccatgaaatcatatctatcctcacacctgcatcccaaacaatgccgtcgctcaggcaatcaaacttcttgtcttccacacgcaattgaactagaacatgtagatgaaggcaatcgtagaagctatgttgcacatcgcgttcctgcgttctacacgccagtttattctccgaggttcgtctatggatgcgtcctgtcggcatccatcgggggaattctcttcggatacgacaccggcatcatttcaagcgctcttgttgtattctatagagatctgggccatgatctcagcagggaagagaagcaactcttgaccagtcttaccagcggtggtgcttttatcggagctttgatcgcggctctcaccacagatgctatcggacgaaaaatggtcatagggctcggatgcatctggttcaccgtcggctccgtcctcgcatcatccgcatattcagttgccctaatgtccatcgcgcgattcatcatcggggtaggcatgggcctcgaaaccatggtaactccaatctacatctccgaactctccccctcctcgcgccgcggtcgcatgatcaccgtctactcgctagcagtaacaggtggtcaagccctcgcctacgcaatcgggtccatattcaacctcgtctcgcagggctggcgctacatgttcgccttcggcgccatcccagccctaatccaagtcgcgctgttccccatctaccccgagaccccgcgccacctcatctaccggaaccaaacagcagacgccataatggtgctacaacagatatacccacaggcgcccccctccgacatccagaccctcgtccaaaccatccaagacgacgtcaaccgctccgtctccttcgaccaggggatccgacgcgcatgctggtcctggaaacagctgcacaccgtcccctcgcatctccgttcgctcatcacagcttgcggcctcatggcgctgcaacagctctccggtttcaattcgctgatgtactactccgccacgctcttcaatataatggggttctcgaaaccaatcgaagcgggccttatcgtctccgggacgaacttcatcttcacagccctctctctcaaattcgtggacctaggtcgtcggcgcttattgattggcactgtgtggggattgccagtggcgctggccatggctgcgggggcgttctcgaagatcaacatcgatacgaatctagagcttgtggctacaccaccgctgtgggcaaaggtccttgccatcatttctttcgcagtgttcgtggcgttttatgcgatcgcattgggcaatgtgccgtggttggccaacgagttcttggccctggaggtcagggccgttgggacggcgatgttgactatggtttgttggagctcgaatattcttgtttcggcgacttttctttcgcttgtgagtgcgatctcggcgtcgggtgcgtttgggctctatgctggggtttgttttgttgggtgggtgttcattattttcacgtatccggaaacagctgggttagggctggagagtgtgcggcaggtgtttgagcatgggtttggtgttcggtacgcgaatcagttgcaggggcttcggtggatagatgcggcgttatga

SEQ ID NO: 4637 - protein, 556 aa, Aspergillus oryzae
MRIPFLSDRHCENISPFTSMKSYLSSHLHPKQCRRSGNQTSCLPHAIELEHVDEGNRRSYVAHRVPAFYTPVYSPRFVYGCVLSASIGGILFGYDTGIISSALVVFYRDLGHDLSREEKQLLTSLTSGGAFIGALIAALTTDAIGRKMVIGLGCIWFTVGSVLASSAYSVALMSIARFIIGVGMGLETMVTPIYISELSPSSRRGRMITVYSLAVTGGQALAYAIGSIFNLVSQGWRYMFAFGAIPALIQVALFPIYPETPRHLIYRNQTADAIMVLQQIYPQAPPSDIQTLVQTIQDDVNRSVSFDQGIRRACWSWKQLHTVPSHLRSLITACGLMALQQLSGFNSLMYYSATLFNIMGFSKPIEAGLIVSGTNFIFTALSLKFVDLGRRRLLIGTVWGLPVALAMAAGAFSKINIDTNLELVATPPLWAKVLAIISFAVFVAFYAIALGNVPWLANEFLALEVRAVGTAMLTMVCWSSNILVSATFLSLVSAISASGAFGLYAGVCFVGWVFIIFTYPETAGLGLESVRQVFEHGFGVRYANQLQGLRWIDAAL

SEQ ID NO: 4638 - DNA, 1671 bp, Debaryomyces hansenii
  CDS (1)..(1671)
atgagtaattctactaaaaaggatgactgtcatgacgtgacaatagatagcactatatcagatattgaaatagaaaggtcaggctctacaaataatgttatgattgaaccaagtcccaaaagttcttcagaattgttgagctcagaatcagttatttctgattcggacgcaagaccatccaaattgattattttaatcacgttaacatcatctataagtgggtttatgtttgggtatgacaccggttacatatcgtctgcgttggtgaatattggcactgatttgagcaataaattattgtctaacggagagaaagaatttattacgtctgctacttctttgggtgcgttgatcggggctatcattggaggcatattagccaacttgattggaagaaaaatggtgttgttaggatcaaacgttatttttgttataggaactataattcaattagctgcacatactgtttggacgatgattgttggtagatttgttttgggactcggagtgggcattgcgtctttgatttcgcctttgatgttgagtgaattggcaccgtcaaaatataggggccgtttgattgttaccaactgtatgtttataactggaggtcaattggttgcctattttataaactggggattaactggtgtgaataatgggtggagagtatctgttggattatgtatggtaccccctataattcaatttgtgttgttttgtttcttacccgataccccaaggttttatattatggtaggtagagttgaagaagctagaaaagttttgagcaaaactcaccacaatccttccaatgctttcgttaatgcaactattcaagatatgatcgcctccaattcgactgttccaggaaataatccattagttcaagcgtggaactcaattaaaatcattcacacaaatccagcaaattttagggcattaatcttagcttgtggcttacaaggtatacagcaatttacggggtttaattctttaatgtatttcagtgcaacaattttcgaaactattgggttcgataatgcaactgcagtatctattattattgccgctacgaactttgtgtttacagggattgcattatgcattattgataagataggacgtagacgtatcctattaggtgcaattccatgcatgtgtatatcattagttctttgtgctattgccttccactttttaggtgtgaagtttacatcagattctgatgtcattgttgaagcgagaggcattactggctgggggattgttattattctcggtatggtgtggtttgtggcttcttacgctattggtataggtaacagtgcttggactggtgttgaattattctcagatgtaaatgttagagctgtcggctgtatgtatgctgctgctactaattgggctggttccttagttattgcatccactttcttgaccatgttggagaatattacacctcctggcacttttgcatttttcgcaggtttatgttttgttgcattcttttttgtttttttcttattgccagaagtttcaggcttggaactagaagaaactacagaatttttagcaaatggattcaatgttaaggcatctcgtcaaatttctaaggatagaaagaaagtgtcaaaattcgttactcaaaatgacgatcacagtgcataa

SEQ ID NO: 4639 - protein, 556 aa, Debaryomyces hansenii
MSNSTKKDDCHDVTIDSTISDIEIERSGSTNNVMIEPSPKSSSELLSSESVISDSDARPSKLIILITLTSSISGFMFGYDTGYISSALVNIGTDLSNKLLSNGEKEFITSATSLGALIGAIIGGILANLIGRKMVLLGSNVIFVIGTIIQLAAHTVWTMIVGRFVLGLGVGIASLISPLMLSELAPSKYRGRLIVTNCMFITGGQLVAYFINWGLTGVNNGWRVSVGLCMVPPIIQFVLFCFLPDTPRFYIMVGRVEEARKVLSKTHHNPSNAFVNATIQDMIASNSTVPGNNPLVQAWNSIKIIHTNPANFRALILACGLQGIQQFTGFNSLMYFSATIFETIGFDNATAVSIIIAATNFVFTGIALCIIDKIGRRRILLGAIPCMCISLVLCAIAFHFLGVKFTSDSDVIVEARGITGWGIVIILGMVWFVASYAIGIGNSAWTGVELFSDVNVRAVGCMYAAATNWAGSLVIASTFLTMLENITPPGTFAFFAGLCFVAFFFVFFLLPEVSGLELEETTEFLANGFNVKASRQISKDRKKVSKFVTQNDDHSA

SEQ ID NO: 4640 - DNA, 1623 bp, Yarrowia lipolytica
  CDS (1)..(1623)
atgtcgctggacaaaaaccgccagatcacgacctctgagtcgtcgtctggaagcagtgccgatgaagggacccatatcatgagaggcctgaccagtactagtactcaggacgagaccactggttccatttcggaaggcaacctagaagccgagaaaatctcgccgtttgtgtttgtgctggttgccctggcctccatttccggattcctgtttggatacgacacgggctatgtttctggagctctggtggtcatcaaggaggatcttggacgtgccctttccaacggagataaggagctgattactgcttccacgtccctgggagctctccttggaggagttattgccggagccatgtgcgacttctttggccgaaagtgggttatcacctttgccaatattctgtttctggttggagctgccattcagtgtggagctcacgccgtgtggaccatgatcggaggccgattcgtcatgggatggggcgtgggtattgcatctctatgtgctcctctgtacatttccgagctggcccccactcgaatccgaggtcgtcttgtcgttctcaacgtcctggctatcaccggaggacagcttgtggcctacggaattggtgctggcatggcccacgtgcaccaaggatggagaattctagttggtctgtctatggtgcctgcctttgtgcaaatggtcatctttgtgttcatgcccgagactcctcgatatcttgttcgaaagaataagattgctgaggccaagaaggtgctggccaagacatatgccaccgatgacgacaaccttctcgaccgaaagctccacgaactcatgctccacaacgcatacaaggagtccggcctgtccactatggcgcgagctcgaaacactatgaaggaactttattgcgtacccagcaacttgcgagccctcataattgcttgtggactgcagggaatccagcagttttgtggtttcaactcgctcatgtacttttctgctaccatttttgaggtggtgggctttgataacgccacagccgtctccatcatcgttgctggaacgaactttgtcttcaccattgtcgcctttatggtcattgaccgtattggacgacgccgaattctcctgggaaccatctggggcatgtctctgggactcgttgtcaacgccattgctttccacttccttgacaagcagaaggaaaagaaccccaaccatgagctcgataaggaacacatttccggatgggcatacgtggtcctcgttgctcagctcgtctacgtcgccttctacgccactggtatcggtaatgtgccatggcagcagtcggagctgttccccatctccgtccgaggtgttggaactggcatggccactgccaccaactgggcaggatcgctcattgtgtcctccactttcctgaccatgttggaaaatatcacccccactggaacattttccttctacgccggtctctgtgctctcggagaagtgtttgtcttcttcctgtatcccgagacttccggcatggatctggagcagattcaacagctgctgacgggaggtttcaacatcaaggagagtatgcggctgtctgatgaggccaagagaggctacaagaagtag

SEQ ID NO: 4641 - protein, 540 aa, Yarrowia lipolytica
MSLDKNRQITTSESSSGSSADEGTHIMRGLTSTSTQDETTGSISEGNLEAEKISPFVFVLVALASISGFLFGYDTGYVSGALVVIKEDLGRALSNGDKELITASTSLGALLGGVIAGAMCDFFGRKWVITFANILFLVGAAIQCGAHAVWTMIGGRFVMGWGVGIASLCAPLYISELAPTRIRGRLVVLNVLAITGGQLVAYGIGAGMAHVHQGWRILVGLSMVPAFVQMVIFVFMPETPRYLVRKNKIAEAKKVLAKTYATDDDNLLDRKLHELMLHNAYKESGLSTMARARNTMKELYCVPSNLRALIIACGLQGIQQFCGFNSLMYFSATIFEVVGFDNATAVSIIVAGTNFVFTIVAFMVIDRIGRRRILLGTIWGMSLGLVVNAIAFHFLDKQKEKNPNHELDKEHISGWAYVVLVAQLVYVAFYATGIGNVPWQQSELFPISVRGVGTGMATATNWAGSLIVSSTFLTMLENITPTGTFSFYAGLCALGEVFVFFLYPETSGMDLEQIQQLLTGGFNIKESMRLSDEAKRGYKK

SEQ ID NO: 4642 - DNA, 1548 bp, Yarrowia lipolytica
  CDS (1)..(1548)
atgggactcgctaacatcatcaaccgtggagaaaagcccgagggctcggccttcatggcggcctttgtggccgtgtttgtcgcgtttggaggtattctgtttggatacgacactggaaccatttccggcgtcatggccatgccattcgtcaagaagacctttacagatgacggcctggagttcacttctgagcagacctcgctcatcacttccattctttctgcaggcaccttcactggagccatttctgctccctgggcctctgatactctgggaagacgactgggtctgatcctcttctgtgtcgtcttctctgttggcgctattcttcagactgctgccaccggccgaacgcttttgattgtcggacgagttgttgctggtcttggtgttggtggagtctcttccatcgttcctctttaccagtctgaggttgcccccaagtggatccgaggtgccgttgtctccatctaccagtttgccatcaccattggtcttctgctggctgccattgtcaacaacgcaaccaaaaacaaagacaacagtgcttcctaccgaattcctctcggccttcagcttctgtgggccgtcatcctgagtggaggtctcatcctgctaccggagactcctcgattctggatcaagaagggcgagtacgacaaggccgccgattccctgcgacgactacgacgacttcctgttgagcacgaggctgtacagaaggagctcctggagatccaatcttctcacgaccacgagatgcagatcggtagcgccacctgggccgcctgcttctcccccaaggggtcccagctgaagcgaatgctgaccggtattgccattcaggccctgcagcagctcaccggtatcaacttcatcttctactacggaaccgagttcttcaagaagtccaacatctccaaccccttcctcatccagatgatcaccaacattgtcaacgtggttatgaccatccccggtatcatgtttgttgatcgagtcggacgacgaaagctgctgttgatcggagctatcgtcatgtgctcttccgagtttatcgtggcggctgttggtactgccattgataacgagacctcctcaaaggttctgattgccttcacttgtaccttcattgccggtttcgccgccacctggggtcctattgcctgggttgtcattggagagattttccctctacgaatccgagccaagggtgttgctctatgcgccgcctccaactggcttttcaactttgccattgcctttgcaaccccctacctcgtcgacgaggcccctggatcggccggtctcaagaccaaggtcttcttcatctggggaggctgcaacttcctgtgcatcgccttcacttacttcttcatctacgagaccaagggtcttactctggaggaggtggaccagatgtacgccgagatcaagattgcttctcgatcccaccagtttgtgcctaccactcgagtcgctgcttacgacgagcacgcttctgacgacaagaaggacggacagcacgtctacattgagtctgtctag

SEQ ID NO: 4643 - protein, 515 aa, Yarrowia lipolytica
MGLANIINRGEKPEGSAFMAAFVAVFVAFGGILFGYDTGTISGVMAMPFVKKTFTDDGLEFTSEQTSLITSILSAGTFTGAISAPWASDTLGRRLGLILFCVVFSVGAILQTAATGRTLLIVGRVVAGLGVGGVSSIVPLYQSEVAPKWIRGAVVSIYQFAITIGLLLAAIVNNATKNKDNSASYRIPLGLQLLWAVILSGGLILLPETPRFWIKKGEYDKAADSLRRLRRLPVEHEAVQKELLEIQSSHDHEMQIGSATWAACFSPKGSQLKRMLTGIAIQALQQLTGINFIFYYGTEFFKKSNISNPFLIQMITNIVNVVMTIPGIMFVDRVGRRKLLLIGAIVMCSSEFIVAAVGTAIDNETSSKVLIAFTCTFIAGFAATWGPIAWVVIGEIFPLRIRAKGVALCAASNWLFNFAIAFATPYLVDEAPGSAGLKTKVFFIWGGCNFLCIAFTYFFIYETKGLTLEEVDQMYAEIKIASRSHQFVPTTRVAAYDEHASDDKKDGQHVYIESV

SEQ ID NO: 4644 - DNA, 1710 bp, Kluyveromyces lactis
  CDS (1)..(1710)
atgaacgatacttcagagcattccagtgatgtctctcccatcattttcgatgatatctctcaaagcaaattgaaagactcatctgaaaatgaaaccacggatagaatcattatcaaaccggtcaatgatgaagatgacacttcagtcatgattactttcaaccaaaagatttctccgtttatcttgatcttgacctttacagcatctatctctggtttcatgtttggttatgatactggttatatatcgagtgcattggtctctataggtacggacttggataataaagctctaacatatggtgataaggaaataattacagctgcaacatctttgggtgccttaatctcagcagtgtttgcagggatttctgccgacatttttggtagaaaaccttgtctaatgttctctaatattctttttgtcattggtgctgcgttgcaggttagtgcacattcattttggcaaatggcagtaggtagattaattatggggttcggtgtcggtattgggtcgttactagcgccattattcatttctgaaatcgcaccaaaacatatcagaggtagactaacggtgataaactcactttggctaacaggtggtcaattgatcgcttatgcatgtggtgctgggttgaataaagttcataacggttggagaattttagtcggactttctttgattccaactgtggtgcaatttacatgcttcagcttcttgccagacactccgcgtttctacgtgataaaaggtaactataagaaggctgcagaagttttacaaaagagttacattaacgctccccaggaacttatcgatcaaaaaatccgtgaactatcagatttgaatgaggctatcccaggtaagacccctgtacacaagttcttcaacactgtcaaagaattacatactgtcccatgcaatttcagggcattggtgatcggttgtgctttacaaggtattcaacaattctgtggttggaattctttaatgtatttctctggtactatttttcaaactgttggtttcgaaaattctactgcagtgtctatcatcgttgccggtactaacttcgtattcactttagtcgctttctttgcgattgataaggtcggtcgtagagcaatccttttgattggcttgcctggtatgatggtttccttggttatgtgtgctatcgccttccatttcctagatataaaattcactggcgctggtgaatcggaagtttccaatggtggattcagttcttggggtatagtcgttatcgtattcatcatggtatatgcagcattctatgctctaggtatcggtactgtaccatggcagcaatctgaattatttgcaacatccgttagaggtgtaggtacttcttattgtacagctactaactgggctggttccctaattattgcatctaccttcctaacaatgttacaaaacataacaccgactggtacattttcattatttgctgcactagctgcagtatctaccgtcttctgttatctctgttatccagaactatctggtctagaattggaggaagtacaaactattttaagtgatggattcaacatcaaagcttccaaacaactagccaagaagagaaagcaacaaaatagcgaaatgcaaaggagatttagagaaaaggacatggaagcttatcaaaaggataaaccctccgatgaactacttgaaagttaa

SEQ ID NO: 4645 - protein, 569 aa, Kluyveromyces lactis
MNDTSEHSSDVSPIIFDDISQSKLKDSSENETTDRIIIKPVNDEDDTSVMITFNQKISPFILILTFTASISGFMFGYDTGYISSALVSIGTDLDNKALTYGDKEIITAATSLGALISAVFAGISADIFGRKPCLMFSNILFVIGAALQVSAHSFWQMAVGRLIMGFGVGIGSLLAPLFISEIAPKHIRGRLTVINSLWLTGGQLIAYACGAGLNKVHNGWRILVGLSLIPTVVQFTCFSFLPDTPRFYVIKGNYKKAAEVLQKSYINAPQELIDQKIRELSDLNEAIPGKTPVHKFFNTVKELHTVPCNFRALVIGCALQGIQQFCGWNSLMYFSGTIFQTVGFENSTAVSIIVAGTNFVFTLVAFFAIDKVGRRAILLIGLPGMMVSLVMCAIAFHFLDIKFTGAGESEVSNGGFSSWGIVVIVFIMVYAAFYALGIGTVPWQQSELFATSVRGVGTSYCTATNWAGSLIIASTFLTMLQNITPTGTFSLFAALAAVSTVFCYLCYPELSGLELEEVQTILSDGFNIKASKQLAKKRKQQNSEMQRRFREKDMEAYQKDKPSDELLES

SEQ ID NO: 4646 - DNA, 1644 bp, Candida glabrata
  CDS (1)..(1644)
atggttgatgagaatagcaataatgagaatgggctagaccaggaggaagaaatagatgtgtattccgatctgtattcgacgtatacgcaggttacttcgttgactactaatgatgttgataacaccacataccccatgacttggaagacagtcgccctttttggcagctccacagtgggtggattactatttggttacgatacaggtgtcatctcgggggtattgctcagtttaaagccacaggaccttggcagagctaccatttctgattgggataaagagctgatcacctccataacatgccttggttgctttgtgggatccctgctggggtctccgctggctgacaagtatggcaggaggataactctggcgatcttttgcgtattatttatagtcgccgcactgtggatggccttggccagcaacttagtactgctggtattcggtaggtttgttgtggggatcgcagtgggtactgccgcgcaatgtactccggtgtacctctgtgagatatcacctgccaaaattagaggtcaaatattagcactgaattccattgctgttactggtgggcagttcttgtcttacatattcgcttatgagctttacgacgtgaatggctcttggagaattttatttggattgtcagccgtgcctgctataatatttttatccatgttagacttcatacctgaatctcctcgttggttggtatctatgtctaaatatgatagcgctaaagcagccttgcgtatgatctatccgactgcgtctcctggtcagataaacctcaaattcaatgaactagtcatcaatctaagcaagctcaaacattaccaagatgagcaaacttcgctgatggttccattatcggtgcgttcctctcgagttacaatcaattctgctgattacggttcggtagcaaacttgagatcattacactctctaatgaatgaaccttctggaacaaatcattctaataagacagttcatcacagaatggagcctaggacaaagagagcattgttaatcggttgcgttcttatgtttttccagcaaattactggtttcaacgcgtttatgtattacgctccgctaatattttcgaaattaaactctcataacccgctacttccagcaatgtcaattgcatttactaactttttattcacctttttagctgtctatctcgttgaccttgttgggagacgttcgatgcttctaaatacaatttggattatgactgttgggttgttactgtctacaattgggtttcaacatgaaaatgttgttgtattattatttgcagtatctatatttgtggcagcatatgcttctgccatgggcaccataccctggagttcagtagaattcctgccactgaatagaaggtcgttcggagcatcatgtatatcatgtactaactggttaacaaattttgttattacagcatcttacctatctgtgatgaataagatcggtacagaagacacaatgttattctttgcattatttagtgtgatggcatggttttttgtgtatttctggtatcctgaagtcaagggactatcactggaagaaattgggaaagtgtttgaaaatggtattgatgtccattatgtttacaggaactattactga

SEQ ID NO: 4647 - protein, 547 aa, Candida glabrata
MVDENSNNENGLDQEEEIDVYSDLYSTYTQVTSLTTNDVDNTTYPMTWKTVALFGSSTVGGLLFGYDTGVISGVLLSLKPQDLGRATISDWDKELITSITCLGCFVGSLLGSPLADKYGRRITLAIFCVLFIVAALWMALASNLVLLVFGRFVVGIAVGTAAQCTPVYLCEISPAKIRGQILALNSIAVTGGQFLSYIFAYELYDVNGSWRILFGLSAVPAIIFLSMLDFIPESPRWLVSMSKYDSAKAALRMIYPTASPGQINLKFNELVINLSKLKHYQDEQTSLMVPLSVRSSRVTINSADYGSVANLRSLHSLMNEPSGTNHSNKTVHHRMEPRTKRALLIGCVLMFFQQITGFNAFMYYAPLIFSKLNSHNPLLPAMSIAFTNFLFTFLAVYLVDLVGRRSMLLNTIWIMTVGLLLSTIGFQHENVVVLLFAVSIFVAAYASAMGTIPWSSVEFLPLNRRSFGASCISCTNWLTNFVITASYLSVMNKIGTEDTMLFFALFSVMAWFFVYFWYPEVKGLSLEEIGKVFENGIDVHYVYRNYY

SEQ ID NO: 4648 - DNA, 1713 bp, Candida glabrata
  CDS (1)..(1713)
atggctggtgagaaggtggagttgagctccatggatagtgctatagagataaggcatgtgaaccagcatgccaaggaaatatcgtctgagaacaagtctgagagctatgacgacaataaggagtttgaagggtccaatcgcgtggtgataaagcctgttaacgacgaggacgatgtgtctgttatgataaattttaaccagggtgtgtcacacttcattattatgctgacttttgtcgcttccttgtccggtttcttgttcggttacgacaccggttacatatcctcggcgttgatttccatagggactgacctggacaacaaagagctgacgtacggtgagaaggaaatcaccaccgctgccacctccttgggtgctttgatctttgctttagtggcagggttctccgtagacatattcggcagaaaaccatgtcttatgttctcgaacattatgtttttgatcggtgctattcttcaagtcaccgcacacaagttctggcagatgactgcgggcagattcattatgggtttcggtgtcggtatcggttccttgatcgcaccattgtacattagtgagattgcaccaaaaatgatcagaggtagactgactgtgatcaactcactgtggctgacaggtggccagttgatcgcatacggttgtggtgctggtttgaatcacgtccacaacggttggagaattctggtcggtctctccttgattccaaccgtgctacagttcgtgttctttatcttcctaccagacacgcctagatactacgttatgaaaggtgactatgagaaggccaagagcgtgctgaagagaagttacaacggtgtctctgacgaactaatagacagaaagattgaagaactattagctttgaaccaatctattccaggtaagaatcatgtagaaagaacttggaacgctgtgaaagagttgcataccaaaccagctaactttagagctctgatcatcgcatgtggtttacaaggtatccaacaattcactggttggaactccttggtctatttctccggtactatttttgaatccgttggtttcaagaattcctctgcagtttccattatcgtttctggtacaaatttcatctttacactggtggctttcttctgcatagataaaatcggtagaagaaacattctgattataggtatcccaggtatgaccgtggctcatgttatgtccgctattgcgttccacttcattggaatcaagtttgtcggtaacaccgccatcgttgaacactcaggtttctcctcatggggtattgtaatcattgtgttcattatcatgtttgctgcattctacgctctaggtattggtaccgtgccatggcaacaatctgaactgttcccacaaaacgttagaggtgtcggtactgcttttgctactgctactaactgggccggttccttagttattgcttcaactttcttgactatgttacaaaacatcactcctacaggtacattcggtttctttgcaggcttatgtgtggtttctttcttcttctgttatttctgctacccagaactttcaggtttggaattggaagaagttcaaactattttgcaagatggtttcaatgtgcaagcatctaaggaactggcaaagaagcgtaagaggcaaattgctgttctaaagaaagcaaaacatcaaccaacagaagaaatcattgaagagtga

SEQ ID NO: 4649 - protein, 570 aa, Candida glabrata
MAGEKVELSSMDSAIEIRHVNQHAKEISSENKSESYDDNKEFEGSNRVVIKPVNDEDDVSVMINFNQGVSHFIIMLTFVASLSGFLFGYDTGYISSALISIGTDLDNKELTYGEKEITTAATSLGALIFALVAGFSVDIFGRKPCLMFSNIMFLIGAILQVTAHKFWQMTAGRFIMGFGVGIGSLIAPLYISEIAPKMIRGRLTVINSLWLTGGQLIAYGCGAGLNHVHNGWRILVGLSLIPTVLQFVFFIFLPDTPRYYVMKGDYEKAKSVLKRSYNGVSDELIDRKIEELLALNQSIPGKNHVERTWNAVKELHTKPANFRALIIACGLQGIQQFTGWNSLVYFSGTIFESVGFKNSSAVSIIVSGTNFIFTLVAFFCIDKIGRRNILIIGIPGMTVAHVMSAIAFHFIGIKFVGNTAIVEHSGFSSWGIVIIVFIIMFAAFYALGIGTVPWQQSELFPQNVRGVGTAFATATNWAGSLVIASTFLTMLQNITPTGTFGFFAGLCVVSFFFCYFCYPELSGLELEEVQTILQDGFNVQASKELAKKRKRQIAVLKKAKHQPTEEIIEE

SEQ ID NO: 4650 - DNA, 1695 bp, Candida glabrata
  CDS (1)..(1695)
atgtcacaagctcaaagtttgtcaccttctgaaagcgccgaaaactccccagtcagggaagtcaatgttgctaacagcttcaaagatgatgacttcattttggagcagaagcaaaccgctgatgtttctgcgatgtccccagaagcagaagcaccacctaaaccaatctcagcctactttactgtgatctgtctatgtttgatgatcgcattcggtggttttgtctttggctgggatactggtactatttctggttttgttgctcagaccgatttcaagagaagatttggacaacaagctgctgatggttcttactacttatctgatgtgagaactggtttgattgttgctattttcaatattggttgtgccattggtggtttgaccttgggtcgtcttggtgatatgtatggtcgtcgtcttggtttgatggctgttattactgtctacgttgttggtattgtaattcaaatctcttctaccactacctggtaccaatattttgttggtagaattgtctccggtcttggtgttggtggtattgctgtgctatccccaaccttaatttctgaaactgctccaaagcatttgagaggtacttgtgtgtcattctaccagttgatgattactttgggtatcttcttgggttactgtacaaactatggtaccaagactcacaccaattctattcaatggagagttcctctaggtctatgttttgcctgggctttgttcatgcttgttggtatgtccatggttcctgaatcaccaagattcttggttgagaagggtagatttgaagaggccagacgctctcttgcccgttctaacaaggtttccatggatgacccaattgtcacagctgaaattgaaaacatcagcgctggtgttgaagctgagaaatctgcaggtaatgcctcttggggtgaattgttttccaccaagggtaagatcttgcaacgtgttgtcatgggtatcatgatccaatctttgcaacaattgactggttgtaactacttcttctactacggtactactattttcaaggctgttggtttagaagattctttccaaacttctattatcttgggtattgtcaactttgcttccacctttgtcgctttgtatgttgttgaccgctttggtcgccgtaagtgtttgctatggggttcctctacaatggctgtctgcatggtcatctttgcttcagttggtgtcaagagtctatatcctaacggtaaggaccaaccatcctccactactgctggtaacgttatgattgttttcacctgtctatacatcttctgttttgcaactacttgggctccaactgcttacgttattgttgccgaaacctacccactacgtgttaaaaaccgtgctatggccattgctgttggtttcaactggatctggggtttcttgattggtttcttcacaccatttattactactgccattaacttctactacggttacgtcttcatgggctgtctagtcttctccttcttctacgtcttcttctttgtttgcgaaactaaaggtttgactttggaagaagtcaatgaaatgtacgaagaaggcgtcttgccatggaagtccgctcaatggctaccaactaccaagagaaccagtggctacgatgtggacgctgctttgcacgatgacaagccatggtacaagagatttgcttag

SEQ ID NO: 4651 - protein, 564 aa, Candida glabrata
MSQAQSLSPSESAENSPVREVNVANSFKDDDFILEQKQTADVSAMSPEAEAPPKPISAYFTVICLCLMIAFGGFVFGWDTGTISGFVAQTDFKRRFGQQAADGSYYLSDVRTGLIVAIFNIGCAIGGLTLGRLGDMYGRRLGLMAVITVYVVGIVIQISSTTTWYQYFVGRIVSGLGVGGIAVLSPTLISETAPKHLRGTCVSFYQLMITLGIFLGYCTNYGTKTHTNSIQWRVPLGLCFAWALFMLVGMSMVPESPRFLVEKGRFEEARRSLARSNKVSMDDPIVTAEIENISAGVEAEKSAGNASWGELFSTKGKILQRVVMGIMIQSLQQLTGCNYFFYYGTTIFKAVGLEDSFQTSIILGIVNFASTFVALYVVDRFGRRKCLLWGSSTMAVCMVIFASVGVKSLYPNGKDQPSSTTAGNVMIVFTCLYIFCFATTWAPTAYVIVAETYPLRVKNRAMAIAVGFNWIWGFLIGFFTPFITTAINFYYGYVFMGCLVFSFFYVFFFVCETKGLTLEEVNEMYEEGVLPWKSAQWLPTTKRTSGYDVDAALHDDKPWYKRFA

SEQ ID NO: 4652 - DNA, 1692 bp, Candida glabrata
  CDS (1)..(1692)
atgaattctcaaccggatttgataagtccacaaaaatcctcttcttcaaatgaggtggattctcatgaatccaaatatctaaaccaagtcggcaagaatgatatggctgacgaatttgttcagaacgaaatgattgccaacccaaacactggtaaaggtgcttttgtcggtgtcattatcagttgtttcatggtcgcttttggtggttttgtctttggatgggataccggtactatttctggttttgtcgcacaaaaggatttcattcacagatttggtatgaagcatcctgacggaactgaatacttatccaaggtcagaactggtttaattgtctctatcttcaatattggttgtgccatcggtggtattattctatctaagcttggtgacactaaaggtcgtaagatgggtttggttgttgtcgttgttatttacatcgttggtatcatcatccaaatcgcttccattaacaagtggtaccaatacttcatcggtagaattatctctggtttgggtgttggtggtatctctgttctatctccaatgttgatttctgaagtcgctccaagtgatctaagaggttctctagtttcttgctaccaattgatgatcacattgggtattttcttgggttactgtactaacttcggtaccaagaactacactaactctgtccaatggagagttccattgggtctatgtttcgcctgggctcttttcatgatcggtggtatgaccttcgttccagaatccccacgttatttggttgaagctggtcaaattgaagaagccagatcatccttggccagaatcaacaaatgttccccagatcacccatacatccaacaagaactagacttaattcaagctagtgttgatgaagctagatctgcaggttctgcttcttggggcgaattatttaccggtaagccagctatgttcagacgtactcttatgggtatcatgattcaatctttgcaacaattgacaggtgacaactacttcttctactatggtactattgttttcaaggctgttggtttagaagattccttcgagacctccattgttttcggtgttgtcaacttcttctccacctgttgctctttgctaactgtcgatcgtttcggtcgtcgtaactgtttactgtatggtgctatcggtatggtctgctgttacgttgtctatgcttctgttggtgtcacaagattatggccccatggtcaaggtaatggctcttccaagggtgccggtaactgtatgatcgtcttctcctgtttctacatcttctgtttcgctaccacctgggctccaatcgcttatgttattatctctgaaactttcccattgagaatcaaggccaaggccatgtccattgcaactgctgctaactggatgtggggtttcttgattgccttcttcactccattcatcaccaatgccattaacttctactacggatatgttttcatgggctgtatggtttttgcatacttctatgttttcttctttgtctcagagacaaagggtttaactctagaagaggttaacgaaatgtatgccgaaggtgttttgccttggaagtcttccaaatgggttcctgcttccagaagaggtgctgattatgatgccgatgctttgatgcacgacgacaccccatggtacaagagagttgttggtagaggttaa

SEQ ID NO: 4653 - protein, 563 aa, Candida glabrata
MNSQPDLISPQKSSSSNEVDSHESKYLNQVGKNDMADEFVQNEMIANPNTGKGAFVGVIISCFMVAFGGFVFGWDTGTISGFVAQKDFIHRFGMKHPDGTEYLSKVRTGLIVSIFNIGCAIGGIILSKLGDTKGRKMGLVVVVVIYIVGIIIQIASINKWYQYFIGRIISGLGVGGISVLSPMLISEVAPSDLRGSLVSCYQLMITLGIFLGYCTNFGTKNYTNSVQWRVPLGLCFAWALFMIGGMTFVPESPRYLVEAGQIEEARSSLARINKCSPDHPYIQQELDLIQASVDEARSAGSASWGELFTGKPAMFRRTLMGIMIQSLQQLTGDNYFFYYGTIVFKAVGLEDSFETSIVFGVVNFFSTCCSLLTVDRFGRRNCLLYGAIGMVCCYVVYASVGVTRLWPHGQGNGSSKGAGNCMIVFSCFYIFCFATTWAPIAYVIISETFPLRIKAKAMSIATAANWMWGFLIAFFTPFITNAINFYYGYVFMGCMVFAYFYVFFFVSETKGLTLEEVNEMYAEGVLPWKSSKWVPASRRGADYDADALMHDDTPWYKRVVGRG

SEQ ID NO: 4654 - DNA, 1707 bp, Candida glabrata
  CDS (1)..(1707)
atgcttttctcaaaaaagaaggaagatcctcaggccgttcctgaggcatctccagaaaatgacttttctccatctctatcccaacaagattcatctgcttccccatatgaaaatgatgtcaagaagcttgaagaagaagccgaacaaactccaatagtagacattccaaagaagcctgcttctgcttatgttactgtttctatcttctgtctattcatcgcttttggtggttttgttttcggttgggatactggtaccatttctggtttcgtcgctcaaaccgatttcattagaagattgggtcaaaagcgtgcaaatggtacacactacttgtctaaggttagaactggtttggttgtctctattttcaacattggttgtgccattggtggtgttatcttgtccaaattgggtgatgtgtacggccgtaagcctggtttgattatcgttgtcgttatttatgtcgttggtattattatccagatcgctactattgacaagtggtaccaatacttcatcggtagaattatctccggtttgggtgttggtggtattgctgtcttgtctcctatgttgatttccgaagtctctccaaagcacttgagagcaactctggtggcgtgctaccaactaatgattacattgggtattttcttgggttactgtactaacttcggtaccaagaactactccaactctgtccaatggagagttccattaggtctatgttttgcttgggctatctttatgatcagtggtatgaccttcgttccagaatctccaagatttttggtcgagaaaggtagaattgaggatgccaagagatctattgcgtcttctaacaaggtttcggttgatgatccagctgtcgttgctgaagttgacagtgttcaagctgctgttgaagctgaaagattggctggttctgcttcctggggtgaattgttctcaaccaagaccaagattttccaacgtttggttatgggtatcatgattcaatctttgcaacaattgacaggtgacaactacttcttctactatggtactattgttttcaaggctgttggtttggaagattccttcgagacctccattgttatcggtgttgtcaacttcttctctactttcgttggtattttcttggtcggtagatttggccgtcgtacctgtctattgtggggtgccgctaccatgactgcttgtatggttgttttcgcttctgtcggtgtcaccagactatggcctcacggtaagggtaatggttcttccaagggtgctggtaactgtatgattgtcttcacctgtttctacattttctgtttcgctaccacctgggctccactagctttcgttatctgttctgaaaccttcccattgagagtcaaggccaagtgtatggctcttgctcaagcctctaactggatctggggtttcttgattagtttcttcactcctttcattactgatgctattaacttcaactatggttacgtcttcatgggctgtctatgtttctcctacttctacgttttcttctttgttccagaaaccaagggtctaactttggaagaagtcaacaccatgtgggaagaaggtgtcttgccatggaaggcttctcaatgggttcctccatccagaagaggtgctgattatgatgccgatgctttgatgcacgatgacaccccatggtacaagagattcctataa

SEQ ID NO: 4655 - protein, 568 aa, Candida glabrata
MLFSKKKEDPQAVPEASPENDFSPSLSQQDSSASPYENDVKKLEEEAEQTPIVDIPKKPASAYVTVSIFCLFIAFGGFVFGWDTGTISGFVAQTDFIRRLGQKRANGTHYLSKVRTGLVVSIFNIGCAIGGVILSKLGDVYGRKPGLIIVVVIYVVGIIIQIATIDKWYQYFIGRIISGLGVGGIAVLSPMLISEVSPKHLRATLVACYQLMITLGIFLGYCTNFGTKNYSNSVQWRVPLGLCFAWAIFMISGMTFVPESPRFLVEKGRIEDAKRSIASSNKVSVDDPAVVAEVDSVQAAVEAERLAGSASWGELFSTKTKIFQRLVMGIMIQSLQQLTGDNYFFYYGTIVFKAVGLEDSFETSIVIGVVNFFSTFVGIFLVGRFGRRTCLLWGAATMTACMVVFASVGVTRLWPHGKGNGSSKGAGNCMIVFTCFYIFCFATTWAPLAFVICSETFPLRVKAKCMALAQASNWIWGFLISFFTPFITDAINFNYGYVFMGCLCFSYFYVFFFVPETKGLTLEEVNTMWEEGVLPWKASQWVPPSRRGADYDADALMHDDTPWYKRFL

SEQ ID NO: 4656 - DNA, 1671 bp, Candida glabrata
  CDS (1)..(1671)
atgagtagttctaataaagattccgagtcttttgagaattatccttcgcaaaattctgacaacagctacaagagggatgatctggatccagataccctcgagaaggaggccaagatcgaaaaccctaacggtaagagcgcctacatcgcagtgagtatctcctgtgctttggtcgctttcggtggtttcatcttcggctgggataccggtaccatttccggtttcgtcaaccaaactgacttcatcagaagaatcggttccaagcacgctgatggtacctcatacttgtccaaggttagaaccggtctagttgtcggtatcttcaacatcggttgtgccatcggtggtgttgttttgtctaaaatcggtgatactaaaggtcgtaaggccggtctggtgactgtcgtgctaatttacattgtcggtatcgtgattcaaatcgctaccattgacaagtggtaccaatacttcatcggtagaatcatctccggtttgggtgttggtggtatctctgtgctttccccaactctaatttctgaagtcgctcctaaggaattgagaggttctttggtctctctataccaaatcatgatcactttgggtatcttcttgggttactgtactaactacggtaccaagaactactccaactctgtccaatggagagttcctttgggtctatgtttcgcttgggctttgcttatgatcggtggtatgaccttcgttccagaatccccacgttacttgatcgaagccggagatgacgatgctgctcgtaagtctctatgtgctgccaacaagttgccagctgaacacccattcatcgaacaagaattcaccatcttgaaagccaaggtcgaagaagctaatgccgctggtactgcttcttggtccgaattgatcactggtaagcctgctatgttgagacgtaccattatgggtatcatgattcaatctttgcaacaattgactggtgacaactacttcttctactacggtactactgttttcaaggctgttggtttggaagattctttccaaacctctatcgttttcggtgtcgttaacttcttctctaccttcttatctttgttcaccgtcgaccgtttcggtcgtcgtaactgtttgctgtacggtgccgccggtatggtctgctgttacgttgtctacgcttccgttggtgttaccagattatggccaaatggtcaaggtaatggctcttccaagggtgccggtaactgtatgatcgtcttctcctgtttctacatcttctgtttcgctaccacctgggctccaattgcttacgttattatctccgaatccttcccattgagaatcaagaccaaggccatgtccattgcctctgcttccaactggatctggggtttcttgattgccttcttcacaccatttattaccaatgccattaacttctactacggttacgtctttatgggctgtatggtctttgcttacttctacgttttctttttcgtcaacgaaactagaggtttgactttggaagaagtcgatgagatgtacgccgaaggtgttctaccatggaagtcctccaagtgggtcccagaatccgaaagagatgacagctatgacgccgatgctttacttcatgatgacacaccatggtacaagagagtcattggtagaaattaa

SEQ ID NO: 4657 - protein, 556 aa, Candida glabrata
MSSSNKDSESFENYPSQNSDNSYKRDDLDPDTLEKEAKIENPNGKSAYIAVSISCALVAFGGFIFGWDTGTISGFVNQTDFIRRIGSKHADGTSYLSKVRTGLVVGIFNIGCAIGGVVLSKIGDTKGRKAGLVTVVLIYIVGIVIQIATIDKWYQYFIGRIISGLGVGGISVLSPTLISEVAPKELRGSLVSLYQIMITLGIFLGYCTNYGTKNYSNSVQWRVPLGLCFAWALLMIGGMTFVPESPRYLIEAGDDDAARKSLCAANKLPAEHPFIEQEFTILKAKVEEANAAGTASWSELITGKPAMLRRTIMGIMIQSLQQLTGDNYFFYYGTTVFKAVGLEDSFQTSIVFGVVNFFSTFLSLFTVDRFGRRNCLLYGAAGMVCCYVVYASVGVTRLWPNGQGNGSSKGAGNCMIVFSCFYIFCFATTWAPIAYVIISESFPLRIKTKAMSIASASNWIWGFLIAFFTPFITNAINFYYGYVFMGCMVFAYFYVFFFVNETRGLTLEEVDEMYAEGVLPWKSSKWVPESERDDSYDADALLHDDTPWYKRVIGRN

SEQ ID NO: 4658 - DNA, 1754 bp, Oryza sativa
  CDS (115)..(1677)
attgattccctcctccgcgcagctcgcggcttcgatcgatcgatcgaccgatctcccacgtcgccgccgttcgatcgatccgccgccgccgccgccgccggccggccgggcaagatgccgggggccgtgatcgtgcaccaccacacgcggtacaagacgtaccccggcgaggtcaccggcttcgtcttcttctgctgcctcatcgcctccgtcggcggctgcatcttcggctacgacatcggcctcaccgccgggttgacgtcgacggagtcgttcttggcgatgttcttcccggtgatcttcgagcagcagcaggagcgggtgatcacgaaccagtactgcaagttcgacagccaggtgctgacgctgttcggctcgtcgctcttcctctccgccatggtcgccggcatcttcgcctccccgatgtcccgcgccttcggccgcaagtggaccctcttcgtcgccgccgtcgcctacctcatcggcgccatcctcggcgccatctccttcaacttcatcgttctcctcaccggccgcctcctcctcggcgtcggcgtcggcgtctgcatccacgcgtcaccgctgtacatatcggagatggcgccggcgcagcagcgggggatgctgaacatactgttccagctgatgatcacggtggggatcctgtcggcgagcctgacaacgtactggacgtcgaagatcgccggcgggtgggggtggcgcgtggggctggcgttcgggacggtgccggcggcggtgatcgcgctggggtcgctggccatcccggacacgccggtgtcgctcatcgcgcgcggcgagggcgaggcggcgcgcgcgacgctggccaagatccgcggcgtcgacgacgtgcgcgccgagttcgaggacctgacgacggcgagcgaggagagcaaggcggtggcgcacccgtggcgggagctcttcttcggcggcaggtacaagccgcagctcgcgttcgcggtgctcatccccttcttccagcagctcaccggcatcaacgtcatcatgttctacgcccccgtcctcttcaagaccgtcggcttccgccaggacgcctccctcgtctcctccgtcatcaccggcctcgtcaacgtcttctccaccttcgtcgccgtcatgaccgccgacaaggtcggccgccgcgccctcttcctccaaggtggcacccaaatgatcatctcccagatcttggtgggaacattcatcggattacagttcggggtgagcgggacgggggcgatgtcggagcagtacgcgatgtgcatcgttctgttcgtgtgcgtgtacgtggccgggttcgcgtggtcgtgggggccgatggggtggctgatcccgagcgaggtgtacccgctggcggtgaggtcggcggcgcagagcgtgacggtggcggtgaacatgttcttcacggcgttcatcagccagatcttcctcaccctcctctgccacctccgcttcggcctcttctacttcttcggcgcctgggtcctcctcatgaccgtcttcatcgccaccctcctcccggagaccaagtgcgtgccgctcgaagaggtggcgcacgtctggaggaagcactggttctggcgcaagttcatcgtcgactcccccgaccgcggcggcgccgagatgaggaagaggatagccctagagatgagctagagttctctactaatatactgacgtgcaaagcttttacgcgttcgcgaaaaagagaagagaataaaagcttagctaac

SEQ ID NO: 4659 - protein, 520 aa, Oryza sativa
MPGAVIVHHHTRYKTYPGEVTGFVFFCCLIASVGGCIFGYDIGLTAGLTSTESFLAMFFPVIFEQQQERVITNQYCKFDSQVLTLFGSSLFLSAMVAGIFASPMSRAFGRKWTLFVAAVAYLIGAILGAISFNFIVLLTGRLLLGVGVGVCIHASPLYISEMAPAQQRGMLNILFQLMITVGILSASLTTYWTSKIAGGWGWRVGLAFGTVPAAVIALGSLAIPDTPVSLIARGEGEAARATLAKIRGVDDVRAEFEDLTTASEESKAVAHPWRELFFGGRYKPQLAFAVLIPFFQQLTGINVIMFYAPVLFKTVGFRQDASLVSSVITGLVNVFSTFVAVMTADKVGRRALFLQGGTQMIISQILVGTFIGLQFGVSGTGAMSEQYAMCIVLFVCVYVAGFAWSWGPMGWLIPSEVYPLAVRSAAQSVTVAVNMFFTAFISQIFLTLLCHLRFGLFYFFGAWVLLMTVFIATLLPETKCVPLEEVAHVWRKHWFWRKFIVDSPDRGGAEMRKRIALEMS

SEQ ID NO: 4660 - DNA, 1443 bp, Photobacterium profundum
  CDS (1)..(1443)
atgtcatcaagtgtcgagacatcatcaaaaaaacataacctgagttacatcattcgaatttgttgtatcgctgcattaggggggatcttattaggatatgataccgctgttatttcaggagctatcggaccgataagagaatacttcaacttaacggcggcacaaaccggatgggctgtttccagtgttgtattaggcagtattattggtgcaatcagttctggctggtgtgcgcttaaatatggccgtagaaaagcattattcttagctgctcttttattcatcatttccgcgataggctctgcccttgccgctacctttaccatctatgtgttattcagaattgtagggggtattgcggttggtttagcatgtgttgtctctcctatgtatatgtctgaagtcgccccgaaagatttcagggggcgtgcagtcagcatgttccaacaatctgccgttattggtcaaacgggtgtgttctacgttaactatctgattgcaaaaggcatgtctgaagcgtggcttgttgatataggctggcgttggatgctagcatcagaagttctacctgccttattatttggtagcctgttaattatcattcctgaatcacctcgttggttagtcttaaaaggacaccttgatcaagcaaaagaaaccctttcacgtatttctaaccctgaacatgccgaccgcgttattcttgaaatacaaaaatcattagtacccactaatgcatcaaaaaataataaggtcagcttacgttcaccattactattctccattctggttattggtacttttgttgctgcagcacagcagttaaccggtattaatgtcattatgtactacacaccagaaattctaaatccgattgcgggtggtactgaaaacgcactattacaaaccactttcgtgggtgtcgtctttatttttggtaatgctttaggtatgtacctgattgataaagtgggtcgtttaccactgatgaaatacggtacattcggttgtgcgctaggtatgactattgtgggttatgtgctgtatacgggcactgaaggctatgcggctttattcgcactctgtctatatgttgtcgcatatgctgcatcttggggctgtgcctgctggacaatgatttcagaaatattcccgaatagcatccgttctcgtgcaatggccattgctgttggtgcacaatggtttacgggtttcattgttacccagtctttcccgatgttaaatgaaaatgcttacctaaaagagcactttaatggtgcattcagcttctgggtgttcgcggttctttctatcatgtgtatgtatgttgttgttaagtatgtacctgaaacgaaaggcgttagcttggaagacatggaaaaagtcatggctgaaaaactaggtaaaaataagaaacgtcaagttgcagaagcaagcgcttaa

SEQ ID NO: 4661 - protein, 480 aa, Photobacterium profundum
MSSSVETSSKKHNLSYIIRICCIAALGGILLGYDTAVISGAIGPIREYFNLTAAQTGWAVSSVVLGSIIGAISSGWCALKYGRRKALFLAALLFIISAIGSALAATFTIYVLFRIVGGIAVGLACVVSPMYMSEVAPKDFRGRAVSMFQQSAVIGQTGVFYVNYLIAKGMSEAWLVDIGWRWMLASEVLPALLFGSLLIIIPESPRWLVLKGHLDQAKETLSRISNPEHADRVILEIQKSLVPTNASKNNKVSLRSPLLFSILVIGTFVAAAQQLTGINVIMYYTPEILNPIAGGTENALLQTTFVGVVFIFGNALGMYLIDKVGRLPLMKYGTFGCALGMTIVGYVLYTGTEGYAALFALCLYVVAYAASWGCACWTMISEIFPNSIRSRAMAIAVGAQWFTGFIVTQSFPMLNENAYLKEHFNGAFSFWVFAVLSIMCMYVVVKYVPETKGVSLEDMEKVMAEKLGKNKKRQVAEASA

SEQ ID NO: 4662 - DNA, 2181 bp, Drosophila melanogaster
  CDS (549)..(2015)
tcatttccaacttccatgcggcgtgtttcgggtttatttttcgtctaggtgtaaacatttctaattagtgttgtgtttggtgcagtagttcttccttccaatctttgttatcagtcgcgtagtgctaatcgactctatctcaagtgcgctggtaccgtaaaaggtctccgttctttttttggccaatcacttgtatcaataaataattaggggctatcgctccgtgtttatttcgagacataatttaattccagaaagcagtgaggcggcacataagagctctccggtgctcggcaaacgacaaaactaatttatggcattaaaaatgcatattttctagcagtgcgtcgacagtttttatcatttgccagaaaggcaaaaggcgctatccaccagcagctgtgccagaaaaggaagctaggaagacacgtcggtcgagaattggatttgactgcggaggattttgaatccgagtccgaaagttctttagtcagcaaccgaagaagcgtaggataattcacatttttctcacggcaactggcaacgaaatggctttcctatgtgcaccgggtctcaccttcttcctcacctactcgattttctcggcggtgctgggcatgctgcaattcggctacaacaccggcgtcatcaacgcgcccgaaaagaatatcgagaacttcatgaaggacgtctacaaggaccgctacggcgaggacatcagcgaggagttcatccagcagctctactcggtggcggtatccattttcgccatcggcggcatgctgggcggtttcagcggaggctggatggccaaccgctttggcagaaaaggcggcctactgttgaacaatgtgctcggaattgccggcgcctgtttgatgggatttaccaaagttagtcattcctatgaaatgttattccttggccgatttataattggtgttaattgcggcctcaacacttcgctggtgcccatgtacatctcggagatagcgccactgaatctgcgcggtggcttaggaactgttaatcaattggctgtgactgtaggtttactattatcccaagtgctgggcatcgagcaaatcctcggcaccaacgagggctggcccatcctcctgggcctggccatctgcccggcgatcctgcagctgatcctgctgcccgtctgcccggaatcgcccagatatctgctcattaccaagcagtgggaggaggaggcgcgaaaagccctgcgccgactgcgagcctctgggtccgtggaggaggacatcgaggagatgcgggccgaggagcgcgcccagcagtccgagagccacatatcgaccatggagctgatatgctcgcccaccctgcgccctccgctgatcatcggcatcgtgatgcagctgagccagcaattcagcggcatcaacgccgtcttctactattccacgtcgctgttcatgagctcgggattgactgaggagagcgccaagttcgctacgataggcatcggcgccataatggttgttatgacgctcgtgtccattccgctaatggatcgcacgggtcgccggaccctgcatctctatggtctgggcggaatgttcatcttctcaatcttcatcaccatttcgttcctgatcaaggagttctttggttatgtgcaggaaatgatcgactggatgtcctacctctctgtggtggccactctcggattcgtcgtcttctttgcggtgggacccggttcgataccctggatgattaccgcggagctcttctcccagggaccccggcccagtgccatggctattgcggtgctggtcaactggatggccaactttgtggtcggcattggtttccccagcatgaagactgccctggagaactacacgttcttgccgttcagcgtattcctggccatcttctggatattcacgtacaagaaggtgcccgagacgaagaacaagacgttcgaggagatcctggccctcttccggcacaacaatggcaggtatgtgtccttgcactagctcattctacgctcaaattctgcacacaaatcatggcaatatgtcgaatagttatccagctcataacttaaactcaactttcttaactgacacaagaaatgcgaactataaatactataaaatacaatacagaatctttgtaaaaaaaaaaaaaaaaaaaaaaaaa

SEQ ID NO: 4663 - protein, 488 aa, Drosophila melanogaster
MAFLCAPGLTFFLTYSIFSAVLGMLQFGYNTGVINAPEKNIENFMKDVYKDRYGEDISEEFIQQLYSVAVSIFAIGGMLGGFSGGWMANRFGRKGGLLLNNVLGIAGACLMGFTKVSHSYEMLFLGRFIIGVNCGLNTSLVPMYISEIAPLNLRGGLGTVNQLAVTVGLLLSQVLGIEQILGTNEGWPILLGLAICPAILQLILLPVCPESPRYLLITKQWEEEARKALRRLRASGSVEEDIEEMRAEERAQQSESHISTMELICSPTLRPPLIIGIVMQLSQQFSGINAVFYYSTSLFMSSGLTEESAKFATIGIGAIMVVMTLVSIPLMDRTGRRTLHLYGLGGMFIFSIFITISFLIKEFFGYVQEMIDWMSYLSVVATLGFVVFFAVGPGSIPWMITAELFSQGPRPSAMAIAVLVNWMANFVVGIGFPSMKTALENYTFLPFSVFLAIFWIFTYKKVPETKNKTFEEILALFRHNNGRYVSLH

SEQ ID NO: 4664 - DNA, 2536 bp, Pichia angusta
  CDS (578)..(2203)
gatctctcgtgaaaactctgcgtgatggtgggacgtgtattgtttggaaattcatattcagccattattaatgggcaaacggagtaaatcctgacgtggactacctcaagtggaaattccaaaaatttttgcattgttctatttgctgcacaagcaccccatgatgtagcgtgcacaatagaccacgggctgtttttagaacaacaacaatacggtcactctcgcgactggggaaatgtggggccggccgtgcacggcgttgaaagggtctttatccgagaaatagtcttccaggcgagaaagaagagtgtagtaagacctgttgcaaacttggccatgatgaacagtacgacccacacaggaccgtaagtgaggactatcctgatgtttttacccttcccgttccaaatatttttccattgccttgctgcatgcagcacaacaaaagtccagatttttctccccaccttttctcaaaaaaacctggggggctattggacatccattgtttacccttggtataaatacgtgttgtatccccagcaatttctcccgtatccaatcaactattacaaacatggctggcgacagtattactggtgtggcaggaactgctgacgttaacagagtcgaggctcccttgactgtgagagcttatcttatgtgcgcctttggtgcgtttggaggtatccttttcggatacgactccggttacatttccggtgtcatgggtatggactactttatccatgaattcactggaaaggtgaaacacggcgacgatgactcctcttttgtcgttggatcgtctcaaaaatctcttattacttctattctttctgcaggtaccttttttggtgctgtgtgtgccggagacttggccgacatgtttggaagaagaaccattattgtgaccggctgcagtatctactcggtcggtgttgcgctccaggttgcctccaccacggtggctctgctttccgtaggaagagttatagcaggtgttggtgttggttttgtttcgtccgtggtggttttgtatctgtctgaaatttctccaaagaaaatcagaggtgccatcgtttccggttaccagttcttcgtcaccatcggattgctgctcgcgtcctgtgttgactacggcaccgagcacagaaacgactccggctcctacagaatccctattgctctgcaactcatctgggccatcattcttgctgtcggactcatcttgctcccagaatctcctagatactacgtcctcaagggcaagtttgacagggctgcaaaggtgctctccagacttaggggccagcctatcgattccgactacattcaagaagaactcgccgagatcgtggccaaccacgagtacgagaggagcgtcattccaactacgagctactggcaatcctgggcagcttgtttcaccggaggactcagaagaccatcctcgaacctcagaaagaccatcctcggaacctccatgcagatgatgcagcaatggaccggtgtcaacttcatcttctacttcggtaccaccttcttccagcagcttggcaccatccacaatgagttcctgatctcgatgatcactacgatcgtcaatgtggcctcaactcctctgtccttctacacgatcgagaaattcggtcgtcgtgcgctcatgatctacggtgcagcaggtatggttgtgtgtcagtttatcgtggccattggtggtaccgttgatggcgacaatcagaaaaccgtcagcgccatgatcgccttcatctgcatctacattttcttctttgcttcgacctggggtccgggagcttgggttattatcggagagatcttcccattgccaatcagatcgagaggtgttggtctgtcgaccgcctccaactggttgtggaactgtatcattgccgttatcactccttacatggttgacggcgataagggcaatttgggtgctaaggtgttcttcatctggggctcgctatgtggttgctgtcttctttatgccattatgctgatcccagaaaccaagggcctgactttggagcaagtcgacaagatgcttgaggagaccaccccatggacctctgccaaatggaaacctcactccaccttcgctgccgagatgggtcttgccaaggacgacaagggcgtcacccacgagctcaaggagcacgccagcgttgagagtgtataggcgtttagtatgtatactacggctaatatgacattatgagcgatccgaagagggcggggcacgagagtgccagatacactgtattgcggactctcgggaatggtgccgaatcgatggtgtatttttgtgctctgcaacggtgaattttcggtgagtagttgacctttttttacggccaaatacagattgatcttctcatctcgacatttgcatggtgttcaagcagtcgtagctgatttcaagctgcagcatgtgaggtctaaaacagttttgccaggccgtcgctgttggcctccctgtataatgtccggtcatccaaacgttaaaggttgc

SEQ ID NO: 4665 - protein, 541 aa, Pichia angusta
MAGDSITGVAGTADVNRVEAPLTVRAYLMCAFGAFGGILFGYDSGYISGVMGMDYFIHEFTGKVKHGDDDSSFVVGSSQKSLITSILSAGTFFGAVCAGDLADMFGRRTIIVTGCSIYSVGVALQVASTTVALLSVGRVIAGVGVGFVSSVVVLYLSEISPKKIRGAIVSGYQFFVTIGLLLASCVDYGTEHRNDSGSYRIPIALQLIWAIILAVGLILLPESPRYYVLKGKFDRAAKVLSRLRGQPIDSDYIQEELAEIVANHEYERSVIPTTSYWQSWAACFTGGLRRPSSNLRKTILGTSMQMMQQWTGVNFIFYFGTTFFQQLGTIHNEFLISMITTIVNVASTPLSFYTIEKFGRRALMIYGAAGMVVCQFIVAIGGTVDGDNQKTVSAMIAFICIYIFFFASTWGPGAWVIIGEIFPLPIRSRGVGLSTASNWLWNCIIAVITPYMVDGDKGNLGAKVFFIWGSLCGCCLLYAIMLIPETKGLTLEQVDKMLEETTPWTSAKWKPHSTFAAEMGLAKDDKGVTHELKEHASVESV

SEQ ID NO: 4666 - DNA, 1548 bp, Oryza sativa
  CDS (1)..(1548)
atggcgggagggttctctgtgtcggggtccggggtggagttcgaggcgaagatcacgccgatcgtcatcatctcctgcatcatggcggccaccggcggcctcatgttcggctacgacgtcggtatctcaggcggagtgacatcgatggatgacttcctgcgcgagttcttcccgacggtgctgaagaagaagcacgaggacaaggagagcaactactgcaagtatgacaaccagggcctgcagctgttcacctcgtcgctgtacctcgccggcctcacggccaccttcttcgcctcctacaccactcgccggctcggccgccgcctcaccatgctcatcgccggcgtcttcttcatcgtcggcgtcatcttcaacggcgccgcccagaacctcgccatgctcatagtcggcaggatcctgctcggctgtggcgtcggctttgccaaccaggccgttccattgttcctgtcggagatcgcgccgacgaggatccgcggcgggctcaacatcctcttccagctcaacgtcaccatcggcatcctcttcgccaacctcgtcaactacggcaccgccaagatccacccgtggggatggcggctgtcgctgtcgctggccggcatcccggcggcgctgctgacgctgggcgcgctgttcgtggtggacacgcccaacagcctgatcgagcgcgggaggctggaggaagggaaggcggtgctgaggaagatccgggggacggacaacgtggagccggagttcaacgagatcgtggaggcgagccgcgtggcgcaggaggtgaagcacccgttccgcaacctgctccagcgccggaaccggccgcagctggtgatcgccgtgctgctgcaaatattccagcagttcacgggcatcaacgccatcatgttctacgcgcccgtgctgttcaacacgctcgggttcaagaccgacgcgtcgctctactccgcggtgatcacgggggccgtgaacgtgctgtccacgctggtgtccgtctactcggcggacagggtggggaggcggatgctgctgctggaggccggcgtgcagatgttcctgtcgcaggtggccatcgccgtcgtgctggggatcaaggtgacggaccggtcggacaacctcggccacgggtgggcgatcatggtggtggtgatggtgtgcacgttcgtgtcctccttcgcgtggtcgtggggcccgctcgggtggctcatccccagcgagacgttcccgctggagacgcggtcggcggggcagagcgtcaccgtgtgcgtcaacctgctcttcaccttcgtcatcgcgcaggcgttcctctccatgctctgccacctcaagtacgccatcttcgccttcttctccgcgtgggtcgtcgtcatgtcgctcttcgtgctcttcttcctgcccgagaccaagaacatccccatcgaggagatgaccgagagggtgtggaagcagcactggttctggaagcgcttcatggacgacgccgacaaacaccacgtcgtccccaatggcgggaagagcaacggcgccaccgtttaa

SEQ ID NO: 4667 - protein, 515 aa, Oryza sativa
MAGGFSVSGSGVEFEAKITPIVIISCIMAATGGLMFGYDVGISGGVTSMDDFLREFFPTVLKKKHEDKESNYCKYDNQGLQLFTSSLYLAGLTATFFASYTTRRLGRRLTMLIAGVFFIVGVIFNGAAQNLAMLIVGRILLGCGVGFANQAVPLFLSEIAPTRIRGGLNILFQLNVTIGILFANLVNYGTAKIHPWGWRLSLSLAGIPAALLTLGALFVVDTPNSLIERGRLEEGKAVLRKIRGTDNVEPEFNEIVEASRVAQEVKHPFRNLLQRRNRPQLVIAVLLQIFQQFTGINAIMFYAPVLFNTLGFKTDASLYSAVITGAVNVLSTLVSVYSADRVGRRMLLLEAGVQMFLSQVAIAVVLGIKVTDRSDNLGHGWAIMVVVMVCTFVSSFAWSWGPLGWLIPSETFPLETRSAGQSVTVCVNLLFTFVIAQAFLSMLCHLKYAIFAFFSAWVVVMSLFVLFFLPETKNIPIEEMTERVWKQHWFWKRFMDDADKHHVVPNGGKSNGATV

SEQ ID NO: 4668 - DNA, 1407 bp, Bacillus cereus
  CDS (1)..(1407)
atgaagcaaaaacgaaactcactgtatattttttctattacattagtagctgcaattggaggtttattgtttggttatgatacagctgtaatatctggagcggaagaatcattgaaagtttacttcattgacagccttggattaggttccttagcacatggagttactgtatcaagtgcattaataggatgtattattggaggggtaatatccggctactgtgcttcaaaattcggtcgtaaaagatcacttataattgcagcaatactctttatcgtatcggcgctaggtgcatcttatcctgaatttttattttttacaaagggtgaaccaacaatcgttttgttactagcttttaacctttatcgaatcataggtggaattggcgttggattggcttcagctatttgtccgatatatataggggaaattgctccagctgatattcgtggtaggttagtgtcatttaatcaatttatgattatttttggtatgttagtggtttattttgttaactggggtattgcgaatggagaaacactagaatggataaatgatgtgggctggaggtacatgtttgcgtcaggggtaattccagctataatattcgctatacttttgttatttgtacctgaaacacctcgatatctagcgatacagcatcaggacaaaaaggctctggctatacttacaaagattaatggtcctttagaagctaaagctattttagatgatattaaacaaactatggctataaatgtttcctcagaaaagttattctcttatggaaaattagttattattgtcggagtgttactttctgtatttcaacagtttgtaggcataaatgttgccttatattatgctccccgcatttttgaaagtatgggagcagctaaagattcctctatgatgcaaaccattattatgggattagtaaacgttatatttacagttatcgctattttaacagttgatagatggggaagaaaaccattattaatagtgggttctattggtatggcaattggaatgtttggtgtagcaagcatggcttttgctaatatcattggaattggtactctcatatttattattgtctatacagcttcatttatgatgtcatgggggccgatttgttgggtattaatttcagaaattttccctaataaaatccgtgggcaagctgtagccattgcagtagctgctcaatgggcggctaactatttcatttcatctacatacccaatgatgatggaatatagcgggggactaacatatagtttttatggtttaatgagtgtactttctgccttatttgtctggaagttagttcctgaaacgaaaggtaaaactcttgaacagatggagaatacgtggaaaaaacaaactgaatatataagttaa

SEQ ID NO: 4669 - protein, 468 aa, Bacillus cereus
MKQKRNSLYIFSITLVAAIGGLLFGYDTAVISGAEESLKVYFIDSLGLGSLAHGVTVSSALIGCIIGGVISGYCASKFGRKRSLIIAAILFIVSALGASYPEFLFFTKGEPTIVLLLAFNLYRIIGGIGVGLASAICPIYIGEIAPADIRGRLVSFNQFMIIFGMLVVYFVNWGIANGETLEWINDVGWRYMFASGVIPAIIFAILLLFVPETPRYLAIQHQDKKALAILTKINGPLEAKAILDDIKQTMAINVSSEKLFSYGKLVIIVGVLLSVFQQFVGINVALYYAPRIFESMGAAKDSSMMQTIIMGLVNVIFTVIAILTVDRWGRKPLLIVGSIGMAIGMFGVASMAFANIIGIGTLIFIIVYTASFMMSWGPICWVLISEIFPNKIRGQAVAIAVAAQWAANYFISSTYPMMMEYSGGLTYSFYGLMSVLSALFVWKLVPETKGKTLEQMENTWKKQTEYIS

SEQ ID NO: 4670 - DNA, 1431 bp, Mycobacterium paratuberculosis
  CDS (1)..(1431)
atgcgcgacgacgactcggcaaaccggtggtcaggggtccgcgaggctccgaccgcgccgagtcggcaactgacgggtgccgtggtgatcatcgcgctggtcgccgcgatctcgggcatgctttacggctacgacaccggcgtcatctcctgggccctgctgcagctcacgcaggacttcaacatcaccgagggctggcagcaggtgatcgccgccagcatcctgctcggcgccgtcgccggggcgctgacgtgcagctggctctccgacctgcgcggccggcgcggcacgctgttgatgctggcggtggtgttcatcgtcggcgcgttgtggtgcgccgacgccgcagattccgtgatgctgtcgctgggccggctggtgctggggttcgcggtcgggggcgcgacgcagacggcaccgatgtatgtcgccgagctggcgccgccggcctaccggggacggttggtgctgtgcttccagatcgccattggggtgggcatcctcaccgccaccctggtcggggccggcggctcgatctcttggcgggggccgatcggcctcgcctgcgtgcccgcggcgatcatgctgtggctgctgctgcgcctcccggaaagtccgcgctggctggtcaaaaaggacaaccgagacgccgcccgcgccgtgctggaacacgtccggcccgagggctacgacgtggccgccgagctggatgaggccaccgaactcgcccgcgtagaacgcacggccgccacccgcgggtggcgcgggctgcgcgacgcctgggttcgcccggccctggtcctcggttgcggcatcgcggtgttcacccagctcagcggcatcgagatgatcatctactactcgccgaccatcctgaccgacgacggcgtgtaccggtccgtggcgctgcaggtgtcggtgtgtctgggcgcggcgtacctgatcgcccaactggtcgggctggccatcatcgaccgggtcggccggcgccggctcaccctcatcatggtgccgggcgcggcggtcagcctgttcgcgctgggcctgctgttcatcaccagcgacagcggtcgcgacgtgatcccctacatcatgatctgcctgatcgccttcatgctgttcaacggtggcggcctgcagttgatgggctggctgaccggctcggagacctatccgctggcggtgcgaccggcggccaccgccctgcagtcggccaccctgtgggggaccaacctggtgatcaccttgacgatgctgtcgctgatcaaggcgatcggggtcggccccttgatgtggctctacgcgttgttcaacgtggcggcctggatcttcgtgttcttccgcatgcccgacctcaccggcaaaacccttgaggagatcgaataccagctgtccgaggggaaattccggccgtcggacttcggccgctga

SEQ ID NO: 4671 - protein, 476 aa, Mycobacterium paratuberculosis
MRDDDSANRWSGVREAPTAPSRQLTGAVVIIALVAAISGMLYGYDTGVISWALLQLTQDFNITEGWQQVIAASILLGAVAGALTCSWLSDLRGRRGTLLMLAVVFIVGALWCADAADSVMLSLGRLVLGFAVGGATQTAPMYVAELAPPAYRGRLVLCFQIAIGVGILTATLVGAGGSISWRGPIGLACVPAAIMLWLLLRLPESPRWLVKKDNRDAARAVLEHVRPEGYDVAAELDEATELARVERTAATRGWRGLRDAWVRPALVLGCGIAVFTQLSGIEMIIYYSPTILTDDGVYRSVALQVSVCLGAAYLIAQLVGLAIIDRVGRRRLTLIMVPGAAVSLFALGLLFITSDSGRDVIPYIMICLIAFMLFNGGGLQLMGWLTGSETYPLAVRPAATALQSATLWGTNLVITLTMLSLIKAIGVGPLMWLYALFNVAAWIFVFFRMPDLTGKTLEEIEYQLSEGKFRPSDFGR

SEQ ID NO: 4672 - DNA, 1716 bp, Ashbya gossypii
  CDS (1)..(1716)
atggcacagctaaagtggggcgcggggcgcgcagacgacgggcaagacggccgggaagtggatattgaagagagatggcacgggggcgccaagccggacagcgcggacggcagccggcgcatccagatccaggcggtcaacgacgaggacgacacgtcggagctcatcacgttcaaccaggacgtgtcgtggttcatcgtgatgttgacttttgtggcatcgctctctgggtttttgttcgggtacgacaccgggtacatctccagtgcgttgcagtctgtgggcacagacctcggccaccagctcacgtaccgggacaaggagtacatcacgtcggcgacgtcgctcggcgcgctcatcgcagcgttgggtgcgggcatctgtgcggacctgttcggcaggcgaaagtgcatcatgttctccaacatcctctttgtggttggtaccgtcctccaggtggcggcgttcaacttctggcagatggtggttggccggctagtcatgggctttggtattggcttcggctcgctcatctcgcctttgttcatcagcgagattgcgcccaagatgattcgtgggcgcctcacggtgatcaactcgctttggttgactggcgggcagcttatcgcatacgcatgcggagcaggctttcagcatgtgaagcatggttggcggatacttgttggcatctcgatgttgcccgcggtgctgcagttcgtttccttcatctttttgcccgacaccccgcggttctacgtcatgaaaggcaggctggaggatgcagcaaatgtgctagaacgcacttacgtaggtgctgagcgtgccttgattgaccgcaagatagaggagttggtgctgctaaacaagacgatcccagggcgcacggttttccacagagtctggaacacgattgttgctatccacacggtgcccgccaacctccgcgcgctcattattgcctgtggtttgcagggcatccagcagttctgtggttggaactcgttgatgtacttttcgggcgatatattcagtctggtggggttcaaggaccccgtcgccgtatcgattgtggtcgcagccacaaacttcatctttacgttggtcgcattctttgccatcgacaaaatcggccgccgcatcatacttttgatcgggctacccggcatgacgactgccatgactgtttgcgccatagcattccactacatcaaaaccgaggtggacggcgaaaagttgaagccagtgggtgagagcaacgcttggggtattgtggtggtcatcttcatcattgtctatgccgccttctacgcgctgggcatcggaaccgtgccctggcagcagtcggagttgttcccccagcccgtccgtggcgtaggcacctctttcgccaccgccacaaactgggctggctcgatggtcatcgcatctacgttcctaacgatgttcaagaatatcacgccgacagctacatttggcttctttgccggcatctcggtcatctccttggttgctgtctatctctgctatccagaattgtccggtctcgaactcgaggaggtccaattcgtattgaaggatggcttcaacattaaggcctcgaaagcattagctaagaaacgcaaattccagatggccgagtcgcgtaaacaagccagagagctcgaccttgagtccctccacaaagccaagccatccgacgagtttaccgagtcgtga

SEQ ID NO: 4673 - protein, 571 aa, Ashbya gossypii
MAQLKWGAGRADDGQDGREVDIEERWHGGAKPDSADGSRRIQIQAVNDEDDTSELITFNQDVSWFIVMLTFVASLSGFLFGYDTGYISSALQSVGTDLGHQLTYRDKEYITSATSLGALIAALGAGICADLFGRRKCIMFSNILFVVGTVLQVAAFNFWQMVVGRLVMGFGIGFGSLISPLFISEIAPKMIRGRLTVINSLWLTGGQLIAYACGAGFQHVKHGWRILVGISMLPAVLQFVSFIFLPDTPRFYVMKGRLEDAANVLERTYVGAERALIDRKIEELVLLNKTIPGRTVFHRVWNTIVAIHTVPANLRALIIACGLQGIQQFCGWNSLMYFSGDIFSLVGFKDPVAVSIVVAATNFIFTLVAFFAIDKIGRRIILLIGLPGMTTAMTVCAIAFHYIKTEVDGEKLKPVGESNAWGIVVVIFIIVYAAFYALGIGTVPWQQSELFPQPVRGVGTSFATATNWAGSMVIASTFLTMFKNITPTATFGFFAGISVISLVAVYLCYPELSGLELEEVQFVLKDGFNIKASKALAKKRKFQMAESRKQARELDLESLHKAKPSDEFTES

SEQ ID NO: 4674 - DNA, 1620 bp, Ashbya gossypii
  CDS (1)..(1620)
atgagccgtcaggttttacacagtgatatgcggtccgtgggtacagaggtatccgcggcatcgcaaaagaagtatttgatggaagaaacagtcgacataccaacaaaaccggctacggcatacattacagtttgtttgctctgtgtatttgttgcatttggtggctttatttttggctgggataccggtaccatttctggttttgtcaatcagacagactttaggcggcgttttgcccaagtgaatgatgaaggcggatactactggtccaatgccagagttggtcttattgttgcgatctttaatattggctgcgcagttggcggtatcattctatccaggttgggcgatatgtatggacgccgcattggcttgatgatcgttagtctcatttatgtggttggtataattattcaaatttcatccaacactaaatggtatcaatactgtattggcagagtcatctctggtctaggtgttggtggtattgctgtgttgtcgcctatgttgatttcagagacatcgccaaaacatttgagagggacactagtttcatgttaccagttaatgattacggccggtatattattaggctattgcgcgaactacggtacgaaaagcagatacgatgactcaaggcaatggcggattcctttggggctctgctttttgtgggctatattcatgattactggtatggcgttcgtgccagaatcccctcgttatttgatcgaaaaagataaaattgaagaggctaaaagatctctagcaacatcaaataaagttccggtagatgatccggctattctggcagaagtcaataacatccaagctggtgtggagttagaaagaatggcaggttccgcttcctggggtgaattattcaccgtccgcaccaagattctccaacgagtgatcatgggtgctatgatacagtcgttacaacaacttacaggtaacaattatttcttctactacggtaccacgatttttgattccgtcggtttggaggatgcgttcaagacatccatcattttaggtgccgtaaactttggttccacctttgtggcaatgtacactgtcgatagatttggcaggaggaaatgtttgctctacggtgccgcggcaatggccgtttgtatggttatttttgcctccgttggtgtgacaagactatggcccaatggacccgatcagccttcttccagaccggcaggcaatgctatgattgtttttacctgcctctacattttcttctttgcaactacctgggccccaattgcgtatgtcattgtttcggagactttcccattaagagtcaaagccaagggcatggctatcgccacagccgcgaattggatatggggctttttgatcgccttctttacaccatacattaccaatgcgatcaggttttactacggctacgtgttcatgggttgtttgatctttgcgttcttctacatcttcttctttgtccccgagacaaagggtttgactttggaagaggtcgaggagatgtggcaggaaggtgtggtaccttggcgttcagaatcatgggtaccctctgcaaggcggcacgcgccgtactccagtgacaaacaagctgccggcatatga

SEQ ID NO: 4675 - protein, 539 aa, Ashbya gossypii
MSRQVLHSDMRSVGTEVSAASQKKYLMEETVDIPTKPATAYITVCLLCVFVAFGGFIFGWDTGTISGFVNQTDFRRRFAQVNDEGGYYWSNARVGLIVAIFNIGCAVGGIILSRLGDMYGRRIGLMIVSLIYVVGIIIQISSNTKWYQYCIGRVISGLGVGGIAVLSPMLISETSPKHLRGTLVSCYQLMITAGILLGYCANYGTKSRYDDSRQWRIPLGLCFLWAIFMITGMAFVPESPRYLIEKDKIEEAKRSLATSNKVPVDDPAILAEVNNIQAGVELERMAGSASWGELFTVRTKILQRVIMGAMIQSLQQLTGNNYFFYYGTTIFDSVGLEDAFKTSIILGAVNFGSTFVAMYTVDRFGRRKCLLYGAAAMAVCMVIFASVGVTRLWPNGPDQPSSRPAGNAMIVFTCLYIFFFATTWAPIAYVIVSETFPLRVKAKGMAIATAANWIWGFLIAFFTPYITNAIRFYYGYVFMGCLIFAFFYIFFFVPETKGLTLEEVEEMWQEGVVPWRSESWVPSARRHAPYSSDKQAAGI

SEQ ID NO: 4676 - DNA, 1557 bp, Oryza sativa
  CDS (1)..(1557)
atggccggcggcgcggtggtgagcacgggggcaggcaaggactaccctggcaagctcaccctcttcgtcttcttcacatgcgtcgtcgccgccaccggtggtctcatcttcggatatgacatcggtatatcaggtggtgtgacgtccatggacccgttcctgaggaagttcttcccggaggtgtatcggaagaagcagatggcggacaagaacaaccagtactgcaagtacgacaaccagctgctgcagaccttcacctcgtcgctctacctcgccgccctcgtctcctccttcttcgccgccaccgtcacccgcgtcctcggccgcaagtggtccatgttcgccggcggcctcaccttcctcatcggcgccgccctcaacggcgccgccgagaacgtcgccatgctcatcgtcggtcgtatcctcctcggtgtcggcgtcggcttcgccaatcagtcggtgccggtgtacttgtcggagatggcgccggctcggctgcgggggatgctgaacatcgggttccagctgatgatcaccatcggcatcctggcggcggagctgataaactacgggacggcgaagatcaaggccgggtggggatggcgggtgagcctggcgctggccgccgtccccgccgccatcatcaccctcggctccctcttcctcccggacacccccaactcgctcatcgacaggggccacccggaggcggcggagcgcatgctccggcgcatccgcggctccgacgtggacgtgtcggaggagtacgcggacctggtggcggcgagcgaggagtcgaagctggtgcagcacccgtggcgcaacatcctccgccgcaagtaccgcgcccagctcaccatggccatctgcatccccttcttccagcagctcaccgggatcaacgtcatcatgttctacgcccccgtgctgttcgacaccctgggcttcaagagcgacgcgtcgctcatgtccgccgtcatcacgggcctcgtcaacgtcttcgccacgctggtgtccatcttcaccgtggaccgcctcggccgccgcaagctgttcctgcagggcggggcgcagatggtggtgtgccaggtggtggtggggacgctgatcgccgtcaagttcgggacgagcggcatcggcgacatccccaaggggtacgcggcggtggtggtgctcttcatctgcatgtacgtggcagggttcgcgtggtcgtggggcccactggggtggctcgtccccagcgagatcttcccgctggagatccggccggcggggcagagcatcaacgtgtcggtgaacatgctcttcaccttcgtcatcgcgcaggccttcctcaccatgctctgccacatgaagttcggcctcttctacttcttcgccggatgggtcgtcatcatgaccgtcttcatcgccctcttcctccccgagaccaagaacgtccccatcgaggagatggtgctcgtctggaagtcccactggttctggcgccgattcatcggagaccacgacgtccacgtcggcgccaaccacgtctccaacaataagctccaaccataa

SEQ ID NO: 4677 - protein, 518 aa, Oryza sativa
MAGGAVVSTGAGKDYPGKLTLFVFFTCVVAATGGLIFGYDIGISGGVTSMDPFLRKFFPEVYRKKQMADKNNQYCKYDNQLLQTFTSSLYLAALVSSFFAATVTRVLGRKWSMFAGGLTFLIGAALNGAAENVAMLIVGRILLGVGVGFANQSVPVYLSEMAPARLRGMLNIGFQLMITIGILAAELINYGTAKIKAGWGWRVSLALAAVPAAIITLGSLFLPDTPNSLIDRGHPEAAERMLRRIRGSDVDVSEEYADLVAASEESKLVQHPWRNILRRKYRAQLTMAICIPFFQQLTGINVIMFYAPVLFDTLGFKSDASLMSAVITGLVNVFATLVSIFTVDRLGRRKLFLQGGAQMVVCQVVVGTLIAVKFGTSGIGDIPKGYAAVVVLFICMYVAGFAWSWGPLGWLVPSEIFPLEIRPAGQSINVSVNMLFTFVIAQAFLTMLCHMKFGLFYFFAGWVVIMTVFIALFLPETKNVPIEEMVLVWKSHWFWRRFIGDHDVHVGANHVSNNKLQP

SEQ ID NO: 4678 - DNA, 1464 bp, Neurospora crassa
  CDS (1)..(1464)
atgacagacaacccagaagagcccttgatcgccaacactcaatcgacggagagggaccaagatgatggcagccatgatgtcgaacatgcgcatgattcccggggagggaaacagcacatatcaccgcccggcctgttcatctggctactcaccttttccgccggaataagcggtctactcttcggctacgacacaggcgtaataagcgccacccttgtctctatcggtacctccctctcgcaccggcccctgacctcgctcgacaaatccgtcatcacctcatgcacctccctcttcgccctgctcgcgctacccttcgcctccgcgctcgccgacgaccggggccgcaagcgcgttgtcctcttcgccgacaccctcttcatcatcggcgccctctgccaggccgccagccggaccgtcgaggtcatggtaattgggcggtcggttgtcggcatagccatcggcgccgccagcttcgtgacgccgctgtacattgccgagctggcgcctgcgacgcaccgcggccggttggtgacgatgaacattgtgtttatcacgcttgggcaggtggttgcgtacgtggtaggctggatctttgggacgtatggtagtccggagacgacggggtggagatggatggtcgggttgggcgcggtgccggcggtttgtcaggtggtcatcttgttgtggatgccggagagcccgaggtggttggtgaaggacggaaggtcgcaagaggcaagagcggtgattgctaagattgccgcgggggatgatgcgcaggatccgtcgacgaggagggaagtggatgctgtgttgaagagcatcgagattgagggtcttcagcagctgtgcggatttaactcgctcatgtacttctcggccacgatattcacgatggtggggttttcagagccgactttgacctcgctagtcgttgcagtcaccaactttgccttcaccttagttgccctggtgttgatcgaccgggtgggaaggagacgcattctactctggtctcttccctttatgattgcaggtctggtgcttgccggctatggcttttcgttcatcgagctcccgaattcagagaccagctcgccctcgacaacgggaggtcagggcggggccgtcattattttggcgagcatcatgatttatgtggctggctatgccatcggactgggcaatgtgccctggatgcagagcgagctcttctcactgagtgttcggtcagtgggcagtggtgttgcaacagcgaccaactggagcgccaactttgtgattggactgacgttccttccgctgatggaggccttgtcgccgtcttggacgtttgtcctgtacgcagtgatctgcgcggttgggtatggcctgatttggacggtataccctgaaaccgcagggctgagcttggaagatgcggcgacccttctagaagcggatgactggggggtgcggtaa

SEQ ID NO: 4679 - protein, 487 aa, Neurospora crassa
MTDNPEEPLIANTQSTERDQDDGSHDVEHAHDSRGGKQHISPPGLFIWLLTFSAGISGLLFGYDTGVISATLVSIGTSLSHRPLTSLDKSVITSCTSLFALLALPFASALADDRGRKRVVLFADTLFIIGALCQAASRTVEVMVIGRSVVGIAIGAASFVTPLYIAELAPATHRGRLVTMNIVFITLGQVVAYVVGWIFGTYGSPETTGWRWMVGLGAVPAVCQVVILLWMPESPRWLVKDGRSQEARAVIAKIAAGDDAQDPSTRREVDAVLKSIEIEGLQQLCGFNSLMYFSATIFTMVGFSEPTLTSLVVAVTNFAFTLVALVLIDRVGRRRILLWSLPFMIAGLVLAGYGFSFIELPNSETSSPSTTGGQGGAVIILASIMIYVAGYAIGLGNVPWMQSELFSLSVRSVGSGVATATNWSANFVIGLTFLPLMEALSPSWTFVLYAVICAVGYGLIWTVYPETAGLSLEDAATLLEADDWGVR

SEQ ID NO: 4680 - DNA, 1455 bp, Rhodopirellula baltica
  CDS (1)..(1455)
atgctagactttggaacggcgggcacgcaaacgctcggtcggcgcgaaatcattggcacggcggttgagcagcgtgcctccgacgagcaacgttccaacatcgggcaatcaaaattgaatcagcgtgttttcctgtggagtttgacgtcgtccttggcggggtttttgttcggctttgacacagtcgttatttccggagctgaaaaagccatccagggtctgtgggcgctgggtgatttccaacacggtcttgctctgagcgccgcgttgtgggggaccgtcatcggatccttggtcggcggttggccaactgacaaatttggacgcaaaaagacgttgctctggatcggaattctgtacttggtttcggcgatctggtcaggtttcgcgaccgacgttttctcgttcatgatcgctcgcttcatcggcggcttaggcgttggaatttctaccgtcgcggctccgctatacatctctgaaatctcgccaccgaaacatcgcgggactttgactggattgtttcaattcaacatcgtctttggaatcatggtcgcgttcgcgtccaattatctgattggcacctggggtaacgagaatgcttggcgatggatgttggcggtggaagcgatccccgctttgatcttcaccgtcatgtgcatttcgttgccatccagccctcgatggttgatcgcggtcaagaaagaccaagcggccggcatgtcggttctgaaacaactacggccagatgcgtccgatgaagaggtgcaaaggacggtcgatgaaattgtcgcctctctccgtgccgagtcggacctgactcccgcggaaccgttttggagccgtcgactattcactcccatatccattgcattcctcgtcgcgtttttcaatcagctttctggaatcaatgccgttctatacttctcaccgcgaatttttgaattggccggtatgggcgaacaagccgctcttttgcaatcgatcggcattggtatcaccaacctgatcttcacctttgtgggcttgtatttgatcgaccgactgggtcgtcgcacgttgctactgattggttcggcgggctacatcctgtcgctggggacgtgcgcctacgcctttcaatccgaaacatttagcattgttcccgcatgcattttcgccttcatcgcatcgcacgcgatggggcagggtgcggtcatttgggtgctgatctcagaagtctttcccaacgagcatcgtgccgcgggtcaatcgctgggaagcttcacgcactggatctttgcggcattgctgacgcttgtttttccggccgtggtggagacgtttcatcccgctgccatcttcggctttttctgcttcatgatggtcctgcaaggactttgggtcatcacgatgttgcctgaaaccaagggcatctcgctggagcaaatggaagcaaaactcggaatccgcgtttaa

SEQ ID NO: 4681 - protein, 484 aa, Rhodopirellula baltica
MLDFGTAGTQTLGRREIIGTAVEQRASDEQRSNIGQSKLNQRVFLWSLTSSLAGFLFGFDTVVISGAEKAIQGLWALGDFQHGLALSAALWGTVIGSLVGGWPTDKFGRKKTLLWIGILYLVSAIWSGFATDVFSFMIARFIGGLGVGISTVAAPLYISEISPPKHRGTLTGLFQFNIVFGIMVAFASNYLIGTWGNENAWRWMLAVEAIPALIFTVMCISLPSSPRWLIAVKKDQAAGMSVLKQLRPDASDEEVQRTVDEIVASLRAESDLTPAEPFWSRRLFTPISIAFLVAFFNQLSGINAVLYFSPRIFELAGMGEQAALLQSIGIGITNLIFTFVGLYLIDRLGRRTLLLIGSAGYILSLGTCAYAFQSETFSIVPACIFAFIASHAMGQGAVIWVLISEVFPNEHRAAGQSLGSFTHWIFAALLTLVFPAVVETFHPAAIFGFFCFMMVLQGLWVITMLPETKGISLEQMEAKLGIRV

SEQ ID NO: 4682 - DNA, 2251 bp, Oryza sativa
  CDS (152)..(1723)
gttcgacatctcccacctttctcgcgcccccattggattgggggcgtccgccattgatgaccagctccgaatctagtacggcgaatcgcccgcggcaaggagcagcgtcgccgtcgcccgtggatcgccgggagcccggagggaggcggcgatggcgggcgcggaggccgccaatggcaggaacaagtacgcggttcttgatcccagcgacgagccggaggggcggaggaggccctcggcgtgggagcggaggagcaaggagcggttcgtgctcgcctgcgccatcttcgcctcgctcaacgccatcctcctcggctacgatgttggtgtaatgagtggcgcaataatctacattcagaaagatcttcacattaccgaatttcaggaagaaatcctagttggttgcttgagtgtggtttcactcttgggaagtctgtcaggaggaagaacatctgatgcaattggcaggaaatggacaatggctcttggtgcaattgtcttccaggctggtgcagccataatgacgttcgccccttcattcaccgtgctcatgatcgggaggctccttgctggtgtgggcattggctttggtgccatggtatctgcagtctatatcgctgagatatcccctgcagctgcccgtgggactctcacatccctccctgagatctgtatcaatttagggatcctccttggttatgtttccaactatgctttctcgggcctttcagagcatatcaattggaggattatgcttggtgttggtatcctcccatctgtcttcattggatttgcactttttgtgatcccagaatcacccaggtggttgatgatggaaaagagagttccagaagccagggcagtattgctgcagataagtgagtctgaagctgaggttgaagaaaggattgctgagattgaggaagctgcaaatcttcttaaatcgacgaaatccgaggacaaggcagtgtggatggagctgttgaacccttctcctgctgttcgtcggatgctatatgctggctgtggtatccaaatgttccagcagatcacgggtattgatgctactgtctattacagcccaactattttcagagatgccgggatcaagtctgatcaggagcttcttgcagccacagtggctgttggttttactaagacagtgttcatattggttgcaattttcctcattgataaagttggacgcaaaccgcttctttatgttagcaccattggaatgactatgtgcttatttgtcttggggattgcactcacattgcaaaagcatgccatgggacttatttctccaagaattgggattgacctagcagtttttgcagtttgtggaaatgtggctttcttttcaattggcatgggtccaatatgttgggtcttgtcttcagagatatttcctttgagattacgagctcaagcatcggcactaggtcaagtaggtggtagagtgagcagtggtttggtttccatgtcatttctttccatggcccgtattatatcagtggcaggaatgttctttgtctttgcggttatctcgactgtctctgtggcctttgtgtatttctgcgtgccagaaacgaaagggaaaactctggagcagattgagatgatgtttgaaggtgggaaagaatggagagggagtgagatagagcttgaggatacacaacatttaatacagagcagcaagaagtctgtgtctctaggctgacactattagaaacaataaattcgaaatcattcgatgttcaatgatgaaccatacttatcctgcttccatcgcctacgggattctgaaattcaggtctgcaaaatgatcaggctgccttggactgctacggattttgagggcttaacacgagtatattaggtgtaggcgcaaaacagcatgtaaatgtctgctttacacaactacatcccaaaatgttacctgggaggacacagatgatgttgtatatggcggtatcttccacctaccaaaaaatatagttgttgaagttccttattccacagtttaattttaatagaggaagaggtgtgtgatttccaactgaatgaattctgtgtgattcttgatccagctttttgatttagtccttcatgatattgtagtactgtggctttgttggtctagtataaaaccttcaagaccatgccatgtctatagctttgcattgacgtgcagagttctgtaaataccagatttggatgattcattctgtcaaattaattatttact

SEQ ID NO: 4683 - protein, 523 aa, Oryza sativa
MAGAEAANGRNKYAVLDPSDEPEGRRRPSAWERRSKERFVLACAIFASLNAILLGYDVGVMSGAIIYIQKDLHITEFQEEILVGCLSVVSLLGSLSGGRTSDAIGRKWTMALGAIVFQAGAAIMTFAPSFTVLMIGRLLAGVGIGFGAMVSAVYIAEISPAAARGTLTSLPEICINLGILLGYVSNYAFSGLSEHINWRIMLGVGILPSVFIGFALFVIPESPRWLMMEKRVPEARAVLLQISESEAEVEERIAEIEEAANLLKSTKSEDKAVWMELLNPSPAVRRMLYAGCGIQMFQQITGIDATVYYSPTIFRDAGIKSDQELLAATVAVGFTKTVFILVAIFLIDKVGRKPLLYVSTIGMTMCLFVLGIALTLQKHAMGLISPRIGIDLAVFAVCGNVAFFSIGMGPICWVLSSEIFPLRLRAQASALGQVGGRVSSGLVSMSFLSMARIISVAGMFFVFAVISTVSVAFVYFCVPETKGKTLEQIEMMFEGGKEWRGSEIELEDTQHLIQSSKKSVSLG

SEQ ID NO: 4684 - DNA, 2458 bp, Oryza sativa
  CDS (510)..(2255)
gtcccgggctcccggcagcctggggtttctctccccgtttctgtttctcggtgaggtgaagttttccgtctcagcacactgccagttcttcttcttgttcttcctactcgtggcgccgcggcgtcctcacggatcgcaaggtcgggaattatctggggttctcggggtttgtggctcctttccggtgaaaggattcttttttagcgggagatcggttgagtcggtttcttctgtagatcttatcgttgagatttcgttgtttatgttaggcgagtcggggtgagacttatccgcgttcctccctgcgatgaaacacgcgattttggattgtcgttacgtttagggattgtggttttaaggctgttcttccgttgtaaatgttggttgcgccatcctataaaagaaagggactcctgtcgagaaacacaccatgcttcttctgtcctgaaggtttggaaaggcacattctgaggagatttttctgtcctacatcgtagcccttgaatgcaatggaagggggtgcaactctagctgataaggctgaatttaaggaatgtctgcggctgacctggagccagccttacattcttcagcttgttttctctgccggcatcggtggtcttcttttcggatatgatacaggtgtcatatctggagcacttctgtatattcgagatgattttactgcggtcgaaaagagcactgtacttagggaaacgatagtgagtatggctgtagctggagccatagttggagcaggatttggtggctggatgaacgacaagtttggaaggaagccttccatcttgatcgccgattccctgttcctcgcaggtgccttgatcatggcccttgccccaacaccgtttgtcatcattattgggaggatctttgttggtcttggggttggaatggcttccatgacagcacctttgtacatttctgaagcctctccagctagaatcagaggtgcacttgtgagcacaaatggacttcttattaccggagggcagttcatggcatacctcattaatctggccttcactaaggtaaagggaacatggaggtggatgcttggcattgcaggtcttcctgcttttattcagttcatattgatgtgtatgctacctgaatcaccaaggtggctatacagacaggataggaaagaggaggctgaagccatattaaggaagatttaccccgcggctgaggttgaagaagagatcgattcgatgcgccgatcaattgaacatgagaaacaactggagggctccatcggcgagcagagtctggttggcaagctgacgaaggcactgagcagcaaggtcgtccgccgtgggctcatggccggcgtcatcgcgcaggtcgcccagcagttcgtcggcatcaacaccgtcatgtactacagcccgacgatcgtccagctggccggcttcgcgtcgaacaacacggccatggcgctgtccctcatcacctcgggcctcaacgccatcgggtccatcgtcagcatgttcttcgtggacagggccggccgccgtcgcctgatgatcatcagcctcgtcggcatcgtcctgtggctcgccgtgctcggcggcacgttcctcggcgccgcgcaccacgcgccgccggtcagcgacctggagacgcgggtgttcgccaaccagacgtgcccggagtacagcccgagcgcccgctggaactgcatgaactgcctcaaggcccagtccacctgcggcttctgcgcccacggaggaaacaagctcctccccggcgcgtgcctggcggcgggcgaagcgtcgcggcggacgtgccacgcggggaaccgggagttctacacggaagggtgccccaacaacttcgggtggctggcgctggtggcgctcggcgcgtacatcgtctcctactccccgggcatgggcaccgtgccatggatcgtcaactcggagatctacccgctgcggttcaggggcgtctgcggcggcatcgcggcggtggccaactgggtgtccaacctcatcgtcacgcagacgttcctgagcctcaccaaggcgctgggcacgtcggccaccttcttcctcttctgcgccgtctccttcttcgcgctcgtcgtcgtcttcttcaccgtgccggagaccaagggactgcagttcgaggaggtggagaagatgctcggggagaaggactacaagccgtggaagagataccgtcccgacgtgtcgtccaaagggcgcgacatcggcctctctgttccatgaaaggaagaagaacagtgtttggtttcaagttatttgggttttaactagcaataatctgtactcagtttacatgtagagtggccgttgccaatagaaattaatcagttgtttcattgtgtgacacattttagagccttttcccctgtgcttagaacgtttgatgatttttatataagtaaattgcgtcttggtcacctttttcc

SEQ ID NO: 4685 - protein, 581 aa, Oryza sativa
MEGGATLADKAEFKECLRLTWSQPYILQLVFSAGIGGLLFGYDTGVISGALLYIRDDFTAVEKSTVLRETIVSMAVAGAIVGAGFGGWMNDKFGRKPSILIADSLFLAGALIMALAPTPFVIIIGRIFVGLGVGMASMTAPLYISEASPARIRGALVSTNGLLITGGQFMAYLINLAFTKVKGTWRWMLGIAGLPAFIQFILMCMLPESPRWLYRQDRKEEAEAILRKIYPAAEVEEEIDSMRRSIEHEKQLEGSIGEQSLVGKLTKALSSKVVRRGLMAGVIAQVAQQFVGINTVMYYSPTIVQLAGFASNNTAMALSLITSGLNAIGSIVSMFFVDRAGRRRLMIISLVGIVLWLAVLGGTFLGAAHHAPPVSDLETRVFANQTCPEYSPSARWNCMNCLKAQSTCGFCAHGGNKLLPGACLAAGEASRRTCHAGNREFYTEGCPNNFGWLALVALGAYIVSYSPGMGTVPWIVNSEIYPLRFRGVCGGIAAVANWVSNLIVTQTFLSLTKALGTSATFFLFCAVSFFALVVVFFTVPETKGLQFEEVEKMLGEKDYKPWKRYRPDVSSKGRDIGLSVP

SEQ ID NO: 4686 - DNA, 2574 bp, Oryza sativa
  CDS (569)..(2089)
gcgaagcgtatcggcttcatcgccaatcgatgatgcgacgatgctgatctgatcatctgaacccaacaaaatttctccttcaaaacctgcaagctcaccttcttctcccccagctctctcctccgatcatttgcccaaccaccacccagcccgccagccgtgcgagcgcagctttcctatttaagccgcgcctcgctggctcgctgccgctgcccctgcctcttccccgaatgctggtctctcgtcgccccgtcccctggaatctctccctttctaccttggtccgggaccgcggctcctgaaatctctctctgtccctagaaatttctgcgcgcgtcttccgttcttctccccggtttggttggttcccgagcctgtgacctcgggggcggccgaaaggttggattttgtagagcaggctttacttgcatctgggcaaagattggattttttttgtggagcgattttggggtcgttgttttttggtgcttgtttgctgaagtttggattttgggaggagtttggggggggggggggggttcggtcagatttggtgggagcggagggcatgacgatcgatttgtccatgcccgggagctccgggctcctggacgacgtaggggggaagaagcacatgaatttcttcagcaaccgctacgtgctcgcgctcacgggcgccgcaggaatcggcgggttcctctttggctacgacacaggtgtcatatctggagcccttttgtatattcgggatgactttccagcagtcagagacaattatttcttacaggagacaatcgttagcatggcattggtaggagccatcattggagcagctggcggcggctggatcaatgatacatacggccgtaggaagtctactcttgtggctgacatgctgtttgcacttggctcacttgttatgtgtgctgctggtggtccttacattctgattcttggaaggcttcttgttggcttgggtgtgggtatagcatcagtcacagcgccagtttacattgctgaagctgctccttcggaaattaggggaggtttggtgtcaactaatgtactcatgattactggtggtcaattcttctcctacctcatcaatcttggctttactgaggttcctggaacatggcgctggatgctcggagttgctgctgtgcctgcaattctacagtttgttctgatgctttttttgccagaatctccccgttggcttttctggaaggatgagaaagcaaaagctatttctgtcctagagaagatttatgactctgaccgtctagaggaagaggtagagcttcttgcttcttcttcaatgcatgaatttcagtctgatggtactgggagctatttggacattttcaagtcaaaggaactaaggctagcattttttgctggagctggtcttcaggcgttccagcaatttactggcatcaacactgtcatgtactacagcccaacaattgtccagatggctgggtttacctccaacaagttggcattgctcctttccctcatagtcgctggtatgaatgccgctgggaccattgttggaatctacctgattgaccgctgtggccggcgtcgcctggcccttacaagcttggctggtgtggtggtctccctcgccatcctagcaatggccttcatactgcagtcatcatcagatatctgttcgaatgcactcaatggtgcctgccaaggtgcactgggatggttcgcggtggcgggactcgctctatacatcgccttcttctccccaggtatggggccagttccatgggcagtgaactccgagatctaccccgaggcataccgtggaatgtgtggtggcatgtcagccactgtcaactgggtatctaacctgattgtggcacaaacattcctctcgatcgtcgggttggttgggaccggcctgaccttcctgatcatcgccggaatagcggtgctggccttcatcttcgtggctctctacgtgccggagactaaaggcctcagctttgagcaggttgagctcctgtggaaggagagagcatggggaaaccagggcaatcgccagagccttttgggcgctgcaccgtagtgagccagctctcatcctgcttgcccttgctggcaagggtcggtggctggctccctttttaagatggccgtgccaccctcagtttctatcggctctctctagctgggaagttttaggaagatctggatgcagaccaaattttattacgtggtagcgactagatcattgttctgtcacctggcatgtattgtcaatttctcatggtggaaactgggataatttcagcattgggtgggtgaagaatcaggttgtgttggtgtcgaatcttgtatacatgggaaggactgtacgagctatactggttgtgcattgccgtcacaagtgtatagttccggtgctagatgtgccggggagacggttaaaaacctgttatggacagaaacaggaatgaaaattatcgctttaatattcttgctcgttattcctccaccaggtgtatctgacttggcaaaccttgagagttatatgcagatgatgtattttgt

SEQ ID NO: 4687 - protein, 506 aa, Oryza sativa
MTIDLSMPGSSGLLDDVGGKKHMNFFSNRYVLALTGAAGIGGFLFGYDTGVISGALLYIRDDFPAVRDNYFLQETIVSMALVGAIIGAAGGGWINDTYGRRKSTLVADMLFALGSLVMCAAGGPYILILGRLLVGLGVGIASVTAPVYIAEAAPSEIRGGLVSTNVLMITGGQFFSYLINLGFTEVPGTWRWMLGVAAVPAILQFVLMLFLPESPRWLFWKDEKAKAISVLEKIYDSDRLEEEVELLASSSMHEFQSDGTGSYLDIFKSKELRLAFFAGAGLQAFQQFTGINTVMYYSPTIVQMAGFTSNKLALLLSLIVAGMNAAGTIVGIYLIDRCGRRRLALTSLAGVVVSLAILAMAFILQSSSDICSNALNGACQGALGWFAVAGLALYIAFFSPGMGPVPWAVNSEIYPEAYRGMCGGMSATVNWVSNLIVAQTFLSIVGLVGTGLTFLIIAGIAVLAFIFVALYVPETKGLSFEQVELLWKERAWGNQGNRQSLLGAAP

SEQ ID NO: 4688 - DNA, 1407 bp, Shigella flexneri
  CDS (1)..(1407)
atggagggcatcatgcctgacgctaaaaaacaggggcggtcaaacaaggcaatgacgtttttcgtctgcttccttgccgctctggcgggattactctttggcctggatatcggtgtaattgctggcgcactgccgtttattgcagatgaattccagataacttcgcacacgcaagaatgggtcgtaagctccatgatgttcggtgcggcagtcggtgcggtgggcatcggctggctctcctttaaactcgggcgcaaaaagagcctgatgatcggcgcaatcctgtttgttgccggttcactgttctctgcggctgcgccaaacgttgaagtactgattctttcgcgcgttctgctggggctggcggtgggtgtggcctcttataccgcaccactgtacctgtcagaaattgcgccggaaaaaattcgcggcagtatgatctcgatgtatcagttgatgatcactatcgggatcctcggtgcttatctttctgataccgccttcagctacaccggtgcatggcgctggatgctgggtgtgattatcatcccggcaattttgctgctgattggtgtcttcttcctgccagacagcccacgttggtttgccgccaaacgccgttttgttgatgccgaacgcgtgctgctacgcctgcgtgacaccagcgcggaagcgaaacgcgaactggatgaaatccgtgaaagtttgcaggttaaacagagtggctgggcgctgtttaaagagaatagcaacttccgccgcgcggtgttccttggcgtactgttacaggtaatgcagcaattcaccgggatgaacgtcatcatgtattacgcgccgaaaatcttcgaactggcgggttataccaacaccaccgagcaaatgtgggggacagtgattgtcggcctgaccaacgtacttgccacctttatcgcaatcggccttgttgaccgctggggacgtaaaccaacgctaacgctgggcttcctggtgatggctgctggcatgggcgtactcggtacaatgatgcatatcggtatccactctccgtcggcgcagtatttcgccatcgccatgctgctgatgtttattgtcggttttgccatgagtgccggtccgctgatttgggtactgtgctccgaaattcagccgctgaaaggccgcgattttggcatcacctgctccaccgccaccaactggattgccaacatgatcgttggcgcaacgttcctgaccatgctcaacacgctgggtaacgccaacaccttctgggtgtatgcggctctgaacgtactgtttatcctgctgacattgtggctggtaccggaaaccaaacacgtttcgctggaacatattgaacgtaatctgatgaaaggtcgtaaactgcgcgaaatcggcgctcacgattaa

SEQ ID NO: 4689 - protein, 468 aa, Shigella flexneri
MEGIMPDAKKQGRSNKAMTFFVCFLAALAGLLFGLDIGVIAGALPFIADEFQITSHTQEWVVSSMMFGAAVGAVGIGWLSFKLGRKKSLMIGAILFVAGSLFSAAAPNVEVLILSRVLLGLAVGVASYTAPLYLSEIAPEKIRGSMISMYQLMITIGILGAYLSDTAFSYTGAWRWMLGVIIIPAILLLIGVFFLPDSPRWFAAKRRFVDAERVLLRLRDTSAEAKRELDEIRESLQVKQSGWALFKENSNFRRAVFLGVLLQVMQQFTGMNVIMYYAPKIFELAGYTNTTEQMWGTVIVGLTNVLATFIAIGLVDRWGRKPTLTLGFLVMAAGMGVLGTMMHIGIHSPSAQYFAIAMLLMFIVGFAMSAGPLIWVLCSEIQPLKGRDFGITCSTATNWIANMIVGATFLTMLNTLGNANTFWVYAALNVLFILLTLWLVPETKHVSLEHIERNLMKGRKLREIGAHD

SEQ ID NO: 4690 - DNA, 2178 bp, Mesembryanthemum crystallinum
  CDS (512)..(2008)
ctcgttctctttctctctctctctcctctcttgttgttgttgctcccctacacggcagagtagagtagaccattctctgctttgtccttcatctctctctcatttctctcttttcttcaacactgtcacgttcacaacaagcaaaataagtcacgcatcataaaatctcattcacagaaaccagaaaaaaatcactgttactactctttgatcgcttgaaatttttgtgaacgtttcagtcactcaaattgcttcttaaaccagtgttttagtttataaagcttcaatctttgttgggtttttttttctttccattttctgctgagtaagattctgggttttacttcttcaaaactcatttttggacgatttctggggttaaaacccttttatatgtgaattaattttctgggttcattttatttctcatcaatttgggcttgattactgaatttcttgaatttgattctactctgcatttgggaattttgtttggaaaaatttggtgatcatgacacttgattcaatccctgggagttctgggtacttggattcataccctgagaggagaattacgtactttgggaacaaatttgttctggctttgactgttactgctggaattggtggattactctttggctatgatacaggtgtgatatcaggggcactcctgtacataaaagatgaatttccggcagtcaaaaacagcagcttcttgcaggaaacgattgtgagcatggcattggtcggtgcaatgattgggtctgccactgctggatggattaacgatgtatatgggcgtaaaaaagccactcttcttgctgattttatcttcgctattggtgccgtagttatggctgctgctcccgatccatatattctcatagtgggacgattcctggttggattgggtgtcgggctggcatcagtttgtgctcctgtttatattgctgaagcatctcctacggaagtaagaggagggcttgttagcacaaatgtgctaatgataacttttggacaatttgtttcctactgcgtgaaccttgcttttactgaggttcctggaacttggcgttggatgcttggggtatcgggcgtgcctgctgtcttgcaattcggctttatgcttcttttgccagagtccccccgctggctttacttgaagcatgagaaatccaaagctgctgcagtactcgcaaagatatacgacccctttaggctggaagacgagcttgatttgcttgctgctgctgaggaggaggagaagaacaaaccagctgtccatatatcagatgttttcacaaaaagagaactcagatatgcatttattgctggtggtggtctcctggcatttcagcaacttgcgggaatcaacaccgtcatgtattacagccctacgattgtccagatggctggtttcagttccaaccagttagccctcctaatctctctcatcgtcgctgccatgaacgcggtcggaacggtccttggtatataccttatcgaccacatggggcgacgcaaactagccctcacgagcctctcgggcgtgtttgtcgccctcgtcatgctcacgatctccttcatgctccgttcatcgggccccacctccgccctctactcgtggctcgctgtcttggggcttgccctttacattgccttctttgctccagggatgggacctgtcccatgggccatcaactctgagatatacccccaggcttacaggggtttgtgtgggggtatgggtgccacgatctgttggatcgttaacctctttgtttcggagacgttcctctccatcgcagacgccattggaaccggtcccacattcctgataatcgcaggcattgtgattgttgcgtttgtattcgtggtttgcttcgttcccgagaccaaggccttgacattcgaggaggtcgaccagatgttcatggacagagcttatggaaccgaggaaaatactcaaagccttcttgaatcctcgaatcggtctggaaattagcctatttgtcgtgaatcgcgatgaacgtgccatatttatcacaccaccctagttatggctacatgttgttgattatttttgcctcattagtccacatatggagttattataaagagttgtttatgctattgagcagagtcttctttatgtcatgtaaatgatcactatga

SEQ ID NO: 4691 - protein, 498 aa, Mesembryanthemum crystallinum
MTLDSIPGSSGYLDSYPERRITYFGNKFVLALTVTAGIGGLLFGYDTGVISGALLYIKDEFPAVKNSSFLQETIVSMALVGAMIGSATAGWINDVYGRKKATLLADFIFAIGAVVMAAAPDPYILIVGRFLVGLGVGLASVCAPVYIAEASPTEVRGGLVSTNVLMITFGQFVSYCVNLAFTEVPGTWRWMLGVSGVPAVLQFGFMLLLPESPRWLYLKHEKSKAAAVLAKIYDPFRLEDELDLLAAAEEEEKNKPAVHISDVFTKRELRYAFIAGGGLLAFQQLAGINTVMYYSPTIVQMAGFSSNQLALLISLIVAAMNAVGTVLGIYLIDHMGRRKLALTSLSGVFVALVMLTISFMLRSSGPTSALYSWLAVLGLALYIAFFAPGMGPVPWAINSEIYPQAYRGLCGGMGATICWIVNLFVSETFLSIADAIGTGPTFLIIAGIVIVAFVFVVCFVPETKALTFEEVDQMFMDRAYGTEENTQSLLESSNRSGN

SEQ ID NO: 4692 - DNA, 1614 bp, Neurospora crassa
  CDS (1)..(1614)
atgacagacaacccagaagagcccttgatcgccaacactcaatcgacggagagggaccaagatgatggcagccatgatgtcgaacatgcgcatgattcccggggagggaaacagcacatatcaccgcccggcctgttcatctggctactcaccttttccgccggaataagcggtctactcttcggctacgacacaggcgtaataagcgccacccttgtctctatcggtacctccctctcgcaccggcccctgacctcgctcgacaaatccgtcatcacctcatgcacctccctcttcgccctgctcgcgctacccttcgcctccgcgctcgccgacgaccggggccgcaagcgcgttgtcctcttcgccgacaccctcttcatcatcggcgccctctgccaggccgccagccggaccgtcgaggtcatggtaattgggcggtcggttgtcggcatagccatcggcgccgccagcttcgtgacgccgctgtacattgccgagctggcgcctgcgacgcaccgcggccggttggtgacgatgaacattgtgtttatcacgcttgggcaggtggttgcgtacgtggtaggctggatctttgggacgtatggtagtccggagacgacggggtggagatggatggtcgggttgggcgcggtgccggcggtttgtcaggtggtcatcttgttgtggatgccggagagcccgaggtggttggtgaaggacggaaggtcgcaagaggcaagagcggtgattgctaagattgccgcgggggatgatgcgcaggatccgtcgacgaggagggaagtggatgctgtgttgaagagcatcgagattgaggtgagagaggaggctacggctatgagactgggtggcgccggggccgggtatgcaaatgggaatgcagtgaatgcgtggatggaggctatgcgggaactgatcagggtgaggaggaacagacgggcattggcaattgcttgtctcctccagggtcttcagcagctgtgcggatttaactcgctcatgtacttctcggccacgatattcacgatggtggggttttcagagccgactttgacctcgctagtcgttgcagtcaccaactttgccttcaccttagttgccctggtgttgatcgaccgggtgggaaggagacgcattctactctggtctcttccctttatgattgcaggtctggtgcttgccggctatggcttttcgttcatcgagctcccgaattcagagaccagctcgccctcgacaacgggaggtcagggcggggccgtcattattttggcgagcatcatgatttatgtggctggctatgccatcggactgggcaatgtgccctggatgcagagcgagctcttctcactgagtgttcggtcagtgggcagtggtgttgcaacagcgaccaactggagcgccaactttgtgattggactgacgttccttccgctgatggaggccttgtcgccgtcttggacgtttgtcctgtacgcagtgatctgcgcggttgggtatggcctgatttggacggtataccctgaaaccgcagggctgagcttggaagatgcggcgacccttctagaagcggatgactggggggtgcggtaa

SEQ ID NO: 4693 - protein, 537 aa, Neurospora crassa
MTDNPEEPLIANTQSTERDQDDGSHDVEHAHDSRGGKQHISPPGLFIWLLTFSAGISGLLFGYDTGVISATLVSIGTSLSHRPLTSLDKSVITSCTSLFALLALPFASALADDRGRKRVVLFADTLFIIGALCQAASRTVEVMVIGRSVVGIAIGAASFVTPLYIAELAPATHRGRLVTMNIVFITLGQVVAYVVGWIFGTYGSPETTGWRWMVGLGAVPAVCQVVILLWMPESPRWLVKDGRSQEARAVIAKIAAGDDAQDPSTRREVDAVLKSIEIEVREEATAMRLGGAGAGYANGNAVNAWMEAMRELIRVRRNRRALAIACLLQGLQQLCGFNSLMYFSATIFTMVGFSEPTLTSLVVAVTNFAFTLVALVLIDRVGRRRILLWSLPFMIAGLVLAGYGFSFIELPNSETSSPSTTGGQGGAVIILASIMIYVAGYAIGLGNVPWMQSELFSLSVRSVGSGVATATNWSANFVIGLTFLPLMEALSPSWTFVLYAVICAVGYGLIWTVYPETAGLSLEDAATLLEADDWGVR

SEQ ID NO: 4694 - DNA, 1467 bp, Lactobacillus plantarum
  CDS (1)..(1467)
atgtctgctgaaaaaagtatttcatctgatcatgtaccgctatcagatccagctttaaaaaccatcaatcgaaatgccgggcgtaatctgaatcatattgcatttatttcaacacttggcggtttattatttggggttgataccggtgtcattaacggtgcaatcggatatatggcgacccccgcggaattaaacctctcgcctaataatgaaggactagtcacgagtggcatcactcttggtgctgcattcggtgcagtcttcgcaggacacctctcagaccgaattggtcgaaaacgacttttaaagtacctagccttgcttttctttgtttgcacattagcttgttctcttgcgccgaacgcactgtttatgatcatctcccgggtcctactcgggctagctgtgggtggtgcctccgttatagtgccaacatatctatcagaaatatccacccctgaaataagaggacgtctagtaacacaaaacgagttaatgattgttaccggacaactattagcctttatcgtaaatgctattttaggtaattggtttggccatatttctaatatttggcgttatatgattggctttggcatgattccagctgttgcactcttcttcggtatgatggttgtgccagaatcaccgcggtggctagtaatggtcaatcagcttgataatgcctttgattctcttaggaaaatccgctcccatcccgaaacatgtaacgaagaaattacccagattcaggatacattgaatcaagaaagcgagattaagcaggccactttcaaggacctatcaacaccatggattcgacgcctggtctttattggaatcggtcttggcgtaatgcagcaatttattggcattaatatcatgatgtattacggaacaacaatcctgacgaactccggattcgcacataatgccgctctaattgcaaatataggtaatggtctagtgtcggttatcgctacttttatcggcatgtcaattatgaatcgcgtgaatagacgaagcatgctaatcgctggtattatcggcactaccacttcacttatcttaatcgttggtgtttctgcattccttagccagagcccgctgttaccaatacttgtcgttctttgcaccatgatgtttttgggctttttccaaggttttatctctccattagtttggctcttgctctctgaaatatttccacaaaacttacgtggactgggaatgggtgtctcgacctttttcctgtggtttgcaaactttcttgtaggctactttttcccaatactattgagtgcagtcggaatgacatggacatttttgatcttcgtatttttcaatattctgtcatttatcttcgcatataaatatgcacctgaaacgcgtggaaaatcacttgaattgatccaaatggaatttaaatatggtgataccacgggaattaaccccgaagataaataa

SEQ ID NO: 4695 - protein, 488 aa, Lactobacillus plantarum
MSAEKSISSDHVPLSDPALKTINRNAGRNLNHIAFISTLGGLLFGVDTGVINGAIGYMATPAELNLSPNNEGLVTSGITLGAAFGAVFAGHLSDRIGRKRLLKYLALLFFVCTLACSLAPNALFMIISRVLLGLAVGGASVIVPTYLSEISTPEIRGRLVTQNELMIVTGQLLAFIVNAILGNWFGHISNIWRYMIGFGMIPAVALFFGMMVVPESPRWLVMVNQLDNAFDSLRKIRSHPETCNEEITQIQDTLNQESEIKQATFKDLSTPWIRRLVFIGIGLGVMQQFIGINIMMYYGTTILTNSGFAHNAALIANIGNGLVSVIATFIGMSIMNRVNRRSMLIAGIIGTTTSLILIVGVSAFLSQSPLLPILVVLCTMMFLGFFQGFISPLVWLLLSEIFPQNLRGLGMGVSTFFLWFANFLVGYFFPILLSAVGMTWTFLIFVFFNILSFIFAYKYAPETRGKSLELIQMEFKYGDTTGINPEDK

SEQ ID NO: 4696 - DNA, 1554 bp, Bifidobacterium longum
  CDS (1)..(1554)
atgacgacgacaacggcatcacccgtatcgaaacagacggcatccgcggcgcaggaaaccagcgcaaccggtgcggcggccaccgcaatcgaaaccatcgaaaccggcgtggccggagtggcgggcgcggccacaaacgcggcagccaacgcaatcgaggacctcgaagccgccgaatcgcacggcttctccacgcgcttcccgctcaacagcgcattcatcttcaccttcggcgcgctcggcggcatgctgttcggtttcgacaccggcatcatctccggcgcctccccgcttatcgaatcggacttcggcctgagcgtctctcagaccggcttcatcacctcctcggtgctgatcggctcgtgcgcaggcgcgctgtcgatcggcgcactgtctgaccggttcggccgcaagaagctgctcatcgtctccgcgctgctgttcctgctcggctcaggcctgtgcgcctcctccaccggattcgcgatgatggtgtgcgcccgcatcatcctgggtctcgccgtcggcgcggcctccgccctgaccccggcgtacttggccgaactggcgccgaaggagcgtcgcggctcactgtccacgctgttccagctcatggtcaccttcggcattctgctggcctacgcctccaacctcggattcctgaaccacaacctcttcggcatccgcgactggcgctggatgctcggttcggcgctggtgccggccgccttgttgctgctcggcggcctgttgctgcccgaatccccgcgttatctggtgaacaagggcgacacccgcaacgccttcaaagtgcttacgctgattcgcaaggacgtggatcagacccaggtgcagattgagctggacgaaatcaaggccgtggccgcacaggacaccaagggtggtgtgcgcgaactgttccgtatcgctcgtccggcgctggtggccgccatcggtatcatgctgttccagcagctcgtgggcatcaactcggtgatctacttcctgccgcaggtgttcatcaagggcttcggcttccctgaaggcgacgcgatctgggtgtcggtgggcatcggcgtggtgaacttcgtgagcaccatcgtggccacgcttatcatggatcgtttcccgcgcaagggcatgctgatcttcggttccatcgtgatgaccgtttcgctcgcggtgctcgccgtgatgaacttcgtgggcgacgtggccgtgctggcagtgccgacgatgattctcatcgctttctatatcctcggctttgcggtctcgtggggcccgatcgcctgggtgcttatcggcgagatcttcccgctgagcgtgcgcggcatcggctcatccttcggctcggcggcgaactggctgggcaacttcatcgtctcccagttcttcctcgtgctgctcgatgcgttcggcaacaatgtgggcggcccgttcgcgattttcggcgtgttctcggccctgtccatcccgttcgtgctgcgcttggtgcccgagaccaagggcaagtcgctggaggaaatcgagaaggaaatgaccaagcgctag

SEQ ID NO: 4697 - protein, 517 aa, Bifidobacterium longum
MTTTTASPVSKQTASAAQETSATGAAATAIETIETGVAGVAGAATNAAANAIEDLEAAESHGFSTRFPLNSAFIFTFGALGGMLFGFDTGIISGASPLIESDFGLSVSQTGFITSSVLIGSCAGALSIGALSDRFGRKKLLIVSALLFLLGSGLCASSTGFAMMVCARIILGLAVGAASALTPAYLAELAPKERRGSLSTLFQLMVTFGILLAYASNLGFLNHNLFGIRDWRWMLGSALVPAALLLLGGLLLPESPRYLVNKGDTRNAFKVLTLIRKDVDQTQVQIELDEIKAVAAQDTKGGVRELFRIARPALVAAIGIMLFQQLVGINSVIYFLPQVFIKGFGFPEGDAIWVSVGIGVVNFVSTIVATLIMDRFPRKGMLIFGSIVMTVSLAVLAVMNFVGDVAVLAVPTMILIAFYILGFAVSWGPIAWVLIGEIFPLSVRGIGSSFGSAANWLGNFIVSQFFLVLLDAFGNNVGGPFAIFGVFSALSIPFVLRLVPETKGKSLEEIEKEMTKR

SEQ ID NO: 4698 - DNA, 2234 bp, Kluyveromyces lactis
  CDS (402)..(2102)
cccatgtcttttaatttctccagtcagttcctgaggcccagccagtttctgtggttttttccccggatcttttactggtgactacaaaggcaattttttttccttccgcttttcgtttttagcgtggagtaagcaatagatagggctttcttatggtattgatccgctaattcaaactggacctatctcgtcgacaaatttgtatataatacgaagagaattcgcttactttcgtccaaattatccaaccccattgtcaaataagaatatatttgtgtacttctactctcgtatttactagatcaaaaaattagaaagctacagtattaatagcatattggtccgctaagttaaagctattagagcgtagaggttgttgatattaaaaaggttaagaaacaatgtctagtaatctgtctgaaaaagcagttgaccagcaaaaagaattcggcttgcttaagagtacgagttctgttgactcggtacacgaagttgaagccggtgtgaaagtcggtgaagatgacgacaattattttttcagtgaagatcaaatcttaacacagattaaggtgtacgaagatgaaattgcaaatactccagttactaagacgctaagacaacgtatgagaagaatggaattttgtgaagtgaacttctcaaataaaacgtatatggttattatgcttggttttttcgcatcatttgcaggtattttgtcaggtgtggatcaatcgaccatttcaggtgccagttatggtatgaaggcatcgttgaaattgacttccgatgaagattccttgatttcctctttaatgcctttgggtgcggtcggtggttctatcttgttaactccattaagtgaatatttcggtagaaaagttgccttagtgatctcatgtattttttataccattggtggtattttgtgtgccgctgctcaggatgttcatacaatgtatgcaggcagattcttgatcggtgttggtgtcggtattgaaggtggtggtgttggtgtttatattgctgaatctgtcccatctaccgtgcgtggttccttagtttcgttgtatcaattcaatattgcccttggtgagttggttggttatgtcattggtgtcattttcttcgatgtcaaaggtggttggagatatatgttaggttcctctttggtattttctaccatcttatttgttggtttattcttcttacctgaatcccctcgttggttgatccacaagggttatgatgtagaagcttataaggtctggcgtagattgagagacacatcggatctaggcaataaaagagaattcttggaaatgaaacatgcagctgaacaagatagacaattgaaagaacaagaatctcgcttcaagagtatgtttgacttgatcttaatcccaagaaatcgtcgtgcattgttatactccattatgatggtctctttgggtcaattgactggtattaacgcaatcatgtattatatgtccacgttgatgggacagatcggtttctctccaaaacaagccgtcgctatgtctatggttggtggtgctgctttgttaataggtaccattccagcaatcctatatatggataaatttggtagacgtccatggtctatgaccattatcggtttctccgtaggtctagttctcgtcggtgttggttatcagatcgatttgaataccaacttggctgctgctgaaggggtttacttaaccggccagattttgtataacatcttctttggtacttatgccactttgacctgggttgttccttctgagtctttctctttggctacaagatcgatcggtatgacgatttgctctgctttcttatacttatgggccttcactgttacttataacttcaacaaaatgaaggacgctttcacatacactggtttgactttaggtttctatggtggtattgctattgttattggtattccataccaattgttgtttatgccagaaaccaaagataaaactttggaagaaatcgatgatatctttgagatgccaactagacaattggtcaaacaaaatttgaagaacttaaaagattacgtttctggtaaccgtaaatctatttaattctctgtcttatgctaataaaactgaatgaagtaaggagttcactttgaaatcgatcctgaaagtgggagcttatttctatcatatgttttgagctgtatagacacaggataggggttactctctccgatc

SEQ ID NO: 4699 - protein, 566 aa, Kluyveromyces lactis
MSSNLSEKAVDQQKEFGLLKSTSSVDSVHEVEAGVKVGEDDDNYFFSEDQILTQIKVYEDEIANTPVTKTLRQRMRRMEFCEVNFSNKTYMVIMLGFFASFAGILSGVDQSTISGASYGMKASLKLTSDEDSLISSLMPLGAVGGSILLTPLSEYFGRKVALVISCIFYTIGGILCAAAQDVHTMYAGRFLIGVGVGIEGGGVGVYIAESVPSTVRGSLVSLYQFNIALGELVGYVIGVIFFDVKGGWRYMLGSSLVFSTILFVGLFFLPESPRWLIHKGYDVEAYKVWRRLRDTSDLGNKREFLEMKHAAEQDRQLKEQESRFKSMFDLILIPRNRRALLYSIMMVSLGQLTGINAIMYYMSTLMGQIGFSPKQAVAMSMVGGAALLIGTIPAILYMDKFGRRPWSMTIIGFSVGLVLVGVGYQIDLNTNLAAAEGVYLTGQILYNIFFGTYATLTWVVPSESFSLATRSIGMTICSAFLYLWAFTVTYNFNKMKDAFTYTGLTLGFYGGIAIVIGIPYQLLFMPETKDKTLEEIDDIFEMPTRQLVKQNLKNLKDYVSGNRKSI

SEQ ID NO: 4700 - DNA, 1561 bp, Arabidopsis thaliana
  CDS (1)..(1530)
atgacattgacgatcccaaacgcacctgggagctccgggtacttggatatgttcccagagagaaggatgtcgtattttgggaattcttacattctgggtttgactgtcactgccggaatcggtggccttctgttcggttatgatacaggtgtaatttccggtgcccttttgtacattaaggatgatttcgaagttgttaagcagagcagtttcttacaggaaactattgtaagtatggctttagttggtgccatgattggtgctgcagctggaggttggatcaatgactactacggtcgtaaaaaggcgactctttttgcagatgttgtctttgcagctggagctatcgttatggctgctgctcctgatccgtatgttttgatatcgggtcgtctcttggtcggtttaggagttggtgttgcttctgtgactgctccggtttatatagcggaagcatctccatcggaagttagaggtggacttgtgagcaccaacgtattgatgatcactggtggacagtttctttcatatctcgttaattctgctttcacacaggttccaggaacatggagatggatgcttggtgtttcaggcgttcccgctgtgattcagttcatcctcatgcttttcatgccagaatcccctcgatggcttttcatgaaaaatcgtaaagcggaagccatccaagtgctcgccagaacctatgacatctcgcggttagaagacgagattgatcatctttcagcggctgaagaggaagaaaaacaaaggaagcgcactgttggctacttggatgttttcagatccaaagaattgagacttgcatttcttgccggagcaggacttcaggcgtttcagcagttcactggtatcaatacagttatgtactacagccctacgatagtccaaatggctggatttcactcaaaccagctcgctttgttcctgtctctcattgttgctgccatgaatgctgctggaacagtcgtggggatttacttcatcgatcattgtggaaggaaaaagctagctctctcaagtttatttggcgtcattatatcactcttaatcctctcagtctcgtttttcaaacaatctgagacatcatctgatggagggctctatggttggctcgctgtgcttggcttagctctatacattgttttctttgcaccgggaatgggaccagtcccatggacggtgaactcagagatataccctcaacaataccgaggcatatgcggaggcatgtcagctacagttaactggatcagcaatttgattgtggcacaaacattcttgacaatcgcggaagctgctggaacaggaatgactttcttgattttggcgggaattgcggttcttgctgtaatctttgtgattgtgtttgtccctgagactcaagggctaacgttttcggaagttgaacagatttggaaagaaagagcttatggaaatatcagtggctggggcagtagcagtgatagcaacaacatggaagggttactcgagcagggatctcaatcttaaagatcttggatggctcatgagtcatgcatga

SEQ ID NO: 4701 - protein, 509 aa, Arabidopsis thaliana
MTLTIPNAPGSSGYLDMFPERRMSYFGNSYILGLTVTAGIGGLLFGYDTGVISGALLYIKDDFEVVKQSSFLQETIVSMALVGAMIGAAAGGWINDYYGRKKATLFADVVFAAGAIVMAAAPDPYVLISGRLLVGLGVGVASVTAPVYIAEASPSEVRGGLVSTNVLMITGGQFLSYLVNSAFTQVPGTWRWMLGVSGVPAVIQFILMLFMPESPRWLFMKNRKAEAIQVLARTYDISRLEDEIDHLSAAEEEEKQRKRTVGYLDVFRSKELRLAFLAGAGLQAFQQFTGINTVMYYSPTIVQMAGFHSNQLALFLSLIVAAMNAAGTVVGIYFIDHCGRKKLALSSLFGVIISLLILSVSFFKQSETSSDGGLYGWLAVLGLALYIVFFAPGMGPVPWTVNSEIYPQQYRGICGGMSATVNWISNLIVAQTFLTIAEAAGTGMTFLILAGIAVLAVIFVIVFVPETQGLTFSEVEQIWKERAYGNISGWGSSSDSNNMEGLLEQGSQS

SEQ ID NO: 4702 - DNA, 1419 bp, Salmonella typhimurium
  CDS (1)..(1419)
atggtctctattaatcatgactctgctttaacgccgcgttcgcttcgcgacacacgacgtatgaatatgtttgtttcggtttctgcagcggtagcgggactgttatttggtctggatatcggcgttatcgccggggcgctgccttttattaccgaccatttcgtactgaccagccggctgcaggaatgggtcgtcagcagcatgatgcttggcgcggcaattggcgcattatttaacggctggctttcattccggctggggcgtaagtatagcctgatggctggcgcgattttgttcgtgctcggctcgctggggtcggcgtttgcttccagcgtggaagtattgattggcgcccgcgtgatactgggcgtagcagtagggattgcctcctataccgcgccgctttatctctctgaaatggcaagtgaaaatgttcgcggcaaaatgatcagtatgtatcaactgatggtgacgttaggcattgtgctggcttttttatccgatacggcattcagctacagcggcaactggcgcgcgatgttgggcgtgctggcgctgcctgcggtgttgctcattattctggtggtattcctgccgaatagtccgcgttggctggcgcaaaaaggtcgccatattgaagcggaagaggtgctgcgtatgctgcgcgatacctcggaaaaagcccgtgatgaactgaatgagattcgggaaagcctcaaactcaagcagggagggtgggcattatttaaagctaaccgcaatgttcgccgcgccgtgttcctcggtatgctgctacaggcaatgcagcagttcaccggcatgaacatcattatgtactatgcgccgcgcatttttaaaatggccggctttaccaccacggaacagcaaatgatcgccacgctggtggtcggactgacttttatgttcgcgacgtttatcgccgtctttacggtcgataaggccgggcgtaaaccggcgttaaaaatcggtttcagcgtaatggcgttagggacattggtgttgggctactgcctgatgcagtttgataacggtacggcatcaagcggtctctcctggctttccgttgggatgacgatgatgtgtatcgccggttacgcgatgagcgccgctccggtggtgtggatactgtgttcggaaatccagccgctgaaatgccgtgattttggcattacctgttcaaccacgacaaactgggtatcgaacatgatcatcggcgcgacattcctgacactgttggacagcattggcgcggcaggtacattctggctctacaccgcgctgaatatcgcttttatcggcatcactttctggctgattccggaaaccaaaaatgtcaccctggagcacatcgaacgcaagctgatggcgggcgagaagctaagaaatattggcgtgtaa

SEQ ID NO: 4703 - protein, 472 aa, Salmonella typhimurium
MVSINHDSALTPRSLRDTRRMNMFVSVSAAVAGLLFGLDIGVIAGALPFITDHFVLTSRLQEWVVSSMMLGAAIGALFNGWLSFRLGRKYSLMAGAILFVLGSLGSAFASSVEVLIGARVILGVAVGIASYTAPLYLSEMASENVRGKMISMYQLMVTLGIVLAFLSDTAFSYSGNWRAMLGVLALPAVLLIILVVFLPNSPRWLAQKGRHIEAEEVLRMLRDTSEKARDELNEIRESLKLKQGGWALFKANRNVRRAVFLGMLLQAMQQFTGMNIIMYYAPRIFKMAGFTTTEQQMIATLVVGLTFMFATFIAVFTVDKAGRKPALKIGFSVMALGTLVLGYCLMQFDNGTASSGLSWLSVGMTMMCIAGYAMSAAPVVWILCSEIQPLKCRDFGITCSTTTNWVSNMIIGATFLTLLDSIGAAGTFWLYTALNIAFIGITFWLIPETKNVTLEHIERKLMAGEKLRNIGV

SEQ ID NO: 4704 - DNA, 1557 bp, Arabidopsis thaliana
  CDS (1)..(1467)
atgagttttagggatgataatacggaagagggaagaaatgatcttcggcgaccgttcttacacacaggaagttggtatcggatgggttcgagacaatctagtatgttggaatcgtctcaagttattcgagacagctcaatttctgtcttagcttgtgttttgattgttgctcttggtcctattcaattcggattcacttgtggttattcctcaccaactcaagctgccattactaaggatcttggtttaactgtatcagagtactctgtgtttgggtctctatccaatgtgggtgctatggttggagcaattgcgagtggtcagattgctgaatacgttggacggaaagggtctctgatgattgctgcaattcccaatattattggatggctttcgatatcatttgcaaaagatacttcttttctttacatgggaagattgttagaaggcttcggagttgggattatctcctatacggttcccgtatatatagctgagatcgctccacagaccatgagaggagccttaggttcagttaaccagctttctgtaacaattgggataatgctggcgtatttactcggtctctttgttccatggagaattcttgcagttttgggagtattgccatgtacattgttgataccgggtctttttttcattcctgaatctcctcggtggttggcaaagatgggtttgacagatgatttcgaaacttcattgcaagttcttcgtggatttgagactgatattaccgttgaggttaatgaaatcaagagatctgtggcatcatctagcaaacgttctgcagttcggtttgtagacctcaagcgcaggagatactatttcccactgatggttggtatagggctgcttgcacttcaacaacttggaggaatcaatggtgtcttgttctattcgagtacaatttttgaatctgcaggggtgacatcaagtaatgtggcgacatttggagttggcgttgttcaggtagtggcgactgggatagcgacatggttggtggataaagcaggtcgtcggcttctactcatgatctcttctatcggaatgacgataagcctcgtgattgtagcagttgcattttaccttaaggaatttgtatcacctgattccaacatgtacaacattctaagcatggtttccgtagttggagttgtggctatggttatttcttgctctctaggaatgggaccaattccatggctgattatgtctgagattctgccagtgaatataaagggtttagccggaagtatagcaactttgttaaactggttcgtgtcatggttagtgacaatgactgcaaatatgctgttagcatggagcagtgggggaactttcactctctacgctttggtttgtggattcactgtggtttttgtgagtctttgggttcctgagactaaaggaaaaacgcttgaagagatccaagctttgttcagatgatcaaaacaagaagaggaagaagaagacaaaattttcactttttgctttctccattacagatcattcttttgtcccttccctgtgtctgta

SEQ ID NO: 4705 - protein, 488 aa, Arabidopsis thaliana
MSFRDDNTEEGRNDLRRPFLHTGSWYRMGSRQSSMLESSQVIRDSSISVLACVLIVALGPIQFGFTCGYSSPTQAAITKDLGLTVSEYSVFGSLSNVGAMVGAIASGQIAEYVGRKGSLMIAAIPNIIGWLSISFAKDTSFLYMGRLLEGFGVGIISYTVPVYIAEIAPQTMRGALGSVNQLSVTIGIMLAYLLGLFVPWRILAVLGVLPCTLLIPGLFFIPESPRWLAKMGLTDDFETSLQVLRGFETDITVEVNEIKRSVASSSKRSAVRFVDLKRRRYYFPLMVGIGLLALQQLGGINGVLFYSSTIFESAGVTSSNVATFGVGVVQVVATGIATWLVDKAGRRLLLMISSIGMTISLVIVAVAFYLKEFVSPDSNMYNILSMVSVVGVVAMVISCSLGMGPIPWLIMSEILPVNIKGLAGSIATLLNWFVSWLVTMTANMLLAWSSGGTFTLYALVCGFTVVFVSLWVPETKGKTLEEIQALFR

SEQ ID NO: 4706 - DNA, 1876 bp, Arabidopsis thaliana
  CDS (87)..(1727)
ctcagcaatcacaatctatctggtttaagccctcactatcctctctctcaaatcgcggagtctccgaagtttctctgtcagacaaaatgcagtcgtcaacgtatgcggttaaaggaaacgctgcgtttgcgtttcagagacggaccttctcttctgacagatcgacgacttctaccggaattcgcttcgctggttataagagcttagccaccaccgggccactctactgttctggttctgaagccatgggagcgacgcttgctcgtgctgataacgggatccagagcgttatgagtttctcttctgtcaaagctcgatcggtcagagctcaagcctcatctgatggagatgaagaagaagctatacctctgagatctgaagggaaaagctctggaacagttttgccttttgttggtgttgcttgtcttggtgctatactctttggttatcatctcggggtggttaatggtgctcttgaatatcttgctaaggatcttgggatcgccgaaaatactgttttgcaaggatggattgttagttctctgcttgctggtgctacggtaggttcattcactggaggtgcattagctgacaaatttggacgaacaagaacttttcaattggatgctatcccgcttgccattggagctttcttatgtgcaacagctcagagtgtgcagactatgattgtgggacgtctgctcgctggaattggaattggaatctcatcagcgattgtaccactttacatatctgagatatcaccaactgaaatccgtggagcactcggatctgtgaaccagttgttcatctgtataggaatacttgcagccttgatagctggattaccccttgcagcaaaccctctatggtggaggacgatgtttggtgttgcagttatcccttccgttctattggccataggaatggctttttctccagaaagcccaaggtggctcgttcagcaaggaaaagtctctgaagctgaaaaggcgatcaaaactttgtatggcaaagaaagagtggttgaactagttcgcgacttatcagcctctggccaaggttcttctgagccggaggcaggatggtttgatctattcagcagccgctactggaaagttgtaagcgtaggtgcggctctcttcttgtttcaacagttagccgggataaacgcagttgtgtattactccacatcggtattccgtagtgcgggaatccaatcagatgttgcagccagtgctctcgttggagcatcaaatgtctttggcactgctgttgcttcatcgttgatggataaaatgggaaggaaaagtcttttactgacaagctttggtggaatggctttgtcaatgctgttactctccttgtccttcacatggaaggctcttgctgcctattctggaacccttgccgttgttggaactgttctatatgtcctgtcattctcacttggtgctggcccggtaccggctcttcttcttccagagatatttgcatcccgaatcagagcaaaagccgtcgctctttctctcggcatgcactggatatcaaactttgtgatcggactatacttcttaagcgttgtgactaaattcggaatcagcagtgtctacttgggttttgctggagtctgcgtccttgcggtcctctacattgcaggaaacgtcgtcgagactaaaggtcgatcactggaggaaatagagcttgctcttacatctggagcttgaaattaaacaaaagaaatcagcagaacaaaaaccagtttgtttcatcatttagtttgtgagtctttctctaatctgctactcttaaattgtacaatggacgacgttatcaataacgagaaatcttttcatgaccaaaaaaaaaaaaaaaa

SEQ ID NO: 4707 - protein, 546 aa, Arabidopsis thaliana; identical to SEQ ID NO: 89

SEQ ID NO: 4708 - DNA, 1787 bp, Arabidopsis thaliana
  CDS (100)..(1524)
gctctcttggttttttgctaaaaacagagcattttctctctagctctcactgtttctttaccagaagtttcgtcatattagtacatgcaagtgtaagggatggtgatggaggaaggaagaagcatagaagaagggcttttgcagctcaagaacaaaaacgacgattcagagtgtcgtattactgcttgtgttatccttagcacttttgtcgccgtttgtggctccttctcttttggtgttgctactggttacacttcaggtgctgagacaggagttatgaaggacttggatctttctatcgcgcaattttcagcttttggctcattcgccactttaggagctgcaattggtgcactgttctgcggtaatctggcaatggtcattggcagaagagggacaatgtgggtctccgatttcctatgcatcactggttggctctccatcgcttttgctaaggaagtaatgttgctgaacttcggaagaatcatttcagggataggtttcggcttgacgagctatgtggtacctgtctacatagcagaaattacgccaaaacatgttcgtggtacatttacgttttcaaaccagcttcttcaaaacgctggactcgccatgatttatttttgtgggaacttcatcaattggaggacgttggctttattaggtgctttaccatgcttcattcaagtaatcggtttattcttcgtgccagagtctccaagatggctggccaaagttggctccgataaagaactagaaaattcactgtttcggcttagaggaagagatgctgatatttcacgtgaagcctcagaaattcaagtaatgaccaaaatggtggaaaatgattcaaagtcgagtttttcagatttgttccagagaaagtatagatacaccctcgtggtaggaatcgggctaatgttgatacaacaattctcaggaagtgctgctgtaatctcttatgcaagtaccatttttagaaaagctggtttttcggtggccattggaacgacgatgctaggtatcttcgtgattccaaaagccatgattggcctcattcttgtcgataaatggggcagacgtcctctcttgatgacttcagcgtttgggatgagcatgacttgcatgctacttggggtcgccttcacattacagaaaatgcaattgctttcggaactaactccaatattatcgtttatatgcgtaatgatgtatattgcaacttatgcaataggcttgggaggtctaccttgggtaattatgtcggagatatttccaataaatataaaagtaactgcaggaagtatagttacgttagtctcattttcaagtagttcaatcgtcacttacgctttcaactttctgttcgaatggagcactcaaggaacgtttttcatattcgcgggtatcggtggagcagcgttgctttttatatggttgctcgttccagaaacgaaaggattatcactcgaagaaatacaagtttcacttattcatcagcccgatgaaagaaatcaaacttaatttgaattattttattttattataaaaatgatcaaattcagtttatggtgttatatttgtttatttacaaacaaggattttttttttttcattatgtaattactactttatttttctgggtaattagccccatttttatgatgtatatttacgagatgtaaaacttggcctacgtacatgtgtattttatctctaaaattgcaaatgtaatatttttcggacatatattaaagaagagattgatttctaaaaaaaaaaaaaaa

SEQ ID NO: 4709 - protein, 474 aa, Arabidopsis thaliana
MVMEEGRSIEEGLLQLKNKNDDSECRITACVILSTFVAVCGSFSFGVATGYTSGAETGVMKDLDLSIAQFSAFGSFATLGAAIGALFCGNLAMVIGRRGTMWVSDFLCITGWLSIAFAKEVMLLNFGRIISGIGFGLTSYVVPVYIAEITPKHVRGTFTFSNQLLQNAGLAMIYFCGNFINWRTLALLGALPCFIQVIGLFFVPESPRWLAKVGSDKELENSLFRLRGRDADISREASEIQVMTKMVENDSKSSFSDLFQRKYRYTLVVGIGLMLIQQFSGSAAVISYASTIFRKAGFSVAIGTTMLGIFVIPKAMIGLILVDKWGRRPLLMTSAFGMSMTCMLLGVAFTLQKMQLLSELTPILSFICVMMYIATYAIGLGGLPWVIMSEIFPINIKVTAGSIVTLVSFSSSSIVTYAFNFLFEWSTQGTFFIFAGIGGAALLFIWLLVPETKGLSLEEIQVSLIHQPDERNQT

SEQ ID NO: 4710 - DNA, 1702 bp, Oryza sativa
  CDS (87)..(1628)
ggactggtgagtactgatcgtagtccagccttgttctcctctctctctctctctcctcactcctcgcacacttcggaattcccatcatggccggcggcgccatgaccgacaccgatggcgctcacaagaactacccggggaagatgaccatcttcgtcttcctcgcctgcctcgtcgcctcctccggcggcctcatcttcggctacgacatcggcatctccggcggcgtgacgtcgatggactcgttcctgatcaagttcttcccgtcggtgtacgccaaggagaaggagatggtggagacgaaccagtactgcaagttcgacagcgagctgctcaccctcttcacctcgtcgctctacctcgccgcgctcatcgcctcgctcttcgcttccgtcatcacccgcaagttcggccgcaggatcaccatgctcggcggcggcgtcatcttcctcgtcggcgccatcctcaacggagccgccgccgacgtcgccatgctcatcatcggccgcatcctcctcggcatcggcgtcggcttcagcaaccaggctgtgccactgtacctgtcggagatggcgccggcgaggatgcggggcatgctgaacatcagcttccagctcatgatcaccgtcggcatcctcgccgccaacctcatcaactacttcaccgacaagatcgccggagggtgggggtggcgcgtcagcctcggcctcgccgccgtcccggccgtcatcatggccggcggctccctcttcctccccgacacccccaactcgctcctctcccgcggcaaggagaacgaggcgcgcgccatgctccgccgcatccgtggcaccgacgacgtcggcccggagtacgacgacctcgtcgccgccagcgaggcgtccaaggccatcgagaacccgtggcgcacgctcctcgagcgccggtacaggccgcagctggtgatgtcggtgctgatcccgacgctgcagcagctcaccggcatcaacgtcgtcatgttctacgcgccggtcctcttcaagaccatcggattcggcggcacggcctcgctcatgtccgccgtcatcaccggcctcgtcaacatgttcgccaccttcgtctccatcgccaccgtcgaccgcctcggccgccgcaagctcctccttcagggcggcgtccaaatgatctttgcgcagttcattcttgggacgctgatcgccgtcaagttcgggacggcgggcgtggcgaacatctcgcggggttacgccatcgtggtggtgctgtgcatctgcgtgttcgtgtcggcgttcgcgtggtcgtggggacccctcgggtggctggttcccagcgagatcttcccgctggagatcaggtcggcggcgcagagcgtggtggtggtgttcaacatggccttcaccttcatcatcgcgcagatcttcctgatgatgctgtgccacctcaagttcggcctcttctacttcttcggcgccatggagctcatcatgacggggttcgtcttcttcttcctgccggagacgaaggggattcccatcgaggagatggacaggatctggggtaagcactggtactggagacggttcgtcggcgctggggccggcggcaaggtcgagattacctccacagtatgacattcgtgccgtaaacgtttatctttcaatttgttttcggattacgtaattgaatctgctggctacatcgatcc

SEQ ID NO: 4711 - protein, 513 aa, Oryza sativa
MAGGAMTDTDGAHKNYPGKMTIFVFLACLVASSGGLIFGYDIGISGGVTSMDSFLIKFFPSVYAKEKEMVETNQYCKFDSELLTLFTSSLYLAALIASLFASVITRKFGRRITMLGGGVIFLVGAILNGAAADVAMLIIGRILLGIGVGFSNQAVPLYLSEMAPARMRGMLNISFQLMITVGILAANLINYFTDKIAGGWGWRVSLGLAAVPAVIMAGGSLFLPDTPNSLLSRGKENEARAMLRRIRGTDDVGPEYDDLVAASEASKAIENPWRTLLERRYRPQLVMSVLIPTLQQLTGINVVMFYAPVLFKTIGFGGTASLMSAVITGLVNMFATFVSIATVDRLGRRKLLLQGGVQMIFAQFILGTLIAVKFGTAGVANISRGYAIVVVLCICVFVSAFAWSWGPLGWLVPSEIFPLEIRSAAQSVVVVFNMAFTFIIAQIFLMMLCHLKFGLFYFFGAMELIMTGFVFFFLPETKGIPIEEMDRIWGKHWYWRRFVGAGAGGKVEITSTV

SEQ ID NO: 4712 - DNA, 1569 bp, Uromyces fabae
  CDS (1)..(1569)
atgcctgcggttatggccggcccggtctctttcgccccgccggagggtaaatctagtaaggtcgcgattgtcattgctgtatttgccgcctttggtggcttcttatatggatatgacactggttacattgccggagttaaagccatgcccttttggctacgctctgctggacagcgcggacctgatggtaaatacatgatcactacaagccaagactcaatggttactagtattctttcagttgggactttcgtgggagctcttttagcctatcctatcggtgacaggttcggacgaagaattggcataatgattgcctgtgcaattttttctgttggtgttgctctgcaaactgcctcaaccaagataccaatgttcgtcgtcggcagagtttttgctggcttaggagttggggtagcttcttgtcttgtgccaatgtatcaatcagaatgtgcaccaaaatggatacgtggagggattgtcgcgtgctaccaatgggctattaccattggtttattagttgcctcaattacggtcaacgcaacgaaagatttcgacagtgccaactcataccgcattcccattggtattcagtttatttgggctgcaatccttactatcggtttgcttgtgttacccgaatcgccgagatacttactactcaagggcagggaagacgaggcttggaaatctttaagtcgcctctacagcgctccatacgatgacccagatgtacaagcagaattctcagaaatcatggctagtttggaaaaagagagatcgttcggaaaaaccacgttactagactgcttcaaaacagacaaaagaaaaaatctccaaaggactttgacaggtttgggcgttcagggatggcaacaagcgtcgggaattaattttttcttttattacggtacaacgttcttcaaaaatgcgggaatcgaaaacgcgtttctagtgacggtcgcaactaatgtagtcaatgtggttatgactataccaggaatttgggccgtagacaaagtaggtcgcagaacgatgatgatttgtggggcagcgatgatgttcacatgtgaacttatcctggcttgcgttggtactttcactgcaactagcaacctagcctcgcagaaagttctcgtggccttctcttgtatcttcatcggtctttttgcggccacttggggcccgattccctgggttgtgacaagcgagatttatccgctcgcgacccgtggtaagcaaatggcaatgtcaaccgcctcaaattgggcagtgaattttttcattggtttcattacgccatacttggtcgattcgggtgccggtcaagccggcttgggtgttaaagtcttctggctttgggctgctttgtgctttggagccatggtgttctcattcttacttatccctgagacgaaaggactttcgctggagcaagttgacctcctttacactaattctaccgtccttaagagcaatacctacaggagccagttgatcgcaaacaacttgcacgagggtatgacacctgcagaaaaggcataccaagagaaattggaacatatttga

SEQ ID NO: 4713 - protein, 522 aa, Uromyces fabae
MPAVMAGPVSFAPPEGKSSKVAIVIAVFAAFGGFLYGYDTGYIAGVKAMPFWLRSAGQRGPDGKYMITTSQDSMVTSILSVGTFVGALLAYPIGDRFGRRIGIMIACAIFSVGVALQTASTKIPMFVVGRVFAGLGVGVASCLVPMYQSECAPKWIRGGIVACYQWAITIGLLVASITVNATKDFDSANSYRIPIGIQFIWAAILTIGLLVLPESPRYLLLKGREDEAWKSLSRLYSAPYDDPDVQAEFSEIMASLEKERSFGKTTLLDCFKTDKRKNLQRTLTGLGVQGWQQASGINFFFYYGTTFFKNAGIENAFLVTVATNVVNVVMTIPGIWAVDKVGRRTMMICGAAMMFTCELILACVGTFTATSNLASQKVLVAFSCIFIGLFAATWGPIPWVVTSEIYPLATRGKQMAMSTASNWAVNFFIGFITPYLVDSGAGQAGLGVKVFWLWAALCFGAMVFSFLLIPETKGLSLEQVDLLYTNSTVLKSNTYRSQLIANNLHEGMTPAEKAYQEKLEHI

SEQ ID NO: 4714 - DNA, 1440 bp, Zymomonas mobilis
  CDS (1)..(1440)
atgaataacaattcagaaatagaaaatgatacccaaactaacgttcgaaataccgtatcagattttattggttcacaattatatttgctcggtaccgttctggtaacggctattgctggctttctttatgggtatgacacgggtattatttcaggcgcattgatgaatattgcgcatgacttcaaactggatgcccatcaacaagaaattattactagtattctcttatttggtgccgtgatcggctctctggtctgtggtcgactgtctgcttttgttggccgccgtcatatgattatgattgtgaccgctattttcggtttcagtgtgattgccgcagacgcccccacggctttctggttaggtgcagcccgcttggttctcggcttcgccgttggcggatcatcacaaattgtgcctgtctatatcgccgaattggcaccagctgaccaacgtggtcgcatggtaaccttctataatatttcgattggtcttggtattctggcggcgggtattgtcggcgctttccttcaggaagaatggacatggcggacaatgttcagcgtcgcggctattccggcggctgttttattctgctcaatgatgatgcttcccgaaagtcctcgctggttggtgcggcaggaacgcgttgaagaagcgcgtgatatgctggataccgtccgcgaaacagatcacgaagtcaccaaagaacttcgctctatcaagaaaaatcagcaaccggacgaaggaagcggctcaagatggctggaaagcttggcacagccttgggtgcgccctgccctgatcgcaggtctaggcgtcgctgcttttacccagctttccggcattgaaatgatgatctattataccccgaccttcttgcgggattccggcttcactgaaaaaatggcctattattcggctttgggtgtcgcccttatttatgtcatcatgacaaccatcgggaaattgttggtcgatcatgtcggtcgtcgtaaattagctttatgcatgatgccgctggccgctctcagcctttttgcattgggtattgcctttaacctgccggggggtgcttcggaacatcgctggcttattcttgcctgtctgtttgcctttatggttttcaatgcgggtggtattcaggttatcggctggcttattggttcggaagtctatccgctctgtattcgcgctcgtgccaccagccttcacgctgcgactttgtggggttccaacctcattttaacgtcaactgcgttaacgatgaccagcttattgggcatcggtggttccatgtggttctatggcggtctgaatgctttgggttttgttttcgtctatttcatggtgccggaaaccaaaggccgcagtttggaagaaatcgaatccagcctgaaagatggcagcttcttaccgagtaaaaaagcctccgcctaa

SEQ ID NO: 4715 - protein, 479 aa, Zymomonas mobilis
MNNNSEIENDTQTNVRNTVSDFIGSQLYLLGTVLVTAIAGFLYGYDTGIISGALMNIAHDFKLDAHQQEIITSILLFGAVIGSLVCGRLSAFVGRRHMIMIVTAIFGFSVIAADAPTAFWLGAARLVLGFAVGGSSQIVPVYIAELAPADQRGRMVTFYNISIGLGILAAGIVGAFLQEEWTWRTMFSVAAIPAAVLFCSMMMLPESPRWLVRQERVEEARDMLDTVRETDHEVTKELRSIKKNQQPDEGSGSRWLESLAQPWVRPALIAGLGVAAFTQLSGIEMMIYYTPTFLRDSGFTEKMAYYSALGVALIYVIMTTIGKLLVDHVGRRKLALCMMPLAALSLFALGIAFNLPGGASEHRWLILACLFAFMVFNAGGIQVIGWLIGSEVYPLCIRARATSLHAATLWGSNLILTSTALTMTSLLGIGGSMWFYGGLNALGFVFVYFMVPETKGRSLEEIESSLKDGSFLPSKKASA

SEQ ID NO: 4716 - DNA, 1545 bp, Arabidopsis thaliana
  CDS (1)..(1545)
atggcaggaggggcatttatagacgagagtggccatggaggagactacgaaggtcgtgtaaccgcgtttgtcatgataacctgcattgtagctgcaatgggtggtctcctctttggttacgacattggtatctcaggaggagtgatatcaatggaggactttctaacgaaattcttccctgacgtgcttcgtcaaatgcaaaacaaaagagggcgtgaaacagaatattgtaaatatgacaatgagcttcttactctcttcacttcctctctttacctcgctgctttgttcgcttctttccttgcctccaccattacaaggctttttggccggaaggtctcaatggttatcgggtctctcgcttttctctctggagctcttctcaacggtttagctatcaacctcgagatgttgatcatcgggcggttatttctcggtgtaggtgtcggattcgctaaccaatctgttcctctttacctctctgagatggctcctgctaagatcagaggagctctcaacattggttttcaattagcaatcacgatcgggatcttagccgcgaacattgtcaattacgtgaccccaaagctccagaacgggatcggatggagattatctctcggtttagctggagttccggccgttatgatgcttgtcggatgctttttcttgccagatacgccaaactcaatccttgaacgtggaaacaaagaaaaggctaaggagatgctgcagaagatcagaggaaccatggaggttgagcatgagtttaatgaactttgcaacgcgtgtgaagccgcgaagaaagttaagcatccatggacgaacataatgcaagctcgttatcgaccgcagctcacgttttgtaccttcatcccattcttccagcagctaaccgggatcaatgtcattatgttctatgcacctgttctgtttaagaccatcggttttggaaatgacgcctctctcatatccgcagttatcaccggtcttgtcaatgtcctttccaccattgtctccatctactccgttgacaaattcggacgaagagctttgtttcttcaaggtggttttcagatgatcgtgacccagatcgcggtcgggtcgatgatcggatggaaatttggattcaacggggaaggaaatttgtcaggggttgatgcggatataatcttggcactgatatgtctctatgtggcgggtttcgcgtggtcatggggaccgttgggatggttagtgccgagtgagatatgtccattggaaattagatcagcaggacaatcgttaaacgtttcggtgaacatgttctttacattcttcattggacaattcttcttgacgatgctttgccatatgaagtttggtttgttctatttcttcgcgggtatggtcttgatcatgaccattttcatttacttcttgttgccggagacaaaaggtgttccgattgaggagatggggaaagtgtggaaagagcatagatattgggggaaatatagtaataatgatgatggtgatgatgttgatgatgatgcttatttttag

SEQ ID NO: 4717 - protein, 514 aa, Arabidopsis thaliana
MAGGAFIDESGHGGDYEGRVTAFVMITCIVAAMGGLLFGYDIGISGGVISMEDFLTKFFPDVLRQMQNKRGRETEYCKYDNELLTLFTSSLYLAALFASFLASTITRLFGRKVSMVIGSLAFLSGALLNGLAINLEMLIIGRLFLGVGVGFANQSVPLYLSEMAPAKIRGALNIGFQLAITIGILAANIVNYVTPKLQNGIGWRLSLGLAGVPAVMMLVGCFFLPDTPNSILERGNKEKAKEMLQKIRGTMEVEHEFNELCNACEAAKKVKHPWTNIMQARYRPQLTFCTFIPFFQQLTGINVIMFYAPVLFKTIGFGNDASLISAVITGLVNVLSTIVSIYSVDKFGRRALFLQGGFQMIVTQIAVGSMIGWKFGFNGEGNLSGVDADIILALICLYVAGFAWSWGPLGWLVPSEICPLEIRSAGQSLNVSVNMFFTFFIGQFFLTMLCHMKFGLFYFFAGMVLIMTIFIYFLLPETKGVPIEEMGKVWKEHRYWGKYSNNDDGDDVDDDAYF

SEQ ID NO: 4718 - DNA, 1766 bp, Apium graveolens var
  CDS (17)..(1558)
ggcacgaggagcttctatgattaccggcgaagtttccgtcgattcatatgatactaacaagcctaaacctaaaaggaataagtatgcttttgcttgtgctcttttagcttccatgaattccatcttactcggctatgacaccggagtgttgagtggagcatcaatatacataaaggaagatctccatttctccgacgttcaaatcgaaataatcatcggaatcatcaacatctactctcttcttggttcggccatagccggaaggacctcggactggataggcagacgttacaccatggtactagctggtatcatattttttctaggagccattttcatggggcttgctacaaactttgcctttctcatgtttggtcgctttgttgctggaattggtgtcggttatgccatgatgatcgctcccgtctacactgccgaggttgctccgtcgtcttcccgtggtttcctcacttcttttcctgaggttttcattaattctggtgtgttgctcgggtatgtatccaactttgcatttgccaagtgcccactttggttaggctggagaattatgctgggaattggagcatttccttcagttgccttggccataattgtgttatatatgccagagtccccacgttggctcgttatgcagggtcgacttggtgaagcgaggactgtacttgagaaaacttctacttccaaagaagaagctcaccaaagactgtctgatattaaggaagctgctgggattgataaagattgtaatgacgatgttgttcaagttccaaaacgtaccaaagacgaagcagtgtggaaagaattgattcttcaccctacaaaacctgttcgccacgctgcaattacgggtattggtattcatttcttccaacaggcttgtggtattgatgctgttgttttatacagccctcgaatttttgaaaaagctggtatcaaaagtaatagtaaaaagctccttgcgacaattgctgttggagtctgcaaaacagtctttattctgatatcaacgtttcagctggacaaaattggacgacgccccctgatgctaacaagtatggggggtatggttattgctctatttgtactggcaggctcattgacggttattaacaaatcacatcatactggtcattgggctggtggtttggcaatatttacagtgtatgcttttgtgtcgatattttcaagtggcatgggtccaattgcttgggtctatagctccgaggtgttccctttgaggctaagagctcaaggttgtagtatcggagtggcagttaaccgtggcatgagtggcataattggaatgacatttatatcgatgtacaaagccatgactattggtggtgcattccttttatttgctgtggttgcatctatcggatgggtctttatgtacacaatgttccccgagacacaaggtagaaatctcgaagaaattgagttattgtttggcagctactttggctggaggaagacattgaaggatttgaaggcaaaagaagctgctgaagcaaagagtcgcgagagtgaagtttagcagtcagatgaatttagggttcaaagatgttatattagctctgtgtagagggtagttttagagaagcccttagtatgtgttggagtatgtgtgattattaaccatcacccgataatttagaataagggtgtcaaagaacaattacccatttcttatgtggtaatctattgaaaagaatttgcccaatggtaaaaaaaaaaaaaaaaaa

SEQ ID NO: 4719 - protein, 513 aa, Apium graveolens var
MITGEVSVDSYDTNKPKPKRNKYAFACALLASMNSILLGYDTGVLSGASIYIKEDLHFSDVQIEIIIGIINIYSLLGSAIAGRTSDWIGRRYTMVLAGIIFFLGAIFMGLATNFAFLMFGRFVAGIGVGYAMMIAPVYTAEVAPSSSRGFLTSFPEVFINSGVLLGYVSNFAFAKCPLWLGWRIMLGIGAFPSVALAIIVLYMPESPRWLVMQGRLGEARTVLEKTSTSKEEAHQRLSDIKEAAGIDKDCNDDVVQVPKRTKDEAVWKELILHPTKPVRHAAITGIGIHFFQQACGIDAVVLYSPRIFEKAGIKSNSKKLLATIAVGVCKTVFILISTFQLDKIGRRPLMLTSMGGMVIALFVLAGSLTVINKSHHTGHWAGGLAIFTVYAFVSIFSSGMGPIAWVYSSEVFPLRLRAQGCSIGVAVNRGMSGIIGMTFISMYKAMTIGGAFLLFAVVASIGWVFMYTMFPETQGRNLEEIELLFGSYFGWRKTLKDLKAKEAAEAKSRESEV

SEQ ID NO: 4720 - DNA, 1458 bp, Thermoplasma acidophilum
  CDS (1)..(1458)
atggaaaatggagtcagatattccgatctcatcgaaaggctagacatgagcagggtaaccaggttttactggttgctgaccattctggccacgataggtggttttctattcggatacgatacctctaacataggctctgcactgccattgcttgaaagaatatacccaggtataagtggttttgttgagggctacttggttgctggggcctcgcttggtgccgctgtaggcgcgataatagctgcgggactaacggacaggtacgggagaaagtacctgctcatagccgatgcggctatttacgcagccggtgcattgctctcagcattcaccgtggatctggtcatgctgctgctttccaggacgctaatagggattgctgtcggcgcagactccggcatagcgacagcttatatagcggaatatgctccaaaggccaggagaggaagcctcggcattctgcagcagtggatgatcaccatcggcattctggcagcttacctaatcggaatggcaaccctgttcttcgcacccggcttggcttatgcagttggttggaggataatgctgggcgttgccgccataccagctatcataggtctcgccttcaggttcatgatgccagaatcgcctaggtggctcctcgttaatggaaaatacaaggaagcatccgcttccctgaagaggctcggcctcaacatgagcgaggaagatctgaaatctgtaaagctatcacagccccacaagatcactcctggcgtaaagcgtgctctcctcatcgtgggcctgttctttgttttccagcagatcaccggaattaacataccgttttactacggcccggttgtgctggagaaccttcacatagttggaaaatcgacatcgctcgtttacagtatatactattcaatcgccgcatccgcaatactggcgatcataaacgtggctgcaacgtatataggcttccgctacatagactccgtcggaaggagaaaactggcgctgatgggatacgctggcatgacattcttcggaatacttggtggaatactgctgtacctcaagttagacataggcctgttcatagccttcgctggcttcataatattctttgccttcggtgttggcggcaccggctggatgatacagggagaatacttcccgaccagcatgagggggctgtatgcttcccttggtgcgttcatagactggatagccaacttcgcaataatagagcttttccctgtcatggactccgccataacgataaagaatgtggagtttgttttcggcgtcctctcgctgatagcgctgatactcttctactatataatgccggagacgaaagggctgtccgtcgagcagatagacacgctttttgaaaacaacagcctcgggcagatgaagcatgcctctatatccatgaagaaggagagcgttccagcagacccgaaatga

SEQ ID NO: 4721 - protein, 485 aa, Thermoplasma acidophilum
MENGVRYSDLIERLDMSRVTRFYWLLTILATIGGFLFGYDTSNIGSALPLLERIYPGISGFVEGYLVAGASLGAAVGAIIAAGLTDRYGRKYLLIADAAIYAAGALLSAFTVDLVMLLLSRTLIGIAVGADSGIATAYIAEYAPKARRGSLGILQQWMITIGILAAYLIGMATLFFAPGLAYAVGWRIMLGVAAIPAIIGLAFRFMMPESPRWLLVNGKYKEASASLKRLGLNMSEEDLKSVKLSQPHKITPGVKRALLIVGLFFVFQQITGINIPFYYGPVVLENLHIVGKSTSLVYSIYYSIAASAILAIINVAATYIGFRYIDSVGRRKLALMGYAGMTFFGILGGILLYLKLDIGLFIAFAGFIIFFAFGVGGTGWMIQGEYFPTSMRGLYASLGAFIDWIANFAIIELFPVMDSAITIKNVEFVFGVLSLIALILFYYIMPETKGLSVEQIDTLFENNSLGQMKHASISMKKESVPADPK

SEQ ID NO: 4722 - DNA, 1413 bp, Lactobacillus casei
  CDS (1)..(1413)
atgtatcaatcaaaaacacacaatcatcgatttaccggtcaccttgcgagtgcgaagacacggttgcggctagtagcattgatttcaacgatgggtggcctgctttttggctatgacactggggtgatcaatggcgcattgccttttatttcttcggaactgaaacttgcccctggatcacagggttgggtcaccagtagcttgacgctgggtgctgcttttggtgctatcttagtcggtcgtttaagtgatcgctatgggcgcaggcggctcatcaccatgttagcgggcttattttttctggcaacggtagcctcgtcactttccccgagtgctggctggctgattggcgcacggctgatccttggattagccgttggcggcgtctctgtgctggttccaagctttttagcagagattgccccaacgagtcatcgtgggcggttagtcacacaaaatgagctgatggtcgtgactggccagttacttgcttttgttctcaatgcctttttaggaaccacttttggtaacgttcctggtatctggcgctggatgattgtattggcagtcattccggcaattatcttaggtatcgggacttattttgttccggaatctcctcgttggttaatgatgaaaggacggccggcagcagcacgttcaagtttggaagtgttgcgatctgctgctgaagtgccagcagagattgaccatttgaaacagaatcttgccgaagatgctaaacataagcaggcgagtgttcgagcattgaaaaccaaatggattcgccgactggttctgattggcatcggcctaggcgtcattcagcaaattgctggtatcaatgtcatgatgtattatggcacctcaattttacaaatgacgggttttgggcgagatagcgccttgatcgccaacattgccaatggggttactgccgttgctgcaacgattgtgacgttgcaattgttgaagcatgttccgcggcggccaatgctgattgtgggattgattggctcaaccgtggcgattactggtgtcaccttcgctagtcgactaccagcgggttcgccattccgggcatttgcgacaatcgggatgatgatgctgttcttggcgttcttccaaggcgctatcagtccaatgacttggctgctgatgtctgaaatcttccctgaacaggttcggggcatagggatgggcgctgcaaccttctgcttgtggttagctaactttggtgttggcgttctgttcccgattggtctggcccaaataggcatgttctggacattcgtttgcttcatcgggacaaatttgatttcattgcttttcgttctgatttttgtgccggaaacggctggacgctccctcgaaactttgcaccgagaggagaaagcccgcttaaatcattaa

SEQ ID NO: 4723 - protein, 470 aa, Lactobacillus casei
MYQSKTHNHRFTGHLASAKTRLRLVALISTMGGLLFGYDTGVINGALPFISSELKLAPGSQGWVTSSLTLGAAFGAILVGRLSDRYGRRRLITMLAGLFFLATVASSLSPSAGWLIGARLILGLAVGGVSVLVPSFLAEIAPTSHRGRLVTQNELMVVTGQLLAFVLNAFLGTTFGNVPGIWRWMIVLAVIPAIILGIGTYFVPESPRWLMMKGRPAAARSSLEVLRSAAEVPAEIDHLKQNLAEDAKHKQASVRALKTKWIRRLVLIGIGLGVIQQIAGINVMMYYGTSILQMTGFGRDSALIANIANGVTAVAATIVTLQLLKHVPRRPMLIVGLIGSTVAITGVTFASRLPAGSPFRAFATIGMMMLFLAFFQGAISPMTWLLMSEIFPEQVRGIGMGAATFCLWLANFGVGVLFPIGLAQIGMFWTFVCFIGTNLISLLFVLIFVPETAGRSLETLHREEKARLNH

SEQ ID NO: 4724 - DNA, 2013 bp, Mesembryanthemum crystallinum
  CDS (131)..(1876)
acctcccttcagtagttcccttagtttttctttctactccaagtctcgaaccgcccacagaataagaagacacgggtatcaacaggcgttgagggaagaagttgaatgattaatcatcaacagtgcaaagatggtagaaggtggaattgtgaaggcagataagacagagttcacagaatgtttcagaacaatcgggaaaacaccctatatcttgaggcttgccttctctgctggcattggtggtcttctttttggatatgacactggtgttatctctggcgctcttctttacattaaagaagacttcaaagaggtggaaaggaaaacatggctgcaggaaaccattgtagccatggcagttgcaggggcaattataggagcaggagtcggagggtacctaaacgataagtttgggagaaaacctgcaattataattgctgacattttgttcttcattggtgcaataattatgtcactggcccctgcaccatggatgatcatactcggaagaatcttcgttggtttaggggttggaatggcttccatgacatcacctttgtacatatcagagacttcccctactagaatccgaagtgctcttgttagtacaaatggtttgctgatcacgggaagccagttcttatcctaccttatcaacctcggtttcactagggttaaggggacgtggagatggatgcttggggtagctgcggttccagcattcgtgcagcttctcttgatgctgtccctcccagagtctcctagatggctgtatagaaagaataaagtcgtggaagctgaagcgatcttggctagaatttatcccccagaagaagtggaagaggagatgagagcacttaaggcatcaattgagtacgaaatggcagaggaaggagaaattggtggtgggagtatgttaagcaaagtaaggaaagcttggggtaacaaaatagttcgaagggggctatatgctggcattacagttcaagttgctcaacagtttgtgggtatcaacactgtcatgtattacagccccacaattgtgcaattagcaggatttgcctctaacagcactgccttggctctttctttggtcacctctggcttaaatgcaattgggtccattgttagcatgatgtttgtcgataggcatgggagaagacgacttatgatcatctctatgtttggtattattacgtgcctcattgtcttggctattggattcttccaagctgctgctcatgctccgaagatcagccatgctgaatcgacccattttggactgaactctacatgccctgcttacaccaccactcgaaaccctgcaacttggaactgtatgacatgtttgcaagctgcctcagagtgtgcattttgtaccaataaaggaaaccagctgcttcctggcggatgtgtgtcgcgaacagatgccatgaaggtggcatgccacggagagaaaagagtgtacttcacagaaggttgtcctagcaaattcgggtttttggccgtgatacttctaggggcatacattatatcctactctcctgggatgggcacagtgccatggattgtcaattcagagatttacccattaaggtacagaggagtcggaggagggattgcagccgtgtctaattggacatcaaacctaatagtgagcgaaacatttttgaccttgacggaggctctaggagctgcaggcacgttccttctgtttgccgggttctcagctatcgggctcgtgttcatctacttattggtgcctgagaccaaagggcttcccattgaagaggtggagcatatgctggaaaacggcttcaagcctagcattttcaggggtaacaaggataaggagaccaaagctagtggaacttgagtggttgtgtgatcatcttgaagaccaaagctcttatcacttctgtaagttctattttactttatttggattgaatttggtcattttggggatgattgaacttagccacttgaaagtgaaaaagtgtgaataagaga

SEQ ID NO: 4725 - protein, 581 aa, Mesembryanthemum crystallinum
MVEGGIVKADKTEFTECFRTIGKTPYILRLAFSAGIGGLLFGYDTGVISGALLYIKEDFKEVERKTWLQETIVAMAVAGAIIGAGVGGYLNDKFGRKPAIIIADILFFIGAIIMSLAPAPWMIILGRIFVGLGVGMASMTSPLYISETSPTRIRSALVSTNGLLITGSQFLSYLINLGFTRVKGTWRWMLGVAAVPAFVQLLLMLSLPESPRWLYRKNKVVEAEAILARIYPPEEVEEEMRALKASIEYEMAEEGEIGGGSMLSKVRKAWGNKIVRRGLYAGITVQVAQQFVGINTVMYYSPTIVQLAGFASNSTALALSLVTSGLNAIGSIVSMMFVDRHGRRRLMIISMFGIITCLIVLAIGFFQAAAHAPKISHAESTHFGLNSTCPAYTTTRNPATWNCMTCLQAASECAFCTNKGNQLLPGGCVSRTDAMKVACHGEKRVYFTEGCPSKFGFLAVILLGAYIISYSPGMGTVPWIVNSEIYPLRYRGVGGGIAAVSNWTSNLIVSETFLTLTEALGAAGTFLLFAGFSAIGLVFIYLLVPETKGLPIEEVEHMLENGFKPSIFRGNKDKETKASGT

SEQ ID NO: 4726 - DNA, 2422 bp, Mesembryanthemum crystallinum
  CDS (386)..(2131)
accttacccttagttccttttttttttttctttcatctttctctctctttttttctctctctaacaacccctttttgccagatcccactctgcaccagagagagatcacccacataaccaaaacacacacaagtttaagtgagagaagacgaagaagaagaacaacaacacagaagaagaaaaatacaaaaacagaacaaaataaatataaaaaagggtttttgttcttaatttcgtttactggcggcacgtattctgggcgcaaacttgttcaatcaacgtccaccatattgcttctcctttctttggagagattcggattaatagctttgaacgttgttaatttgatcctttggagaaaaagaaaaaaaaaaacacattgaagatggtggaaggtggtgtagtcaaggtagacaaaactgaatttacagaatgtttcagaactgtagggaagacaccttatatcatgagattggctttttctgcgggaatcggaggacttttatttggctatgacactggtgttatttcgggtgcccttctttacatcaaagaagacttcaaggaagtggcacagaaaacatggctacaggaaaccattgtagctatggcagtggctggagctattgtaggagcagggttgggcgggttcttaaatgacaagtttgggaggaaaccggccatgattgtggcggatattctgtttctaaccggagccataatcatgtcagttgctcctgctccttgggtgattatcatagggcgaattgtcgttggtttaggagttggcatggcgtctatgacagcgcccctgtatatatcggagacttccccagcgaagatccgaggtgcccttggtgcgaccaacggcttgctcattactggtggacagtttgtttcctacctcgtcaatcttggctttactcgggtcaagggaacgtggagatggatgcttggagtagcagctgttccagccgcgattcaagttgttttgatgctcactcttcctgagtctcctagatggctatacagacagaacaagatatcggaggcagaggagatcctaggccggatttatcctccagagcaagtcaaggaagagatggattcattgaagacatccattgaaaatgaaatggccgataggaaagcagttggcgagggcaatgcttttgtgagggcaaagagagcctgggacaataaggtggttcgaaggggtttgattgcaggtatctcagttctagtggcccagcaattcgtaggtatcaacactgtcatgtactatagccccacaatcatccaactggcaggttttgcttctaacagcactgcccttgccctttcattggtcacctctggccttaatgcggtgggatcgattgtgagcatgatgtttgtggacaggtttgggaggcgaaggctcatgatcatctctatgtttgctatcattacttgtcttgttgtcttgtccggcctcttttatggggctgcccaagctgctcccaaaatcagccagcttgaatcttctcactttggggccaactctacttgccctgcttttgcctctgcaacatctcctgatagatggaattgtatgacttgcttgaaggcttccgactgtgctttctgttccaatagtgctagtgagttccatcccggagcatgtgtggcacaaactagcacaatgaaaaatgcatgtttgggagagaagaggatctattttacagaaggatgccctagcaaatttggttttatggccattattgtacttgggctatacatcatcacctactctcctggtatggggacggttccatggatcctcaactctgaaatctatccattaagatacagaggcatatgtggaggaattggagccgtgaccctatggtgtgctaaccttatagtgagcgaaacttttctgaccttgaccgaagctttaggttcctcgggcactttccttctctatgcaggattttcgcttattgggctcatcgtcatattcttgctagtccccgagactaaaggattgccaattgaggacatcgagaaaatgttagagaagggtttttggccgagtttgtgcggtggcaacaaggacaaggacaacaaggaagaacaacaagcataataatacatactatgcctgccttatttttttcttctcgaattttggagtgaagagagggtgaggtttctaataattagctatgtttctagttagttacacacctctgaacaaattattttggtgttgttggatgttttaattttgattgctagtttttgctgctctatgtaatgggtttatattaatcttagattataatatgatgcaatagtaatttcaagaaagattgttgaaaacagctgatgccccataaaacttgtgaatgctaagagcgaacaactcttttgcttt

SEQ ID NO: 4727 - protein, 581 aa, Mesembryanthemum crystallinum
MVEGGVVKVDKTEFTECFRTVGKTPYIMRLAFSAGIGGLLFGYDTGVISGALLYIKEDFKEVAQKTWLQETIVAMAVAGAIVGAGLGGFLNDKFGRKPAMIVADILFLTGAIIMSVAPAPWVIIIGRIVVGLGVGMASMTAPLYISETSPAKIRGALGATNGLLITGGQFVSYLVNLGFTRVKGTWRWMLGVAAVPAAIQVVLMLTLPESPRWLYRQNKISEAEEILGRIYPPEQVKEEMDSLKTSIENEMADRKAVGEGNAFVRAKRAWDNKVVRRGLIAGISVLVAQQFVGINTVMYYSPTIIQLAGFASNSTALALSLVTSGLNAVGSIVSMMFVDRFGRRRLMIISMFAIITCLVVLSGLFYGAAQAAPKISQLESSHFGANSTCPAFASATSPDRWNCMTCLKASDCAFCSNSASEFHPGACVAQTSTMKNACLGEKRIYFTEGCPSKFGFMAIIVLGLYIITYSPGMGTVPWILNSEIYPLRYRGICGGIGAVTLWCANLIVSETFLTLTEALGSSGTFLLYAGFSLIGLIVIFLLVPETKGLPIEDIEKMLEKGFWPSLCGGNKDKDNKEEQQA

SEQ ID NO: 4728 - DNA, 1976 bp, Lycopersicon esculentum
  CDS (87)..(1658)
attttatttttcttatataaaaaacatatcatcttcttattgttattttaactaccacatttgaagccggaaaacttagtaacacgatggccggtggaggatttacgacctccggtaacggaggcacgcatttcgaggctaaaatcacaccaattgttatcatatcttgtattatggctgctaccggaggtctcatgtttggttatgatgttggagtttctggtggtgttacatcaatggatccatttttaaaaaaattctttccaacagtttataagagaacaaaggagccaggattagacagtaattactgtaaatacgataatcaagggttacaattatttacttcatcgttatacctagctggtttaacggcgacgttttttgcttcttacactacaagaaaacttggccggagattaactatgttaatcgccggttgttttttcattattggagttgtactaaatgctgctgctcaagatttagctatgcttattattggaagaattctccttggttgtggcgttggtttcgccaatcaggctgttccattatttttatcagaaatagcacctacaagaattcgtggaggacttaacattttgttccaacttaacgtaactattggtattctttttgccaatctcgtcaactacggaacagccaagattagtggaggatggggatggagattatcattagggttagctggatttccagcagtattgttgactttgggcgcattatttgttgttgaaaccccaaacagtttgattgaaagaggttacttagaagaaggcaaagaagtacttcgaaaaatcagaggtaccgacaacattgaacctgaattcttggaacttgttgaggctagtcgtgttgctaaacaagtcaaacaccctttcagaaatttactccaacgtaaaaatagacctcaattaatcatctctgttgccctccagatattccaacaatttacaggaatcaacgctattatgttctacgcacctgttttattttcaacactagggtttggaaacagcgcagctctttactcagctgtcatcaccggagcagtcaacgttctctccaccgttgtctcagtctactccgttgacaagctcggacgacgagtcctcctcctggaagctggggtccaaatgttactatctcaaataataatcgctataatcctaggtatcaaagttactgatcattcagacaaccttagccatggttggggaatcttcgtagtagttctgatctgtacatatgtatcggctttcgcatggtcatggggcccacttggatggttaattcctagcgagacgttccctttggaaactcgttcagctggtcaaagtgtaacagtgtgtgttaacttgcttttcacgtttgttatggcacaagcatttctctcaatgctttgtcatttcaagtatgggatattcttgttcttctcggggtggatttttgtgatgtcgttgttcgttttcttcttgttgcctgagacgaagaatgttcctattgaggagatgacggagagggtgtggaagcaacattggctgtggaagaggtttatggtggatgaagatgatgttgatatgattaaaaagaatggacatgctaacggatatgatcccacttctcggttgtaaaataaaaaataaaagaatattagcggtgttttacgttgattttatcatagtaaagatgcgtagaaataaatcaaacatgcaagagagagatcagagtctactgtctagtctagtgatatcgataagtgtttctcacaaaataggtgtgcatttggattttttttactgcttgttttcctcctttatatcgttcaatgtagtagaaattgtttagccaaagtgtaagagatgcaatatggtgataatttatgtaaccatatagcctatgtatattagagatttggtataattcattttgggaaaaaaaaaaaaaaaaaa

SEQ ID NO: 4729 - protein, 523 aa, Lycopersicon esculentum
MAGGGFTTSGNGGTHFEAKITPIVIISCIMAATGGLMFGYDVGVSGGVTSMDPFLKKFFPTVYKRTKEPGLDSNYCKYDNQGLQLFTSSLYLAGLTATFFASYTTRKLGRRLTMLIAGCFFIIGVVLNAAAQDLAMLIIGRILLGCGVGFANQAVPLFLSEIAPTRIRGGLNILFQLNVTIGILFANLVNYGTAKISGGWGWRLSLGLAGFPAVLLTLGALFVVETPNSLIERGYLEEGKEVLRKIRGTDNIEPEFLELVEASRVAKQVKHPFRNLLQRKNRPQLIISVALQIFQQFTGINAIMFYAPVLFSTLGFGNSAALYSAVITGAVNVLSTVVSVYSVDKLGRRVLLLEAGVQMLLSQIIIAIILGIKVTDHSDNLSHGWGIFVVVLICTYVSAFAWSWGPLGWLIPSETFPLETRSAGQSVTVCVNLLFTFVMAQAFLSMLCHFKYGIFLFFSGWIFVMSLFVFFLLPETKNVPIEEMTERVWKQHWLWKRFMVDEDDVDMIKKNGHANGYDPTSRL

SEQ ID NO: 4730 - DNA, 1653 bp, Pichia stipitis
  CDS (1)..(1653)
atgtcctcacaagatttaccctcgggtgctcaaaccccaatcgatggttcttccatcctcgaagataaagttgagcaaagttcgtcctcaaatagccaaagtgatttagcttccattccagcaacaggtatcaaagcctatctcttggtttgtttcttctgcatgttggttgcctttggtggcttcgtattcggtttcgataccggtacaatttccggtttccttaatatgtctgatttcctttccagatttggtcaagatggttctgaaggaaaatatttgtctgatatcagagtcggtttgattgtttccatttttaacattggttgtgcaattggtggtattttcctttctaagataggagatgtttacggtagaagaattggtatcatttcagctatggttgtatacgtcgtcggtattatcatccagatctcgtcccaagacaagtggtaccaacttacaattggacgtggagttacaggattagctgttggtactgtttcagtgttgtctccaatgttcattagtgaaagtgctccaaagcatttgagaggtactttggtatactgttaccaattatgtatcaccttaggtattttcattggttactgtgtcacttatggaaccaaagatttaaatgattcaagacaatggagagttcctttgggcttatgcttcctttgggctattttcttagttgtcggtatgttggctatgccagaatccccaagattcttaattgaaaagaagagaatcgaagaagccaagaagtcccttgcaagatccaacaagttatctccggaagatccaggtgtctacactgaacttcaattgattcaggctggtattgacagagaagctgctgcaggttctgcttcgtggatggaattgatcactggtaagccagctattttcagaagagttatcatgggaattatcttgcagtctttgcaacaattaactggtgtcaactatttcttctattacggaactacaatcttccaagctgttggtttgcaagattccttccagacttccatcatcttaggtacagtcaactttctttctacatttgttggtatttgggccattgaaagatttggaagaagacaatgtttgttagtcggttctgctggtatgttcgtttgtttcatcatttactccgttattggtacaactcatttgttcattgatggagtagtagataacgacaacacccgtcaactgtctggtaatgctatgatctttatcacttgtttgttcatcttcttctttgcctgtacatgggctggaggtgtttttaccatcatttccgaatcatatccattgagaatcagatccaaggcaatgtctattgctactgctgctaactggatgtggggcttcttgatttccttctgcactccattcattgttaatgccatcaacttcaagttcggctttgtgtttactggttgtttactcttttcgttcttctatgtctacttctttgtcagcgaaaccaaaggtttgtcgttggaagaagttgatgagttgtacgctgaaggtattgcaccatggaagtctggtgcatgggttcctccttctgcccaacaacaaatgcaaaactccacttatggtgccgaagcaaaagagcaagagcaagtttag

SEQ ID NO: 4731 - protein, 550 aa, Pichia stipitis
MSSQDLPSGAQTPIDGSSILEDKVEQSSSSNSQSDLASIPATGIKAYLLVCFFCMLVAFGGFVFGFDTGTISGFLNMSDFLSRFGQDGSEGKYLSDIRVGLIVSIFNIGCAIGGIFLSKIGDVYGRRIGIISAMVVYVVGIIIQISSQDKWYQLTIGRGVTGLAVGTVSVLSPMFISESAPKHLRGTLVYCYQLCITLGIFIGYCVTYGTKDLNDSRQWRVPLGLCFLWAIFLVVGMLAMPESPRFLIEKKRIEEAKKSLARSNKLSPEDPGVYTELQLIQAGIDREAAAGSASWMELITGKPAIFRRVIMGIILQSLQQLTGVNYFFYYGTTIFQAVGLQDSFQTSIILGTVNFLSTFVGIWAIERFGRRQCLLVGSAGMFVCFIIYSVIGTTHLFIDGVVDNDNTRQLSGNAMIFITCLFIFFFACTWAGGVFTIISESYPLRIRSKAMSIATAANWMWGFLISFCTPFIVNAINFKFGFVFTGCLLFSFFYVYFFVSETKGLSLEEVDELYAEGIAPWKSGAWVPPSAQQQMQNSTYGAEAKEQEQV

SEQ ID NO: 4732 - DNA, 2514 bp, Drosophila melanogaster
  CDS (463)..(2082)
tgcggttaaagatacaaagatactcccggcgcacaaataagatactcgcgagtggcactgcggaaacatcgatgagccaaccgatacatatccaaaaatatccatatatcttaaacgaaactcgtgtcatatcgcccagtttactggctaattagaggggcaaagaagggccaaaataatacattttttggccagcaacatgtttgattgttgatgcgcatgcgccctaaagtattccatgctacgtgggtggccgacgtgttaaaggacaaaaaacgcaagccaaaggacatttcacagacattgacgcattgctcaacattatcacatcgccaaagctaaagtgcagttccaagtgagaaaagcgggcagaagttaacggataatcgccgaagaatattgaaatacatatcccccatcgtaactgtgcaatcctaccgaagtttacataatcccttcgatatgtccaccgcatcgtcgagcaactccagcggcgaggaggccaacaaaaagtccggctccaacaacgaggagagctcccacctgctggaatccgccgaaaatggagccaagtacggctccagacagccggtcaaaatcgtcaaagccagcgataatggacgcaccagctccacaccacatgatcaggagaatctactgggcaacatggtgcacacgtctacttcgaataactcccagaagtggccacaatatgtggccgcattggccgctgctggtggcgccttcgccgccggtaccgtcctgggttggacatcgccggccgaaacggagatcgtggatcgcggcgaaggatacgatttccctgtcgacaaggatcagttttcgtgggtaggatctgccatgaccctgggtgccgcctgtgtgtgcattcccattggcttcctgatcaacatgattggccgaaagtggaccatgctgtttctggtgctgcccttcattctcggttggaccatgctcatctgggcggtcaatgtcagtatgctgtatgcctcgcgcttcatcctcggtatcgccggtggagctttctgtgtgaccgctcccatgtacacgggtgagattgctcagaaggagattcgcggaacgctgggcagcttcttccagttgatgataaccattggtatcctgttcgtctatgccgtcggagctggtgtgaaaatattctggttgagcatcatttgcggcattctgcccctcatctttggcgccatcttctttttcatgccggaatcgcccacctacttggtttccaaagatcggtcggagaacgccatcaagtccattcaatggctgcgtggcaaggaatacgattacgagccagagctggcggagctgcgtgaaaccgaccgggaaaccaaggccaacaaggtcaacgtgtgggctgctctgaaccgacccgtcacccggaaggctttggccatcagcatgggtcttatgttcttccagcaggtctgcggaatcaatgctgttattttctacgcttcgaggatctttttggaagccaacactggcatcgaggctgagtgggcaacgatcctgatcggtatcatgcaagtggtggccaccttcgtctccaccctggtagtagacaagctgggccgtcgcatcctgctgttggcctcaggaatttccatggccatttccaccaccgccatcggagtgtacttcttcctccagaaacaggacgcggcacaagtggtgagtctgggctggctcccagtggccagtctgtgcctgttcatcatcatgttctcgatcggctatggaccggtgccatggctgatgatgggagagctcttcgccaccgacatcaagggatttgctggatcgctggccggaacatccaactggcttttggcattcgtggtgaccaagacgtttgtgaacttgaacgatggcctgggaattggcggaaccttctggctattcgctggtctgactgttgtgggtgtgatattcgtttatttcgccgtgccggaaaccaagggcaagagtctcaacgagattcagcaggagctggctggcaaccggtcgactccacaagctattcccgcggaaaagtaaaggggcaatgtccacctgaggagcccgaaaggcaaatcgcgattcgcaatccggaaggcgaaagacggaccggaaatcactgttaacttgctgttaatatacgttcgatttaagttcgcgtttagtgcaagtcttttggcgttttcgatggatgaatttgtttatagaatttaatatgcgcatagattttcgtttaagcatagcaagattcagatgaagatgaagaaaattgcaggaaactataactaagagcgaagactgaaggtcaactgcagaaaagccgcgataatatttttttgcagccatagaaaagacaacagcaatttaagaaaaaacatatatacctatatatatatccatataatgtatgtatgcttatttagtgttattcattcaaccaacgaaatctgttttacaaaattttaagccata

SEQ ID NO: 4733 - protein, 539 aa, Drosophila melanogaster
MSTASSSNSSGEEANKKSGSNNEESSHLLESAENGAKYGSRQPVKIVKASDNGRTSSTPHDQENLLGNMVHTSTSNNSQKWPQYVAALAAAGGAFAAGTVLGWTSPAETEIVDRGEGYDFPVDKDQFSWVGSAMTLGAACVCIPIGFLINMIGRKWTMLFLVLPFILGWTMLIWAVNVSMLYASRFILGIAGGAFCVTAPMYTGEIAQKEIRGTLGSFFQLMITIGILFVYAVGAGVKIFWLSIICGILPLIFGAIFFFMPESPTYLVSKDRSENAIKSIQWLRGKEYDYEPELAELRETDRETKANKVNVWAALNRPVTRKALAISMGLMFFQQVCGINAVIFYASRIFLEANTGIEAEWATILIGIMQVVATFVSTLVVDKLGRRILLLASGISMAISTTAIGVYFFLQKQDAAQVVSLGWLPVASLCLFIIMFSIGYGPVPWLMMGELFATDIKGFAGSLAGTSNWLLAFVVTKTFVNLNDGLGIGGTFWLFAGLTVVGVIFVYFAVPETKGKSLNEIQQELAGNRSTPQAIPAEK

SEQ ID NO: 4734 - DNA, 2425 bp, Kluyveromyces lactis
  CDS (539)..(2194)
gaattccgagcagtgagtgagaacggtaatgttgaggattgtagtgtttttcttttattgatagaagatgctcatcgcatcgtcgtgttccgtgaaagctctccatgttagaaagtccaccgttgccagttggcaggctgtatcctccccgctcttccttggtgccggattttctttagctccttacacaatgacgctttgggacaatgtttcgttattccatcgacgatgttgccccagactaattaatcaacgggctaagaaattagcgtaactgatgtagaatgatcagagggtttttttttctttcttagttctatttacactattttccagcttgaatggtttaagatttaatccgttgtttctgatataaaagccaggtaataaaccttctaacttgcctcttcttggtgtcgattcgaaaacacttttcggttgtttgtttctgtttttttccctttcgattcaataacccaattaaaaaacgtattataacaaactataacaaacatcaactttagctaataacaacaaaatgtcattgaaaaattggcttttgctacgtgatatccaatacgagggaacgttttataaaaagttcccccatgtctacaacatttacgtcatcggtttcatagcatgtatctccggtcttatgttcggttttgatatcgcatcgatgtcttctatgattggtaccgatgtttacaaggactatttcagtaatcctgactctttgacttacggtggtattactgcttctatggcaggtggttcattcttgggttctttgatctctccaaacttttctgatgcttttggtagaaaagtctctttgcatatatgtgctgctctatggattattggtgccattctacaatgtgctgctcaagaccaagccatgttgatcgtgggtcgtgttatttctggtatgggtattggtttcggttcctctgctgcccctgtgtactgttctgaaatctccccaccaaagattagaggtaccatttctggtcttttccaattctctgttaccgttggtatcatggtcctattctacatcggttacggttgtcacttcattgatggcgctgctgcctttagaatcacttgggggttgcaaatggttccaggtttgatcttaatggtcggtgtattctttatcccggaatccccacgttggttggctaaccatgatcgttgggaagaaacttctctcatcgttgctaacatcgttgctaacggtgacgttaacaacgaacaagttcgtttccaattggaagaaattaaggaacaagtcatcatcgattctgctgccaagaacttcggttacaaagatttattcagaaagaagactttaccaaaaacaatcgttggtgtttctgctcaaatgtggcaacaactatgtggtatgaatgttatgatgtactacattgtctacattttcaacatggctggttacactggtaacactaacttggttgcctcgtccattcaatatgtgctaaatgttgttatgactatcccagcattgttcttgattgataaatttggtagaagacctgtgttgatcattggtggtatcttcatgttcacttggttgttctctgtcgctggtatcttggctacttactccgttccagccccaggcggtgtcaacggtgatgatactgttactattcaaattccaagtgaaaacacttccgctgctaacggtgtcattgcatcctcatacttgttcgtctgtttcttcgctccaacttggggtattggtatctggatttactgttctgaaattttcaacaacatggaaagagctaagggttctgccctttctgcagcaactaactgggccttcaactttgccttggctatgttcgttccatctgccttcaaaaacatttcctggaagacctacatcatctttggtgtcttctctgttgctttgactattcaaactttcttcatgttcccagaaactaaggggaaaactttagaagaaatcgaccaaatgtgggttgataatattccagcatggaggactgctaattacattccacaactacctatcgttaaagatgaagaaggtaacaagttgggcttgttgggtaacccacaacatttggaagatgttcattctaatgaaaagggtctacttgaccgttccgactcagcaagcaactccaattaaacagtgaccagctatgacaaataaataaatttttcgaactaattactagcgcatctttctctaatgacttaagaaatgaaatgaattatttcaaacaaatataacaatatcaatccataacatggttttatgctcttactatcttctgtcttttttttctttgtgtggcagacgacaaactcagtggctctacatgactataaatatagcacgaggctcacgtcaaagctt

SEQ ID NO: 4735 - protein, 551 aa, Kluyveromyces lactis
MSLKNWLLLRDIQYEGTFYKKFPHVYNIYVIGFIACISGLMFGFDIASMSSMIGTDVYKDYFSNPDSLTYGGITASMAGGSFLGSLISPNFSDAFGRKVSLHICAALWIIGAILQCAAQDQAMLIVGRVISGMGIGFGSSAAPVYCSEISPPKIRGTISGLFQFSVTVGIMVLFYIGYGCHFIDGAAAFRITWGLQMVPGLILMVGVFFIPESPRWLANHDRWEETSLIVANIVANGDVNNEQVRFQLEEIKEQVIIDSAAKNFGYKDLFRKKTLPKTIVGVSAQMWQQLCGMNVMMYYIVYIFNMAGYTGNTNLVASSIQYVLNVVMTIPALFLIDKFGRRPVLIIGGIFMFTWLFSVAGILATYSVPAPGGVNGDDTVTIQIPSENTSAANGVIASSYLFVCFFAPTWGIGIWIYCSEIFNNMERAKGSALSAATNWAFNFALAMFVPSAFKNISWKTYIIFGVFSVALTIQTFFMFPETKGKTLEEIDQMWVDNIPAWRTANYIPQLPIVKDEEGNKLGLLGNPQHLEDVHSNEKGLLDRSDSASNSN

SEQ ID NO: 4736 - DNA, 2568 bp, Saccharomyces cerevisiae; identical to SEQ ID NO: 4542
  CDS (470)..(2299)

SEQ ID NO: 4737 - protein, 609 aa, Saccharomyces cerevisiae
MKNSTAASSRWTKSRLSHFFPSYTNSSGMGAASTDQSSTQGEELHHRKHCEEDNDGQKPKKSPVSTSTMQIKSRQDEDEDDGRIVIKPVNDEDDTSVIITFNQSISPFIITLTFVASISGFMFGYDTGYISSALISINRDLDNKVLTYGEKELITAATSLGALITSVGAGTAADVFGRRPCLMFSNLMFLIGAILQITAHKFWQMAAGRLIMGFGVGIGSLISPLFISEIAPKMIRGRLTVINSLWLTGGQLIAYGCGAGLNHVKNGWRILVGLSLIPTVLQFSFFCFLPDTPRYYVMKGDLKRAKMVLKRSYVNTEDEIIDQKVEELSSLNQSIPGKNPITKFWNMVKELHTVPSNFRALIIGCGLQAIQQFTGWNSLMYFSGTIFETVGFKNSSAVSIIVSGTNFVFTLIAFFCIDKIGRRYILLIGLPGMTVALVICAIAFHFLGIKFNGADAVVASDGFSSWGIVIIVFIIVYAAFYALGIGTVPWQQSELFPQNVRGVGTSYATATNWAGSLVIASTFLTMLQNITPTGTFSFFAGVACLSTIFCYFCYPELSGLELEEVQTILKDGFNIKASKALAKKRKQQVAEGAAHHKLKFEPTQEIVES

SEQ ID NO: 4738 - DNA, 1413 bp, Brassica napus
  CDS (1)..(1413)
atgacgatgtcggagaaccaaagaaatctggaagctggtttgttactgaacaagaatcgaaacgacatcaacgagtgtcgtatcactgttgttgtgctcttcagtacctttgtatctgtttgtggctctttctgtttcggttgtgcggcaggttattcatcagttgctcaagctgggatcacaaaagacttaggcctctctgttgcacaatactccatgtttggttcaatcatgacttttggagccatgtttggtgccatcttcagtgggaaagtctcagatctcatcggtcgaaaagggacaatgtggtttgctcaaatcttctgcatcgccggttggcttgcaatagcatttgcaaaggacacggtttggctagatgctggaaggttttctactggatttgcagttggtttattcagctacgtgataccagtttatatcgcagaaataacaccaaaacacgtccgaggagcatttgtatttgctaatcagctgatgcaaagttgtgggttgtcattatactacgtcattggaaattttgttcattggcgtaatttggctttaatcggtctgattccatgtgttttgcaagttgtgactttgttcttcattccagagtcccctagattgctgggaaaatggggacttgaaaaggaatgtacagcttcattgcagcttctccgtggagaggatgctgatgtctctgaagaagccaacactatcaaagaaaccatgatcttgtttgaagaaggaccaaagtctagggttatggatttgttccagaggagatatgctccatctcttgttattggtgtggggctaatgcttctacaacaactctctggaagctcagggattatgttttatgtcggtagcgtatttgataaaggaggattcccaagcagcattggctcaatgattcttgcagtgatcatgataccaaaagctattttgggtctgattttggttgagaaaatgggacgtaggccgcttctactggcttctactagtggaatgtgtctttgcagcttgttcctcgcattttccttcagctttcggtcatatggcatgctcgatgagctcactccaatttttacatgcattggtgtagtgggtttcatctcttcatttgccgtaggcatgggaggcttaccatggatcatcatgtctgagattttcccaatgaatgttaaagtatcagctgggactctagttaccttggccaactggtcctttagttggattgtagctttcgcttacaacttcatgattgaatggaacgcatcaggaacattcttgatcttctttagtatctgcgctgggggtatagtcttcatttatgcgatggtacccgaaactaaaggaagaacactagaagatatacaagcttctcttacagattttctacaatga

SEQ ID NO: 4739 - protein, 470 aa, Brassica napus
MTMSENQRNLEAGLLLNKNRNDINECRITVVVLFSTFVSVCGSFCFGCAAGYSSVAQAGITKDLGLSVAQYSMFGSIMTFGAMFGAIFSGKVSDLIGRKGTMWFAQIFCIAGWLAIAFAKDTVWLDAGRFSTGFAVGLFSYVIPVYIAEITPKHVRGAFVFANQLMQSCGLSLYYVIGNFVHWRNLALIGLIPCVLQVVTLFFIPESPRLLGKWGLEKECTASLQLLRGEDADVSEEANTIKETMILFEEGPKSRVMDLFQRRYAPSLVIGVGLMLLQQLSGSSGIMFYVGSVFDKGGFPSSIGSMILAVIMIPKAILGLILVEKMGRRPLLLASTSGMCLCSLFLAFSFSFRSYGMLDELTPIFTCIGVVGFISSFAVGMGGLPWIIMSEIFPMNVKVSAGTLVTLANWSFSWIVAFAYNFMIEWNASGTFLIFFSICAGGIVFIYAMVPETKGRTLEDIQASLTDFLQ

SEQ ID NO: 4740 - DNA, 1599 bp, Brassica napus
  CDS (1)..(1599)
atggccggaggaggattcgcgacggcgacggcaaacggagtggagtttgaggcaaagataactccaatagttatcatctcttgcatcatggctgctaccggcggtctcatgttcggctacgacgttggtgtctccggcggagtgacatcgatgccggactttctgaagaagttttttccggtggttcaccggaaagtagaagccggagccgacaaaaacagcaactactgcaagtacgacaaccaaggactacaactcttcacatcatctctatacttagccggtctaaccgcaacgttcttcgcttcatacacgacgagaacgttaggacgaagaccaaccatgcttatagccggcgtgttcttcatcatcggtgtggttctcaacgccgcggctcaagacctagctatgctcattgcaggaaggatattacttggttgtggagttgggttcgctaatcaagctgtgcctttgttcttgtcggagattgcacctactaagatccgtggtggtcttaatattctgtttcaacttaacgtcactattggaatcctcttcgctaatcttgtcaactatggtaccgccaagatcaagggaggatggggatggagactatccttaggtttggccggagtcccggcgcttctactgacggtgggagctttgttggtgacggaaacaccgaacagtctcgtcgaaagaggtcgtcttgatgaaggaaaagccgttcttcgtcgcattcggggtactgataatgtcgagccagagtttgctgaccttcttgaagctagccgccttgctaaagaagtcaaacacccttttagaaaccttcttcaacgtaggaataggcctcagcttgtcattgccgtggctttgcagatctttcaacaatgcactggaatcaacgccatcatgttctacgctcctgttctcttcagcactttaggttttggcaatgacgctgctctctactctgcggtggtcactggtgcagtcaacgtgctctccacggtagtctcaatctactctgttgacaaagtcggtcgtcgtgttcttctccttgaagctggtgtccaaatgttcttctctcaagtcgttatcgccattatactcggcatcaaagtcacagaccactcacaaaacctctccaaagggtttgcgattctagtcgtggtgatgatctgcacctacgtagctgctttcgcctggtcttggggaccgctcgggtggctaatccctagtgagactttccctctagagacacgttctgctggacagagtgtgacggtctgcgtcaacctcctcttcactttcatcatcgcgcaggctttcctctcgatgttgtgtcatttcaagttcgggatattcatcttcttttcttcttgggtcttggtgatgtctttctttgtgatgttcctccttcctgagaccaagaacattcctatcgaggagatgactgagagagtgtggaagaagcactggttctgggctaggttcatggatgatcatcacgatgatcaagtgttcgcgagtggtcatgtaaatggtaagaagagtaacggtaaatctaacggatttgacccttcaacacggctctaa

SEQ ID NO: 4741 - protein, 532 aa, Brassica napus
MAGGGFATATANGVEFEAKITPIVIISCIMAATGGLMFGYDVGVSGGVTSMPDFLKKFFPVVHRKVEAGADKNSNYCKYDNQGLQLFTSSLYLAGLTATFFASYTTRTLGRRPTMLIAGVFFIIGVVLNAAAQDLAMLIAGRILLGCGVGFANQAVPLFLSEIAPTKIRGGLNILFQLNVTIGILFANLVNYGTAKIKGGWGWRLSLGLAGVPALLLTVGALLVTETPNSLVERGRLDEGKAVLRRIRGTDNVEPEFADLLEASRLAKEVKHPFRNLLQRRNRPQLVIAVALQIFQQCTGINAIMFYAPVLFSTLGFGNDAALYSAVVTGAVNVLSTVVSIYSVDKVGRRVLLLEAGVQMFFSQVVIAIILGIKVTDHSQNLSKGFAILVVVMICTYVAAFAWSWGPLGWLIPSETFPLETRSAGQSVTVCVNLLFTFIIAQAFLSMLCHFKFGIFIFFSSWVLVMSFFVMFLLPETKNIPIEEMTERVWKKHWFWARFMDDHHDDQVFASGHVNGKKSNGKSNGFDPSTRL

SEQ ID NO: 4742 - DNA, 1551 bp, Brassica napus
  CDS (1)..(1551)
atggctggaggagcatttgtatcagagggtagtggaggaggaagctatgaaggtggagtcactggttttgtcatcatgacatgtatcgtggccgctatgggaggtctcctcttcggttacgaccttggaatctcaggaggagtaacatcaatggaggagtttctaagcaagtttttcccggaggttgacaggcaaatgcacaatgctagacgcgagacggcttactgcaaattcgacaaccagttactccagttgttcacttcctcactctacctcgcggctctcgtctcttcctttgcagcttcagctgtcacaaggaaatacggacgcaaaatctccatgtttgttggtggtgttgctttcctcattggttctctattcaacgcatttgcaaccaacgttgcaatgctcatcatcggtagattgttgcttggagtcggtgttgggttcgctaatcagtctacaccggtttacctctcagagatggctcctgccaagatcagaggagcactcaacataggatttcaaatggctattactattggaatcttgatagcaaacctaatcaactacggaacatctcaaatggctaggaacggatggagggtgtcattaggtctagctgctgttccagcagttgtaatggtcattggatcttttgtcttgcccgacacgccaaactcaatgctcgagagaggcaagtacgaacaagcgagagagatgttgcagaagattcgtggagctgataacgtagacgaggagtttcaagatctttgcgatgcttgtgagtctgctaagaaagtggagcatccgtggaagaacatcttccaagaagctaaatacagaccagcgcttgtgttctgttctatgattcctttcttccagcagttcactggtatcaatgtgatcatgttctacgctcctgttctgttcaaaactcttggtttcgcagatgatgcctcgctcatctccgcggttattaccggtgtggtcaatgttgtctctactcttgtctccatctatgcggttgacaggtatggaagaaggctcctcttccttgaaggtggcattcaaatgatcatttgccagatcattgtcggaagcttgatcggtgcgaagtttggaaccacaggatcagggaccttgacacctgcaacagcagattgggttctagctttcatatgcatttacgttgcagggtttgcatggtcatggggtccattaggatggttagtgccaagtgagatctgtccattggaagtaagaccagcgggacaagccatcaatgtgtctgtcaacatgttcttcactttcctcattggacagttcttcctgacgatgctttgccacatgaagtttggtctcttctacttctttggaggaatggttctgatcatgaccatcttcatctacttcttgtttccggagacaaagggggttcctattgaagagatgggaagggtgtggaaggcgcatccgttctggaaacgttacgtcccagatgatgctgttattggaggaagtggagagacctatgtcaaggaggtttaa

SEQ ID NO: 4743 - protein, 516 aa, Brassica napus
MAGGAFVSEGSGGGSYEGGVTGFVIMTCIVAAMGGLLFGYDLGISGGVTSMEEFLSKFFPEVDRQMHNARRETAYCKFDNQLLQLFTSSLYLAALVSSFAASAVTRKYGRKISMFVGGVAFLIGSLFNAFATNVAMLIIGRLLLGVGVGFANQSTPVYLSEMAPAKIRGALNIGFQMAITIGILIANLINYGTSQMARNGWRVSLGLAAVPAVVMVIGSFVLPDTPNSMLERGKYEQAREMLQKIRGADNVDEEFQDLCDACESAKKVEHPWKNIFQEAKYRPALVFCSMIPFFQQFTGINVIMFYAPVLFKTLGFADDASLISAVITGVVNVVSTLVSIYAVDRYGRRLLFLEGGIQMIICQIIVGSLIGAKFGTTGSGTLTPATADWVLAFICIYVAGFAWSWGPLGWLVPSEICPLEVRPAGQAINVSVNMFFTFLIGQFFLTMLCHMKFGLFYFFGGMVLIMTIFIYFLFPETKGVPIEEMGRVWKAHPFWKRYVPDDAVIGGSGETYVKEV

SEQ ID NO: 4744 - DNA, 1527 bp, Brassica napus; identical to SEQ ID NO: 98
  CDS (1)..(1527)

SEQ ID NO: 4745 - protein, 508 aa, Brassica napus; identical to SEQ ID NO: 99

SEQ ID NO: 4746 - DNA, 1524 bp, Brassica napus
  CDS (1)..(1524)
atggaagatcaggtcatctccagcaagaatccggatcccgtcgatcagaagccgaccaatgaaaagccacccggagttaatagatacgctcttcagtgttctattgtcgcctccatcgtctccatcatctttggttacgatactggtgttatgagtggagcaatggtgtttattgaagaagatctaaagactaacgaagttcagatcgaagttctcaccggaatcctcaacctttgtgcccttttcggatcattactcgctggaagaacatcggacataatcggacgtcgttacacaatcgtcttagcttcaatactgttcatgttaggttcagtattaatgggctggggtccaaattatcccgttctcctaaccggtagatgcacagccggtctaggcgtcggttttgctctaatggttgctccggtttactcagccgagatagcaaccgcttcacatagaggactcttagcttctcttcctcatctttgcatcagtatagggattttactaggttacctagtcaattacttcttctccaagttaccaatgcatatcggttggagactgatgctcggcatagctgcgatcccctcgctagtgctagcgttagggatcttgaaaatgccggagtctccacgctggttggtcttacaaggccgtctcggagaagccaagaagatactgaagttagtatcgaactcgcctgaagaagctgagatacggtttaaagacatcaaaaccgctgctggaatcgacgcaaattgtgaagatgaagttgtgaagatggagaacaagaagactcacggtgaaggagtgtggaaagagctaatcttaagaccaacacctgccgtacgacgagttcttttgactgcgttagggattcatttcttccagcacgccacgggtatcgaagccgtgcttttatacggtccgaagatctttaagagggcagggatcacggctaaagacaagcttttcttggtcacaatcggtgtcggaatcatgaagacgacgtttatcttcatagcgactttcttgcttgacaaggtaggtcgaaggaagcttttgttgaccagcgttggaggaatggtttgtgcgttgacgatgttagggtttgggctcacgatggctcagaactctggcgggaaactagcttgggctttggtattaagcatagtttctgcttatagttttgttgcggttttctctattgggcttgggccgataacttgggtgtacagctctgaggtgttcccgttgaagcttagggcgcaaggagcgagtctcggcgttgcggtgaatagagtgatgaatgctacggtgtccatgtcgtttttgtcgctgactagggcgataacaaccggaggagctttctttatgtttgctggagttgcggcggtggcgtggaacttcttcttcttcctaatgccggagacgaaaggtaagtcgcttgaagagatcgaagcgctttttcaaagagatggtgacaataaaacaaaaggagagaacgtcaccgtttaa

SEQ ID NO: 4747 - protein, 507 aa, Brassica napus
MEDQVISSKNPDPVDQKPTNEKPPGVNRYALQCSIVASIVSIIFGYDTGVMSGAMVFIEEDLKTNEVQIEVLTGILNLCALFGSLLAGRTSDIIGRRYTIVLASILFMLGSVLMGWGPNYPVLLTGRCTAGLGVGFALMVAPVYSAEIATASHRGLLASLPHLCISIGILLGYLVNYFFSKLPMHIGWRLMLGIAAIPSLVLALGILKMPESPRWLVLQGRLGEAKKILKLVSNSPEEAEIRFKDIKTAAGIDANCEDEVVKMENKKTHGEGVWKELILRPTPAVRRVLLTALGIHFFQHATGIEAVLLYGPKIFKRAGITAKDKLFLVTIGVGIMKTTFIFIATFLLDKVGRRKLLLTSVGGMVCALTMLGFGLTMAQNSGGKLAWALVLSIVSAYSFVAVFSIGLGPITWVYSSEVFPLKLRAQGASLGVAVNRVMNATVSMSFLSLTRAITTGGAFFMFAGVAAVAWNFFFFLMPETKGKSLEEIEALFQRDGDNKTKGENVTV

SEQ ID NO: 4748 - DNA, 1569 bp, Brassica napus
  CDS (1)..(1569)
atggctggcggtggattcgtagtcggagatggccaaaagacttatcccggcaaactcactccctttgttctcttcacttgtgtcgttgctgccatgggtggtctcatcttcggatacgatatcggaatctctggtggagtgacgtcgatgccatctttcctccggcgtttcttcccgtcggtttaccgtaaacagcaagaagacgtgactacaaaccagtactgtcaatacgatagtcccacgcttacgctgttcacttcgtccctatatttagcggcgctaatttcgtcgctggtggcttccaccgtgacgaggaagttcgggcggaggctctctatgctttttggtggcatactcttttgcgccggagctctcatcaatggttttgctaagcacgtttggatgctcatcgttggtcgtatcttgctcggttttggtatcggtttcgctaatcagtctgtgccactttacctatctgaaatggctccatacaaatacagaggagcgctaaacatcggcttccagctttcaatcacaatcggaatcctcgtagccgaagtgctcaactacttctttgccaagatcaaaggaggctggggatggcgtctcagtctcggcggtgctgtggtccctgccctgatcatcacactcggctccctagtccttcctgacactcccaactcaatgatcgagcgaggcaagcacgagaaggccaaaaccaagctcagacgtatccgtggcgtcgatgacgttagccaagagttcgacgatttagtcgcagctagtaaagagtctcagtcgatagagcacccgtggacgaacctcctccgccgtaaataccggccgcatctcaccatggccattatgattccattctttcagcagctcactgggatcaatgtgattatgttttacgctcctgttttgttcaacaccattggtttcacgaccgacgcttctctcatgtccgccgtggtcactggatcggtcaacgtcgctgccacgcttgtgtcgatctacggtgttgacaagtggggacgtaggtttctctttcttgaaggcggtacacaaatgcttatatgccaggctgtggttgctgcatgcattggggccaagttcggggtagacgggacccctggtgagttaccaaagtggtatgctatagtggttgtaacgtttatatgcatctatgtggcgggtttcgcatggtcatggggtcctctagggtggttagtacctagtgagatcttccccttggagataaggtcggccgcacagagtatcacggtgtccgtgaacatgatcttcacgttcataatcgctcagatcttcttgacaatgctttgccatttgaagtttgggctgttccttgtattcgccttcttcgtgatagtgatgtcgattttcgtctacatattcttgccggagacgaaagggattccgatagaggaaatgggacaagtgtggaggtcacattggtattggtcaaggtttgtggaggatggtgagtatgggaatggacttgagatgggcaagagcagcagcaaccaagtaactaaacatgtttag

SEQ ID NO: 4749 - protein, 522 aa, Brassica napus
MAGGGFVVGDGQKTYPGKLTPFVLFTCVVAAMGGLIFGYDIGISGGVTSMPSFLRRFFPSVYRKQQEDVTTNQYCQYDSPTLTLFTSSLYLAALISSLVASTVTRKFGRRLSMLFGGILFCAGALINGFAKHVWMLIVGRILLGFGIGFANQSVPLYLSEMAPYKYRGALNIGFQLSITIGILVAEVLNYFFAKIKGGWGWRLSLGGAVVPALIITLGSLVLPDTPNSMIERGKHEKAKTKLRRIRGVDDVSQEFDDLVAASKESQSIEHPWTNLLRRKYRPHLTMAIMIPFFQQLTGINVIMFYAPVLFNTIGFTTDASLMSAVVTGSVNVAATLVSIYGVDKWGRRFLFLEGGTQMLICQAVVAACIGAKFGVDGTPGELPKWYAIVVVTFICIYVAGFAWSWGPLGWLVPSEIFPLEIRSAAQSITVSVNMIFTFIIAQIFLTMLCHLKFGLFLVFAFFVIVMSIFVYIFLPETKGIPIEEMGQVWRSHWYWSRFVEDGEYGNGLEMGKSSSNQVTKHV

SEQ ID NO: 4750 - DNA, 1596 bp, Brassica napus; identical to SEQ ID NO: 100
  CDS (1)..(1596)

SEQ ID NO: 4751 - protein, 531 aa, Brassica napus; identical to SEQ ID NO: 101

SEQ ID NO: 4752 - DNA, 1635 bp, Brassica napus; identical to SEQ ID NO: 102
  CDS (1)..(1635)

SEQ ID NO: 4753 - protein, 544 aa, Brassica napus; identical to SEQ ID NO: 103

SEQ ID NO: 4754 - DNA, 1494 bp, Brassica napus
  CDS (1)..(1494)
atggagagacaaaaaagcatggagaaagggttactgaggaagagcttaagcatacgagagaggaagttcccaaacgaagaagcttttcttgaaacaggattagcaagaaaatcccccagagaaattactaagaaagctcaaaacgacgatggtgaatgtcgtgttactgccactgttttctttagcacctttgttgccgtctctggctccttctgcaccggttgtggcgctggtttctcgtcgggtgcgcaatcagggattaccaaagatttatctctctctgttgcagagtactcaatcttcggttcgattttgacactaggcgaattgattggtgcaatattcagcggtaaagtcgccgatgtcttgggaagaaagcggacgatgttgttttgtgaagccttctgcgtcacaggctggcttgctgccgcattggctcaggatgcattgtggctggactgtggaagattgttgcttggaatcggcgttggtctatttagctacgtgatcccagtctatatagctgaaattgcaccaaaacatgtccgtggatcatttgtgttcgccaaccaactgatgcaaaattgtggcattgcacttttcttcattattggcaatttcctgccatggcgattattagcaatagtcggttttgtgccttgtgtgctccacgttttttgtttatttttcattcccgagtctccaaggtggctggcgaagaaaggtcgtgataaagaatgccgatctgctttgcaacgtcttagaggatctgacgtagacatttctcgtgaagcaaacacaattagagataccatagaaatgtccgaagttgacggtgaatctcgaatgtctgaattgtttcagagacgatatgcatatcccttacttatcggagtgggccttatgtttttgcaacaattaagcgggagctcaagtgtaacatattataccagtagcctcttcaacaaaggaggatttccaagtgctattggcacatctgtgatagcgacgatcatggttccgaaagcaatgttgggaacaattatagtcgataaaatggggaggagaacacttctaatggcttcttgtgctgcaatgggtttaagtgcactgctcttaagtgtttcctatgggttcgagtcatttggaattctcccagatctcactcccatctttacttgcatcggtgtattgggtcacattgtggcatttgcaatgggaatgggagggctaccgtggattataatggctgagatatttcccatgaatgtgaaagtgtcagctggaaccttagttaccgtgactaattggttatttggatggattatcacatatactttcaatttcatgctagagtggaatgcatcaggaatgttcttcatcttctcaatggtctccgccttttcgattgtgtttatatactttctggtaccggagactaaaggtcgatcacttgaagaaatacaagcattgttctcgaactctgtacaataa

SEQ ID NO: 4755 - protein, 497 aa, Brassica napus
MERQKSMEKGLLRKSLSIRERKFPNEEAFLETGLARKSPREITKKAQNDDGECRVTATVFFSTFVAVSGSFCTGCGAGFSSGAQSGITKDLSLSVAEYSIFGSILTLGELIGAIFSGKVADVLGRKRTMLFCEAFCVTGWLAAALAQDALWLDCGRLLLGIGVGLFSYVIPVYIAEIAPKHVRGSFVFANQLMQNCGIALFFIIGNFLPWRLLAIVGFVPCVLHVFCLFFIPESPRWLAKKGRDKECRSALQRLRGSDVDISREANTIRDTIEMSEVDGESRMSELFQRRYAYPLLIGVGLMFLQQLSGSSSVTYYTSSLFNKGGFPSAIGTSVIATIMVPKAMLGTIIVDKMGRRTLLMASCAAMGLSALLLSVSYGFESFGILPDLTPIFTCIGVLGHIVAFAMGMGGLPWIIMAEIFPMNVKVSAGTLVTVTNWLFGWIITYTFNFMLEWNASGMFFIFSMVSAFSIVFIYFLVPETKGRSLEEIQALFSNSVQ

SEQ ID NO: 4756 - DNA, 1428 bp, Brassica napus; identical to SEQ ID NO: 104
  CDS (1)..(1428)

SEQ ID NO: 4757 - protein, 475 aa, Brassica napus; identical to SEQ ID NO: 105

SEQ ID NO: 4758 - DNA, 1428 bp, Brassica napus
  CDS (1)..(1428)
atggtggcggtgaaagaagaaaaaagcttagaagaagggcttttaaagctcaagaaccaaaacgaggcttcaggatgtcgtattactgcctgtgttatcctcagcactttcgtagccatctgtggctccttctcctttggagtttctgttggttatacttcaggtgctgaggttggaatgataaaagatatgggtctctctatcgcagaattttcagcgtttggttcgttctcgacgttgggagcaacattcggtgcgctgttcagcggtaaaatggcgatcatgctaggaagaaaagggacgatgtgggtctccgatatactctgcatcaccgggtggctgtgcatcgctttcgctaaggatgtgttgtggctgaacatcggaagattctcatcagggataggactcggtttgattagctacgtggtacccgtctacgtagcagaaattacgccgaaacatgttcgcggcacatttaccttttcaaatcagcttcttcaaaactgtggactcgccatggtttatttttgtgggaatttcatcaactggaggatgatggctttactaggtgctttaccctgcttcattcaaggaatcggtttattcttcgtaccagagtccccaagatggctggcaaaagctggtacggataaagaactagaaaattcactgctccggcttagagggagagatgctgatatctcaagcgaagcctcggagattcaagttatgaccaaaatgctggaaagtgattcgaagtcgagtttcagtgatttgttgcagagaaagtatagacacactctcgtggtaggaatcgggctaatgttaatacaacaattctcaggaagtactgctgtattatgttatgcaaacaccatttttagaaaagctggtttttcggtggccattggatcgacactgttaggcatcttcgtggtaccaaaagccatgattggtctaattcttgttgataaatgggggagacggcccctgttgttgacttcagcgtctgggatgtgcttgttttgcatgtttattgggctcgccttcacattacagaaaatgcaattgcttttggaactaactccagtattcacgtttatatgcgttacgctgtatattgcatcctatgcaataggcgtgggaggcctcccttgggtaattatgtctgaggtatttccaatgaatataaaagtaacagcggggagtatagttacattggcctcatggtcaagtagttctatcgtcacttacgctttcaactttctgtttgaatggagcactcaaggaacattttacatattcggggccgtcggaggagcagcactagtttttatctggtttctcgttccggaaacgaaaggattatcacttgaagaaatacaactttcgcttattcgcgagcccaacgaaataaatcatacgtag

SEQ ID NO: 4759 - protein, 475 aa, Brassica napus
MVAVKEEKSLEEGLLKLKNQNEASGCRITACVILSTFVAICGSFSFGVSVGYTSGAEVGMIKDMGLSIAEFSAFGSFSTLGATFGALFSGKMAIMLGRKGTMWVSDILCITGWLCIAFAKDVLWLNIGRFSSGIGLGLISYVVPVYVAEITPKHVRGTFTFSNQLLQNCGLAMVYFCGNFINWRMMALLGALPCFIQGIGLFFVPESPRWLAKAGTDKELENSLLRLRGRDADISSEASEIQVMTKMLESDSKSSFSDLLQRKYRHTLVVGIGLMLIQQFSGSTAVLCYANTIFRKAGFSVAIGSTLLGIFVVPKAMIGLILVDKWGRRPLLLTSASGMCLFCMFIGLAFTLQKMQLLLELTPVFTFICVTLYIASYAIGVGGLPWVIMSEVFPMNIKVTAGSIVTLASWSSSSIVTYAFNFLFEWSTQGTFYIFGAVGGAALVFIWFLVPETKGLSLEEIQLSLIREPNEINHT

SEQ ID NO: 4760 - DNA, 1671 bp, Triticum aestivum
  CDS (13)..(1425)
cttcttgtagcgatgacaaggggtggtgatgcggcggcggaggcgagcgagcacctccttggcccgccgccggcgaggggtggcgacgggtcgtcgctggggatggtcatggccagcacaggcgtcgccgtgctcggctctttcgccttcggcgtcgcgattggctactcggcaccagctgaggccgggatcagccgggacctccagctgaccctctccgagtactctgttttcgggtcggtaataacagtcggggccatgatcggagcggtcgcgagcgggcagattgcggatgttgctggacgaaaaggggcgatgagggcttctgctctcgtttccattgtcggatggctggcaatcttctctgcacagagtgcttactcgcttgattttgggagattttgcaccggactcggcgtcggagtgttttcatacgtggtgccggttttcattgcagaaattgctccgaaggctcttcgtgggggacttacagctctgaatccattgatgataggcactggattatccatgacgtatatcgtcggcacagttgtgtcctggcggatgctggccatggctggacttgctccatgcataattctcatagttggtctcttcttcattcctgaatctcctcgatggctggcaaaggttggccggaaaaaggagtttgaaatagcactccagcgcctccgtggcagagacgcggatgtgtcccttgaagctgcagaaatcaaggacttcgtcgaaactattgacaatcttccaaagcctggaattaaggatctcttcagcaggccatacatccgtcctgtcattatcggcgccggtctaatggttttccagcagtttgcagggataaacgggatcctgttctacgccagtgaaacatttgtctcagctgggttcgattcaggaaacctaggaacaatcttgatggcgtgtatccagttaccactcacaacacttggagctctactgatggacaggagtgggagaaagccgttattactgatttccacatctggactcctcgtggggactcttatgtcagcagtatcattctaccttaaggttcacggtatattcccgaagcaagtcccaatcatcacactcaccagcatattggtctacattgcaagttattcactagggatgggttccgttccttgggtcataatgtcagagatattcccaattaatatgaaaggaatcggcgggagcttcgtgactctggtgaactggttggcttcgttagcagtttctttcgccttcaacttcctcatgagctggagtgcttcaggaacattcttcttcttcgccttcgtttgcgcaatggctattctcttcattgtgaagatcgtgccggagacaaaaggcaagaccttggaagagattcaggcttcgataaactgcggcacatgagtggcttggagaaacatggctcttgtgttcattgtgaagattcgtgccagagacaaaaggcaagacattggaagagattcaagctttgataaactgcagcacatgtgtggtttcgagaaagttagatggcatttttctttgcccgcacaattgtatacaatctgtatcgaatctgtaacgaagatgggtatcaggatagctaaaacgtgcagaagatttcaaaaaaaaaaaaaaaaaaaaaaaaaa

SEQ ID NO: 4761 - protein, 470 aa, Triticum aestivum
MTRGGDAAAEASEHLLGPPPARGGDGSSLGMVMASTGVAVLGSFAFGVAIGYSAPAEAGISRDLQLTLSEYSVFGSVITVGAMIGAVASGQIADVAGRKGAMRASALVSIVGWLAIFSAQSAYSLDFGRFCTGLGVGVFSYVVPVFIAEIAPKALRGGLTALNPLMIGTGLSMTYIVGTVVSWRMLAMAGLAPCIILIVGLFFIPESPRWLAKVGRKKEFEIALQRLRGRDADVSLEAAEIKDFVETIDNLPKPGIKDLFSRPYIRPVIIGAGLMVFQQFAGINGILFYASETFVSAGFDSGNLGTILMACIQLPLTTLGALLMDRSGRKPLLLISTSGLLVGTLMSAVSFYLKVHGIFPKQVPIITLTSILVYIASYSLGMGSVPWVIMSEIFPINMKGIGGSFVTLVNWLASLAVSFAFNFLMSWSASGTFFFFAFVCAMAILFIVKIVPETKGKTLEEIQASINCGT

SEQ ID NO: 4762 - DNA, 1999 bp, Triticum aestivum
  CDS (351)..(1838)
cttcagcaatatccttgtttgggcctgcaagaagtatcgacaatgaaagtcattgtgtgtgtgatcatggcaatgcttctcaccaattcatgcccatttgtgcgttcaaggaacatcgaagggaatgcaatgcatgtgaagaacatgcgcaaactgacttctagttctgttgatggaaggagtacccctgctggtgaggaaatacatcatgcgtgttcactagggaactacccctgccaagggatgttccacagttccaaggagaacacagaaggtggaggaaacgcgggtcttacttcagcacggcgcgctactactcctagcacggagcagagcaggacaggacattaatggcgtccaagggcgagagggatgtggagatccacgtctcctccccgccgcccgacgaccgcgacgccgctaggcccttgctgcccgccgcctgcgagccctactccgtctccgccgcaatcctccccttctttttcccagctctgggtgggcttctctatggctatgacatcggggcaacatctggtgccaccatatcgctcaagtcccccacatccagtggtacagcatggtacgacctgtcatcagtgcaaaccggcctcgtggtcagcggctcactctatggtgctttgatcggatccgccacggcattcaccattgcggattttctaggaaggcgcagagagcttgttgtttcttctatcatgtatttgattggagctcttctcaccgcagtggctcctaacttccttatcatggtggttggtcgctttttatatggcataggaattggattggctatgcacgctgctccaatgtatattgctgagactgctccaagtcagattagaggcatgctcatctctctcaaggagttctttattgttcttgggatgcttcttggttatatagtaggcaatctatttgttgaagtgatttctggttggcgctacatgtatgccaccagtgctccgatatgtgtcattatgggcatcggaatgtgctggttaccttgttcacctaggtggcttctgttatgtgccacacaaggaaaaggagatctgcgggagacaaaagaaaatgctacacgttgcttatgtcgattgaggggtcaagcgtcacctgatttggtttcggagcaggtcaatttgattctggaagaactctcatacgttggtgaagagaaaaaagcaggcttcagtgagatctttcaaggaaagtgtctcaaagcaatgataattggatgtggtttggtgttctttcagcaggtcactggtcaaccaagtgtgctatattatgctgcgacaatttttcagagtgctggattctctggagcatctgatgccactcgtgtatcaattcttcttggcttgctgaagctgattatgactggagttgccgttcttgtggttgacaaacttggcagaagaccattactaattggtggtgttagtggaattgctgtctccctattcttattgtcttcatactataccttgtttacgggtgctccttatgtggctgtaatagcacttctactgtatgttggctgctaccagttatcatttggcccgattggctggcttatgatttcggaggttttcccgctgaaactgcgtggccgtggattgagtgttgctgttcttgtgaacttcgcctccaacgcgcttgtcacttttgctttctccccactagaggacttgattggcaccggggttctctttgcttcgttcggggtgattgcggtggcgtctctcgcattcatattctgcattgtgcctgaaacaaaagggctcaccctggaagaaatcgaagccaaactgtagatccaactatctgtaatctctcatcttagttagcatcttctttactgctcttattactcagctattttgtatgtgtagtattacattgagaaaactacttatttgcctctgaataaggtatatctaaatagaaggtgtccaagtggaaaaaaaaaaaaaaa

SEQ ID NO: 4763 - protein, 495 aa, Triticum aestivum
MASKGERDVEIHVSSPPPDDRDAARPLLPAACEPYSVSAAILPFFFPALGGLLYGYDIGATSGATISLKSPTSSGTAWYDLSSVQTGLVVSGSLYGALIGSATAFTIADFLGRRRELVVSSIMYLIGALLTAVAPNFLIMVVGRFLYGIGIGLAMHAAPMYIAETAPSQIRGMLISLKEFFIVLGMLLGYIVGNLFVEVISGWRYMYATSAPICVIMGIGMCWLPCSPRWLLLCATQGKGDLRETKENATRCLCRLRGQASPDLVSEQVNLILEELSYVGEEKKAGFSEIFQGKCLKAMIIGCGLVFFQQVTGQPSVLYYAATIFQSAGFSGASDATRVSILLGLLKLIMTGVAVLVVDKLGRRPLLIGGVSGIAVSLFLLSSYYTLFTGAPYVAVIALLLYVGCYQLSFGPIGWLMISEVFPLKLRGRGLSVAVLVNFASNALVTFAFSPLEDLIGTGVLFASFGVIAVASLAFIFCIVPETKGLTLEEIEAKL

SEQ ID NO: 4764 - DNA, 2229 bp, Triticum aestivum
  CDS (347)..(1876)
gccatgcccaacctcctcccaccattgccatgcccacccgcccgcacactttcccatttcagtcgcggctccgtggcagggccgtgcttcaaatgccggtctccgctcgcttcattattcgcctgagcatgcagtaattcctccgggtcggcaccgggttcctgaaatttcgctccacttctagaattatattggcccgacgccgcctcaaggttggatttttagagtcaaacatcggaatcttggccgacacggactgggtttctttgagcaaaatcgcttgcctgctacccacccgctgagctagagattggattcgcgggggcgtttcggtggggggccgagcatgacgatcgatttgtccaccatgcccgggagctcctcctcccgtctcctggacgccgccgcggcgaggaaggacatgaacttcttcaaaaaccgctacgtgcttgggctcaccggcgtcgccggaatcggcgggttcctctttggatacgacacaggtgttatatctggagcgcttctgtatattcgggacgaatttccagctgtcaaagacaatctattcttgcaggagacaattgttagcatggcattacttggagccatgcttggagcagctgggggcggttggataaatgatgcctacggtcgtaaaaagtccactcttcttgctgacctgatgttcgcacttggttcactggttatgtgtgctgctggcggtccttacattctgatacttggaaggctctttgttggattgggtgtgggaatagcatcagtcactgccccagtttacatcgctgaagctgctccttcagaaatcaggggaggtttggtgtcaactaatgtcctcatgattactggcggccaattcttctcctacttggtcaatcttggctttaccgaggttcctgggacatggcgctggatgctcggagtagctgctgtgccagcaatcatacagtttgtgctgatgctttttctgccagaatctccccgctggctttaccggaaggatgagaaagcaaaagctattgctgtcctggagcagatatatgactctggtcgtctggaggaagaggttgagctgcttgcgtcggcttccatgcatgaattccagtctaactgtactgggagctatttggacatattcaggttgaaggaattaaggctagctttttttgctggagctggtcttcaggcctttcagcaatttactggcatcaacaccgtcatgtactacagccccacgatcgtccagatggctgggttcacttccaacaggctggccctgctactttccctcatcgttgccgccatgaatgcgagtggaaccatcgtcggaatctacctcatcgaccgttgtggccgccgccgcctggcccttacaagcctagccggggtcgtgctctcccttgtcatcctcgccacggccttcatactgcagtcatcctccagcctctgcgggagcctgttcagcggctcctgccaaggcgtgctggggtggttcgcggtcggagggctcgctctgtacatcgccttcttctctccgggcatggggccggtgccatgggccgtgaactcggagatctaccccgaggcctaccgcggcatgtgcggcggcatgtcggccaccgtcaactggatctccaacctgatcgtggcgcagacgttcctctcgatcgtggggtgggtcggcaccggcccaacattcataatcatcgccgggatagccgtgatggccttgatcttcgtcgccctctacgtgccggagaccaagggcctgagcttcgaggaggtggacctcctgtggaaagagcgggcctggggaagccagggcagccacgagagcctcctgggtgctgcgccgtaagaggtaagaccaccacctgctggctctggtcctgcacggcggtgcatcggcggcgcccttttagtatggttctgcggctgcgccccgccgcgcctggctggctcgcggcggtcgctggcttctagctaggacgggagtcttagaaagaactggatggacaatatcatacacgaatcacgaacctgtatatcaatggcggtgtgttatgttgtcgtcgcgtgttcaagtcgaatattgttgagtcaaagcgaccgtatgactgagacgcagcaatattgtttctgcattgccggcatgagtgcaccaagaaccaaagagcaagagctccgttggcggtgaaaaaaaaaaaaaaa

SEQ ID NO: 4765 - protein, 509 aa, Triticum aestivum; identical to SEQ ID NO: 107

SEQ ID NO: 4766 - DNA, 1458 bp, Zea mays; identical to SEQ ID NO: 108
  CDS (1)..(1458)

SEQ ID NO: 4767 - protein, 485 aa, Zea mays; identical to SEQ ID NO: 109

SEQ ID NO: 4768 - DNA, 1524 bp, Glycine max
  CDS (1)..(1524)
atggccggagggggattagccgtcgttgatgcaccgccctgtggcttcgacggcaagataacactctcagttgtcatcacttgcatcgttgctgcatccagtggactcattttcggatatgacatcggtgtttcaggaggtgtcacaacgatggtaccgtttcttgaaaaattcttcccatcaatactgagaaatggagctggtgcgaagaacatgtactgtgtgtatgacagccaattgttgacgttattcacgtcttctttgtaccttgctgggttagtgtcatctcttgcggctagccgagtcacggcggcgttgggtcggagaaacaccatcatgttgggtggtgtcattttttttgctggtggcgctcttaatggaggtgcggaaaatattgctatgctcattttgggtcgtatccttctgggccttggggtcggtttcactaatcaagctgcgccactatacctctctgaaatcgcaccaccaaaatggcgaggggctttcaacacaggcttccaatttttcctaggagttggagtgcttgccgccggctgcataaactacgccaccgcgaagcacccgtgggggtggcgaatctcccttggcctcgccgtggtgcccgcaaccgttatgacagttggcgcattcctcataaccgacacccccagcagcttggttgagcgcgggaaaatagaccaagccagaaacgccttgagcaaagtcagagggtccaacatcgacgttgaacccgagttggaagagctaattaattggtcgcataatgcgaaatctatggtgcaggagtccttcatgaccatatttgagagacgctatcgaccccacttggtcatggcaattgctatcccactttttcagcagcttacgggcatcaacatcgtcgcattctattcacctaacctctttcagcctgtgggtatgggacacgatgctgctttactttcaactgtaatacttggaattgtcaaccttgcttctctcatcttatccactgctgttgttgatcgctttggtcgaaggttcttgttcattactggtggcattctcatgcttttctgtcagattgcggtgtctgctttgctagctatggtgactggtgttcatggtacaaaggacatatcaaagggtaacgcaatgttggtattggtcctactgtgcttttatgatgcaggttttggttggtcatggggccctctcacctggctaattccaagtgaaattttccccttgaaaatcagaaccaccgggcaaagcatagcagttggggtgcagtttatagcactatttgcgttatcccagacatttttgacaatgctgtgccacttcaagttcggcgccttcttgttctatactgtttggattgcagtgatgactctctttattatgtttttcttgcccgagacgaaaggaattccattggagtcaatgtacaccatatggggcaaacactggttttgggggaggtttgttggaggagcagttaagcaagataatcttccatga

SEQ ID NO: 4769 - protein, 507 aa, Glycine max
MAGGGLAVVDAPPCGFDGKITLSVVITCIVAASSGLIFGYDIGVSGGVTTMVPFLEKFFPSILRNGAGAKNMYCVYDSQLLTLFTSSLYLAGLVSSLAASRVTAALGRRNTIMLGGVIFFAGGALNGGAENIAMLILGRILLGLGVGFTNQAAPLYLSEIAPPKWRGAFNTGFQFFLGVGVLAAGCINYATAKHPWGWRISLGLAVVPATVMTVGAFLITDTPSSLVERGKIDQARNALSKVRGSNIDVEPELEELINWSHNAKSMVQESFMTIFERRYRPHLVMAIAIPLFQQLTGINIVAFYSPNLFQPVGMGHDAALLSTVILGIVNLASLILSTAVVDRFGRRFLFITGGILMLFCQIAVSALLAMVTGVHGTKDISKGNAMLVLVLLCFYDAGFGWSWGPLTWLIPSEIFPLKIRTTGQSIAVGVQFIALFALSQTFLTMLCHFKFGAFLFYTVWIAVMTLFIMFFLPETKGIPLESMYTIWGKHWFWGRFVGGAVKQDNLP

SEQ ID NO: 4770 - DNA, 1620 bp, Glycine max
  CDS (1)..(1620)
atggctggtggaggagtagagattggaggaccaggaaaaagggctcatctttacgagcacaagttcagttggtatttcgtctatacatgcttcgttggggcccttggcggttctctctttggctatgatctcggtgtttcaggtggggtgacttcaatggatgatttcctgaaggaattcttcccaaaggtttacagaaggaagcagatgcatctgcatgaaacagactattgtaaatatgacgaccaagtgctgacactgtttacatcatctctttatttctcagcacttgtcatgacattctttgcttccttcttgacaagaaagaagggaagaaaggccagtatcattgtgggagcccttagcttcctggctggggctatcctcaatgccgcagccaagaacattgcaatgctaattattggcagagtccttcttggtggaggcattggatttggcaaccaagctgttccattgtatctttcggaaatggctccagctaagaaccgaggagcagtgaaccaactgtttcagttcacaacttgtgctggaatcttaattgcaaacctagtgaattactttactgaaaaaatccatccctatggatggaggatatctctgggtttggcaggtcttccagcatttgcaatgcttgttggaggtatttgttgtgctgagacaccaaacagccttgtggagcaaggaaggttggataaagcaaaacaagtattgcagagaattagaggtaccgagaacgttgaagccgaatttgaggatcttaaagaagccagtgaagaagcacaagctgttaagagcccgtttaggacactcctcaagaggaagtacaggccacaactgatcataggtgcattggggattccagcgttccagcagctaactggcaataactccatcctcttctatgcccctgtcatttttcagagcttgggctttggtgccaatgcttcactgttttcatcttttattaccaatggggctcttcttgttgccactgtcatctcaatgtttttggttgacaagtatggtagaagaaaattctttctggaagctggctttgaaatgatatgctgcatggtaactacatgtttatattcctcgagtttgatagagctaatggaattgctaattggactttttgatttattctttgctttgcagattattacaggtgcagtcttggctgtgaactttgggcacggcaaagaaattgggaaaggagtgagtgcctttctggttgttgtgatcttcttgttcgttttggcatatgggagatcttggggtccccttgggtggttggttcccagtgagctcttcccattagagataagatcatctgcacagagtattgtggtctgtgtcaacatgatcttcactgcacttgttgctcaattgttcctcatgtcactttgccacctcaaatttgggatcttcttgctctttgcttccttaattatcttcatgagcttctttgtcttcttccttttgcccgaaaccaagaaagttccaattgaggagatttatcttctttttgagaatcattggttctggaggagatttgtaactgaccaagacccagagacatcaaaggggactgcttaa

SEQ ID NO: 4771 - protein, 539 aa, Glycine max
MAGGGVEIGGPGKRAHLYEHKFSWYFVYTCFVGALGGSLFGYDLGVSGGVTSMDDFLKEFFPKVYRRKQMHLHETDYCKYDDQVLTLFTSSLYFSALVMTFFASFLTRKKGRKASIIVGALSFLAGAILNAAAKNIAMLIIGRVLLGGGIGFGNQAVPLYLSEMAPAKNRGAVNQLFQFTTCAGILIANLVNYFTEKIHPYGWRISLGLAGLPAFAMLVGGICCAETPNSLVEQGRLDKAKQVLQRIRGTENVEAEFEDLKEASEEAQAVKSPFRTLLKRKYRPQLIIGALGIPAFQQLTGNNSILFYAPVIFQSLGFGANASLFSSFITNGALLVATVISMFLVDKYGRRKFFLEAGFEMICCMVTTCLYSSSLIELMELLIGLFDLFFALQIITGAVLAVNFGHGKEIGKGVSAFLVVVIFLFVLAYGRSWGPLGWLVPSELFPLEIRSSAQSIVVCVNMIFTALVAQLFLMSLCHLKFGIFLLFASLIIFMSFFVFFLLPETKKVPIEEIYLLFENHWFWRRFVTDQDPETSKGTA

SEQ ID NO: 4772 - DNA, 1524 bp, Glycine max; identical to SEQ ID NO: 110
  CDS (1)..(1524)

SEQ ID NO: 4773 - protein, 507 aa, Glycine max; identical to SEQ ID NO: 111

SEQ ID NO: 4774 - DNA, 1452 bp, Glycine max; identical to SEQ ID NO: 114
  CDS (1)..(1452)

SEQ ID NO: 4775 - protein, 483 aa, Glycine max; identical to SEQ ID NO: 115

SEQ ID NO: 4776 - DNA, 1509 bp, Zea mays
  CDS (1)..(1509)
atggcgaggagcaggacgtcgggcggcggcgagtacgagagcggcagcgaccacgacggctcgctgcagaagccgctgctgcccaacagcgggagctggtaccggatggggatggggtcgcgccagtccagcctcaacgccgccggcacctcctccatggccgtcctgcgcgagtcccacgtctccgccttcctctgcacgctcatcgtcgcgctcggccccatccagttcggcttcaccggcggctactcctccccgacgcaggccagcatcatccgggacctcaacctctccatctccgagttctcggtgttcggctcgctgtccaacgtgggcgccatggtcggggcgatcgccagcggccagatggccgagtacgttggccgcaaagggtcgttgatgattgcagcaattccaaacgtcattggttggcttgcgatctcctttgcaaaagactcttcatttctgtatatgggacgcttgcttgaaggattcggtgtcggtatcatttcctatgtggtaccggtatacatagcagagatatctccacaaaacatgagaggggctcttggctctgtgaaccagttatctgtaacccttggtatcatgtttgcctatttgctcggcttgtttgttccttggaggcttcttgcagtaataggaaccttgccctgcatagtgttgatacctggccttttcttcattccggaatctccaagatggctggcaaagatgaatatgatggatgattgcgagacttctctacaagttctgagaggattcgatgctgacatcactgcagaattgaatgatataaagagagcagtaatgtcagcaaacaaaagggctacaattcgtttccaagagttgaaccaaaagaaataccgaacgcccctaattataggaattggtctacttgtgctgcaacagctaagtggaataaatggtatactattttatgcaagtagcatcttcaaagctgccggtctgaaggacagtgacttggacacctttgcacttggagctattcaggttcttgccacttttgttacaaccatgttcttggacagagctgggcggcgaatcctccttattatttcttctgctgggatgactctaagtcttcttgtagttgctattgtattttacatcaaggataatatttcacatgactctgacttgtatgacatcttaagtatggtgtccttggttggtgtcgtggcttatgtcattgctttctccttcggtatgggtgccattccttggatcataatgtctgagatcctcccagttagcatcaagagtcttgcaggaagcttcgcgacccttgccaactggttgacatcctttggaataacaatgacggcaaatttgctgatcagctggagtgctggaggtacgtttacctcctacatgattgtgagtgccttcactctcgtgttcgtaatcgtttgggtgccagagacaaagggaagaaccctcgaagagatacaatggtcgttccgctga

SEQ ID NO: 4777 - protein, 502 aa, Zea mays
MARSRTSGGGEYESGSDHDGSLQKPLLPNSGSWYRMGMGSRQSSLNAAGTSSMAVLRESHVSAFLCTLIVALGPIQFGFTGGYSSPTQASIIRDLNLSISEFSVFGSLSNVGAMVGAIASGQMAEYVGRKGSLMIAAIPNVIGWLAISFAKDSSFLYMGRLLEGFGVGIISYVVPVYIAEISPQNMRGALGSVNQLSVTLGIMFAYLLGLFVPWRLLAVIGTLPCIVLIPGLFFIPESPRWLAKMNMMDDCETSLQVLRGFDADITAELNDIKRAVMSANKRATIRFQELNQKKYRTPLIIGIGLLVLQQLSGINGILFYASSIFKAAGLKDSDLDTFALGAIQVLATFVTTMFLDRAGRRILLIISSAGMTLSLLVVAIVFYIKDNISHDSDLYDILSMVSLVGVVAYVIAFSFGMGAIPWIIMSEILPVSIKSLAGSFATLANWLTSFGITMTANLLISWSAGGTFTSYMIVSAFTLVFVIVWVPETKGRTLEEIQWSFR

SEQ ID NO: 4778 - DNA, 1620 bp, Zea mays; identical to SEQ ID NO: 116
  CDS (1)..(1620)

SEQ ID NO: 4779 - protein, 539 aa, Zea mays; identical to SEQ ID NO: 117

SEQ ID NO: 4780 - DNA, 1969 bp, Hordeum vulgare
  CDS (240)..(1727)
ccggcgtggacgacgacgtgactcctccagctccaaggcctcccgcctggttatggttacggtttaggtcctcgtgtacagagcacaacctcgtgctgccgccatcggtttggttcggcgggccttgggcaccaacccctcttcctccccgccccgggtcttcctttcctcagcacagcgcacctgctagctaactgctcccacccacgagtagcacggaaccgagcagcgcgacattgatggcgtccaagggcgagagggatgtggagatccacgtctcctccccggcgcccgacgaccgcgacgccgccaggcccttgctgcccgccgcctgcgaggcctactccgtctccgccgcaatcctacccttcttcttcccagctctgggtgggcttctctatggctatgacatcggggcaacatctggtgccaccatatcgctcaagtcctccacatccagtggtacaacatggtacgacctgtcatcagtgcaaactggcctcgtggtcagcggctcactctacggtgctttgatcggatccgccacggcattcaccgttgcggattttctaggaaggcgcagagagcttgttgtttcttctatcatgtatttggttggggctcttctcacagcagtggcccctaacttccttatcatggtggttggtcgctttttatatggcataggaattggattggcaatgcatgctgctccaatgtatattgctgagactgctccaagtcagattagaggcatgctcatttctctcaaggagttctttattgttcttgggatgcttcttggttatatagtgggcaatctctttgttgaagtgatttctggttggcgctacatgtatgccgccagtgctccgatatgcgtcattatgggcatcggaatgtgctggttaccttgttcacctaggtggcttctgttatgtgccacacaaggaaaaggagatctgcgggagacaaaagaaaatgctacacgttgcttatgtcgattgaggggtcaagcgtcacctgatttggtttcggagcaggttaatttgattctggaagaactctcatacgttggtgaagagaaaaaagcaggcttcagtgagatctttcaaggaaagtgtctcaaagcaatgataattggatgtggcttggtgttctttcagcaggtcactggccaaccaagtgtgctatattatgctgcgacaatttttcagagtgctggattctctggagcatctgatgccactcgtgtatcaattcttcttggcttgctgaagctgattatgactggagttgcggttcttgtggttgacaaacttggtagaagaccattactaattggtggtgttagtggaattgctgtctccctattcttattgtcttcatactataccttgtttacgggtgctccttatgtggctgtaatagcacttctactgtatgttggctgctaccagttatcatttggtcctattggctggcttatgatttcggaggttttcccgctgaaactgcgtggccgtggattgagtgttgctgtccttgtgaacttcgcctccaatgcgcttgtcacttttgctttctcccctctagaggacttgattggcactggggttctctttgcttcgttcggggtgattgcggtggcgtctctcgcattcatattttgcattgtgcccgaaacaaaagggctcaccctggaagaaatcgaagccaaactgtagatccaactatctgtagtctcgtcttagttagcatcttctttactgctcttattggtcaggtattttgtaagcgtagtattacattgagaaaactacttatttgcctctgaataaggtatatctgaatagaaggtgtccaggtgggaaagtcttcatgagtgaaaaaacattcgaagggcagaatctgtgaaatgtagaaaattatgtctcagtggaaaaaaaatggcaaaaaaaaaaaaaaa

SEQ ID NO: 4781 - protein, 495 aa, Hordeum vulgare
MASKGERDVEIHVSSPAPDDRDAARPLLPAACEAYSVSAAILPFFFPALGGLLYGYDIGATSGATISLKSSTSSGTTWYDLSSVQTGLVVSGSLYGALIGSATAFTVADFLGRRRELVVSSIMYLVGALLTAVAPNFLIMVVGRFLYGIGIGLAMHAAPMYIAETAPSQIRGMLISLKEFFIVLGMLLGYIVGNLFVEVISGWRYMYAASAPICVIMGIGMCWLPCSPRWLLLCATQGKGDLRETKENATRCLCRLRGQASPDLVSEQVNLILEELSYVGEEKKAGFSEIFQGKCLKAMIIGCGLVFFQQVTGQPSVLYYAATIFQSAGFSGASDATRVSILLGLLKLIMTGVAVLVVDKLGRRPLLIGGVSGIAVSLFLLSSYYTLFTGAPYVAVIALLLYVGCYQLSFGPIGWLMISEVFPLKLRGRGLSVAVLVNFASNALVTFAFSPLEDLIGTGVLFASFGVIAVASLAFIFCIVPETKGLTLEEIEAKL

SEQ ID NO: 4782 - DNA, 2383 bp, Glycine max
  CDS (421)..(1887)
  misc_feature (2377)..(2377): n is a, g, c or t
  misc_feature (2378)..(2378): n is a, g, c or t
  misc_feature (2379)..(2379): n is a, g, c or t
  misc_feature (2380)..(2380): n is a, g, c or t
  misc_feature (2381)..(2381): n is a, g, c or t
  misc_feature (2382)..(2382): n is a, g, c or t
ggtacttccctggccaggtttttagttttaggtttgttaccagttgcagcactcaaccgtcaattattgagctcggtcgctggaaaaatccaaaacaacagtgtcagtgaggtcaccacttcactcaccgccccaacaccacacgctagatattttaagtttaattttaaaaactccaaacccgtccgcccacacgtccacaaaccaatcagccaacgcctccgaccacgcgaccgaacacacaaaagaaaagaagcacagaaacgtgacccttccaatctcgcaacgcaagcgacaacaatcgtcacagctcagcacagcaaaaccaaaactcccctgtgcgacatttttacaaacaccttctgcctacaaataaaagatatttcagttttcatgtcctcgtagtggttgggtttgagtatgtgtgtgagaatggaagagagtggcgatgcgagggatcttcagaaaccgttcctccacacagggagttggtacaagatgggttccaggcagtccagcatcatgggatcctccactcaggttatccgcgacggcgccgtttccgtcctcttctgcgtcctcatcgtcgccttgggtcccattcaattcggcttcacgtgtgggtattcttctccaacccaaggggctatagttcgcgatctaaacctctctatttcggagttttctttctttggatctttgtctaatgtgggagcaatggtgggagctatagctagtggtcagatagctgaatacatcgggcgcaaagggtcattgatgattgctgcgatccccaatataatagggtggcttgctatttcttttgccaaagattcctcatttttgtatatggggaggttgttggaaggttttggcgttgggattatctcttatgtggtgcctgtttatatagctgagattgcacctcaaaacttgagaggtggccttggatcagtgaaccagctctctgttacaattggcattatgctggcttatctgttgggtctttttgtcaactggagagtccttgcaattctaggaattttgccttgtacagtattaatacctggattatttttcatacctgaatcccccagatggttggccaagatggggatgatagatgagtttgagacttctttgcaagtgttacgaggatttgacactgatatatctgttgaagtacatgaaattaagagatctgtggcttcaacgggaaaaagagctgcaatccgatttgcagatctcaagaggaaaagatattggttcccgttaatggttggtattggattacttgttcttcagcaattatctggtatcaatggaattttgttctattcaactaccatctttgcaaatgcaggaatttcatccagcgaagctgctacagttggacttggagccgttcaggtcatagcaactggaatttccacatggttggtggacaaaagtggccggaggctgcttctaataatatcctcatctgtaatgacagttagccttctcattgtttctatagcattttatctggagggggttgtatcagaggattcacatttattcagcattttgggaatagtttctattgttggactcgtggctatggtgattgggttctctctaggtctgggacccatcccttggcttataatgtctgagatacttccagtgaatataaagggccttgctggcagcatagcgacaatgggaaattggctgatttcgtgggggatcacgatgactgctaacttgcttttgaattggagcagtggagggacatttacaatctacacagtcgtagctgcctttactatagcttttatagcaatgtgggttcctgagaccaagggaagaacattggaagaaattcagttttccttcagatagatatatgttttgggagagcacagaggtagtctattatgtttaaatttattatgtttaaatttaaatgacgagtccacctgtatcatgtatttttgtagtccattgtatttttattgtgtatcaaattttctgtaacaaatgaaaggagaagaatcagtgcatcgtgttttttcactgtacaagctattggtacaaagacaataaaacaaatatagtagcaaaaaaatgagaaagataaagaacaaaaaacttctagtcatagtgtagctgttaaagtcgagtttatttctattacgaattgtattctgtcatggcatagggaagaagaaactactagtgacatctattgtaaacgtggtcaccaagtaaaccagtgacttggttactcaccttgatgacttgaattattgcataatattctggttgctttcctggttttggctgattctcttattgtcgggtaatcaaattaagaaataaaatgattatnnnnnnc

SEQ ID NO: 4783 - protein, 488 aa, Glycine max
MCVRMEESGDARDLQKPFLHTGSWYKMGSRQSSIMGSSTQVIRDGAVSVLFCVLIVALGPIQFGFTCGYSSPTQGAIVRDLNLSISEFSFFGSLSNVGAMVGAIASGQIAEYIGRKGSLMIAAIPNIIGWLAISFAKDSSFLYMGRLLEGFGVGIISYVVPVYIAEIAPQNLRGGLGSVNQLSVTIGIMLAYLLGLFVNWRVLAILGILPCTVLIPGLFFIPESPRWLAKMGMIDEFETSLQVLRGFDTDISVEVHEIKRSVASTGKRAAIRFADLKRKRYWFPLMVGIGLLVLQQLSGINGILFYSTTIFANAGISSSEAATVGLGAVQVIATGISTWLVDKSGRRLLLIISSSVMTVSLLIVSIAFYLEGVVSEDSHLFSILGIVSIVGLVAMVIGFSLGLGPIPWLIMSEILPVNIKGLAGSIATMGNWLISWGITMTANLLLNWSSGGTFTIYTVVAAFTIAFIAMWVPETKGRTLEEIQFSFR

SEQ ID NO: 4784 - DNA, 2470 bp, Zea mays
  CDS (402)..(1922)
  misc_feature (10)..(10): n is a, g, c or t
  misc_feature (22)..(22): n is a, g, c or t
  misc_feature (24)..(24): n is a, g, c or t
  misc_feature (25)..(25): n is a, g, c or t
gtaccctcgnagggccggccgnannaaaaaaaatttccaaaaaaaaaaaaaaaaaaaaaaaaaaaaaaaaaaaaaaaaaaaaaaaaaaaaaaaaaaaaaaaaaacctgggcaatcaaactgcggtggccaaccccggaagcggcggcgggcaaagcgcgcgacgcagagaagcgtaacttcaggccgccggtcgctctacgcatcctgctccccgttctcgtcggagatccaccggggcagcctttctttccccttcctcaatcaagtcgatccaatttcgcgcgcgggtcgggctcgccttctcctccagtctccacctccaccagcgctcgaggtcgacggacgctactcgcagcagttcttctttgcggtgcggccgagaagaagctaaggctcaggcatgagcttccgggaccaggagagtggcggggaggatgggggcaggacgtcctccgcctccgacctgcggaagccgctcatcaacaccgggagctggtaccgcatgccgccggcgggtggcgtgatgggctcgcggcaatctagcctcatggagcgattgggctcctctgcgttctctctccgcgacgtcgctatctcggccacgctctgcacgctcattgtcgcgctaggtcccatccagttcggtttcacatgcggctactcctcgcccacgcaggacgccatcattgctgatctcggcctctccctctctgagttctccctcttcggttcattatctaatgtaggggcgatggtaggcgccatctccagtgggcaacttgcagagtatatcggccgcaaggggtctctcatgatcgctgcgattccaaacataattgggtggctcgcgatatcattcgcaaaagattcctctttcttgtttatgggtcggctgctagaaggatttggagtcggtgtaatatcgtatacagtaccggtttatattgcagaaatcgctcctcaggatcagaggggagctcttggttctgtcaatcagctctccgtcacgattggtatattgcttgcctacttgtttggcatgtttgttccctggagaattcttgctgttctaggcattttaccttgttcaatcctgattcctggactgttctttgtgcctgaatccccaaggtggttggcaaaaatggggaagatggaggattttgaatattcattgcaagttctgagaggatttcagacagatatcacagcagaagtaaatgaaataaagagatcattagcatcatcgaggaggaggacaaccataaggttcgctgatatcaaacagaagagatacagtgttccccttgtgataggaatcggtctccttgtcctgcagcagctaagtggtgtcaatggcattctattttatgctgcgagcatcttcaaagctgctggtattacaaacagtaatctagcaacatttggtttaggggctgttcaggtgattgctactggagtgacaacctggttgactgacaaagctggtcgaaggcttcttctcattatttccaccacaggaatggtcattactcttgttattgtttctgtgtcattttttgtgaaggacaacatagctgctggttcgcacttatactctgtaatgagtatgctttcactggctggacttgtggcatttgtgattgcattttctcttggcttgggagcgattccgtggatcattatgtctgagatccttcctgttaacatcaagagccttgctggaagtgttgcgaccctggcgaactggctgacagcatgggccattacaatgacggcaagcctgatgttgaactggagcagtggaggaacatttgctatctacgccgtcgtgtctaccatggccctcattttcgtgtgcttgtgggtgcctgagaccaagggaagaacgctagaggaaatcgccttctcattccgctgacacgtcgtcatgatctaggtatgggaagccacaccacaccatgtgtcattgagtcatgccgcggtgcgttcagttcatgaatcccgcagggatcttgcagccattctcttgcttggatgtaccaccatcttcagtgttcataccaatgtacattgtacaatatgacgacgacgccatagcagaaaggcaagtgggtttatgtttgtacgatggactagtagcagaaagcactcaacccctgtacgggttgcggaggagagcaatttatttgctgtatttgcctggttcaataccggacacaagttagaattttgaaaaataaaaatctgagcaaatttgaaatcatgtcctagcttgtttctgtgtgaaattggtatccgctcccaattccacacaacataccatcccggaaacataaagtgtaaagccctggggtgccttattgagcgaacctacctaacccttaatgtggttggggctcactggcccgctttccacttcggggaacccggtctgggccacttgaattaatgaaatcggccacgccg

SEQ ID NO: 4785 - protein, 506 aa, Zea mays
MSFRDQESGGEDGGRTSSASDLRKPLINTGSWYRMPPAGGVMGSRQSSLMERLGSSAFSLRDVAISATLCTLIVALGPIQFGFTCGYSSPTQDAIIADLGLSLSEFSLFGSLSNVGAMVGAISSGQLAEYIGRKGSLMIAAIPNIIGWLAISFAKDSSFLFMGRLLEGFGVGVISYTVPVYIAEIAPQDQRGALGSVNQLSVTIGILLAYLFGMFVPWRILAVLGILPCSILIPGLFFVPESPRWLAKMGKMEDFEYSLQVLRGFQTDITAEVNEIKRSLASSRRRTTIRFADIKQKRYSVPLVIGIGLLVLQQLSGVNGILFYAASIFKAAGITNSNLATFGLGAVQVIATGVTTWLTDKAGRRLLLIISTTGMVITLVIVSVSFFVKDNIAAGSHLYSVMSMLSLAGLVAFVIAFSLGLGAIPWIIMSEILPVNIKSLAGSVATLANWLTAWAITMTASLMLNWSSGGTFAIYAVVSTMALIFVCLWVPETKGRTLEEIAFSFR

SEQ ID NO: 4786 - DNA, 25 bp, Artificial sequence
  primer
atgggaatacacataccatatctca

SEQ ID NO: 4787 - DNA, 26 bp, Artificial sequence
  primer
ctatatatcctctataatctcttgag

SEQ ID NO: 4788 - protein, 671 aa, Artificial sequence
  consensus sequence
  Variant (2)..(3): Xaa in position 2 to 3 is any amino acid
  Variant (6)..(6): Xaa in position 6 is any amino acid
  Variant (7)..(27): Xaa in position 7 to 27 is any or no amino acid
  Variant (29)..(29): Xaa in position 29 is any amino acid
  Variant (31)..(54): Xaa in position 31 to 54 is any amino acid
  Variant (55)..(75): Xaa in position 55 to 75 is any or no amino acid
  Variant (77)..(96): Xaa in position 77 to 96 is any amino acid
  Variant (99)..(111): Xaa in position 99 to 111 is any amino acid
  Variant (113)..(127): Xaa in position 113 to 127 is any amino acid
  Variant (128)..(139): Xaa in position 128 to 139 is any or no amino acid
  Variant (142)..(144): Xaa in position 142 to 144 is any amino acid
  Variant (146)..(146): Xaa in position 146 is any amino acid
  Variant (148)..(148): Xaa in position 148 is any amino acid
  Variant (150)..(155): Xaa in position 150 to 155 is any amino acid
  Variant (157)..(160): Xaa in position 157 to 160 is any amino acid
  Variant (162)..(163): Xaa in position 162 to 163 is any amino acid
  Variant (165)..(167): Xaa in position 165 to 167 is any amino acid
  Variant (170)..(181): Xaa in position 170 to 181 is any amino acid
  Variant (183)..(194): Xaa in position 183 to 194 is any amino acid
  Variant (195)..(210): Xaa in position 195 to 210 is any or no amino acid
  Variant (213)..(231): Xaa in position 213 to 231 is any amino acid
  Variant (232)..(233): Xaa in position 232 to 233 is any or no amino acid
  Variant (235)..(236): Xaa in position 235 to 236 is any amino acid
  Variant (239)..(239): Xaa in position 239 is any amino acid
  Variant (241)..(248): Xaa in position 241 to 248 is any amino acid
  Variant (249)..(257): Xaa in position 249 to 257 is any or no amino acid
  Variant (259)..(261): Xaa in position 259 to 261 is any amino acid
  Variant (263)..(292): Xaa in position 263 to 292 is any amino acid
  Variant (293)..(382): Xaa in position 293 to 382 is any or no amino acid
  Variant (385)..(386): Xaa in position 385 to 386 is any amino acid
  Variant (388)..(388): Xaa in position 388 is any amino acid
  Variant (390)..(393): Xaa in position 390 to 393 is any amino acid
  Variant (395)..(401): Xaa in position 395 to 401 is any amino acid
  Variant (402)..(402): Xaa in position 402 is any or no amino acid
  Variant (404)..(428): Xaa in position 404 to 428 is any amino acid
  Variant (429)..(440): Xaa in position 429 to 440 is any or no amino acid
  Variant (442)..(442): Xaa in position 442 is any amino acid
  Variant (443)..(443): Xaa in position 443 is any or no amino acid
  Variant (447)..(490): Xaa in position 447 to 490 is any amino acid
  Variant (491)..(586): Xaa in position 491 to 586 is any or no amino acid
  Variant (588)..(590): Xaa in position 588 to 590 is any amino acid
  Variant (592)..(595): Xaa in position 592 to 595 is any amino acid
  Variant (597)..(601): Xaa in position 597 to 601 is any amino acid
  Variant (602)..(602): Xaa in position 602 is any or no amino acid
  Variant (604)..(655): Xaa in position 604 to 655 is any amino acid
  Variant (656)..(662): Xaa in position 656 to 662 is any or no amino acid
  Variant (666)..(666): Xaa in position 666 is any amino acid
  Variant (668)..(670): Xaa in position 668 to 670 is any amino acid
GXXFGXXXXXXXXXXXXXXXXXXXXXXDXGXXXXXXXXXXXXXXXXXXXXXXXXXXXXXXXXXXXXXXXXXXXXXSXXXXXXXXXXXXXXXXXXXXGRXXXXXXXXXXXXXGXXXXXXXXXXXXXXXXXXXXXXXXXXXGRXXXGXGXGXXXXXXPXXXXEXXPXXXRGXXXXXXXXXXXXGXXXXXXXXXXXXXXXXXXXXXXXXXXXXWRXXXXXXXXXXXXXXXXXXXXXPXXPRXLXXXXXXXXXXXXXXXXXAXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXQQXXGXNXXXXYXXXXXXXXGXXXXXXXXXXXXXXXXXXXXXXXXXXXXXXXXXXXXXDXXGRRXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXXXWXXXXEXXXXXXRXXXXXXXXXXXXXXXXXXXXXXXXXXXXXXXXXXXXXXXXXXXXXXXXXXXXXXXXXXXPETXGXXXE

SEQ ID NO: 4789 - protein, 45 aa, Artificial sequence
  protein pattern
  Variant (2)..(3): Xaa in position 2 to 3 is any or no amino acid
  Variant (5)..(7): Xaa in position 5 to 7 is any amino acid
  Variant (9)..(9): Xaa in position 9 is any amino acid
  Variant (10)..(10): Xaa in position 10 is Ala, Gly or Asn
  Variant (11)..(11): Xaa in position 11 is any amino acid
  Variant (13)..(18): Xaa in position 13 to 18 is any amino acid
  Variant (20)..(23): Xaa in position 20 to 23 is any amino acid
  Variant (25)..(25): Xaa in position 25 is any amino acid
  Variant (26)..(26): Xaa in position 26 is Ala, Cys, Ser or Thr
  Variant (28)..(30): Xaa in position 28 to 30 is any amino acid
  Variant (32)..(32): Xaa in position 32 is Ala or Gly
  Variant (33)..(42): Xaa in position 33 to 42 is any amino acid
  Variant (43)..(43): Xaa in position 43 is Cys, Gly, Asn, Ser, Thr or Val
  Variant (44)..(44): Xaa in position 44 is any amino acid
GXXRXXXGXXXGXXXXXXPXXXXEXXPXXXRXXXXXXXXXXXXXG

SEQ ID NO: 4790 - DNA, 591 bp, Saccharomyces cerevisiae
  CDS (1)..(591)
atgagcaaaatacaggtggcacatagcagccgactagccaaccttattgattataagctgagggttctcactcaagatggccgcgtttacatcgggcaattgatggcatttgataaacatatgaatttagtgttgaatgagtgtatagaagagagggtacccaaaactcaactagataaattaagaccgagaaaagattcaaaagatggaaccactttgaacatcaaggtagaaaaaagagtgttgggactgactatactaagaggagaacagatcttatccacagtggtggaggataagccgctactatccaagaaggaaagactagtgagagataaaaaggaaaagaaacaagcgcaaaagcagacgaaactaagaaaagagaaagagaaaaagccgggaaagatcgctaaacctaacacggccaatgcgaagcatactagtagcaattctagggagattgcccaaccatcgtcgagcagatacaatggtggcaacgataatatcggcgcaaataggtcgaggtttaataatgaagcgccccctcaaacaaggaagtttcagcccccaccaggttttaaaagaaaataa

SEQ ID NO: 4791 - protein, 196 aa, Saccharomyces cerevisiae
MSKIQVAHSSRLANLIDYKLRVLTQDGRVYIGQLMAFDKHMNLVLNECIEERVPKTQLDKLRPRKDSKDGTTLNIKVEKRVLGLTILRGEQILSTVVEDKPLLSKKERLVRDKKEKKQAQKQTKLRKEKEKKPGKIAKPNTANAKHTSSNSREIAQPSSSRYNGGNDNIGANRSRFNNEAPPQTRKFQPPPGFKRK

SEQ ID NO: 4792 - DNA, 498 bp, Candida glabrata CBS 138
  CDS (1)..(498)
atggtaggagttcaagtaaagcacaacagtcgattagctgacctgataaactacaagttacgtgtcataacacaagatggtagggtgtatattggtatattgctggcgtttgataagcatatgaatgtagtactgagtgattgtgtggaggagagagttctcaagaagcagatcgatgacataaagaataaaggctcggttgatcgagacaacctgaaagttgagaagagagtgctgggacttgtcattctccgaggcgagcagatactatcgacagttgtagaggacaagccgctactttcaaaagcagaaagattggttgtcgactcaaaacagcagaaacagctagcaaaggagcgcaataagaggaagaaaaataccactacaaatggcgggaaagtggccaagtcaaacagcaaggatgtgaagccaaatgagagaacaatacaacaaccggtaaggaaattccaaccaccaccaggatttaagagaaagtaa

SEQ ID NO: 4793 - protein, 165 aa, Candida glabrata CBS 138
MVGVQVKHNSRLADLINYKLRVITQDGRVYIGILLAFDKHMNVVLSDCVEERVLKKQIDDIKNKGSVDRDNLKVEKRVLGLVILRGEQILSTVVEDKPLLSKAERLVVDSKQQKQLAKERNKRKKNTTTNGGKVAKSNSKDVKPNERTIQQPVRKFQPPPGFKRK

SEQ ID NO: 4794 - DNA, 576 bp, Kluyveromyces lactis NRRL Y-1140
  CDS (1)..(576)
atgtcgcaagttgaagttaaaaagaaggaaacgaagctatcagatttgatagattatagaatacgagtcgctacccatgacggaagggtttatattggccaacttatggcttttgatgcatatatgaaccttgtaatgggagattgtgtagaggaacgcatgcctcataaacaaatcatagaagtacttaaaagtggaggaaacttgtcaagcaatgtgcaagtcgaaagaaggacttttggactaataattttacggggtgagcatgtgttgagtacctcggttgagtcacctccccaactctctaagaaggaacgaatcgaagtccagaagaagaatgcaaaaaaattagataatgcgaaaaaggctcgtcaagggaagacttctaacaagatgaacgttggaacgaatggatctaatataacttcaactaactcagaaagttcaaatagagttacgaagccaagtcataaacctatcaatacgaattctggagctcccagtaggtttaattctaatagtcaggtacgccccagccggttccaagcccctccaggcttcaaaaaaagaaactaa

SEQ ID NO: 4795 - protein, 191 aa, Kluyveromyces lactis NRRL Y-1140
MSQVEVKKKETKLSDLIDYRIRVATHDGRVYIGQLMAFDAYMNLVMGDCVEERMPHKQIIEVLKSGGNLSSNVQVERRTFGLIILRGEHVLSTSVESPPQLSKKERIEVQKKNAKKLDNAKKARQGKTSNKMNVGTNGSNITSTNSESSNRVTKPSHKPINTNSGAPSRFNSNSQVRPSRFQAPPGFKKRN

SEQ ID NO: 4796 - DNA, 435 bp, Debaryomyces hansenii CBS767
  CDS (1)..(435)
atggccacgaatttatccgtttccaagaagacaaaaatgtcagatttggtgcattacagattaagaatcaccacaattgataatagaaattttataggacaactattggcgtatgacaagcacttgaatctcgtgttatccgaaacagaagagtctagaataaccaaaaaatcatatcaggaattgaagaaaacacaaaactccaattcaatagtggaagagaagagatcgttgggattgataattttaagaggagaacagattgttagtttgagtatagagagcccacctccaatcgacaccaagaagagaataggattagaaaaaggtaaaggaatcaccaagccgttaaagaccccggtgagtgttaaatccaagttacaaggacccgttaaaactccgcaaaatgctggccctgggtttaaacgtcaatag

SEQ ID NO: 4797 - protein, 144 aa, Debaryomyces hansenii CBS767
MATNLSVSKKTKMSDLVHYRLRITTIDNRNFIGQLLAYDKHLNLVLSETEESRITKKSYQELKKTQNSNSIVEEKRSLGLIILRGEQIVSLSIESPPPIDTKKRIGLEKGKGITKPLKTPVSVKSKLQGPVKTPQNAGPGFKRQ

SEQ ID NO: 4798 - DNA, 495 bp, Yarrowia lipolytica CLIB122
  CDS (1)..(495)
atgattgtaccaaacaagacaaaaatggccgatctggtcaactacaggctccgggtgacgactgtggatggcaagcagatggtgggacagatgctggcgttcgaccggtacatgaatcttgttctaagtgactgcgaggagttccgggcaacgaaaaagtcgctgctggaggcaaaaaagactatccagatcgagaatggcgacgcttcttccgtgtccatcactgaggagaaacggactttggggttggtcattctacgaggcgagactgtggtttctgtgtctgtcgaggctcctcctcccacagatcctacagctcgactgggcaacaccgctctgacacccggatccgggtctgccaagggcatcaaccgggccatccccacaggtcccagaggagctggaggaccgggattgggaggtcccgtgcgaagtgcgcctggaggaagagctcctcccgggttccaggctcctcctggatttggacgggcgtag

SEQ ID NO: 4799 - protein, 164 aa, Yarrowia lipolytica CLIB122
MIVPNKTKMADLVNYRLRVTTVDGKQMVGQMLAFDRYMNLVLSDCEEFRATKKSLLEAKKTIQIENGDASSVSITEEKRTLGLVILRGETVVSVSVEAPPPTDPTARLGNTALTPGSGSAKGINRAIPTGPRGAGGPGLGGPVRSAPGGRAPPGFQAPPGFGRA

SEQ ID NO: 4800 - DNA, 25 bp, Artificial sequence
  primer
atgagcaaaatacaggtggcacata

SEQ ID NO: 4801 - DNA, 26 bp, Artificial sequence
  primer
ttattttcttttaaaacctggtgggg

SEQ ID NO: 4802 - protein, 193 aa, Artificial sequence
  consensus sequence
  Variant (2)..(8): Xaa in position 2 to 8 is any amino acid
  Variant (9)..(9): Xaa in position 9 is any or no amino acid
  Variant (12)..(13): Xaa in position 12 to 13 is any amino acid
  Variant (15)..(15): Xaa in position 15 is any amino acid
  Variant (19)..(19): Xaa in position 19 is any amino acid
  Variant (21)..(21): Xaa in position 21 is any amino acid
  Variant (25)..(26): Xaa in position 25 to 26 is any amino acid
  Variant (31)..(31): Xaa in position 31 is any amino acid
  Variant (35)..(36): Xaa in position 35 to 36 is any amino acid
  Variant (42)..(43): Xaa in position 42 to 43 is any amino acid
  Variant (45)..(45): Xaa in position 45 is any amino acid
  Variant (47)..(47): Xaa in position 47 is any amino acid
  Variant (49)..(50): Xaa in position 49 to 50 is any amino acid
  Variant (53)..(68): Xaa in position 53 to 68 is any amino acid
  Variant (69)..(75): Xaa in position 69 to 75 is any or no amino acid
  Variant (79)..(79): Xaa in position 79 is any amino acid
  Variant (83)..(83): Xaa in position 83 is any amino acid
  Variant (89)..(91): Xaa in position 89 to 91 is any amino acid
  Variant (93)..(94): Xaa in position 93 to 94 is any amino acid
  Variant (97)..(98): Xaa in position 97 to 98 is any amino acid
  Variant (100)..(105): Xaa in position 100 to 105 is any amino acid
  Variant (107)..(138): Xaa in position 107 to 138 is any amino acid
  Variant (139)..(184): Xaa in position 139 to 184 is any or no amino acid
  Variant (187)..(187): Xaa in position 187 is any amino acid
VXXXXXXXXDLXXYXLRVXTXDGRXXIGQLXAFDXXMNLVLXXCXEXRXXKKXXXXXXXXXXXXXXXXXXXXXXXEKRXLGLXILRGEXXXSXXVEXXPXXXXXXRXXXXXXXXXXXXXXXXXXXXXXXXXXXXXXXXXXXXXXXXXXXXXXXXXXXXXXXXXXXXXXXXXXXXXXXXXXXXXXFQXPPGFKR

SEQ ID NO: 4803 - protein, 51 aa, Artificial sequence
  protein pattern
  Variant (2)..(2): Xaa in position 2 is any amino acid
  Variant (3)..(5): Xaa in position 3 to 5 is any or no amino acid
  Variant (7)..(7): Xaa in position 7 is Ile or Val
  Variant (8)..(8): Xaa in position 8 is any amino acid
  Variant (10)..(10): Xaa in position 10 is Lys or Arg
  Variant (11)..(11): Xaa in position 11 is Ile or Leu
  Variant (13)..(13): Xaa in position 13 is Ile or Val
  Variant (14)..(14): Xaa in position 14 is any amino acid
  Variant (16)..(16): Xaa in position 16 is any amino acid
  Variant (18)..(18): Xaa in position 18 is Gly or Asn
  Variant (20)..(20): Xaa in position 20 is Asn or Val
  Variant (21)..(21): Xaa in position 21 is Phe or Tyr
  Variant (24)..(24): Xaa in position 24 is any amino acid
  Variant (26)..(26): Xaa in position 26 is Leu or Met
  Variant (28)..(28): Xaa in position 28 is Phe or Tyr
  Variant (30)..(30): Xaa in position 30 is any amino acid
  Variant (31)..(31): Xaa in position 31 is His or Tyr
  Variant (32)..(32): Xaa in position 32 is Leu or Met
  Variant (34)..(34): Xaa in position 34 is any or no amino acid
  Variant (36)..(36): Xaa in position 36 is Leu, Met or Val
  Variant (37)..(37): Xaa in position 37 is Gly, Asn or Ser
  Variant (38)..(38): Xaa in position 38 is Asp or Glu
  Variant (39)..(39): Xaa in position 39 is Cys or Thr
  Variant (40)..(40): Xaa in position 40 is any amino acid
  Variant (42)..(42): Xaa in position 42 is Glu or Ser
  Variant (44)..(44): Xaa in position 44 is Ile, Met or Val
  Variant (45)..(45): Xaa in position 45 is any amino acid
  Variant (46)..(46): Xaa in position 46 is His or Lys
  Variant (47)..(47): Xaa in position 47 is any amino acid
  Variant (48)..(48): Xaa in position 48 is Gln or Ser
  Variant (49)..(50): Xaa in position 49 to 50 is any amino acid
  Variant (51)..(51): Xaa in position 51 is Asp, Glu or Lys
SXXXXLXXYXXRXXTXDXRXXIGXLXAXDXXXNXVXXXXXEXRXXXXXXXX

SEQ ID NO: 4804 - protein, 33 aa, Artificial sequence
  protein pattern
  Variant (2)..(2): Xaa in position 2 is any or no amino acid
  Variant (5)..(5): Xaa in position 5 is Ser, Thr or Val
  Variant (9)..(9): Xaa in position 9 is any amino acid
  Variant (15)..(15): Xaa in position 15 is Gln or Thr
  Variant (16)..(16): Xaa in position 16 is Ile or Val
  Variant (17)..(17): Xaa in position 17 is Leu or Val
  Variant (19)..(19): Xaa in position 19 is any amino acid
  Variant (20)..(20): Xaa in position 20 is Ser or Val
  Variant (21)..(21): Xaa in position 21 is Ile or Val
  Variant (23)..(23): Xaa in position 23 is Ala, Asp or Ser
  Variant (24)..(24): Xaa in position 24 is any amino acid
  Variant (26)..(26): Xaa in position 26 is Leu or Pro
  Variant (27)..(27): Xaa in position 27 is any amino acid
  Variant (28)..(28): Xaa in position 28 is Asp or Ser
  Variant (29)..(31): Xaa in position 29 to 31 is any amino acid
  Variant (33)..(33): Xaa in position 33 is Ile or Leu
EXKRXLGLXILRGEXXXSXXXEXXPXXXXXXRX

SEQ ID NO: 4805 - protein, 8 aa, Artificial sequence
  protein pattern
  Variant (2)..(2): Xaa in position 2 is Ala or Pro
  Variant (7)..(7): Xaa in position 7 is any amino acid
  Variant (8)..(8): Xaa in position 8 is Lys or Arg
QXPPGFXX

SEQ ID NO: 4806 - DNA, 1062 bp, Saccharomyces cerevisiae
  CDS (1)..(1062)
atggtcgatacgcataaactagcagacgacgttcttcagctattggataaccgtatcgaagataattatagggtttgtgttatcctagtcggttctccaggctccggtaagtctactattgcggaagaactttgtcaaattataaatgaaaaatatcacacatttttgtcagagcatccaaatgttattgaggttaatgataggttgaaacctatggttaacctagtagactctttaaagacgctccagcccaataaagtagctgaaatgattgaaaatcaggggctgtttaaagatcatgttgaggatgttaattttcaaccagtcaagtactcagcccttacatcaaataatgaagaatgtaccgcagtagttgccagaggtggtactgcgaatgccataagaatcgcagcagttgataatccagtcaatgttaacaagttggcccaggatagtatcaatatagcgcaaatagtcccaatggatggttttcacttatctcgcagatgtctagacctattcaaagacccacaaactgcccataaaagaagaggttcgccctcaacgtttgacagtaacaatttcttacaattgtgtaaaattctagccaagacgtccctatgtaaggtctcctcacatcataaattttactccacttcaagcgtttttgagaagttatccaaaacttttagccaaacaattcctgatatctttgttccaggatttaaccatgcactaaaagacccaactccagatcagtactgtatttccaaatttacaaggatagttatacttgaagggttatacctactgtatgaccaagaaaactggaagaaaatttacaaaacattagctgatacgggagcacttcttgtttataagattgacatagactatgaggccaccgaagaaagggtggccaaaaggcatttgcaatcagggttagtcacgactattgcagaaggacgagagaagtttcgcagcaatgatttgttgaatggcagggatatagataatcatttaattaaggtagataatatcgtccatatccgcaacgactag

SEQ ID NO: 4807 - protein, 353 aa, Saccharomyces cerevisiae
MVDTHKLADDVLQLLDNRIEDNYRVCVILVGSPGSGKSTIAEELCQIINEKYHTFLSEHPNVIEVNDRLKPMVNLVDSLKTLQPNKVAEMIENQGLFKDHVEDVNFQPVKYSALTSNNEECTAVVARGGTANAIRIAAVDNPVNVNKLAQDSINIAQIVPMDGFHLSRRCLDLFKDPQTAHKRRGSPSTFDSNNFLQLCKILAKTSLCKVSSHHKFYSTSSVFEKLSKTFSQTIPDIFVPGFNHALKDPTPDQYCISKFTRIVILEGLYLLYDQENWKKIYKTLADTGALLVYKIDIDYEATEERVAKRHLQSGLVTTIAEGREKFRSNDLLNGRDIDNHLIKVDNIVHIRND

SEQ ID NO: 4808 - DNA, 813 bp, Arabidopsis thaliana (mouse-ear cress)
  CDS (1)..(813)
atggaggtttcttctttctccactgtacccagatactgtaactcacgctcctttgttccaggggattcaaagttcacttatgggaccaatctcttgttcctcttcatttcagcattcgaaaacgaaagaacacccctcgttatttgtcagaagaaagatgtcactgttgttgatggaagttgtatggatgagatctatgataagttggcggaacgtcttgtccctacagcagcggcaatgtttagccccaatcttaaacgtttggtcggtttggctggtcctcctggtgccgggaaaagtacagtagcaaatgaagttgtgcgtcgtgtaaataagctatggcctcagaaagctgcttcttttgatgctgaggttaatccaccggatgttgctatagtacttcccatggatggtttccatttgtatcgttcgcaactcgatgctatggaggatcccaaagaagcccatgcgagaagaggggtttatgtgccatcatttgatcatggagttggggatccagttgaagatgatatctttgttagcctccagcataaagtggtaattgtagaaggaaactacatcttgttagaagaagggtcttggaaagacatctcagatatgtttgatgagaaatggttcatcgatgtgaatctcgatacagcaatgcaacgtgttgaaaaccggcatatctcaactggtaaacccccagatgttgctaaatggcgggtggattataatgaccgacccaacgcagagctgataataaagtcaaagacaaacgctgatctactgatcagatctatgaacatttga

SEQ ID NO: 4809 - protein, 270 aa, Arabidopsis thaliana (mouse-ear cress)
MEVSSFSTVPRYCNSRSFVPGDSKFTYGTNLLFLFISAFENERTPLVICQKKDVTVVDGSCMDEIYDKLAERLVPTAAAMFSPNLKRLVGLAGPPGAGKSTVANEVVRRVNKLWPQKAASFDAEVNPPDVAIVLPMDGFHLYRSQLDAMEDPKEAHARRGVYVPSFDHGVGDPVEDDIFVSLQHKVVIVEGNYILLEEGSWKDISDMFDEKWFIDVNLDTAMQRVENRHISTGKPPDVAKWRVDYNDRPNAELIIKSKTNADLLIRSMNI

SEQ ID NO: 4810 - DNA, 642 bp, Brucella melitensis
  CDS (1)..(642)
atgaggcctatcgagcgcgaagccctgccttcggaaattcttgcgcggttggcgaaaaccgaagggcgtctgatcgtggccattgccggcccgccgggcgcgggcaaatccaccctgtccgattatctgctccacgccatcaacaagggcggcaatgcgccatccatcatcgtgcccatggacgggtttcacatcgacgatgtgattcttgaacagcgcggattgctggatcgcaagggatcgccgcccacttttgattgcgcaggtttttcttcccttctccagcgcctgaaaggggcggaagaagagatttttatcccggttttcgaccgctcgctggagttttcgcgcgctgccgcatccgtggttgggcctgagcatcgcatcctgctggtcgaaggcaattacctgctgcttgaccgggagccgtggtcaaggcttgctccctttttcgacatgacggtctatctggatgtgccctttgccgtgctggagcgccgcctgacagaccgctggctcggtttcggcttcgatgtggaaacggcccgaaaccgcgccctctccaatgacattcccaacgccgaactcgtggctgcacagtcacgcaaggccggttttgtcgttagtttcgacgcgcgataa

SEQ ID NO: 4811 - protein, 213 aa, Brucella melitensis
MRPIEREALPSEILARLAKTEGRLIVAIAGPPGAGKSTLSDYLLHAINKGGNAPSIIVPMDGFHIDDVILEQRGLLDRKGSPPTFDCAGFSSLLQRLKGAEEEIFIPVFDRSLEFSRAAASVVGPEHRILLVEGNYLLLDREPWSRLAPFFDMTVYLDVPFAVLERRLTDRWLGFGFDVETARNRALSNDIPNAELVAAQSRKAGFVVSFDAR

SEQ ID NO: 4812 - DNA, 708 bp, Schizosaccharomyces pombe
  CDS (1)..(708)
atggctttacaagtagatgccccagatgtatcgtcttatgacgaactttacaaccgtgcagttgaattgttgaagcaccagcaacgagttctaatcggtttggctggaggtcctggttcaggcaagtcaacattatgtgctattctcgcaaaggcatggaatgaaagatttggatcggagatcgtaaaaataattccaatggatggctttcattattcgttggaagagcttgatcgattcgacaacccagaaaaggcccgggctcttcgtggagcagaatggacgtttgatgcagacttattctactccttagttcggcttatgaaaaagatcactgacagagagctctatgccccttcatttgatcatgcaattggtgaccctgtagtcgacgatatttgcgttgagcccaaaaatcgaattttaatttttgaaggtaattaccttttgctcaacaaacctccatggtcagacgcatgcaaattatatgacattaaggcatacctccctgtagagcactcagtggcccgtgctcgtgttgcgcatcgtcacttggtttcaggattatgcgcaacagaagaagaggcaattgagaggaccgacagaaatgatatgattaatctcacttttgtcgagaagaacatggttaccccagatattgtattacagcagctacgtttgaaaaccgttaaaacatctagtttgtaa

SEQ ID NO: 4813 - protein, 235 aa, Schizosaccharomyces pombe
MALQVDAPDVSSYDELYNRAVELLKHQQRVLIGLAGGPGSGKSTLCAILAKAWNERFGSEIVKIIPMDGFHYSLEELDRFDNPEKARALRGAEWTFDADLFYSLVRLMKKITDRELYAPSFDHAIGDPVVDDICVEPKNRILIFEGNYLLLNKPPWSDACKLYDIKAYLPVEHSVARARVAHRHLVSGLCATEEEAIERTDRNDMINLTFVEKNMVTPDIVLQQLRLKTVKTSSL

SEQ ID NO: 4814 - DNA, 1038 bp, Candida glabrata CBS 138
  CDS (1)..(1038)
atggtcgatgttaatcgattaaaagaagaagtgattgcttcatatagggaaatttgcaaagagaattatagactgttggttttcattgttggtccaccaggatccggtaaatccacaattgctgaaaaactgaaggatgcaatcaacacatcatatcttgattatcttaaggaaatagacagaaagactttaaggtgtgaaaactataaccatattaacattgatcaatttgttcaaggtattgaaggtgaaaccattagtagtgctttagaagatgaaagacatgagaacttcgattcagtggaaaatgttgacttcatttgtaagaaaaaacgtctaaaagatggttcatatacaattactggtagggggggtcaattgaatgccataaaagttagacaacccacctctcaagaaaagaatcttgaaggtaacactacaattgccgaggttctacctatggatgggtttcacttaagccgagaatgcctggatcatttttctgatcctcaatgggctcacctaagaagaggttcttctttaacttttgatagtaataattttcttaaactctgtgagatcatggccaagacaagtcggatattcccatccataggatatgatggggatgacttcacagcatttgatgccatttcatcatcgtttgactgcagtgttccgtcagtcgaagttcctggttttgatcattcacttaaagatccacaaccttctcaacatactatttcttttaagtccagaattgttatatttgaaggactctatttgctctataataaagaaaactggtcaaaaatctataatatagttagtaactcgaatgctaaattattttataagatccttgcatgtgaggaccaaatagaatcacgagtcgcaaaaagacacctaaaagcaggtttagttgcttcgattgaggatgggaaggacaagtttaggaaaaacgatttattgaatgctagagatgttgaaaagaattcaatatcttcagaagatattagactaattcgtaatgattaa

SEQ ID NO: 4815 - protein, 345 aa, Candida glabrata CBS 138
MVDVNRLKEEVIASYREICKENYRLLVFIVGPPGSGKSTIAEKLKDAINTSYLDYLKEIDRKTLRCENYNHINIDQFVQGIEGETISSALEDERHENFDSVENVDFICKKKRLKDGSYTITGRGGQLNAIKVRQPTSQEKNLEGNTTIAEVLPMDGFHLSRECLDHFSDPQWAHLRRGSSLTFDSNNFLKLCEIMAKTSRIFPSIGYDGDDFTAFDAISSSFDCSVPSVEVPGFDHSLKDPQPSQHTISFKSRIVIFEGLYLLYNKENWSKIYNIVSNSNAKLFYKILACEDQIESRVAKRHLKAGLVASIEDGKDKFRKNDLLNARDVEKNSISSEDIRLIRND

SEQ ID NO: 4816 - DNA, 1062 bp, Kluyveromyces lactis NRRL Y-1140
  CDS (1)..(1062)
atgttggattacgatgcgcttgtagatcaagcgttacagctgctcgaacaaaatatcaacaagaattatagggtttgcattgggataattggaccaccaggttctggtaagtcgactgtagctgaaaaattgaaggaaaagatcaatagcagatatcacgattacctagctcacgagcatcatgcagaggtggcagtacggccgttaagctctgctattgatctaactggagacctatcagttgccaacaaagaactgcaagcggagattaaggcaggattttactcacacgtcgaagataataatttcaaaccagtgcaagtgaaagagtctgacgggtcaacccttatcgttggtcgcggtggtttggacaatgcggttaggataaaaccgctacgtaaggaagccaacttgtccccaacaaagccggatatagctcaaattgttccaatggatggattccatctgtcaagaaaacatctagatcacttcaaggatcctactgtggctcatcttcgtcgggggtcgccgtttacgtttgatagtaataatttcttgcaattgtgcaaagtgctgtcaaaaacctgttccctggacccaaactaccattctactggcccagagactgtaaatgaagataatacaaattcattgttcgacaatgttacgaatagctttatagacttacctgaaatatctttccccgggtttgatcatgcaattaaagatccagtggctgaccagcatacagttcataaatttacaagaatactaattctagaaggactctatcttctcttaaatcaagagaactggagtctaatatacgatgccatagcaagcacgggtgcatttattttttggaatatcgtgattgatgaagatgttatcgaacaaagagtggccaaacgtcatgttaaatctggtatttgcctgtctttagaggaaggcatacaaagatttagagcaaacgatcaaataaacggtaggctgattcaatcgcaatctgttaggaacgccaataaaaatgtgaaaaacgtctacgacatacgaaatgattaa

SEQ ID NO: 4817 - protein, 353 aa, Kluyveromyces lactis NRRL Y-1140
MLDYDALVDQALQLLEQNINKNYRVCIGIIGPPGSGKSTVAEKLKEKINSRYHDYLAHEHHAEVAVRPLSSAIDLTGDLSVANKELQAEIKAGFYSHVEDNNFKPVQVKESDGSTLIVGRGGLDNAVRIKPLRKEANLSPTKPDIAQIVPMDGFHLSRKHLDHFKDPTVAHLRRGSPFTFDSNNFLQLCKVLSKTCSLDPNYHSTGPETVNEDNTNSLFDNVTNSFIDLPEISFPGFDHAIKDPVADQHTVHKFTRILILEGLYLLLNQENWSLIYDAIASTGAFIFWNIVIDEDVIEQRVAKRHVKSGICLSLEEGIQRFRANDQINGRLIQSQSVRNANKNVKNVYDIRND

SEQ ID NO: 4818 - DNA, 738 bp, Streptomyces avermitilis
  CDS (1)..(738)
atgacgatcaccgacaagaaccgcctcaccggggaagccgacccgcgccgtacgtcgctctacgggcctccgtccatggacgccctcaccgagcgggccctgcacctggcccgggccgggcgggcactgctcggcatcgtcggagaaccgggcgccggcaagtccacgttcgccgagcagctgcgggcgcggctggagaaagagcggccgggactggccgtgaccgtgtccatggacggattccacctcgcccagaaggtcatcgaggcccgggggcaggcggccgacaagggcacgatcgacaccttcgacgccgacggcttcgtcgccctcctgcgccgtacgcgtgccgagaccggagacaccgaaaacaccgaaagcaccgtctggtggccggagttcgaccgcgacctcgaggaccccgtggccgggtcgatcgaggtcgcgccgcaccaccggctggtcatcgtcgacggcaacttcctgctgtccgcgcaggagccctggcggcaggtgaagggcctgctggacgagacctggttcctggacgccctcccggagccgaggcgcgagcggctcacccgccgctacatcagctacggcttcaccccggaggccgcgcgcgcgaagaccctgggagtcgacgaggacaccagtgccctcatccgcagcaccgtctcacgggccgatctcgtcatcggcgaggccagggagagcggcggggtcagcgactgctga

SEQ ID NO: 4819 - protein, 245 aa, Streptomyces avermitilis
MTITDKNRLTGEADPRRTSLYGPPSMDALTERALHLARAGRALLGIVGEPGAGKSTFAEQLRARLEKERPGLAVTVSMDGFHLAQKVIEARGQAADKGTIDTFDADGFVALLRRTRAETGDTENTESTVWWPEFDRDLEDPVAGSIEVAPHHRLVIVDGNFLLSAQEPWRQVKGLLDETWFLDALPEPRRERLTRRYISYGFTPEAARAKTLGVDEDTSALIRSTVSRADLVIGEARESGGVSDC

SEQ ID NO: 4820 - DNA, 735 bp, Neurospora crassa
  CDS (1)..(735)
atggaggaacaaatggatcgcctggtcgagagggcatgggacaagtttctcgacacacccacggatcagagactcttgattgccatagcaggtatccccggctccggaaaaacaaccctctcccaaattctcgctcgccgcctaaatatcctgcacgccaccgaatatccccttgcttccatgtctccagacttcgccactgccctccccatggacggcttccacctcacgcgcgcccaactgtccgccatgcccgacccggaactcgcacacgcccgacgcggcgcggaatttacttttgatggacaggggttttatgagctggtgaaggaactacgaaagccagtggtgacaacggcaaccagaacaacggtgtgggcgcctagtttcgatcatgcgttgaaggatccggtggagaaagggatcgaggtgggaccggagatgagggtggtggtttttgaagggaattacctcctactagaccaaaaaccctggtctgatgctgccaaattgatggacctcaagttcttcgtcagagtgccgttccccgtggccaggaaacggttggtcaagagacatttggctgctgggatcgcggccacagaggaggaggcggataagagggcggtggagaatgatttggtcaatggggctctaattgaggagttattgagggaggatgaggtggacgaggttgtggagagcttggaggatgggaagtgggtgcacacttag

SEQ ID NO: 4821 - protein, 244 aa, Neurospora crassa
MEEQMDRLVERAWDKFLDTPTDQRLLIAIAGIPGSGKTTLSQILARRLNILHATEYPLASMSPDFATALPMDGFHLTRAQLSAMPDPELAHARRGAEFTFDGQGFYELVKELRKPVVTTATRTTVWAPSFDHALKDPVEKGIEVGPEMRVVVFEGNYLLLDQKPWSDAAKLMDLKFFVRVPFPVARKRLVKRHLAAGIAATEEEADKRAVENDLVNGALIEELLREDEVDEVVESLEDGKWVHT

SEQ ID NO: 4822 - DNA, 735 bp, Vibrio parahaemolyticus
  CDS (1)..(735)
atgaaagtgaatttaaacgtcagtggcttcgaaaccgaagcaacctttcccgatgccgacgtaaaacgaatccatcagcctcttatcgaaaaatttactcgcctctatcatgagaagcaggaacgcatagtggtgttcttgtgtgctcctccgggcagtggcaagtcgacactcgctgcattctgggaatacctgtcggaacaagatgaaagccaagagcctttacaagtgctgccgtttgatggtttccattatccaaatgagatcctcgacaacaatacgattgaacgagatggcgagctcgtgtctctgcgcagtattaagggggcccatcaaacatttaatctgacggagcttatcgacaagctcaaacagctcaaagtgaaagatccgaaatggccatactacgaccgcaatttgcatgatccagtcgacgacgccattttagtgaatcgcaatgttgttgtggttgaggggaattggttgctgcttaatgaaccggtgtggaatgaactgcatcgtttggcagattttaccgtcttcgtcgatacacagcctgagtttctgcaagaacgcttagtaaaccgtaagattcgtggtggcaccgcaccagaagccgcattagcgttttatttaaactcagatgccgtaaatgtagataaggttttaaatcattcaattccagcggatctcacgctgtttctcaatcaaaacggttcgttcgaaattcgataa

SEQ ID NO: 4823 - protein, 244 aa, Vibrio parahaemolyticus
MKVNLNVSGFETEATFPDADVKRIHQPLIEKFTRLYHEKQERIVVFLCAPPGSGKSTLAAFWEYLSEQDESQEPLQVLPFDGFHYPNEILDNNTIERDGELVSLRSIKGAHQTFNLTELIDKLKQLKVKDPKWPYYDRNLHDPVDDAILVNRNVVVVEGNWLLLNEPVWNELHRLADFTVFVDTQPEFLQERLVNRKIRGGTAPEAALAFYLNSDAVNVDKVLNHSIPADLTLFLNQNGSFEIR

SEQ ID NO: 4824 - DNA, 699 bp, Brucella suis
  CDS (1)..(699)
atgcctctgataaagggacaggacgaatcacggaaaccggacatgacgcccttcgacatgaggcctatcgagcgcgaagccctgccttcggaaattcttgcgcggttggcgaaaaccgaagggcgtctgatcgtggccattgccggcccgccgggcgcgggcaaatccaccctgtccgattatctgctccacgccatcaacaagggcggcaatgcgccatccatcatcgtgcccatggacgggtttcacatcgacgatgtgattcttgaacagcgcggattgctggatcgcaagggatcgccgcccacttttgattgcgcaggtttttcttcccttctccagcgcctgaaaggggcggaagaagagatttttatcccggttttcgaccgctcgctggagttttcgcgcgctgccgcatccgtggttgggcctgagcatcgcatcctgctggtcgaaggcaattacctgctgcttgaccgggagccgtggtcaaggcttgctccctttttcgacatgacggtctatctggatgtgccctttgccgtgctggagcgccgcctgacagaccgctggctcggtttcggcttcgatgcggaaacggcccgaaaccgcgccctctccaatgacattcccaacgccgaactcgtggctgcacagtcacgcaaggccggttttgtcgttactttcgacgcgcgataa

SEQ ID NO: 4825 - protein, 232 aa, Brucella suis
MPLIKGQDESRKPDMTPFDMRPIEREALPSEILARLAKTEGRLIVAIAGPPGAGKSTLSDYLLHAINKGGNAPSIIVPMDGFHIDDVILEQRGLLDRKGSPPTFDCAGFSSLLQRLKGAEEEIFIPVFDRSLEFSRAAASVVGPEHRILLVEGNYLLLDREPWSRLAPFFDMTVYLDVPFAVLERRLTDRWLGFGFDAETARNRALSNDIPNAELVAAQSRKAGFVVTFDAR

SEQ ID NO: 4826 - DNA, 621 bp, Rhizobium meliloti
  CDS (1)..(621)
atgagcgtcaaatcccttgcggatgaaatcctgaagcggacggtcaattccggccgcttcatcgtcgccatcgccggtccgcccggcgccggtaagtccacgctttccgaaacgcttgcggaggcgatcacgcaggcgggcgaaaaggcggcggtgttgcccatggacgggtttcacatggacaatgccgttctcgaggaaaaagggctgcttgcccgcaagggggcacccgagaccttcgacgtccgatcctttctcgcaacgcttgccgccgtccgcgccgatgacggcgaggttctcgtcccggtcttcgaccgctcccgggaactggcgattgcctcggcgaggatcatcgcgcccgagacgcgtatcgtgcttgccgagggcaactacctgctgctcgacgaagcgccctggaacggcctcgacggcgctttcgattattcgatcttcatcgatccgggtctggaggtgctcgagcggcggctcctgcagcgctggtacgaccacggctatgacgaagacgcggcgcgcagcaaggcctatggcaacgacatacccaatgcccgccgggtcgtcgacagccgcaggccggcggatgtcgtgatcagggacttttag

SEQ ID NO: 4827 - protein, 206 aa, Rhizobium meliloti
MSVKSLADEILKRTVNSGRFIVAIAGPPGAGKSTLSETLAEAITQAGEKAAVLPMDGFHMDNAVLEEKGLLARKGAPETFDVRSFLATLAAVRADDGEVLVPVFDRSRELAIASARIIAPETRIVLAEGNYLLLDEAPWNGLDGAFDYSIFIDPGLEVLERRLLQRWYDHGYDEDAARSKAYGNDIPNARRVVDSRRPADVVIRDF

SEQ ID NO: 4828 - DNA, 1005 bp, Ashbya gossypii
  CDS (1)..(1005)
atggactacgaagacttaaagaagcgagtgtgggatctccttgctcagaatatcgagagcaactatcgggtggctgtagtggtggtggggcatcctgggtccggcaagtctacgatggcgcagaggcttaagcgggacctgaaccaggaattccagagtcacctgaaggcacgaaggggtggattgaggatttccgcgggcattgctgcggaaagcctggacgagactgtgccggttgcgtcaggcgccctggtcgaggaggcgcgacgggggttcttcgcgcacgtggaggacccggggttcaagccacacaagttctacgatggggatgggaccgcagttatcttcgggcgcggcgggctccccaattcggtgcgcatcgcgagcgaagccctggatccagcgtcatcggtcaatatagctgaggtggtgcccatggacgggttccatctgtcgcgggcgcacctggaccacttcgcggatgctgctgcggcgcacaaacggcgcggggcaccctggacgtttgacagtaataactatctgcagctctgtaagctcctggcggccacgtgcaagtggaagccggcgaagagaccgaagggcgaaacgctcatggaaacaatatgcgatacctttgcacagtgccctgtgatatcctatccgggctttgaccacgcggcgaaggatcccgtacgcgatcagcacgtcctaacgggcttcacccgggtgctgatctttgatgggctgtatctgctctacgaccaagaaaactgggcgcatatatatcactcgctggcgagcaccggcgcggtgctggtcgtcaacgtcactgccagcgaagagacccgcgagacccgcgttgcgactagacactttgccgcaggactggttgggtccattgaggagggcgtccgcaagttccgcgagaacgacttactcaacgccaagctcatcgaagaacacacgctggggggcgtgccaaccttgattctttcgaacgactaa

SEQ ID NO: 4829 - protein, 334 aa, Ashbya gossypii
MDYEDLKKRVWDLLAQNIESNYRVAVVVVGHPGSGKSTMAQRLKRDLNQEFQSHLKARRGGLRISAGIAAESLDETVPVASGALVEEARRGFFAHVEDPGFKPHKFYDGDGTAVIFGRGGLPNSVRIASEALDPASSVNIAEVVPMDGFHLSRAHLDHFADAAAAHKRRGAPWTFDSNNYLQLCKLLAATCKWKPAKRPKGETLMETICDTFAQCPVISYPGFDHAAKDPVRDQHVLTGFTRVLIFDGLYLLYDQENWAHIYHSLASTGAVLVVNVTASEETRETRVATRHFAAGLVGSIEEGVRKFRENDLLNAKLIEEHTLGGVPTLILSND

SEQ ID NO: 4830 - DNA, 24 bp, Artificial sequence
  primer
atggtcgatacgcataaactagca

SEQ ID NO: 4831 - DNA, 23 bp, Artificial sequence
  primer
ctagtcgttgcggatatggacga

SEQ ID NO: 4832 - protein, 320 aa, Artificial sequence
  consensus sequence
  Variant (2)..(7): Xaa in position 2 to 7 is any amino acid
  Variant (9)..(9): Xaa in position 9 is any amino acid
  Variant (12)..(12): Xaa in position 12 is any amino acid
  Variant (17)..(20): Xaa in position 17 to 20 is any amino acid
  Variant (22)..(35): Xaa in position 22 to 35 is any amino acid
  Variant (36)..(136): Xaa in position 36 to 136 is any or no amino acid
  Variant (143)..(147): Xaa in position 143 to 147 is any amino acid
  Variant (149)..(157): Xaa in position 149 to 157 is any amino acid
  Variant (158)..(166): Xaa in position 158 to 166 is any or no amino acid
  Variant (168)..(170): Xaa in position 168 to 170 is any amino acid
  Variant (174)..(176): Xaa in position 174 to 176 is any amino acid
  Variant (177)..(226): Xaa in position 177 to 226 is any or no amino acid
  Variant (228)..(228): Xaa in position 228 is any amino acid
  Variant (231)..(245): Xaa in position 231 to 245 is any amino acid
  Variant (246)..(247): Xaa in position 246 to 247 is any or no amino acid
  Variant (249)..(252): Xaa in position 249 to 252 is any amino acid
  Variant (255)..(255): Xaa in position 255 is any amino acid
  Variant (259)..(263): Xaa in position 259 to 263 is any amino acid
  Variant (265)..(286): Xaa in position 265 to 286 is any amino acid
  Variant (287)..(291): Xaa in position 287 to 291 is any or no amino acid
  Variant (293)..(295): Xaa in position 293 to 295 is any amino acid
  Variant (297)..(300): Xaa in position 297 to 300 is any amino acid
  Variant (302)..(313): Xaa in position 302 to 313 is any amino acid
  Variant (314)..(315): Xaa in position 314 to 315 is any or no amino acid
  Variant (318)..(319): Xaa in position 318 to 319 is any amino acid
RXXXXXXGXPGXGKSTXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXPMDGFHXXXXXLXXXXXXXXXXXXXXXXXXGXXXTFDXXXXXXXXXXXXXXXXXXXXXXXXXXXXXXXXXXXXXXXXXXXXXXXXXXXXXPXFDXXXXXXXXXXXXXXXXXRXXXXEGXYLLXXXXXWXXXXXXXXXXXXXXXXXXXXXXXXXXXRXXXRXXXXGXXXXXXXXXXXXXXNDXXN

SEQ ID NO: 4833 - protein, 17 aa, Artificial sequence
  protein pattern
  Variant (2)..(2): Xaa in position 2 is Ile, Leu or Val
  Variant (3)..(3): Xaa in position 3 is Leu or Val
  Variant (4)..(4): Xaa in position 4 is Ile, Leu or Val
  Variant (5)..(5): Xaa in position 5 is any amino acid
  Variant (6)..(6): Xaa in position 6 is Asp or Glu
  Variant (8)..(8): Xaa in position 8 is any amino acid
  Variant (9)..(9): Xaa in position 9 is Phe or Tyr
  Variant (12)..(12): Xaa in position 12 is any amino acid
  Variant (13)..(13): Xaa in position 13 is Ala, Asp or Asn
  Variant (14)..(15): Xaa in position 14 to 15 is any amino acid
  Variant (16)..(16): Xaa in position 16 is Asn or Pro
RXXXXXGXXLLXXXXXW

SEQ ID NO: 4834 - protein, 19 aa, Artificial sequence
  protein pattern
  Variant (2)..(3): Xaa in position 2 to 3 is any amino acid
  Variant (4)..(4): Xaa in position 4 is Ile, Leu or Val
  Variant (5)..(5): Xaa in position 5 is any amino acid
  Variant (6)..(6): Xaa in position 6 is Ile, Leu or Val
  Variant (7)..(7): Xaa in position 7 is any amino acid
  Variant (8)..(8): Xaa in position 8 is Ala or Gly
  Variant (9)..(9): Xaa in position 9 is any amino acid
  Variant (12)..(12): Xaa in position 12 is Ala or Ser
  Variant (17)..(17): Xaa in position 17 is Phe, Ile, Leu, Met or Val
  Variant (18)..(18): Xaa in position 18 is Ala, Cys or Ser
  Variant (19)..(19): Xaa in position 19 is Ala, Asp, Glu or Gln
RXXXXXXXXPGXGKSTXXX

SEQ ID NO: 4835 - protein, 17 aa, Artificial sequence
  protein pattern
  Variant (2)..(4): Xaa in position 2 to 4 is any or no amino acid
  Variant (6)..(6): Xaa in position 6 is Phe or Met
  Variant (11)..(15): Xaa in position 11 to 15 is any amino acid
  Variant (17)..(17): Xaa in position 17 is Asp or Glu
VXXXPXDGFHXXXXXLX

SEQ ID NO: 4836 - DNA, 1047 bp, Saccharomyces cerevisiae
  CDS (1)..(1047)
atgactactgaaaaaaccgttgtttttgtttctggtgctactggtttcattgctctacacgtagtggacgatttattaaaaactggttacaaggtcatcggttcgggtaggtcccaagaaaagaatgatggattgctgaaaaaatttaagagcaatcccaacctttcaatggagattgtcgaagacattgctgctccaaacgcttttgacaaagtttttcaaaagcacggcaaagagatcaaggttgtcttgcacatagcttctccggttcacttcaacaccactgatttcgaaaaggatctgctaattcctgctgtgaatggtaccaagtccattctagaagcaatcaaaaattatgccgcagacacagtcgaaaaagtcgttattacttcttctgttgctgcccttgcatctcccggagatatgaaggacactagtttcgttgtcaatgaggaaagttggaacaaagatacttgggaaagttgtcaagctaacgcggtttccgcatactgtggttccaagaaatttgctgaaaaaactgcttgggattttctcgaggaaaaccaatcaagcatcaaatttacgctatcaaccatcaacccaggatttgtttttggccctcagctatttgccgactctcttagaaatggaataaatagctcttcagccattattgccaatttggttagttataaattaggcgacaatttttataattacagtggtccttttattgacgttcgcgatgtttcaaaagctcatttacttgcatttgagaaacccgaatgcgctggccaaagactattcttatgtgaagatatgttttgctctcaagaagcgctggatatcttgaatgaggaatttccacagttaaaaggcaagatagcaactggcgaacctggtagcggctcaacctttttgacaaaaaactgctgcaagtgcgacaaccgcaaaaccaaaaatttattaggattccaatttaataagttcagagattgcattgtcgatactgcctcgcaattactagaagttcaaagtaaaagctaa

SEQ ID NO: 4837 - protein, 348 aa, Saccharomyces cerevisiae
MTTEKTVVFVSGATGFIALHVVDDLLKTGYKVIGSGRSQEKNDGLLKKFKSNPNLSMEIVEDIAAPNAFDKVFQKHGKEIKVVLHIASPVHFNTTDFEKDLLIPAVNGTKSILEAIKNYAADTVEKVVITSSVAALASPGDMKDTSFVVNEESWNKDTWESCQANAVSAYCGSKKFAEKTAWDFLEENQSSIKFTLSTINPGFVFGPQLFADSLRNGINSSSAIIANLVSYKLGDNFYNYSGPFIDVRDVSKAHLLAFEKPECAGQRLFLCEDMFCSQEALDILNEEFPQLKGKIATGEPGSGSTFLTKNCCKCDNRKTKNLLGFQFNKFRDCIVDTASQLLEVQSKS

SEQ ID NO: 4838 - DNA, 1233 bp, glycine max
  CDS (40)..(1035)
gtcagctacgtaggccccccccccagcttggcttgtgatatggaacaaagaggcagaggtagagtgtgtgtcaccggggcttcaggctttctcgcctcttggctcattaagcgacttcttttgtctggctaccatgtcattggaactgtcagagatttagggaagcagaagaagtatgaatacttatggtgtctagaaggggcaacagagaggctccaactagtccaagccgatttgatggaagaaagcagcttcgacaacgcaatcatgggatgcaaaggagtcttccatgtggcctctcccgtactcaatactatatctgatcccaagtcagaaatattggaaccggcagttaaaggcacgctgaatgttcttcgctcttgtggaaagaacccagccctttgtcgtgtggtattaacctcatcatcttcaactcttaggctaagagatgattttgatccaaacaccccactagatgaatcatcctggagctccttggaaatttgtgagaaactccaggcatggtatgcgatggcaaagacacaggcagaaagagcagcgtgggaatactgcatagagaatggaataaatttggtgacagttctgccatcattcatcattggacccagcttgccaccaaatttatgctctactgcatctgatgtgctaggcttgctcaaaggagaaaccaagcgattccaactacttggaaggatgggatatgttcatatcgatgatgttgccctttgccaaatccttgtttatgaaaatgaaggctcccatggtagatacctttgcagctctaccgtaatggatgaagatgatttggctgcattgctagcaaatcgttatcctaccctccccatctccaaaaggttcgagaaactagataggccaaattacgaactaaacactggaaagctgaggagtctaggattcaattttaagtctgttgaagaaatgttcgatgattgcattgcatcccttgtgaagcagggccatgtcactcttcagcaaggccacggtccaatttaataaacttacataagttgctagttgagattgtactctgaatccaaatgatcaataacattgttaggttgatggtacttgcttgccaaattaatgaccctatatttcaaatgtagaactgtgatattatatcgagactcggaagtaactcatggggatttttctttccctcgcaaaaaaaaaaaaaaaaaaaaaaaaaaa

SEQ ID NO: 4839 - protein, 331 aa, glycine max
MEQRGRGRVCVTGASGFLASWLIKRLLLSGYHVIGTVRDLGKQKKYEYLWCLEGATERLQLVQADLMEESSFDNAIMGCKGVFHVASPVLNTISDPKSEILEPAVKGTLNVLRSCGKNPALCRVVLTSSSSTLRLRDDFDPNTPLDESSWSSLEICEKLQAWYAMAKTQAERAAWEYCIENGINLVTVLPSFIIGPSLPPNLCSTASDVLGLLKGETKRFQLLGRMGYVHIDDVALCQILVYENEGSHGRYLCSSTVMDEDDLAALLANRYPTLPISKRFEKLDRPNYELNTGKLRSLGFNFKSVEEMFDDCIASLVKQGHVTLQQGHGPI

SEQ ID NO: 4840 - DNA, 1507 bp, triticum aestivum
  CDS (135)..(1172)
agcgctccccacgcatacgttgttctcatctgcctgactagttgatatcgccaacacatctattcattcacctaaccgaccggaggggagatctttgtgccgcaccgcctcgtacgccccagcaaggagccagcatgaccgtcggcggcgaggccacagccacggccatggggcacgggcagacggtgtgcgtgaccggcgccggcggctacatcgggtcgtggatcgtcaagctcctgctcgagaaggggtacgccgtacgaggcaccgtcaggaaccccgatgacgcgaagaacgcgcacctgaggggcctcgccggcgcggcggagcggctggtgctgtgcaaggcggacctgctcgacggcgacgcgctgcgcgccgccatcgccggctgccacggcgtcttccacaccgcctcgccggttaccgacgatcccgaggagatggtggagccggcggtgaggggcacgcgctacgtcatcgacgccgcggcggagtccggcacggtccgccgcgtcgtgctgacgtcgtccatcggcgccgtcgccatggaccccagccgcggcccggacgccgtcgtcgacgagtcgtgctggagcgacctcgagttctgcaagaagaccaagaactggtactgctacgggaagacggtggcggagcgggaggcgtgggaggcagcggcggcgcgcggggtggacctggtggtggtgaacccggtgctggtgcagggcccggcgctgcagccagcggtgaacgccagcctgacgcacgtgctcaagtacctggacggctccgccaagacgtacgccaacgccgtgcaggcgtacgtgcacgtccgggacaccgccgccgcgcacgtcctcgtcttcgagtcccccgctgccgccggccgctacctctgcgtggccgacggcgccgtgctccaccgggaggacgtcgtcaccatcctccgcaagttcttccccgagtaccccatccccagcaggtgctctgacgaggtgaacccgagtaagcagccgtacaagatgtcgaacaagcggctccgtgagctgggcctcgagttcacgccggtggcgcagtgcctctacgacaccgtcgtcagcttccaggagaagggcgtcctcccggcccctcccgcctcggcaaagccggccatgaaagagaccaactgacagagtagtaatacttctagtaattacaaagaagcatccatggatgaatgaaatccttcagctatgtattggcatgccattctgattctggtgatcctacagccaggagctagggcatccgacggctcgcaaagacagccgtcgtcccaaaaacaaactagggataagcagacacactagacaaagctcacgaaaggaatggatccgatgcccatggcactgtgattggagcagtcgtggcgggtggtatgtgacgatgtcagaccgccttgtcaagcttaccgttggattacttttttccatgaagaatcaaatttattaaaaaaaaaaaaaaa

SEQ ID NO: 4841 - protein, 345 aa, triticum aestivum
MTVGGEATATAMGHGQTVCVTGAGGYIGSWIVKLLLEKGYAVRGTVRNPDDAKNAHLRGLAGAAERLVLCKADLLDGDALRAAIAGCHGVFHTASPVTDDPEEMVEPAVRGTRYVIDAAAESGTVRRVVLTSSIGAVAMDPSRGPDAVVDESCWSDLEFCKKTKNWYCYGKTVAEREAWEAAAARGVDLVVVNPVLVQGPALQPAVNASLTHVLKYLDGSAKTYANAVQAYVHVRDTAAAHVLVFESPAAAGRYLCVADGAVLHREDVVTILRKFFPEYPIPSRCSDEVNPSKQPYKMSNKRLRELGLEFTPVAQCLYDTVVSFQEKGVLPAPPASAKPAMKETN

SEQ ID NO: 4842 - DNA, 1272 bp, Oryza sativa
  CDS (48)..(1091)
aaccaaactcagtacgtgcctgcgtacgaagcgacctagattttgacatggcggggcagcaggagcaaccggagatggcgccgcctccgccgcggcggcgcgtcgtgtgcgtcaccggcgccggcgggttcgtcggctcgtggctcgtcgagctcctcctctcccgcggctacgccgtccatgccacggtccgtgacccagacgatcccaagaacgcgtttctgaagcaactggagaatgctccggagaatctgcaactgttcgaggccgacgtgctcgactgcggctcactgacggcggcgttcgccggctgcgagggtgtcttccatctggccactccggtgccggaagaaaagatcgttgatccacagaaggagatgatggctcctaccgtggaaggcaccagaaatgtactcgaggcttgctcagctgcgagcgttcagaaactcgtcgtggcctcctccattgctactgtttgccttaacccgagctggcctcaagatatgccgaaagatgagacttcctggtcagacaagaagctctgcattgaaaatgaggattggtactctgttgccaaaatcgaagctgaagagatggccctggaatacggagagaaaaatgggcttcatgtacttacgatttgtcctggaattgtttttggcccaatgttgcagacagtggaaatcaacacaagcagcaaagtgctcctctatatgattaagggaggagacggccctcacgttatgaacaacaaattctggcccatggtagatgtccgtgatgttgctgatgctttacttctagcataccacaaggcagggccatctgagcggtacttatgcactctagaacagatggacctgaaacatttattggatctgatgaagaacatgtaccctaactacaattatgcagacaagatggttgatgtggattacaaggtcgaagtgacatcagagaaactgaagaatctgggctggaacccaaggaaacgggaggagacacttgcggacagcatcgagttctttgagaaggcaggccttctagatgggcgaccttgccggcttccctatttcgctgtccaggaatgaactgaagatggccttggtcccaattctcagctaattaatcttccccatttactagtatggatgcaccttgtaaaaaaagttaatgcatgttttttttatgtatcttgtactgatacttaggaggccggtatcatgtatacttacaaaaagttgatcatagctacagttaataccgattttt

SEQ ID NO: 4843 - protein, 347 aa, Oryza sativa
MAGQQEQPEMAPPPPRRRVVCVTGAGGFVGSWLVELLLSRGYAVHATVRDPDDPKNAFLKQLENAPENLQLFEADVLDCGSLTAAFAGCEGVFHLATPVPEEKIVDPQKEMMAPTVEGTRNVLEACSAASVQKLVVASSIATVCLNPSWPQDMPKDETSWSDKKLCIENEDWYSVAKIEAEEMALEYGEKNGLHVLTICPGIVFGPMLQTVEINTSSKVLLYMIKGGDGPHVMNNKFWPMVDVRDVADALLLAYHKAGPSERYLCTLEQMDLKHLLDLMKNMYPNYNYADKMVDVDYKVEVTSEKLKNLGWNPRKREETLADSIEFFEKAGLLDGRPCRLPYFAVQE

SEQ ID NO: 4844 - DNA, 1227 bp, Oryza sativa
  CDS (92)..(1078)
agagatgcgaagcagatatcagctgtaagcaaagcctactagtactagttacggcagagcagagaacaggcggccgaaccgatcgacgacgatggtcaccggccggagcgagcagatggtgtgcgtgaccggcgccggtggcttcatcgggtcgtggctggtgaaggagctcctccaccgcggatacttcgtgaggggagccatgagagaacctgcggacatcaagaatgctcatttgcatgttctggatggagctagagaaggcctgtccctctatcgagctgatgtgctcgaccgcaacagccttcgtgctgcgttcgccttatgcgatggcgttttccacgtggcatcgccagtctcaaatgaccctgaacttctgccagctgctatcgagggaaccaagaatgtcatcaacgctgctgcggacatgggcgtcaagcgtgtggtgtttacttcgtcttatggtgctgtccatatgaaccctaacagaagatctgaccagattgttgatgagagctgttggagtgaccttgagttctgcaaacaaacacagaactggtattgctacgcgaagatgttggccgagaggacggcgatggaggaggcgtcgaagagaggtgtgaatctgttggtggtcgtgccggccgtcaccgtgggggagatgctgcagccgacgctgaacgccagcgtccacagggtggccacctacatgtggggcaccaagagtgcgtacccgaacgccgtcgccgcgtacgtcgacgtgcgcgacgtcgcccgcgcgcacgcgctggtgtacgagcaccccgacgcgcgtggccgctacctctgcatcggcagcgtgctgcaccggtccgagtttgttcgcttgcttagggagctcttcccccagtaccctatcacctccagatgtaaggacaacagtaagccaatggtgaaaccatacaaattctctgtacaaaggctggagactttaggcatgcagttcactcctttgaaagagagtttatacagaacggtaataagcttacaagacaagggtcatctacctgcagcaatctcacgccgttcagccctgtgaatcatgatcagccctgggaagatttgaataaattgattgcgaatcatgatcagatataaattaaagggaagatttgaataaactgaatctgcgtgtatgcattgtgaaaaggaatggagttgaatcctagtgagtcaatgattatcgtt

SEQ ID NO: 4845 - protein, 328 aa, Oryza sativa
MVTGRSEQMVCVTGAGGFIGSWLVKELLHRGYFVRGAMREPADIKNAHLHVLDGAREGLSLYRADVLDRNSLRAAFALCDGVFHVASPVSNDPELLPAAIEGTKNVINAAADMGVKRVVFTSSYGAVHMNPNRRSDQIVDESCWSDLEFCKQTQNWYCYAKMLAERTAMEEASKRGVNLLVVVPAVTVGEMLQPTLNASVHRVATYMWGTKSAYPNAVAAYVDVRDVARAHALVYEHPDARGRYLCIGSVLHRSEFVRLLRELFPQYPITSRCKDNSKPMVKPYKFSVQRLETLGMQFTPLKESLYRTVISLQDKGHLPAAISRRSAL

SEQ ID NO: 4846 - DNA, 1128 bp, Oryza sativa
  CDS (83)..(1114)
atacacaaaattaaaacctcgatcgatcgaacaacgacaatctttcaactagctctagctcggcatcaccatcaccatcaccatgtcgtccatttccaacgacaacaatggtgatcagaagcgacagcagcagcagcagctggtgtgcgtgaccggagcaggtggcttcatcgggtcatgggtggtgcgggagctcctcctccgtggctaccgcgtcagggccaccgtcagggaccccgcggaccgcaagaacgcccacctgctcgcgctggagggagcccacgagaggctctccctgcgccgcgccgatgtcctcgacttcgccggcctcctcgccgcgttcgccgggtgccatggcgtcttccacgtcgcctgcccgctgtccaaccgcgatccagagctgatggcggtcgcggtggatgggacgaggaacgtgatgaacgcggcggcggacatgggcgtgcggcgcgtggtgttcacgtcgtcctacggcgccgtgcacatgaaccccaaccggagccccgacgccgtcctcgacgagtcctgctggagcgaccccgaattctgccggcaaaaagacatgtactgctacgcaaagacgatggcggagatggcggcgacggaggaggcggcgaagagggggctggagctggcggtggtggtgccgtcgatgacgatgggccccatgctgcagcgtgcgctcaacctcagcagcacgcacgtcgccaactacctcaccggcgccaagaagtcgtacccgaacgccgtcgcggcctacgtcgacgtccgcgacgtcgcccgcgcgcacgccctcgtctacgagcgccacgacgcgcgcggccgctacctctgcatcggcgccgtgctgcaccgcgcccagctcctccagatgctcatggacctcttcccccagtacaccatcgcttcaaagtgtgatgacaaggggaagccgatggtgaagccgtatgagttttcgaaccagaggctcaaggatttgggcttggaattcaccccgttgaggaagagttgtacgacgcagtcatgtgcatgcaacgaaacggtcacctgcctgtcgtcttgccatagcaggagtgtagatccaagatatatataaaagacgaatttatg

SEQ ID NO: 4847 - protein, 343 aa, Oryza sativa
MSSISNDNNGDQKRQQQQQLVCVTGAGGFIGSWVVRELLLRGYRVRATVRDPADRKNAHLLALEGAHERLSLRRADVLDFAGLLAAFAGCHGVFHVACPLSNRDPELMAVAVDGTRNVMNAAADMGVRRVVFTSSYGAVHMNPNRSPDAVLDESCWSDPEFCRQKDMYCYAKTMAEMAATEEAAKRGLELAVVVPSMTMGPMLQRALNLSSTHVANYLTGAKKSYPNAVAAYVDVRDVARAHALVYERHDARGRYLCIGAVLHRAQLLQMLMDLFPQYTIASKCDDKGKPMVKPYEFSNQRLKDLGLEFTPLRKSCTTQSCACNETVTCLSSCHSRSVDPRYI

SEQ ID NO: 4848 - DNA, 1342 bp, Oryza sativa
  CDS (58)..(1089)
gacagttgcaggcttgcagcagtggtccagtggatacggaggtggtggcaaccggagatgacgcctccgcctccgccgccgcggcgccccgtgtgcgtgaccggcgccggcgggttcaccggctcgtggctcgtcaagctcctcctctcccgtggctacgccgtccacgccaccctccgcgacccagatgatcccaagaacgcgtttctgaagcagctggagaacgctccggagaacctgcgcctgttcaaggccgacgtgctcgacggcggctcgctgacggcggcgttcgccggctgcgagggggtcttccatccggccactcccgtgccggaacacaagacggtcgatccggagaaggagatgctggctcctgctgtgaaaggcaccagaaatgtgctcgaggcttgctctgctgcgagcgttcagaaactcgtcgtggtctcatccatctgtgctgtttgctttaacccgagcttgcctcgagacaggctcatagatgagacttgctggtcagacaagaagtcatgcaaagaaaatgagaactggtactgtcttgccaagaccgaagctgaagagatggccctggaatattcagagaaaaatggactgcatgtcattacggtttgccctggcgttatctttgggccactgttgcagactgtgctactcaacaccagcagcaaagttctgctctacatcatgaaaggaggccctgatgcactaagcaacaaattctttcccatagtcgatgtccgcgatgtcgccgatgctttacttctagtgtacgacaaggcagggccatctgagcgatacatctgttctcaagaacaaatggacatgagggatttgttggatttgatgaagagcatgtaccctaactacagctacacagccaaagtggttgatgtggatatgactacgagtgttgaattgacatcagagaagctgaagaagctgggctggaaacctaggaaactcgaggagacgcttgtcgacagcgttgaatcctacaagaaggcaggctttgtagatgacgaaccttgccggcttccccatctttaccgtgcaccagatgctcaggagtgaacagccggcgccgtcttgctgctactgttcttgatctaattgtcactgaaaaaaaaagtttccaataatactgtaatagatgagggatcaggtgttcctgtccagtgtccacattatcatctgctctgttccattagtgaattgattcagcctgtgatcaatgacacaatttatgcctggcaataattgaatattgtctactgattaagatggacaattgtgtgtgtaattttaatatatccgccacccgatt

SEQ ID NO: 4849 - protein, 343 aa, Oryza sativa
MTPPPPPPRRPVCVTGAGGFTGSWLVKLLLSRGYAVHATLRDPDDPKNAFLKQLENAPENLRLFKADVLDGGSLTAAFAGCEGVFHPATPVPEHKTVDPEKEMLAPAVKGTRNVLEACSAASVQKLVVVSSICAVCFNPSLPRDRLIDETCWSDKKSCKENENWYCLAKTEAEEMALEYSEKNGLHVITVCPGVIFGPLLQTVLLNTSSKVLLYIMKGGPDALSNKFFPIVDVRDVADALLLVYDKAGPSERYICSQEQMDMRDLLDLMKSMYPNYSYTAKVVDVDMTTSVELTSEKLKKLGWKPRKLEETLVDSVESYKKAGFVDDEPCRLPHLYRAPDAQE

SEQ ID NO: 4850 - DNA, 1101 bp, Oryza sativa
  CDS (1)..(1101)
atgtacaacatttcttggtcctcctcctctaggatatttctttgctgtgcttatatgagcaggttgatttgcttcagagttcaacatcatcacttccagtttgagaaaatggtgatctcatccaagggcaaagtgtgtgtaactggtgcttcaggcttcgtcgcctcttggctcatcaagaggcttcttgaggcgggctatcatgtgataggaactgtgagagacccaagcaatcgcgataaagtgtcacacctttggagattaccaagtgcaaaggagaggctgcaacttgtgagagctgatctgatggaagaagggagctttgacgatgctgtgatggcttgcgaaggcgtcttccacactgcatcgcctgtccttgccaaatctgattccaattgcaaggaagaaatgcttgttcctgcgataaatggtactctgaatgtgctgaaatcttgcaagaagaatccatttctgaaaagggttgttcttacatcctcatcatccacggtaagaatcagggatgagagtaaacatccagaaatctcactggatgaaacaatatggagctctgtggcactctgtgaaaagctacagctatggtatgccctggcaaagatatctgcagagaaagcggcatgggagtttgccaaggagaacaacattgaccttgtaactgttcttccatcatttgtgattgggcccagtttatcacatgaactgtctgtcactgcttcagacatccttggcttacttcaaggtgacacagatagattcatctcgtatgggagaatgggatatgttcacatcgacgatgtggcgagctgccacattctggtgtacgaagcacctcaggctactgggagatatctctgcaactccgttgttcttgacaacaacgaattagtcgccttgcttgcgaagcaatttccaatttttcccatcccaaggagcttgaggaacccatatgagaaacagtcatatgagctaaacacatccaagatccagcagctgggtttcaagttcaaaggggtgcaagagatgtttggtgattgtgtcgagtcgctgaaagatcagggacacttgctggagtgcccgttgtaa

SEQ ID NO: 4851 - protein, 366 aa, Oryza sativa
MYNISWSSSSRIFLCCAYMSRLICFRVQHHHFQFEKMVISSKGKVCVTGASGFVASWLIKRLLEAGYHVIGTVRDPSNRDKVSHLWRLPSAKERLQLVRADLMEEGSFDDAVMACEGVFHTASPVLAKSDSNCKEEMLVPAINGTLNVLKSCKKNPFLKRVVLTSSSSTVRIRDESKHPEISLDETIWSSVALCEKLQLWYALAKISAEKAAWEFAKENNIDLVTVLPSFVIGPSLSHELSVTASDILGLLQGDTDRFISYGRMGYVHIDDVASCHILVYEAPQATGRYLCNSVVLDNNELVALLAKQFPIFPIPRSLRNPYEKQSYELNTSKIQQLGFKFKGVQEMFGDCVESLKDQGHLLECPL

SEQ ID NO: 4852 - DNA, 1310 bp, Glycine max
  CDS (36)..(1013)
  misc_feature (1293)..(1293): n is a, g, c or t
  misc_feature (1294)..(1294): n is a, g, c or t
tacggctgcgagaagacgacagaagggggaagaatatgagcagcagtgcagggaagttggtgtgtgtcaccggtgctgccggttatattgcttcatggattgtcaagttcctacttgaacgtggttacactgtcagggccactgttcgaaacccaaatgatcacacgaaggtagaacatttgctaaaacttgaaggtgcaaaggagagactgcacctttttaaggcagatcttttgggtgaaaattcttttgactccattgttgagggctgtgatggcgtctttcatactgcttctccttttattatcaacgtcaaagacccacaggctgacctacttgacccagcagtgaagggaactcttaacgttcttaaatcatgtgtaaaatcgccatctgtgaaacgagtcatcttaacatcttctgtggctgcagttgcatataataaaaggcctaaaagtcctgaagttgtagttgatgaaacctggtggtctgatccagattactgtagggaattaaagctgtggtatttactttcaaagactttggctgaagatgctgcctggaaatttgccaaagaaaacgaccttgacttggttgttgttaacccagcaatggttgtagggcctcttttgcaagcagagcttaacactagtgctgctattattttaaacctaataaatggttcagaaactttttcaaatgatacatatggatggatcaatgtgaaagatgttgcaaacgcccatattcaggcatatgagattgcttcagctagtggaagatattgtttagttgagagagtggcacactactctgaactcgccaggattttacgtgatcagtacccgacatatcaaattccagaaaagtctgcagacgataagccttatgtaccaacatttcaggtttccaaagaaaaggcaaagaccttggggattgaatttattcctttggaagtgagtcttagagagacagtggaaactttgaaagaaaagaactttgccaacttttagtctctgatatctctgcttgatcaggagtgaacacgttgagaatctcaacggtgtttcgtttgtggttctggttttagaatctcattgcttgaaaataaactattgtactgaaatgtcaagcttgtgtgttgtaataaaacaagattaattgttggttttatttcggtttgtactcatgaaggaaaccaacgtgtggtataaaaagataataattaagtatcaggctatttctagtccaaaaaaaaaaaactataaaaataaaaaaatttttaattttaannttagcgcggccgccgc

SEQ ID NO: 4853 - protein, 325 aa, Glycine max
MSSSAGKLVCVTGAAGYIASWIVKFLLERGYTVRATVRNPNDHTKVEHLLKLEGAKERLHLFKADLLGENSFDSIVEGCDGVFHTASPFIINVKDPQADLLDPAVKGTLNVLKSCVKSPSVKRVILTSSVAAVAYNKRPKSPEVVVDETWWSDPDYCRELKLWYLLSKTLAEDAAWKFAKENDLDLVVVNPAMVVGPLLQAELNTSAAIILNLINGSETFSNDTYGWINVKDVANAHIQAYEIASASGRYCLVERVAHYSELARILRDQYPTYQIPEKSADDKPYVPTFQVSKEKAKTLGIEFIPLEVSLRETVETLKEKNFANF

SEQ ID NO: 4854 - DNA, 1641 bp, Glycine max
  CDS (328)..(1305)
tttagtttttacacgtatcatattagttcatgcttggattaaagtttacagacgggaggttgcaaaagcaagccaggcctggccttttcataacatattttccaggctaaactctattgttcaaacgttctttttagatgcactgaaccagaacgcagacttgatcccgcgtttacagcactacagttccacagcattagccattagcactataaataaatagagaacacgcgaaacacctgattcccctccccagacgccgcagagtcagagagagagattcactgaaacagagcgcagaagaaaatacataaactaatccagaaaatgagcagcggcgctggaaaggtggtgtgtgtcaccggcgcttccggttacattgcttcctggatagtcaaattcctcctcaatcgcggctacaccgttaaggccaccgttcgcgacacaagtgatccgaaaaaaataaaccacttggttggcctcgacggtgctaaggagaggctgcacctctacaaggcgaatcttcttgaagaaggttcctttaactctgtcgttcaaggttgccatgctgtgtttcacactgcttctcccttttatcacaatgtcaaggacccccaggctgaattgttagacccagctttgaaggggactctcaatgttctgaaatcgtgtgtaaacttgccgacgctggaacgcgttgttttaacctcttctgttgctgcagttgcgtacaacggaaagcctcgaactcccgatgtagtagttgatgagacttggttttctgacccgggtttctgtagggaatcacagatgtggtatacactttcaaagactttggccgaagatgctgcctggaaattcgtaaaagagaacaacattgacatggttactattaacccagcaatggtgataggacctctcttgcaaccagtccttaacacaagtgctgcttcaattttaaacgtaattaatggtgcacaaacatttccaaatgcatcttttggttgggtcaatgtgaaagatgttgcaaatgcccatattctagcatatgagaatgcttcagctaatggaaggtattgtttggtggagagagtggcacactactcagaaattgtgaagattttacgtgatttgtacccgacattacaacttccagagaagtgtgcagatgataacccatatgtgccaatatatcaggtatccaaagaaaaggcaaagagcttggggattgaatatactcctttggaagtgagcctcaaggagactgtggatagcttgaaagaaaagaagtttaccaacttttaatttgtgatatctcctagaggagaaaacgttaataatagaaaccttgtgtggttggtcacttggcttgtgatgctcatgcttctgaacaaacttactattaaataagacttaaatcaagattggtataagtactgaaagaaaccattcttggtctgatttgtaccggtgacaattaagtttcaaacatgcgtttccaagtagagtttgcattacaaattgtatccccgtttttattatattactaggaaatgtctgatgcaaccaatgttgttaaataactgttatggttagcgccataacactataatgtggcgattttggacccctttgcaaaaa

SEQ ID NO: 4855 - protein, 325 aa, Glycine max
MSSGAGKVVCVTGASGYIASWIVKFLLNRGYTVKATVRDTSDPKKINHLVGLDGAKERLHLYKANLLEEGSFNSVVQGCHAVFHTASPFYHNVKDPQAELLDPALKGTLNVLKSCVNLPTLERVVLTSSVAAVAYNGKPRTPDVVVDETWFSDPGFCRESQMWYTLSKTLAEDAAWKFVKENNIDMVTINPAMVIGPLLQPVLNTSAASILNVINGAQTFPNASFGWVNVKDVANAHILAYENASANGRYCLVERVAHYSEIVKILRDLYPTLQLPEKCADDNPYVPIYQVSKEKAKSLGIEYTPLEVSLKETVDSLKEKKFTNF

SEQ ID NO: 4856 - DNA, 1476 bp, Glycine max
  CDS (50)..(1027)
  misc_feature (1461)..(1461): n is a, g, c or t
aaaacttgaaagtagggtgtttttttttttaaagtaaggaagaaagaagatgagcagcaactcaggaaaagtggtgtgtgtgactggtgcttctggtttcattgcttcatggatcatcaaactgcttctccaacgtggttacactgtcagggccactgttcgcgacccatctaaacccgaaaaggttgatcacttgctcaaacttgatggtgcaaaggagaggctacatctctttaaggcagatctgctggaagaaggttcctttgactctgcttttgagggttgtgatggtgtctttcatactgcttcacccgttcatttcattgttactgatccacagaatcagttaattgatccagcgattaaaggaacccttaacgttgttaaatcatgtgccaaatcgccatctgtgaaacaagttattttaacttcttctgttgctgccgttttatataatggaaggcctcgtacccccgaggttgtagttgacgagacttggttttcggatccagacttcttaagggaaaatgagaggtggtatgcatttgcaaagacttcggcagaggatgctgccaggaaatttttaagcgaatacgacattaagttggttgttattaacccatcaatgtccatagggcctctcttgcaaccagagctgaatgcaagttcttcttcaattttaaacctaatcaatggttcaccaacgttttcaaataatagttttgggtggatcaatgtgaaagatgttgcaaacgcgcatattcaagcatatgagattgattcagctagtggaagatattgtctggttgaaagagtgatacacttctccgaacttgcaaaaattttacgtgatatgtacccaactttacagattccagacaagtgtgaagacgatgagccttttatgccaacatttcaggtttccaaagaaaaggcaaagagcttgggagttgaatttattcccttggaagtgagcctcagggagacagttgaaagtttaaaagaaaagaagtttgtggacttctagttcgtgatatctcctagaagaataaatattgataacactaactttgtctagtcagtgattttggtttcagaaactccatgcttaaggggaaattattaatgcgaaataaggcttgtattaatcaaaatatacaagtcggattgaatttgttttgaacttatgactttgctttgcatttacaattgtggaaatttctatatctttaaggtagaaaaagaggcatttttagggtggtcccttgaatttgaatggagcttggggattgaatttattcctttggaagtaagtctttgggagactgtggaaagcttgaaagacaagaagtttcccaatttttatttcttcatgtctctccttgatcaggagtgaacgttgataatgggaatggcatttcgtcaatgattaaggttttcatacccctatgctttaaaatnaattaatagaagtat

SEQ ID NO: 4857 - protein, 325 aa, Glycine max
MSSNSGKVVCVTGASGFIASWIIKLLLQRGYTVRATVRDPSKPEKVDHLLKLDGAKERLHLFKADLLEEGSFDSAFEGCDGVFHTASPVHFIVTDPQNQLIDPAIKGTLNVVKSCAKSPSVKQVILTSSVAAVLYNGRPRTPEVVVDETWFSDPDFLRENERWYAFAKTSAEDAARKFLSEYDIKLVVINPSMSIGPLLQPELNASSSSILNLINGSPTFSNNSFGWINVKDVANAHIQAYEIDSASGRYCLVERVIHFSELAKILRDMYPTLQIPDKCEDDEPFMPTFQVSKEKAKSLGVEFIPLEVSLRETVESLKEKKFVDF

SEQ ID NO: 4858 - DNA, 1415 bp, Glycine max
  CDS (88)..(1104)
cggctcgagcatctctgatctcactcaccattcaccaacctgcttctctgttctcttctttcccttcccaagaagaagaagaagaagatgccttcttcagaatcatcaacaggcttctccgaaaccatttgtgtgaccggcgctggtggcttcatcgcctcttggatggtcaaactcctcttggagaaaggctacactgtccgaggaaccctcagaaacccagatgatcccaagaacgggcacttaaaagagtttgaaggagcttcccagagactaactctgcataaggttgacctccttcatcttgactccgttagatctgttattaacggctgtcatggtgtctttcacactgcttctcccgtcaccgataaccccgaagaaatggtggagcctgcggtgaatggagctaagaatgtgatcatagcagctgcagaggctaaagttagacgcgtggtgttcacctcatccattggtgccgtttacatggaccccaaaaggagcatcgatttggtggttgacgagtcctgttggagtgatttagaattttgcaagaacaccaagaattggtattgctatgggaaggctgtggctgaagaagcggcatgggacacagcaaaagagaaaggggtggacatggttgtagtgaacccagttttggtacttggaccattactgcaacccagcataaatgctagtacaattcacattctcaagtacctcactggctctgctaagacctatgcaaatgccacacaggcttatgttcatgttagggacgtggcattggcccacatacttgtttatgagaagccttctgcctctggtagatacatatgtgccgaaagctctctccaccgtggagaattagttgaaattctcgccaagtatttccccgactacccagttcccaccaagtgttcagatgaaaagaatccgagagcaaaaccctacactttttcaaatcaaaaactgaaagatttgggattggaattcaccccagtgagtcagtgtttatatgaagccgtcaagaacctgcaggagaaagggcaccttcctgttcctgcaaggcagcaggaagattcaactactgtgaaaccttaaacgagctatccctttttatctaatttgtcaacaaacaagaagctgcagcttttggcaatctgggctcatcttatattattatagagaatcctacattagaagatttctgtatttggatttcgtaaaaaaaaaaaagacatcgaccaaattgttgccatgtatgaacttgataatattagtggaatttattcctcttgttgagttgaattattctgctcctcaagctcttttatctatcttaaaagaaattgtattctttaatatttttttaaataatattatgccatgcaatcccaagatgggagagaaaa

SEQ ID NO: 4859 - protein, 338 aa, Glycine max
MPSSESSTGFSETICVTGAGGFIASWMVKLLLEKGYTVRGTLRNPDDPKNGHLKEFEGASQRLTLHKVDLLHLDSVRSVINGCHGVFHTASPVTDNPEEMVEPAVNGAKNVIIAAAEAKVRRVVFTSSIGAVYMDPKRSIDLVVDESCWSDLEFCKNTKNWYCYGKAVAEEAAWDTAKEKGVDMVVVNPVLVLGPLLQPSINASTIHILKYLTGSAKTYANATQAYVHVRDVALAHILVYEKPSASGRYICAESSLHRGELVEILAKYFPDYPVPTKCSDEKNPRAKPYTFSNQKLKDLGLEFTPVSQCLYEAVKNLQEKGHLPVPARQQEDSTTVKP

SEQ ID NO: 4860 - DNA, 1330 bp, Glycine max
  CDS (131)..(1132)
tcgtacggctgcgagaagacgacagaagggggccacactcatcatattccataagcatcttcttccatcaccgcattattcatcttttctcttctcattcaccaattcacaattcattttatttcttaagatgccaactgacacgtcatcagtttccggcggcgaaatcgtgtgtgtgaccggtgccggcggtttcatagcctcttggcttgtcaaacatctcttagagaaaggctacactgtgagaggaaccgtgagaaacccagatgatccgaagaatggtcatttgaaagagttggaaggaggcaaggagaggctaactctgcataaagttgatctcttcgatattgactccattaaagaagctcttaacggttgccacggtgtcttccacactgcttctccagtcaccgacaaccctgaagagatggtagagccagcagtgaatggaacgaagaatgtgatcacagcagcagcagaagcaaaagtgcgacgggtggtgttcacttcgtcaattggcacagtctacatggaccccaatacgagtagggatgcgttggtcgatgaatcattctggagtgatttggagtactgcaagaacaccaagaattggtattgctatggaaagacggtggcagaacaaacagcatgggatgtagcaaaagagagaggggtggacttggttgtggtgaacccagttttggtaattggaccattactgcaacccaccattaatgctagtacaattcacatcctaaagtaccttactggctctgccaagacttatgtaaatgcaactcaggcttatgtacatgtgagggatgtggcattagcccacatacttgtttatgagaagccttcagcttctggtcgatacatatgtgccgaaagctcgctgcatcgtggtgagctagttgaaattttggccaagtttttccccgagtacccaattcctaccaaatgttcagatgaaaagaacccgagagtaaaaccctacatattttcaaatcaaaagctgaaagatttgggattggaattcaccccagtgaagcagtgtctatatgacaccgttaaaaatctgcaagagaatggccaccttcctgtccccccaaagcaaaaagattcctattgaagttagatcctacctagctaggttgccataaattaattaacaagtttaattctggtacaaattacaattgtagttgttaatcaatttatatttaatccttagaagtacgtattttcagtttttaagacacacaccacacaaattgttgccttttgtaaaagtataaccgataacattaatggattatattttgtcccc

SEQ ID NO: 4861 - protein, 333 aa, Glycine max
MPTDTSSVSGGEIVCVTGAGGFIASWLVKHLLEKGYTVRGTVRNPDDPKNGHLKELEGGKERLTLHKVDLFDIDSIKEALNGCHGVFHTASPVTDNPEEMVEPAVNGTKNVITAAAEAKVRRVVFTSSIGTVYMDPNTSRDALVDESFWSDLEYCKNTKNWYCYGKTVAEQTAWDVAKERGVDLVVVNPVLVIGPLLQPTINASTIHILKYLTGSAKTYVNATQAYVHVRDVALAHILVYEKPSASGRYICAESSLHRGELVEILAKFFPEYPIPTKCSDEKNPRVKPYIFSNQKLKDLGLEFTPVKQCLYDTVKNLQENGHLPVPPKQKDSY

SEQ ID NO: 4862 - DNA, 1236 bp, Oryza sativa
  CDS (1)..(1236)
atgtcgtccaacaattccatggaggccaacaatggcgatgatgagaagaagcaagagcaggtggtgtgcgtgacgggagcgggaggcttcatcgggtcgtgggtggtgaaggagctcctcctccgcggctaccgcgtgaggggaacagccagggatccccgcaagaacgcccacctgcttgatcttgagggagccaaggagaggctgacactgtgccgcgccgacgtcctggacttcgccagcctacgcgccgcgttcgccgggtgccatggcgtcttccacatcgcctccccggtgtccaaggaccctaatctggtgccggtcgcgattgaggggacgaggaacgtgatgaaggcggcggcggacatgggcgtgcggcgcgtggtgttcacgtcgtcgtacggcgccgtgcacatgaaccccaaccggagccccgacgccgtcctcgacgagtcctgctggagcgaccccgaattctgccagcgagaggacatatactgctacgccaagatgatggcggagaagacggcgacggaggaggcgtcgaggcgtcggctgcagctcgcggtggtggtgccgtgcgtgacggtgggtcccatcctgcagccgtccgtcaacttcagctgccaccacgtcgtccgctacctcaccggcgccgcggccacctaccccaacgccgtcgccgcctacgccgacgtccgcgacgtcgcccgcgcccacgtcctcgtctacgagcaccacggcgcgcgcggccgctacctctgcatcggcaccgtcatccaccgcgccgagctcctccggatgctcaaggagctcttcccccagtaccccgtcacttcaaagtgtgaggatgaggggaatcagatggtgaagccgtacaagttctcgaaccagaggctcagggatttgggtttggagtttactccactgaggaagagcttgcatgaggcgatcgaatgtctgcagcgcaagggtcacctgcctgttgtcacggtggcacaacagcgtgcataccaatggcaatatccttgcacgaagaggtttttccaaagcggtgcccccaaggaggatgcgacgtggatcgccgccaccgcttgttcggaatcgaagcaaggttttcacccggagaatatgcgattcggccaagaccaccgcccacagttcttcccgccgtcgacgacgcgcccgcacccggactcctccttccccgcctccacatatcacctccgccgatga

SEQ ID NO: 4863 - protein, 411 aa, Oryza sativa
MSSNNSMEANNGDDEKKQEQVVCVTGAGGFIGSWVVKELLLRGYRVRGTARDPRKNAHLLDLEGAKERLTLCRADVLDFASLRAAFAGCHGVFHIASPVSKDPNLVPVAIEGTRNVMKAAADMGVRRVVFTSSYGAVHMNPNRSPDAVLDESCWSDPEFCQREDIYCYAKMMAEKTATEEASRRRLQLAVVVPCVTVGPILQPSVNFSCHHVVRYLTGAAATYPNAVAAYADVRDVARAHVLVYEHHGARGRYLCIGTVIHRAELLRMLKELFPQYPVTSKCEDEGNQMVKPYKFSNQRLRDLGLEFTPLRKSLHEAIECLQRKGHLPVVTVAQQRAYQWQYPCTKRFFQSGAPKEDATWIAATACSESKQGFHPENMRFGQDHRPQFFPPSTTRPHPDSSFPASTYHLRR

SEQ ID NO: 4864 - DNA, 1556 bp, Oryza sativa
  CDS (253)..(1338)
tttgagccggagcgagttggctttgttgtgttgagccctttcctgggcccacgcattcggcatcacgctccaacgcatccgcccacgcgtacccagctaccaaatcgaacctaccaactcattcccgatcgatcgatcttaaaaaaaaactaatcgtaacttttctctctctctcctatctttagaactagcaggtagcaactgcttcgagtgtagtctggtgaacgtacgatctttcgttcgttcatcaagatgaccgtgatcgacggcgccgtcgctgccgacgccggcggcgcagccgcggcggtggtgcagccggggaacgggcagaccgtgtgcgtgaccggcgcggccgggtacatcgcgtcgtggctcgtgaagctgctgcttgagaagggctacactgtcaagggcaccgtcaggaacccagatgacccgaagaacgcgcacctgaaggcgctcgacggcgccggcgagcggctggtgctctgcaaggccgacctcctcgactacgacgccatctgccgcgccgtcgccggctgccacggcgtcttccacaccgcctcccccgtcaccgacgaccccgagcagatggtggagccggcggtgagggggacggagtacgtgataaacgcggcggcggaggccggcacggtgcggcgggtggtgttcacgtcgtcgatcggggcggtgaccatggaccccaaccgcgggcccgacgtcgtcgtcgacgagtcctgctggagcgaccttgactactgcaaggaaaccaggaactggtactgctacgggaaggcggtggcggagcaggcggcgtgggaggcggcgcggcggcgaggggtggagctggtggtggtgaacccggtgctggtgatcgggccgctgctgcagccgacggtgaacgccagcgtcgcccacatcctcaagtacctggacggctcggccagcaagttcgccaacgccgtcggccgctacgtcgacgtccgcgacgtcgccgccgcccacctcctcgtcttcgagtccccttccgccgccggccgcttcctctgcgccgagtctgtcctccaccgcgagggtgtcgtccgcatcctcgccaagctcttccccgagtaccctgtccccaccaggtgctccgacgagaagaaccccaggaagcagccgtacaagatgtcgaaccagaagctccgggacctggggctggagttccggccggcgagccagtcgctgtacgagacggtgaagtgcctccaggagaagggccacctgccggtgctcgccgccgagaagacggaggaggaggccggcgaggtccagggcgggattgccatccgagcatgaggaaaacagcagagcaaaagagcaggaaaaatgtccatatcgtgttagtgtttaccgtgctgtaaaaccaaagtagtagtgttcgctggtttgtctggtctgaagccctgtaatacacccctgttgttgttacatgtgcaccagagtgaccgaataagtatttctatgaagttctctatgttcacaaaaaaaaaaaaaaaaaaaaaaaaaaaaaaaaa

SEQ ID NO: 4865 - protein, 361 aa, Oryza sativa
MTVIDGAVAADAGGAAAAVVQPGNGQTVCVTGAAGYIASWLVKLLLEKGYTVKGTVRNPDDPKNAHLKALDGAGERLVLCKADLLDYDAICRAVAGCHGVFHTASPVTDDPEQMVEPAVRGTEYVINAAAEAGTVRRVVFTSSIGAVTMDPNRGPDVVVDESCWSDLDYCKETRNWYCYGKAVAEQAAWEAARRRGVELVVVNPVLVIGPLLQPTVNASVAHILKYLDGSASKFANAVGRYVDVRDVAAAHLLVFESPSAAGRFLCAESVLHREGVVRILAKLFPEYPVPTRCSDEKNPRKQPYKMSNQKLRDLGLEFRPASQSLYETVKCLQEKGHLPVLAAEKTEEEAGEVQGGIAIRA

SEQ ID NO: 4866 - DNA, 1370 bp, Oryza sativa
  CDS (1)..(1143)
atgaccaattcccctcacccaaaatccatccccatctccacagcttggccggaggtgccatgggtggaggtgcctttggcggagcttggtccggttggtgacaatggatatgggcaagccattgatccggttggagattgtgattttcttcccccatgcgctattttctcgatggatgatgggatagcgtttctgctgggaatgcttgaaggagcaggaggcttcattgggtcgtgggtggtgaaggagctcctgatccgtggctatgccgtgagaggaactgcaagagatccatctagtcaaaagaactcccatttgcaaaaacttgaaggagccaaagagaggctctgtctgaactatgcagatgtgatggactttgatagtctttctgttgcatttaatggatgtgaaggtgtattccatgttgcctcacctgtatccgttgatccgcgacttgtgcccgttgctgttgaaggaactaagaacgtgatcaacgctgcagcagacatgggcgtacgacgcgtggtgttcacatcaaccttcggtgctgtacacatggacccaaataggagccatgatacagtcgtggatgagagctgctggagtaaccttgagttctgcaaacaaaaagactggtactgttatgccaaaacggttgctgagatggtagcagcagagcaggcatcgaagagagggattcagctagtggtggtgcttcctgccatgacactaggccagatgttgcaatcaaccataaaccctagcatcagacatatcgccgatttcttgaacggaagcaggaaaacccaccggaatgctgtcgctgggtatgttgatgcgcgcgatgtggcccgtgcacatgcactggtgtatgaagaccccaaggcgcatgggcgttatctctgcattgctagtgtgcttcaccggtccgagcttattcagatgatcagagaactctttccacagtatccaatcacctgtaacaagtgtgaagacagcaagcagatggtccaacctttcaagttctctaatcaaaggctgagagacttgggcctcacattcacccccataaaagaaagtttgtacaacacactgatatgcctacgggagaaggggcacctaccgccttattcatctctttgaggacaggagaaattccgtccggttctatgcatccttcgtgtatcatcatggtattatataaatgtaatgagttagtcgtgcttgtttgctagctgttgtgttgaactgtatgtttcgcatgaatcatgtcttgcttctttgttagctgttggccctgttgtgttgaactgtattgtggatttttttaccatcctagcttgagaattgagatggcatctccatgtacc

SEQ ID NO: 4867 - protein, 380 aa, Oryza sativa
MTNSPHPKSIPISTAWPEVPWVEVPLAELGPVGDNGYGQAIDPVGDCDFLPPCAIFSMDDGIAFLLGMLEGAGGFIGSWVVKELLIRGYAVRGTARDPSSQKNSHLQKLEGAKERLCLNYADVMDFDSLSVAFNGCEGVFHVASPVSVDPRLVPVAVEGTKNVINAAADMGVRRVVFTSTFGAVHMDPNRSHDTVVDESCWSNLEFCKQKDWYCYAKTVAEMVAAEQASKRGIQLVVVLPAMTLGQMLQSTINPSIRHIADFLNGSRKTHRNAVAGYVDARDVARAHALVYEDPKAHGRYLCIASVLHRSELIQMIRELFPQYPITCNKCEDSKQMVQPFKFSNQRLRDLGLTFTPIKESLYNTLICLREKGHLPPYSSL

SEQ ID NO: 4868 - DNA, 1068 bp, Oryza sativa
  CDS (1)..(1068)
atggacgacggcgctgccgccgccgccgccgcagggagggagacgacgaagaacaagaagaagacggtgtgcgtcaccggcgccggcggcttcgtcgcctcgtggctcgtccatcgcctcctctcctccggcgactacgtcgtgcatggcaccgtccgtgacccaagtgatgccaagaacggtcacctgagggagatggactacggcgccggcgagcggcggctgcggctgttcaagcccgacgtgctggaccgcgccagcgtggccccccccgtcgccggctgcgccggcgtcttccacgtcgccagccccgtccccgcctccaagccccacaaccccgaaatcacattagaaactaaacccggaagaaacgtcgcggaggtgctggctccggcggtggcgggaacgcggaacgtggtcgaggcgagccacgaggcgggcgtcccccgcgtcgtggtggtgtcctcccccgcccccgtcatcctcaacccggccttcccccgcgacgccgtcctcgacgaggacgcgtggtcggacgagcactactgccgatccatagagaactggtactgcctctccaagacgctcgccgagcgcgaggcgtggcgtttcgcggctgacaacgccgccgccatggacgtcgtcaccgtctgtccgccattaattcttggacctctgctccaatcgaccgtgaacaccagcagctccatcctcatcaacctgatcaaaggcggcggcggtgatgatgaggagaaggccgccaccacggacaagaggaggaacgtggttgacgtgcgtgatgtcgccgccgcactcatcctgacgtacgaaaatccggcggcttccggccgctacatctgcagcgcatacgacatcaaggtgtctgaaatggttgacatcgtcaggcgcttcttcccggatatcaactacccaaagtttgtgggaggggaggatgagaggattttgagctccaagaagctgcagaagctggggtggaagttcaggacggtggaggaatgcctgagggatagcgttcaatcctacaaggctgctgggatcctgaaatga

SEQ ID NO: 4869 - protein, 355 aa, Oryza sativa
MDDGAAAAAAAGRETTKNKKKTVCVTGAGGFVASWLVHRLLSSGDYVVHGTVRDPSDAKNGHLREMDYGAGERRLRLFKPDVLDRASVAPPVAGCAGVFHVASPVPASKPHNPEITLETKPGRNVAEVLAPAVAGTRNVVEASHEAGVPRVVVVSSPAPVILNPAFPRDAVLDEDAWSDEHYCRSIENWYCLSKTLAEREAWRFAADNAAAMDVVTVCPPLILGPLLQSTVNTSSSILINLIKGGGGDDEEKAATTDKRRNVVDVRDVAAALILTYENPAASGRYICSAYDIKVSEMVDIVRRFFPDINYPKFVGGEDERILSSKKLQKLGWKFRTVEECLRDSVQSYKAAGILK

SEQ ID NO: 4870 - DNA, 1094 bp, Oryza sativa
  CDS (29)..(994)
gtgttgaggaagtcggaagtccgaaggcatggcagcggcggcggcgaggcagacggtgtgcgtcaccggcgccggggggttcatggcctcgtcgcacgtcgagctgctcctctcccgggggaactacgcggtccgcggcaccgtgcgggatccaggtgatgccaagaatgatcatctcagggcgctacaaggtgccgaggagaggttgcagctgctcaaggctgatctgttggactatgacagtgtagcttcagcggttgccggctgtgagggcgtcttccatgtcgccagccctgtaccctcgggccgatccaccaaccctgaggtagaggtcatagctcctgctgtaacaggcacacttaatgtgttgaaggcctgccatgaggcaaaagttaagcgagttgtcatggtgtcttccattgctgccgtgttcagtaatcctaactggccaaaggataaggctttcactgaagacagttggtcagatgaggaattatgcagaaagaatcaggattggtattacctttcgaaaacggtggcagagcgtgaggcttttgcttatgcagcaaaaactgggctggacattgtaactatttgcccatcattggtgattggacccttaatgcaatctacagtaaacgcgagtagtaaagttctcattaactatttcaaaggagatcgtgacactgtcgaaaatagactccggaatgtagtggatgttcgtgatgttgccaatgctctccttttggcgtatgaaaatccagcatccggacgatacatctgcagctcagctccaataagagtctctgatatgataaacattttaaagaccttatatccaacttatacttatcccaaaaactttgtggatgtggaagagaacaccatatacagttttgagaaacttcagaagcttggctggagtttcaggcctattgaggaaaccctccgggacagcgtggaatcctacaaagcatttggcatccttgattgaggatccaaactgtgagaacttcagtgtctgttaaactctccatgattcatgtaatctgtgttgagatcaaccgggtcaataaagaatcgttattaaaacc

SEQ ID NO: 4871 - protein, 321 aa, Oryza sativa
MAAAAARQTVCVTGAGGFMASSHVELLLSRGNYAVRGTVRDPGDAKNDHLRALQGAEERLQLLKADLLDYDSVASAVAGCEGVFHVASPVPSGRSTNPEVEVIAPAVTGTLNVLKACHEAKVKRVVMVSSIAAVFSNPNWPKDKAFTEDSWSDEELCRKNQDWYYLSKTVAEREAFAYAAKTGLDIVTICPSLVIGPLMQSTVNASSKVLINYFKGDRDTVENRLRNVVDVRDVANALLLAYENPASGRYICSSAPIRVSDMINILKTLYPTYTYPKNFVDVEENTIYSFEKLQKLGWSFRPIEETLRDSVESYKAFGILD

SEQ ID NO: 4872 - DNA, 1324 bp, Zea mays
  CDS (124)..(1083)
gctgtagcaataattgaagaaacgtccggatcgctcgtccggtgtggtctctggacgacttgccattcacttcttcagcggcagcgtggcaacgagagcaacgaagtattcaaaccgaaaacaatggagccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacaacagcattgcatcagcagttgccggctgtgagggtgtcttccatgtagccagtcctgtcctttcccatcgaccctccaaccctgaggtggaggtcatagctcccgctgtaataggtacaaccaatgtgttaaaggcttgctatgaggcaaaagttaggcgagttgtggtggtgtcttcatgtggagctgtgtatgctaatcctatttatccgaagggtaaggtgtttgatgaagactgctggtcagatgaggattactgcaggaagaaggaggattggtatttagtttccaaaacactgtcggaacgagaagctcttgcttttgcagcaaaaacagggctggacgttgtaactgtttgtccgtcattagtatttggacccttgatgcagcctacagtaaatttgagcagcgaaatgatccttaaatatttcaaagatctcgagactgttgaaaatgtactcagtaatatggtggatattcgtgatgttgctgatgctcttcttctgacttacgaaaagccagaagcgtctggacgatacatctgcagttcacatgcaataaaaatttctgatatgataaacatactgaagaccatgtatccgtcttacccttatcccaaaaattttgtggaagatgatgtcaactctgtatacagctctgagaaattgcagaagctggggtggagcttcaagcctatagaggaatccctccgtgacactgttgaatcctacaaagcatttggcatcctgaattgaacatccagctacgactgttccatctgctgtttttgcctccgaacttctcctgaataatgtaggcgcagtgaaacagcagcagtgccgttctctttatttttcaacattattatgtagtggttcaagaccaaataagtaggccaggtgctgactgttgtatggtttgtggcctattgtcgttgctaaaaactagaaatgtgcgtactaatgttgcattgctgcaaccggccttgtttgtcgt

SEQ ID NO: 4873 - protein, 319 aa, Zea mays
MEPVRKSVCVTGAGGFVASELVKLLLSRGQYAVRGTVRDPGASKNAHLKVLEGAEERLQLLKADLMDYNSIASAVAGCEGVFHVASPVLSHRPSNPEVEVIAPAVIGTTNVLKACYEAKVRRVVVVSSCGAVYANPIYPKGKVFDEDCWSDEDYCRKKEDWYLVSKTLSEREALAFAAKTGLDVVTVCPSLVFGPLMQPTVNLSSEMILKYFKDLETVENVLSNMVDIRDVADALLLTYEKPEASGRYICSSHAIKISDMINILKTMYPSYPYPKNFVEDDVNSVYSSEKLQKLGWSFKPIEESLRDTVESYKAFGILN

SEQ ID NO: 4874 - DNA, 1414 bp, Zea mays
  CDS (207)..(1169)
  misc_feature (1406)..(1406): n is a, g, c or t
  misc_feature (1409)..(1409): n is a, g, c or t
tcgaggccggccgggccgggcacgactctcggcaacggatatctcggctctcgcatcgatgaagaacgtagcaaaatgcgatacctggtgtgaattgcagaatcccgcgaaccatcgagtttttgaacgcaagttgcgcccgaagccttctggcggagggcacgtctgcctgggcgtcacgcaacgaagtattcaaaccgaaaacaatggagccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacaacagcattgcatcagcagttgccggctgtgagggtgtcttccatgtagccagtcctgtcctttcccatcgaccctccaaccctgaggtggaggtcatagctcccgctgtaataggtacaaccaatgtgttaaaggcttgctatgaggcaaaagttaggcgagttgtggtggtgtcttcatgtggagctgtgtatgctaatcctatttatccgaagggtaaggtgtttgatgaagactgctggtcagatgaggattactgcaggaagaaggaggattggtatttagtttccaaaacactgtcggaacgagaagctcttgcttttgcagcaaaaacagggctggacgttgtaactgtttgtccgtcattagtatttggacccttgatgcagcctacagtaaatttgagcagcgaaatgatccttaaatatttcacaggagatcgcgagactgttgaaaacatactcagaaatatggtggatgttcgtgatgttgctgatgctcttcttctggcttacgaaaagccagaagcgtctggacgatacatctgcagttcacatgcaataaaagttgctgatatgataaacatactgaagaccttgtatccatcttacccttatcccaaaaatttcgtggaagatgatgacaactctgtatacagctctgagaaactgcagaagctggggtggagcttcaagcctatagaggaatccctccgtgacactgttgaatcctacaaagcatttggcatcctgaattgaacatccagctaggactgttccatctgctgtttttgcctccgaactctttctgaataatgtatgtaggcagtgaaacagcattgccagcaggttaatcctggcatcatgctggagcagcactgtagttctatctttttcttttttttttccatccccaatactatctagtggttcaggaccaaataagtaggcccagtgctgactggtttatggaaaaaaaaaaaaaaaaaaaataanaanagtag

SEQ ID NO: 4875 - protein, 320 aa, Zea mays
MEPVRKSVCVTGAGGFVASELVKLLLSRGQYAVRGTVRDPGASKNAHLKVLEGAEERLQLLKADLMDYNSIASAVAGCEGVFHVASPVLSHRPSNPEVEVIAPAVIGTTNVLKACYEAKVRRVVVVSSCGAVYANPIYPKGKVFDEDCWSDEDYCRKKEDWYLVSKTLSEREALAFAAKTGLDVVTVCPSLVFGPLMQPTVNLSSEMILKYFTGDRETVENILRNMVDVRDVADALLLAYEKPEASGRYICSSHAIKVADMINILKTLYPSYPYPKNFVEDDDNSVYSSEKLQKLGWSFKPIEESLRDTVESYKAFGILN

SEQ ID NO: 4876 - DNA, 1020 bp, Zea mays
  CDS (1)..(1020)
atggccggaggaggtgcaacggtgtgcgtgaccggagccggcgggttcatcgcctcgtgggtagtgaagctcctgctctcccgcgggtacaccgtgcacggcaccgtccgccacctcagtgacgagaagacaggccacctgaagcgcctggagaatgctgccggaaaccttaggatcttcaaggctgacctgctggactacgacgccatggcagctgcggtcgtcgggtgccagggggttttccatgtggccactcctgtgccttcggaggacctgactgacccagagctacaaatgctgggtcctgctgttaccggcaccacgaatgtgctcaaagctgcctccagcgcgaacgtccagcgagtggtggtggtgtcgtccatggttgccgtcgagatcagccccaaagattggcctgaaggtaaggtccgagatgagaggtgctggtcagaccgagagttctgcaggagcattgagagctggtacccggtggctaagatcatctcagaggaggcggcgctggcgtacgggcagcaaaccgggctcgacgtggtgactatcaatccagggttggtgttcggccccatgctgcagccgacggtcaacacgaccatccagttcctcatctacttcctcaaaggaggccccgacccggtgaagaacaagctctggcatatcgtcgacgtccgtgatgtggccgacgccatgctgctgctctacgaggtgcctgaagcgaccggcagacacatctgcgcgcctcatgttatcagtgcccgcgacctgctggatctgctgaagagcatgtaccctgactacccttgcattgccaacgagagcatacttgacagagaccacccagcgccgatgacctctgacaagctgaagaagatcgggtggagctgccgaccgctggaggagacgatcgtggacaccgtcgagtgctgcctgcgggctggatttctggaccatgtgggtggggagacttcctgtcgcttccctcctcttttaaaccagatctag

SEQ ID NO: 4877 - protein, 339 aa, Zea mays
MAGGGATVCVTGAGGFIASWVVKLLLSRGYTVHGTVRHLSDEKTGHLKRLENAAGNLRIFKADLLDYDAMAAAVVGCQGVFHVATPVPSEDLTDPELQMLGPAVTGTTNVLKAASSANVQRVVVVSSMVAVEISPKDWPEGKVRDERCWSDREFCRSIESWYPVAKIISEEAALAYGQQTGLDVVTINPGLVFGPMLQPTVNTTIQFLIYFLKGGPDPVKNKLWHIVDVRDVADAMLLLYEVPEATGRHICAPHVISARDLLDLLKSMYPDYPCIANESILDRDHPAPMTSDKLKKIGWSCRPLEETIVDTVECCLRAGFLDHVGGETSCRFPPLLNQI

SEQ ID NO: 4878 - DNA, 1260 bp, Zea mays
  CDS (41)..(1036)
gtaccccctcggacggccgggagagtgtctagctgagaacatggtgacctcaagcaagggcaaggtatgcgtaaccggggcctcaggctttgttgcctcttggcttatcaaacggctcctcgagtctggatatcatgtggtagggactgtcagggacccaggaaatcaccaaaagacagcccacctttggaaattacctggcgctaaagagaggctgcaaatcgtgcgagctgatctgttggaagaagggagcttcgacagcgccgtgatggcctgtgagggtgtattccacactgcatcccccgtcctcgctaaacccgactctactagcaaggaggacacgctcgtccctgcggtgaacggtactctgaacgtgctgagatcgtgcaagaagaacccgttcctgaaaagggtcgtccttacgtcttcgtcgtctgcggtgaggatcagggacgacggtggccagtccagtaacatctcgctggacgaaacgacatggagctccgtgccactctgcgagaagatgcatctatggtatgccctagccaaggtatttgcagagaaagcggcgtgggagttcgccaaggagaacggcatcgaccttgtgactgtcctcccgtcgttcgtgatcgggcccagtttgtcccacgaactatgcgttaccgcttcagacgtcctaggcctattccaaggcgacacggcaaggttcagctcgtacggaagaatggggtacgtccacatcgacgacgttgcgagcagccacatcctggtgtacgaggccccccaggccgccgggaggtacctgtgcagctcagtggtgctggacaacgacgagctggtctcctcgctcgcgaaacgctacccgatattccccataccccggaggctgaacagcccctacggcaagcagtcgtaccagctgaacacgtcgaagctgcaggggctgggcttcaagttcagaggggtgcaggagatgttcgacgactgcgtacagtcgctcaaagaccagggacacctgctggagtgccccctgtgaactgcgatggggtgcctccgcctgtgaacgcgccggttgggttgcgtcccgaacccgctgttaattcgtttttttttcttcaataattccacgtcatgtcacggtgtcctcgcgcagactgctactgtcagggcgtcatagctcacgggctctccggctacatgaataaaatgtcacgctagctcgtcatttgctttgccatttaaaaaaaaaaaaaaaaaaaa

SEQ ID NO: 4879 - protein, 331 aa, Zea mays
MVTSSKGKVCVTGASGFVASWLIKRLLESGYHVVGTVRDPGNHQKTAHLWKLPGAKERLQIVRADLLEEGSFDSAVMACEGVFHTASPVLAKPDSTSKEDTLVPAVNGTLNVLRSCKKNPFLKRVVLTSSSSAVRIRDDGGQSSNISLDETTWSSVPLCEKMHLWYALAKVFAEKAAWEFAKENGIDLVTVLPSFVIGPSLSHELCVTASDVLGLFQGDTARFSSYGRMGYVHIDDVASSHILVYEAPQAAGRYLCSSVVLDNDELVSSLAKRYPIFPIPRRLNSPYGKQSYQLNTSKLQGLGFKFRGVQEMFDDCVQSLKDQGHLLECPL

SEQ ID NO: 4880 - DNA, 1714 bp, Zea mays
  CDS (280)..(1395)
  misc_feature (1690)..(1690): n is a, g, c or t
  misc_feature (1691)..(1691): n is a, g, c or t
  misc_feature (1692)..(1692): n is a, g, c or t
cgcgccactccaacgcccacccttctcattggggccctcgaggccggccgggaggatgaatcggaagagagaatcctaccaaacctagctaccaactcgatcgtcgtcatcacgctcgaccgcacaactgcaccgaggggggaggagacctaaaaactactacatcttttatagctacacatctagctaaagatcgagaggggtaaataaggacacaagcgagcgctagccagaagagcagctgcaggtactattatcatcgtcgtcgtcgtcgccaggatgaccgtcgtcgacgccgtcgtctcctccaccgatgccggcgcccctgccgccgccgccgcaccggtaccggcggggaacgggcagaccgtgtgcgtcaccggcgcggccgggtacatcgcctcgtggttggtgaagctgctgctcgagaagggatacactgtgaagggcaccgtgaggaacccagatgacccgaagaacgcgcacctcagggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggagacggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccgcggccgagatgcagcagggagggatcgccatccgtgcctgagagggcgatgccacacatgaacacaaagcaatgttcatactgctgccctgcacctgcacctgcttcttcccctgctgtgtaaacaggcctgtgtttgttctggctgatagtgatgtaccctaagacttgtaacgtcatgttcgttcttgtgaactatagcgagtgaataaaactggttaatgttggatgttcaaaaaaaaaaaaaaaaaaaaaaaaaaaaaaaaaaaaaaaaaaaaaaaaaaaaaaaaaaaaaaaaaaaaaaaacgaaaaaaaaaaaaaaaaaaaaaaaaaaaannncctttgggttgttaccactgtt

SEQ ID NO: 4881 - protein, 371 aa, Zea mays
MTVVDAVVSSTDAGAPAAAAAPVPAGNGQTVCVTGAAGYIASWLVKLLLEKGYTVKGTVRNPDDPKNAHLRALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEQAAWETARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPAAEMQQGGIAIRA

SEQ ID NO: 4882 - DNA, 1475 bp, Triticum aestivum
  CDS (88)..(1209)
attcttttgttgctgccaccgcaccgctggtcatcgatcacgacttgcgtggcgaccaaagcagcagccaccaacatctgtgcataaatgcacacacgtccgtacttgagttgcctctcagcagccagagaaatagagccctgtgctagagctattgccaggagaagagagctcagctcggtagtgatcatcggcgatatggcgacgaggaggaagacggcgtgcgtcaccggcggcagcgggtacatcgcgtcggcgctggtgaagatgctgctggagaagggatacgccgtcaagaccaccgtcagaaaccccgatgacgcggagaagaacgcgcatctcaaggccttggcagcgctcggctccttggaggtcttccgcgccgatctgaacgaggagggcagcttcgaccacgccgtcgccggctgcgactacgccttcctcgtcgccgctccggtgagcctcatgccagagaaccctgagaaagacgtgatcgagccggccgtccacgggaccctgaacgtgatgaagtcgtgcgtgagagcggggacggtgaagcgagtggtcctcacatcgtcggtggcgggggtgtccagccggccgctggaaggcgacggccatgtccttgacgaggaatcctggtccgacgtggagttcctcagatcaacaaagaccggtccctgggcgtactccgtctcgaaggtgcttgtggagaaggcggcgatggcgttcgcggaggacaagggcatcagcctggtcaccgtgtgcccggccgtcacggtgggcgaggcgccggcggcgaacgacctcaccagcgtcagcatcatcctctccctgctgtccggggatgatgcgtatgccggcgccctggagcacatcgagagggcgacgggctcgatcccgattctgcacatcgaggacctctgccgagcggagatgttcgtggccgaggaggaggccgcgtcggggcggtacatcgtctgcggcctcaaccccaccgccgtcgagattgcccgcttcttggctgccaactacccgcagtacaaggtcaatacagataggttcagagatctccctgagaagccgagagtctgcatttcgtcggcgaagctcgtcaaggaagggtttgagtacaagtacaagaacctggacggaatatatggcagcgtcgtcgagtatggaagggccttgggaatccttccctactaagaagtatgatcgatcttagaatcagacgatgcgcttggaagcaaaataagccttttagtctcctgaagtacacaaatgatgaaatgtgggtgttcagttcatatgaaaaatgtattataaaatgtactgtagtacttgtatggaaagtgatagttgtgtctgatgagagcatgctcagtcatggtgaaaaaagccatagtcgtgcacgtagataaaccgccattaaaatctcccccaacgcagaagaagccttcttgttttcctcc

SEQ ID NO: 4883 - protein, 373 aa, Triticum aestivum
MHTRPYLSCLSAAREIEPCARAIARRRELSSVVIIGDMATRRKTACVTGGSGYIASALVKMLLEKGYAVKTTVRNPDDAEKNAHLKALAALGSLEVFRADLNEEGSFDHAVAGCDYAFLVAAPVSLMPENPEKDVIEPAVHGTLNVMKSCVRAGTVKRVVLTSSVAGVSSRPLEGDGHVLDEESWSDVEFLRSTKTGPWAYSVSKVLVEKAAMAFAEDKGISLVTVCPAVTVGEAPAANDLTSVSIILSLLSGDDAYAGALEHIERATGSIPILHIEDLCRAEMFVAEEEAASGRYIVCGLNPTAVEIARFLAANYPQYKVNTDRFRDLPEKPRVCISSAKLVKEGFEYKYKNLDGIYGSVVEYGRALGILPY

SEQ ID NO: 4884 - DNA, 1475 bp, Triticum aestivum; identical to SEQ ID NO: 4882
  CDS (199)..(1209)

SEQ ID NO: 4885 - protein, 336 aa, Triticum aestivum
MATRRKTACVTGGSGYIASALVKMLLEKGYAVKTTVRNPDDAEKNAHLKALAALGSLEVFRADLNEEGSFDHAVAGCDYAFLVAAPVSLMPENPEKDVIEPAVHGTLNVMKSCVRAGTVKRVVLTSSVAGVSSRPLEGDGHVLDEESWSDVEFLRSTKTGPWAYSVSKVLVEKAAMAFAEDKGISLVTVCPAVTVGEAPAANDLTSVSIILSLLSGDDAYAGALEHIERATGSIPILHIEDLCRAEMFVAEEEAASGRYIVCGLNPTAVEIARFLAANYPQYKVNTDRFRDLPEKPRVCISSAKLVKEGFEYKYKNLDGIYGSVVEYGRALGILPY

SEQ ID NO: 4886 - DNA, 1316 bp, Zea mays subsp. mays
  CDS (111)..(1070)
gtctagatcgctcgtccggtgtggtctctggacttgcttgccgttcacttctcttcagcggcagcgtggcaaggcaacgagagcaacgaagagtattcaaaccgaaaacaatggatccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacgacagcattgcatcagcagttgccggctgtgagggtgtcttccatgtagctagccctgtcctttcccatcgaccctccaaccctgaggtggaggtcatagctcccgctgtaataggtacaaccaatgtgttaaaggcttgctatgaggcaaaagttaggcgagttgtggtggtgtcttcatgtggagctgtgtatgctaatcctatttatccgaagggtaaggtgtttgatgaagactgctggtcagatgaggattactgcaggaagaaggaggattggtatttagtttccaaaacactgtcggaacgagaggctcttgcttttgcagcaaaaacagggctggacgttgtaactgtttgtccgtcattagtatttggacccttgatgcagcctacagtaaatttgagcagcgaaatgatccttaaatatttcaaagatctcgagactgttgaaaatgtactcagtaatatggtggatattcgtgatgttgctgatgctcttcttctgacttacgaaaagccagaagcgtctggacgatacatctgcagttcacatgcaataaaaatttctgatatgataaacatactgaagaccatgtatccgtcttacccttatcccaaaaattttgtggaagatgatgtcaactctgtatacagctctgagaaactgcagaagctggggtggagcttcaagcctatagaggaatccctccgtgacactgttgaatcctacaaggcatttggcatcctgaattgaacatcgaactaggattgtttccatctgctgttgcctccgaactcctcctgaataatgtaggcgcagtgacaacagcactgccgttctctttatttttcaacactattatgtagtggttcaggccaaataagtaggcccggtgctgactgttgtatggtttgtggcctattgtcgttgctaaaaactagaaatatgcgtactaatgttgcattgctgcacttgatttgcttgtcgtcattctgatgc

SEQ ID NO: 4887 - protein, 319 aa, Zea mays subsp. mays
MDPVRKSVCVTGAGGFVASELVKLLLSRGQYAVRGTVRDPGASKNAHLKVLEGAEERLQLLKADLMDYDSIASAVAGCEGVFHVASPVLSHRPSNPEVEVIAPAVIGTTNVLKACYEAKVRRVVVVSSCGAVYANPIYPKGKVFDEDCWSDEDYCRKKEDWYLVSKTLSEREALAFAAKTGLDVVTVCPSLVFGPLMQPTVNLSSEMILKYFKDLETVENVLSNMVDIRDVADALLLTYEKPEASGRYICSSHAIKISDMINILKTMYPSYPYPKNFVEDDVNSVYSSEKLQKLGWSFKPIEESLRDTVESYKAFGILN

SEQ ID NO: 4888 - DNA, 1317 bp, Zea mays subsp. mays
  CDS (38)..(1132)
atctgcttactgtgatcaccaaagttgtgctgatacgatgtgcgattattgctctttcttctctagaatgttcctgccgatgctttataagagaaggttggtcagcatcgatctctgccagtgtctagctgagaacatggtgacctcaagcaagggcaaggtatgcgtaaccggggcctcaggctttgttgcctcttggcttatcaaacggctcctcgagtctggatatcatgtggtagggactgtcagggacccaggaaatcaccaaaagacagcccacctttggaaattacctggcgctaaagagaggctgcaaatcgtgcgagctgatctgttggaagaagggagcttcgacagcgccgtgatggcctgtgagggtgtattccacactgcatcccccgtcctcgctaaacccgactctactagcaaggaggacacgctcgtccctgcggtgaacggtactctgaacgtgctgagatcgtgcaagaagaacccgttcctgaaaagggtcgtccttacgtcttcgtcgtctgcggtgaggatcagggacgacggtggccagtccagtaacatctcgctggacgaaacgacatggagctccgtgccactctgcgagaagatgcatctatggtatgccctagccaaggtatttgcagagaaagcggcgtgggagttcgccaaggagaacggcatcgaccttgtgactgtcctcccgtcgttcgtgatcgggcccagtttgtcccacgaactatgcgttaccgcttcagacgtcctaggcctattccaaggcgacacggcaaggttcagctcgtacggaagaatggggtacgtccacatcgacgacgttgcgagcagccacatcctggtgtacgaggccccccaggccgccgggaggtacctgtgcagctcagtggtgctggacaacgacgagctggtctcctcgctcgcgaaacgctacccgatattccccataccccggaggctgaacagcccctacggcaagcagtcgtaccagctgaacacgtcgaagctgcaggggctgggcttcaagttcagaggggtgcaggagatgttcgacgactgcgtacagtcgctcaaagaccagggacacctgctggagtgccccctgtgaactgcgatggggtgcctccgcctgtgaacgcgccggttgggttgcgtcccgaacccgctgttaattcgtttttttttcttcaataattccacgtcatgtcacggtgtcctcgcgcagactgctactgtcagggcgtcatagctcacgggctctccggctacatgaataaaaatgtcacgctcgcc

SEQ ID NO: 4889 - protein, 364 aa, Zea mays subsp. mays
MCDYCSFFSRMFLPMLYKRRLVSIDLCQCLAENMVTSSKGKVCVTGASGFVASWLIKRLLESGYHVVGTVRDPGNHQKTAHLWKLPGAKERLQIVRADLLEEGSFDSAVMACEGVFHTASPVLAKPDSTSKEDTLVPAVNGTLNVLRSCKKNPFLKRVVLTSSSSAVRIRDDGGQSSNISLDETTWSSVPLCEKMHLWYALAKVFAEKAAWEFAKENGIDLVTVLPSFVIGPSLSHELCVTASDVLGLFQGDTARFSSYGRMGYVHIDDVASSHILVYEAPQAAGRYLCSSVVLDNDELVSSLAKRYPIFPIPRRLNSPYGKQSYQLNTSKLQGLGFKFRGVQEMFDDCVQSLKDQGHLLECPL

SEQ ID NO: 4890 - DNA, 1317 bp, Zea mays subsp. mays; identical to SEQ ID NO: 4888
  CDS (68)..(1132)

SEQ ID NO: 4891 - protein, 354 aa, Zea mays subsp. mays
MFLPMLYKRRLVSIDLCQCLAENMVTSSKGKVCVTGASGFVASWLIKRLLESGYHVVGTVRDPGNHQKTAHLWKLPGAKERLQIVRADLLEEGSFDSAVMACEGVFHTASPVLAKPDSTSKEDTLVPAVNGTLNVLRSCKKNPFLKRVVLTSSSSAVRIRDDGGQSSNISLDETTWSSVPLCEKMHLWYALAKVFAEKAAWEFAKENGIDLVTVLPSFVIGPSLSHELCVTASDVLGLFQGDTARFSSYGRMGYVHIDDVASSHILVYEAPQAAGRYLCSSVVLDNDELVSSLAKRYPIFPIPRRLNSPYGKQSYQLNTSKLQGLGFKFRGVQEMFDDCVQSLKDQGHLLECPL

SEQ ID NO: 4892 - DNA, 1284 bp, Zea mays subsp. mays
  CDS (42)..(1061)
acgggaaaggagtacggagtaccggagacatcgtcaacgccatggccggaggaggtgcaacggtgtgcgtgaccggagccggcgggttcatcgcctcgtgggtagtgaagctcctgctctcccgcgggtacaccgtgcacggcaccgtccgccacctcagtgacgagaagacaggccacctgaagcgcctggagaatgctgccggaaaccttaggatcttcaaggctgacctgctggactacgacgccatggcagctgcggtcgtcgggtgccagggggttttccatgtggccactcctgtgccttcggaggacctgactgacccagagctacaaatgctgggtcctgctgttaccggcaccacgaatgtgctcaaagctgcctccagcgcgaacgtccagcgagtggtggtggtgtcgtccatggttgccgtcgagatcagccccaaagattggcctgaaggtaaggtccgagatgagaggtgctggtcagaccgagagttctgcaggagcattgagagctggtacccggtggctaagatcatctcagaggaggcggcgctggcgtacgggcagcaaaccgggctcgacgtggtgactatcaatccagggttggtgttcggccccatgctgcagccgacggtcaacacgaccatccagttcctcatctacttcctcaaaggaggccccgacccggtgaagaacaagctctggcacatcgtcgacgtccgcgatgtggccgacgccatgctgctgctctacgaggtgcctgaagcgaccggcagacacatctgcgcgcctcatgttatcagtgcccgcgacctgctggatctgctgaagagcatgtaccctgactacccttgcattgccaacgagagcatacttgacagagaccacccagcgccgatgacctctgacaagctgaagaagatcgggtggagctgccgaccgctggaggagacgatcgtggacaccgtcgagtgctgcctgcgggctggatttctggacgacgtgggtggggagacttcctgtcgcttccctcctcttttaaaccagatctagcctcggcgaaagcatgaattgtgattgcctatgctcttgcttatgttaccgtggacgacgagcgtcagcttttaaataaacgtcattgcatgctgttgtatttcttatattactgtggacaagcatcgatcagagcttttaaattgttaggatcacaggtgaaaaaggagacagagtttaacgtggaaaaaactctctaatttggaggagaaaaaatcacggg

SEQ ID NO: 4893 - protein, 339 aa, Zea mays subsp. mays
MAGGGATVCVTGAGGFIASWVVKLLLSRGYTVHGTVRHLSDEKTGHLKRLENAAGNLRIFKADLLDYDAMAAAVVGCQGVFHVATPVPSEDLTDPELQMLGPAVTGTTNVLKAASSANVQRVVVVSSMVAVEISPKDWPEGKVRDERCWSDREFCRSIESWYPVAKIISEEAALAYGQQTGLDVVTINPGLVFGPMLQPTVNTTIQFLIYFLKGGPDPVKNKLWHIVDVRDVADAMLLLYEVPEATGRHICAPHVISARDLLDLLKSMYPDYPCIANESILDRDHPAPMTSDKLKKIGWSCRPLEETIVDTVECCLRAGFLDDVGGETSCRFPPLLNQI

SEQ ID NO: 4894 - DNA, 1472 bp, Zea mays subsp. mays
  CDS (224)..(1327)
aggatgaatcggaagagagaatcctaccaaacctagctaccaactcgatcgtcgtcatcacgctcgaccgcacaactgcaccgaggggggaggagacctaaaaactactacatcttttagctacacatctagctaaagatcgagaggggtaaataaggacgagcgggcgcgagctagaagagcagctgcaggtactaccatcatcgtcgtcgtcgtcgccaggatgaccgttgtcgacgccgtctcctccaccgatgccggcgccgccgccgccacggtaccggcggggaacgggcagaccgtgtgcgtcaccggcgcggccgggtacatcgcctcgtggttagtgaagctgctgctcgagaagggatacactgtgaagggcaccgtgaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggagacggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctattccccgagtaccccgtcccagccaggtgctccgacgaggtgaatccgcgaaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccacggccgagatgcagcagggagggatcgccatccgtgcctgagagggcgatgccacacatgaacacaaagcaatgttcatactgctgccctgcacctgcaccttcccctgctgtgtaaacaggcctgtgtttgttctggctgatagtgatgtaccctaagacttgtaacgtcatgttcgttcttgtg

SEQ ID NO: 4895 - protein, 367 aa, Zea mays subsp. mays
MTVVDAVSSTDAGAAAATVPAGNGQTVCVTGAAGYIASWLVKLLLEKGYTVKGTVRNPDDPKNAHLKALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEQAAWETARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPTAEMQQGGIAIRA

SEQ ID NO: 4896 - DNA, 1157 bp, Glycine max
  CDS (76)..(1089)
atcctaatttgttattgttatctcgtcctagcacactccagactctgcgaacagctaccactgtcgaccatcaccatgcagtccagctccaaggccggcggcaatggcgacgaggagcacctggtttgcgtgacgggggcggggagcttcatcgggtcgtgggtggtcaaggagctcctcctccgtggctaccatgtccggggaaccgccagagatcccgctgaccgcaagaacgcgcatctgctggcgctggacggcgccgaggagaggctcaccctgtgccgcgccgacgtcatggacggcgacagcctcggcgccgcattccatggctgccgcggcgtgttccatgtcgcctccccggtctccaatgaccctgagctcatgcctgaggccgtggaggggacgaggaacgtgatcaacgcggcagcagacgcgggcgtgcggcgtgtggtgttcacttcctcctacggtgccgtgcacatggacccaaagcggagcccggacaccgtcgtcgatgagtcgtgctggagcgactacgactactgcaaacaaaccggcaatctgtactgctgcgccaagatgatggcggaggtcgccgcgaaggaggaggcgaccaagagggggctggagctggcggtggtggtgccggcgacgaccatcggtcctgccctgcagcagacgctcaacttcagcagtgaccacgtcgcccgctacctcacaggcgccaagccggcctaccagaacgtcgtcaccgcctacatcgatgtccgagacgtcgcccgcgcgcacgccctcgtctacgagcaccctgacgcgcgcggcgatcgctacctctgcgtcagcgccgtgatgcaccgcgctcacttcgtccggctcctcaaggacctctacccgcagtaccccgtcaccgccaagcgcgaagacgacggcaagccgatggcgagggagtacaggttctcgaatcagaagctcggggatttgggcttggagttcactgacatgaggacaagtttgtacgacacggtgatttgcctgcagcacaggggccatgtccctgtcatcgtgccacgtcatcgtgcatgtttgtgaaaattataatgtgtacacaaattgaactcgattataagcaaataaatgaggataagtactctgttttc

SEQ ID NO: 4897 - protein, 337 aa, Glycine max
MQSSSKAGGNGDEEHLVCVTGAGSFIGSWVVKELLLRGYHVRGTARDPADRKNAHLLALDGAEERLTLCRADVMDGDSLGAAFHGCRGVFHVASPVSNDPELMPEAVEGTRNVINAAADAGVRRVVFTSSYGAVHMDPKRSPDTVVDESCWSDYDYCKQTGNLYCCAKMMAEVAAKEEATKRGLELAVVVPATTIGPALQQTLNFSSDHVARYLTGAKPAYQNVVTAYIDVRDVARAHALVYEHPDARGDRYLCVSAVMHRAHFVRLLKDLYPQYPVTAKREDDGKPMAREYRFSNQKLGDLGLEFTDMRTSLYDTVICLQHRGHVPVIVPRHRACL

SEQ ID NO: 4898 - DNA, 1226 bp, Triticum aestivum
  CDS (95)..(1066)
gtctgctgtccacttcagcgcagcgtggcgagacgcggagcaaccaaactccgcacagcagaggggactagccggagcggggagaaaaaacagcatggcggcggcggcggcggcgaggaagagcgtgtgcgtgaccggcgcagggggcttcgtcgcctcgtggctcgtcaagctcctcctctctaagggccactacgcggtccgcggcaccgtgcgcgatcccggtaatgctaagaatgctcaccttaaggcgctagaaggtgctggggaaaggttggagctgctcagcgccgacctgctgaactacgacagcattgcgtcagcggttgctggctgtgagggcgtctttcatgttgctagccctgtcccttctggcagatcaaccaatcctgaggaagaagttatagcccctgctgtaacaggcacactgaatgtcttgaaggcttgctacgaggcgaaagttaagcgagttgtcatggtgtcttcagttgctgctgtgtccaataatcctaactggcctaaggataaattatttgatgaagatagctggtcagacgaggatctctgcagaaagggtgaggattggtatttcctttccaaaacactcgcagagcgtgaggcttttgcttatgcagcaaaaactgggctggatattgtaactatttgcccgtcgttggtaattggccccttgatgcagtctacagtaaatacaagcagtaacattctccttaattacctcaaaggagaacgtgatactgtagaaaataaactcaggaatgtagtggatgtccgtgatgttgccgatgctcttctattggcatatgaaaatccagaggcgtctggacggtacatctgcagttcaaaaccagtaaaagtctctgatatgataagcgtactgaagaccttatatccaatgtacacttatcccaaaaactttacggaagtggaagaaaataccatttatagttcagagaaacttcagaagctagggtggaccttcaggcctttagagaagaccctgggggacagcgtggaatcctacaaagcatctggcgtcctgaactgagcatccaaccagggaaagtttggctgttaatgcttgcaaactccttgtggttcatgtaagcagtgaaacaaaataagttggtgacacaatcgtcacgagagtctgtgtgaacatgaacaaagcatgaatcgtatgcgcgcctttcttttggtgtgtcttg

SEQ ID NO: 4899 - protein, 323 aa, Triticum aestivum
MAAAAAARKSVCVTGAGGFVASWLVKLLLSKGHYAVRGTVRDPGNAKNAHLKALEGAGERLELLSADLLNYDSIASAVAGCEGVFHVASPVPSGRSTNPEEEVIAPAVTGTLNVLKACYEAKVKRVVMVSSVAAVSNNPNWPKDKLFDEDSWSDEDLCRKGEDWYFLSKTLAEREAFAYAAKTGLDIVTICPSLVIGPLMQSTVNTSSNILLNYLKGERDTVENKLRNVVDVRDVADALLLAYENPEASGRYICSSKPVKVSDMISVLKTLYPMYTYPKNFTEVEENTIYSSEKLQKLGWTFRPLEKTLGDSVESYKASGVLN

SEQ ID NO: 4900 - DNA, 1284 bp, Triticum aestivum
  CDS (128)..(1120)
acccacgacgcggacactactttgtacgcaggcagcgtctttccccttcctcttttgcctcccatctcccctctccgctcccactccacagtccacccagccgcggccggaagagcaggaggacgggatgagctccgggacggggaaggtggtgtgcgtcaccggcgcctcgggctacatcgcctcctggctcgtcaagttcctcctccagcgcggctacaccgtccgcgccaccgtcagggacaccgccgaccccaagaaaacattgcacctgcaggccctggatggagccaaggacaggctgcacttgtttaaagcaagcttgttggaagaaggcaccttcgatgatgctgttgccggctgcgattgtgtcttccacacggcatctcccttttatcacaatgtcaaggatcccaaggctgagttacttgatccagcagtcaatggaacgctcaatgttctccgttcctgcaagaaggcctctatcaagagagtgatcgtaacctcatccatggctgctgttgcctacaatgggaagccaaggactcctgatgtagtagttgacgagacatggttttcaagtgcagaggtctgcgaaaagaataagcaatggtatgtgctatccaagacccttgccgaggaggctgcatggaagtacgcaaatgataatggattagaaataattacaataaacccaacaatggtcatcggtcccctgttgcagcctacactgaatactagcacagaagcaatattgaagtttataaatggatcatcttctacatacgccaatttctgctttggatggataaacgttaaagatgttgccctggcacatatccttgcatatgaagttccttcagcaaacggaagatattgtatggttgaaagagtcattcaccactcggaccttgtcaagatcatacacgagatgtatcctgaatttccagtgccagacaagtgtgcagatgatgcgccgtttgccccaatctaccaggtatcaaaggacaggataagaagtctgggcatggagctgacccccctggagacgagcctcaaggagactatcgagagcttgagagagaaaggatttgtcacttctgagtcgagccatctgtgaaactttctttgctttggcatcactagtggcagacgctagatgcacacatgtttatgtgcacctgaaataaatcgaggcatagtgtattcttgagacatgtatttgtggatctgctgtgtttcaatggattcaagttcggagaatgtataaaaaaaaaaaaaaaa

SEQ ID NO: 4901 - protein, 330 aa, Triticum aestivum
MSSGTGKVVCVTGASGYIASWLVKFLLQRGYTVRATVRDTADPKKTLHLQALDGAKDRLHLFKASLLEEGTFDDAVAGCDCVFHTASPFYHNVKDPKAELLDPAVNGTLNVLRSCKKASIKRVIVTSSMAAVAYNGKPRTPDVVVDETWFSSAEVCEKNKQWYVLSKTLAEEAAWKYANDNGLEIITINPTMVIGPLLQPTLNTSTEAILKFINGSSSTYANFCFGWINVKDVALAHILAYEVPSANGRYCMVERVIHHSDLVKIIHEMYPEFPVPDKCADDAPFAPIYQVSKDRIRSLGMELTPLETSLKETIESLREKGFVTSESSHL

SEQ ID NO: 4902 - DNA, 1483 bp, Triticum aestivum
  CDS (132)..(1169)
acacacatcgatcagcagcagcctcaagcaaacgcaaactcgtactgctagcccgtgtagtttgttaagcagcaagcttgcatccacacatcgatcggcagaccaccgtggtcaccggacaccaatccaccatgccgtccattgacaaggccaccgacaacggcgagatgaagcagcggcagccggagcaggagctggtctgcgtcacgggggccggaggcttcatcggctcctgggtcgtgaaggagctcctcctccgcggctaccgcgtcaggggaaccgccagggaccccgctgaccaaaagaacgcacacctgctggcgatggagggcgccgaggagaggctcaccctgtgccgggccgacgttcttgactacgacggcctccgcaccgccttccgcggctgccacggcgtcttccacgtcgcctcgccagtctccaacgacccggacctcgtgccggtcgccgtggaggggacgaggaacgtgatcagagcggcggcggacgcgggcgtgcggcgcgtggtgttcacttcgtcctatggcgccgtgcacatggaccccaaccgcaggcccgacgcagtgctcgacgagtcgtgctggagcgactatgagtactgcaaaaacacagggaacatgtactgctgcgccaagatgatggcggagatcacggcgacggaggaggcggccaagaggggcctggagctagcggtggtggtgccgtccatgaccatgggccccatgctgcagcagtcgctcaacttcagcagcagccacgtggcccgctacctcaccggcgcaaagcccacctacccgaatgccgtcgccgcctacaccgacgtccgtgatgtcgcccgcgcgcacgtcttcgtctacgagcacccggacgcgcgcggccgctacctctgcatcggtgccgtgctgcaccgcgcgcatttccttcagctcctcggcgacctctttcctcagtacaacataaccgccaagtgcgaagacgacgacaattccatggccaagccatacaagttctcgaaccggaggctgagggagctcggattagagttcactccgttgagggaaagcttgtacgagacagtgatgtgcttgcagaaaaagggctatctgcctctccccgttgttcccatagcacagaagcgtgcgtacttgtaacagggcaggacaggggataagcccatctgatgaaacaacaagagcaaagccgcaagaacaaaagaagatactatccggattttggagcttcagcatagaattaattgtgtattcctacaaagcacagtgtggcatgtaaatagaattaaaaccacaataagtattttggaacggagggagtactacctccgtctaggtgaataagtcattcgcgcagttctaggtcatcgatttgaggaattaaacatatgctaaaaaaaaaaaaaaaaaagcttatcgataccgtcgacctcgagggggggcccggtacccaa

SEQ ID NO: 4903 - protein, 345 aa, Triticum aestivum
MPSIDKATDNGEMKQRQPEQELVCVTGAGGFIGSWVVKELLLRGYRVRGTARDPADQKNAHLLAMEGAEERLTLCRADVLDYDGLRTAFRGCHGVFHVASPVSNDPDLVPVAVEGTRNVIRAAADAGVRRVVFTSSYGAVHMDPNRRPDAVLDESCWSDYEYCKNTGNMYCCAKMMAEITATEEAAKRGLELAVVVPSMTMGPMLQQSLNFSSSHVARYLTGAKPTYPNAVAAYTDVRDVARAHVFVYEHPDARGRYLCIGAVLHRAHFLQLLGDLFPQYNITAKCEDDDNSMAKPYKFSNRRLRELGLEFTPLRESLYETVMCLQKKGYLPLPVVPIAQKRAYL

SEQ ID NO: 4904 - DNA, 1483 bp, Triticum aestivum; identical to SEQ ID NO: 4902
  CDS (168)..(1169)

SEQ ID NO: 4905 - protein, 333 aa, Triticum aestivum
MKQRQPEQELVCVTGAGGFIGSWVVKELLLRGYRVRGTARDPADQKNAHLLAMEGAEERLTLCRADVLDYDGLRTAFRGCHGVFHVASPVSNDPDLVPVAVEGTRNVIRAAADAGVRRVVFTSSYGAVHMDPNRRPDAVLDESCWSDYEYCKNTGNMYCCAKMMAEITATEEAAKRGLELAVVVPSMTMGPMLQQSLNFSSSHVARYLTGAKPTYPNAVAAYTDVRDVARAHVFVYEHPDARGRYLCIGAVLHRAHFLQLLGDLFPQYNITAKCEDDDNSMAKPYKFSNRRLRELGLEFTPLRESLYETVMCLQKKGYLPLPVVPIAQKRAYL

SEQ ID NO: 4906 - DNA, 1294 bp, Zea mays
  CDS (108)..(1106)
gtcgacccacgcgtccgcggacgcgtgggcggacgcgtgggcggacgcgtgggcaggtctccagcgaagcaggctcaggcgcaacgcaacaacacaaggcggcggttatggcctctgctgctgcgacggctacgatggggacggggaaggtggtttgcgtcaccggcgcatcagggtacatcgcgtcctggattgtcaggctcctactcgaccgcggctacaccgtccgcgccaccgtgcgagacaccgctgacccaaagaaaacattgcacctgactgcgttggatggtgctaaggataggctgcacttatttaaagctagcctgctagaagagggttctttcgatgctgcagttcatggatgcgacactgtatttcatactgcctctcccttttatcacaatgtcaaggatgctaaggcagagttacttgacccagcagttaagggaacactcaatgttctcggttcatgcaagaaagcttctattaaaaaggtggttgtaacatcatctatggctgctgtagcctacaacaggaggccaaggactcctgaggtcacagttgacgagacatggttttctgatccacaaatttgtgaaacaaatcagcaatggtatattttgtccaagacgctggcagaggaggctgcttggaagttctcaagggataatggacttgaaatcgttactataaacccagcgatggttattggtcccctgctgcagcctacactaaataccagtgctgaagcaatcctgaagttaatcaatgggtcatcgtctacatatcccaatttttgctttggatgggttaatgtcaaggatgttgccctggcccatatccttgcatacgaggttccctcatcaaatggaaggtactgcatggtggaaagagttgttcactactcagaactggtgaacattatccgcaacatgtatcctacccttcctcttccggacaagtgtgcagatgacaagccgtttgtcccaccctaccaagtatcaaaggagaagataaaaagcataggcatcgagttgattccactggagacgagcgtcaaggagaccatcgaaagcttgaaagagaaggggttcgctagtttttgactcgagcaagctgtgaaacataagtgttactgtactacgtgatgttgcattgtatacatgcatcggacttcgcagttcccaagctattttggtagctttggtctgtaagattacctaaaataaactgagccacgttgccacgctgtagcttttggaaaaaaaaaaaaaaaaaaaaagggcggccgctc

SEQ ID NO: 4907 - protein, 332 aa, Zea mays
MASAAATATMGTGKVVCVTGASGYIASWIVRLLLDRGYTVRATVRDTADPKKTLHLTALDGAKDRLHLFKASLLEEGSFDAAVHGCDTVFHTASPFYHNVKDAKAELLDPAVKGTLNVLGSCKKASIKKVVVTSSMAAVAYNRRPRTPEVTVDETWFSDPQICETNQQWYILSKTLAEEAAWKFSRDNGLEIVTINPAMVIGPLLQPTLNTSAEAILKLINGSSSTYPNFCFGWVNVKDVALAHILAYEVPSSNGRYCMVERVVHYSELVNIIRNMYPTLPLPDKCADDKPFVPPYQVSKEKIKSIGIELIPLETSVKETIESLKEKGFASF

SEQ ID NO: 4908 - DNA, 1394 bp, Zea mays subsp. mays
  CDS (191)..(1189)
aaataggtagatgatgccgctaacagtaacacagagtaaaagactccaattttcccacggctactgaatcacggatgcttaaatctccccaatccgtatctctgtttccctcacagcgcggctgcctataaccactccaggtctccagcgaagaggctcaggcgcaacgcaacaacacaaggcggcggttatggcctctgctgctgcgacggctacgatggggacggggaaggtggtgtgcgtcaccggcgcatcagggtacatcgcgtcctggattgtcaggctcctcctcgaccgcggctacaccgtccgcgccaccgtgcgagacaccgctgacccaaagaaaacattgcacctgactgcgttggatggtgctaaggataggctgcacttatttaaagctagcctgctagaagagggttctttcgatgctgcagttcatggatgcgacactgtatttcatactgcctctcccttttatcacaatgtcaaggatgctaaggcagagttacttgacccagcagttaagggaacactcaatgttctcggttcatgcaagaaagcttctattaaaaaggtggttgtaacatcatctatggctgctgtagcctacaacgggaggccaaggactcctgaggtcacagttgacgagacatggttttctgatccacaaatttgtgaaacaaatcagcaatggtatattttgtccaagacgctggcagaggaggctgcttggaagttctcaagggataatggacttgaaatcgttactataaacccagcgatggttattggtcccctgctgcagcctacactaaataccagtgctgaagcaatcctgaagttaatcaatgggtcatcgtctacatatcccaatttttgctttggatgggttaatgtcaaggatgttgccctggcccatatccttgcatacgaggttccctcatcaaatggaaggtactgcatggtggaaagagttgttcactactcagaactggtgaacattatccgcaacatgtatcctacccttcctcttccggacaagtgtgcagatgacaagccgtttgtcccaccctaccaagtatcaaaggagaagataaaaagcataggcatcgagttgattccactggagacgagcgtcaaggagaccatcgaaagcttgaaagagaaggggttcgctagtttttgactcgtgcaagctgtgaaacagaagtgttactgtactacgtgatgttgcattgtacacatgcatcggacttcgcagttcccaagctattttggtagctttggtctgtaagattacctaaaataaactgagccacgttgccacgctgtagcttttgtacatgttatgctttgatcggattgagacacgtgatatatggtcgttgctt

SEQ ID NO: 4909 - protein, 332 aa, Zea mays subsp. mays
MASAAATATMGTGKVVCVTGASGYIASWIVRLLLDRGYTVRATVRDTADPKKTLHLTALDGAKDRLHLFKASLLEEGSFDAAVHGCDTVFHTASPFYHNVKDAKAELLDPAVKGTLNVLGSCKKASIKKVVVTSSMAAVAYNGRPRTPEVTVDETWFSDPQICETNQQWYILSKTLAEEAAWKFSRDNGLEIVTINPAMVIGPLLQPTLNTSAEAILKLINGSSSTYPNFCFGWVNVKDVALAHILAYEVPSSNGRYCMVERVVHYSELVNIIRNMYPTLPLPDKCADDKPFVPPYQVSKEKIKSIGIELIPLETSVKETIESLKEKGFASF

SEQ ID NO: 4910 - DNA, 1394 bp, Zea mays subsp. mays; identical to SEQ ID NO: 4908
  CDS (218)..(1189)

SEQ ID NO: 4911 - protein, 323 aa, Zea mays subsp. mays
MGTGKVVCVTGASGYIASWIVRLLLDRGYTVRATVRDTADPKKTLHLTALDGAKDRLHLFKASLLEEGSFDAAVHGCDTVFHTASPFYHNVKDAKAELLDPAVKGTLNVLGSCKKASIKKVVVTSSMAAVAYNGRPRTPEVTVDETWFSDPQICETNQQWYILSKTLAEEAAWKFSRDNGLEIVTINPAMVIGPLLQPTLNTSAEAILKLINGSSSTYPNFCFGWVNVKDVALAHILAYEVPSSNGRYCMVERVVHYSELVNIIRNMYPTLPLPDKCADDKPFVPPYQVSKEKIKSIGIELIPLETSVKETIESLKEKGFASF

SEQ ID NO: 4912 - DNA, 1032 bp, Unknown
  Synthetic homolog of SEQ ID NO: 4836
  CDS (1)..(1032)
atgggctctgtatttgtatctggcgctaacggttttatcgctcaacacatcgtcgatctgctgctgaaagaagattacaaagttatcggttccgcacgttcccaggaaaaagctgaaaacctgactgaagcatttggtaacaacccgaagttctctatggaagtagtaccggacatttctaaactggacgcattcgaccacgtattccaaaagcacggtaaggatatcaagatcgtactgcacactgcatctccattctgttttgacatcactgattctgagcgcgacctgctgattccggctgttaacggtgttaaaggtattctgcactctattaagaaatatgctgctgattccgtagaacgcgtagttctgacttcctcttatgctgcagtattcgatatggctaaagagaacgacaaatccctgacttttaacgaagaatcttggaacccggctacctgggaatcttgccagtctgacccggttaacgcttattgtggctctaagaagtttgctgaaaaagctgcttgggaattcctggaagaaaaccgtgactctgtaaagttcgagctgaccgctgtaaacccggtatacgtttttggcccgcagatgttcgataaagatgtaaagaagcacctgaacacttcctgtgaactggtaaactctctgatgcacctgtctccagaagataaaatcccggagctgttcggcggttacatcgacgttcgtgacgtagcaaaagcacatctggtagctttccagaagcgtgagactatcggccagcgtctgattgtttccgaggctcgtttcaccatgcaggatgttctggatattctgaacgaagacttcccggtactgaaaggtaacattccggtgggtaaaccaggctctggtgcaactcataacactctgggtgcaactctggataacaagaagtctaagaaactgctgggttttaaattccgtaacctgaaagaaactattgacgacactgcatctcagatcctgaaattcgaaggtcgcatctaa

SEQ ID NO: 4913 - protein, 343 aa, Unknown
  Synthetic homolog of SEQ ID NO: 4837
MGSVFVSGANGFIAQHIVDLLLKEDYKVIGSARSQEKAENLTEAFGNNPKFSMEVVPDISKLDAFDHVFQKHGKDIKIVLHTASPFCFDITDSERDLLIPAVNGVKGILHSIKKYAADSVERVVLTSSYAAVFDMAKENDKSLTFNEESWNPATWESCQSDPVNAYCGSKKFAEKAAWEFLEENRDSVKFELTAVNPVYVFGPQMFDKDVKKHLNTSCELVNSLMHLSPEDKIPELFGGYIDVRDVAKAHLVAFQKRETIGQRLIVSEARFTMQDVLDILNEDFPVLKGNIPVGKPGSGATHNTLGATLDNKKSKKLLGFKFRNLKETIDDTASQILKFEGRI

SEQ ID NO: 4914 - DNA, 1559 bp, Zea mays
  CDS (231)..(1346)
  misc_feature (1031)..(1031): n is a, g, c or t
gtcgacccacgcgtccgggaagagagaatcctaccaaacctagctaccaactcgatcgtcgtcatcacgctcgaccgcacaactgcaccaaggggggaggagacctaaaaactactacatcttttagctacacatctagctaaagatcgagaggggtaaataaggacgagcgggcgcgagctagaagagcagctgcaggtactaccatcatcgtcgtcgtcgtcgccaggatgaccgtcgtcgacgccgtcgtctcctccaccgatgccggcgcccctgctgccgccgccaccgcggtaccggcggggaacgggcagaccgtgtgcgtgaccggcgcggccgggtacatcgcctcgtggttggtgaagctgctgctcgagaagggatacactgtgaagggcaccgtcaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggatgccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggaacaggcggcgtgggagacggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccanctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccacggccgagatgcagcagggagggatcgccatccgtgcctgagagggcgatgccacacatgaacacaaagcaatgttcatactgctgccctgcacctgctgtgtaaacaggcctgtgtttgttctggctgatagtgatgtaccctaagacttgtaacgtcatgttcgttcttgtgaactatagcgagtgaataaaattggttaatgttggatgttcaaaaaaaaaaaaaaaaaaaaaaaaaaaaagggcggccgc

SEQ ID NO: 4915 - protein, 371 aa, Zea mays
  misc_feature (267)..(267): The Xaa at location 267 stands for Gln, or His.
MTVVDAVVSSTDAGAPAAAATAVPAGNGQTVCVTGAAGYIASWLVKLLLEKGYTVKGTVRNPDDPKNAHLKALDGAAERLILCKADLLDYDAICRAVQGCQGVFHTASPVTDDPEQMVEPAVRGTEYVINAAADAGTVRRVVFTSSIGAVTMDPKRGPDVVVDESCWSDLEFCEKTRNWYCYGKAVAEQAAWETARRRGVDLVVVNPVLVVGPLLQATVNASIAHILKYLDGSARTFANAVQAYVDVRDVADAHLRVFESPRASGRXLCAERVLHREDVVRILAKLFPEYPVPARCSDEVNPRKQPYKFSNQKLRDLGLQFRPVSQSLYDTVKNLQEKGHLPVLGERTTTEAADKDAPTAEMQQGGIAIRA

SEQ ID NO: 4916 - DNA, 1038 bp, Issatchenkia scutulata
  CDS (1)..(1038)
atgtcgaacaaaacagttctagtcaccggggctaccggttttattgcactacacatcattgataatttattgtctaagggttattccgttattggtacagctagatcccaatctaaatatcaaccaatccttgatgctttcaagaaaaaataccctgatgcaaatttgacttttgaagttgtccctgacatctccactgaaaacgcattcgatgatgttttgaagaagcatccagaaattactgctgtccttcacacagcatctccattctcttttggtttgaacaaggatctgaaggaagcatatttgaagcctgccgttgatggtactttgaatattctcaaggcaattgagaagtatgcaccacaggttactaaagttgttatcacatcttcttatgctgcaattatgacaggtaatccaagtcatgtccacaccagtgaaacctggaacccaattaattgggaaaacgatgtgaagaatgaatactttgcatatattgcctccaagacgtatgctgaaaaagctgcgagagattttgtcaaggagcataaggtcaatttcaagttagcaactgttaacccaccatacgttctgggtccacaattatttgacttctcagttggtccagtcttgaacacttccaaccaattgatcacggatgcgactaaaattgataagaactctactaagccggaattaggtacaccagctttagcagtcgatgttagagatgttgctgcgttccatgttttaccattggaagatgataaagttgcaagtgaaagattatttattgttgctggtccagcagttgttcaaacattcttaaacatcatcaacgagaacattccagaacttaaaggtaaggttgccctaggagatccagcttcagagaaggagttgattgaaaagcacacagataagtatgatttgacaaatcttcacaacgttattggtaaatatgatttcattccagttgaaaagtccgttgtcgacgtcttagaacaatattacaaaatcaataaaattgattag

SEQ ID NO: 4917 - protein, 345 aa, Issatchenkia scutulata
MSNKTVLVTGATGFIALHIIDNLLSKGYSVIGTARSQSKYQPILDAFKKKYPDANLTFEVVPDISTENAFDDVLKKHPEITAVLHTASPFSFGLNKDLKEAYLKPAVDGTLNILKAIEKYAPQVTKVVITSSYAAIMTGNPSHVHTSETWNPINWENDVKNEYFAYIASKTYAEKAARDFVKEHKVNFKLATVNPPYVLGPQLFDFSVGPVLNTSNQLITDATKIDKNSTKPELGTPALAVDVRDVAAFHVLPLEDDKVASERLFIVAGPAVVQTFLNIINENIPELKGKVALGDPASEKELIEKHTDKYDLTNLHNVIGKYDFIPVEKSVVDVLEQYYKINKID

SEQ ID NO: 4918 - DNA, 1155 bp, Metschnikowia zobellii
  CDS (65)..(1081)
tgagcggatacaattcccctctagaaataattttgtttaactttaagaaggagatatacatatgatgaccacttcagtctttgtctctggtgccaccggcttcattgcccagcacgtcgtcaaactccttctctcgaaaggctacaacgtcgttggctccgtcagaaccgccgagaaaggcaagaacctagcaaagctatttggcaccggctccttcacctacgaggtggtgcccaaactcgaagcgcctggtgcctttgacgaggccttggaaaagcatccagaggtgtctgtgtttttgcacacggcctcgcccgtcacctttgacgtcaaggacattgagaaagagttgcttctccccgccgtcgagggcaccaaaaacgtctttagtgccatcaaagcccacggcccgcagatcaaaaacgtcgtggtgacgtcctctgttgctgcggcactcgatcccgctagaaacctggaccccacgttcactgtgaatgaagactcttggaacccaatctcgtgggaggactcgaagcagaacgccatgaccgggtactttggctccaagaagtttgcagagaaggccgcgtgggattttgtggaagccgagaagcccaactttctgttgaacaccgtgttgcccgtgtacgtctttggcccccaggcgtttgactccgaggtcaagggcgagctcaactactctgccgaaatcatcaacaagttgttgaagttgggacccaacgacgaagtgccctcgcaactggggggtttcgtcgacgtgagagacgtggccaaggctcacttggccgcattcgagggcggactctcgaaccagcgccttttgcttagaacggcagcgtttaatgcgcaacgcgtgcttgacataatcaacaataagtttgttaacttgagaggacagttgcccactggaacgccttgtaaaggcgagcctgaaagcactggctctgtgacggacaattcgagaaccaagaagttattgaacttcccagccatcgacttggagaactgtgtggtggactcggttacccagctcatgaagtcccagaagaaggttttgtaagcgaagcttgcggccgcactcgagcaccaccaccaccaccactgagatccggctgctaacaaagcccgaaagga

SEQ ID NO: 4919 - protein, 338 aa, Metschnikowia zobellii
MTTSVFVSGATGFIAQHVVKLLLSKGYNVVGSVRTAEKGKNLAKLFGTGSFTYEVVPKLEAPGAFDEALEKHPEVSVFLHTASPVTFDVKDIEKELLLPAVEGTKNVFSAIKAHGPQIKNVVVTSSVAAALDPARNLDPTFTVNEDSWNPISWEDSKQNAMTGYFGSKKFAEKAAWDFVEAEKPNFLLNTVLPVYVFGPQAFDSEVKGELNYSAEIINKLLKLGPNDEVPSQLGGFVDVRDVAKAHLAAFEGGLSNQRLLLRTAAFNAQRVLDIINNKFVNLRGQLPTGTPCKGEPESTGSVTDNSRTKKLLNFPAIDLENCVVDSVTQLMKSQKKVL

SEQ ID NO: 4920 - DNA, 1035 bp, Torulaspora delbrueckii
  CDS (1)..(1035)
atgtctattctagtttctggtgctactggttttattgctctacatgttgtcagtgatttgttgaagcaggattacaaagttattggtactgttagatctcaagaaaaagctgataaattgcgtaagcaatttggcaacaatcccaatctttcctttgaattggtttcagatattgctgctcctgaagcttttgacaaagtctttcagaaacatggcaaggacatcaaagtggtgttgcacacagcttctcctttcactctagaaaccacaaattatgagaaagatctgttgcttccagcagtgaatggtacaaagagtatcctggagtcgattaagaaatacgctgctgattctgtcgagagagtagtcatcacatcgtcttacgctgccgtcatgaatgtttcgaaagaaggcgacggctcaatagtctacactgagaaggattggaaccctgccacttgggaaaactgtcagatagatggtttgaatgcttattgtgggtccaagaagctagcagaaaaggctgcatgggacttctttgaagataataaaaacgttgtcaagttcaaactgagcatgatcaatcctacttacgttttcgggcctcagctatttgatgaggacgtgaaggataaattgaatacttcctgtgagctaattaactcaattataaagaataatcctcaggtgggatatctattagagaatattaaaggtcatttcgttgatgtcagagatgttgctaaggctcacttggtggcattccaaaaggatgaagctattggacagagactgctcacctcaaatggtcgtttcgcttaccaagacctcgtagatattatcaatgaggatttcccacaattgaagggtaaggtcattgtaggaaagccaggtgccggtaaacaattgtatggcactttcccagacatcaacaacaccagatcgaaggagattttgggcttcgaattcatctctctgcataaatccgtccatgacactgctgctcaagttttgaaaaaagaaggcaaattgtaa

SEQ ID NO: 4921 - protein, 344 aa, Torulaspora delbrueckii
MSILVSGATGFIALHVVSDLLKQDYKVIGTVRSQEKADKLRKQFGNNPNLSFELVSDIAAPEAFDKVFQKHGKDIKVVLHTASPFTLETTNYEKDLLLPAVNGTKSILESIKKYAADSVERVVITSSYAAVMNVSKEGDGSIVYTEKDWNPATWENCQIDGLNAYCGSKKLAEKAAWDFFEDNKNVVKFKLSMINPTYVFGPQLFDEDVKDKLNTSCELINSIIKNNPQVGYLLENIKGHFVDVRDVAKAHLVAFQKDEAIGQRLLTSNGRFAYQDLVDIINEDFPQLKGKVIVGKPGAGKQLYGTFPDINNTRSKEILGFEFISLHKSVHDTAAQVLKKEGKL

SEQ ID NO: 4922 - DNA, 1436 bp, Triticum aestivum
  CDS (121)..(1131)
agtacacacctcggtttggaacttggaagtcgagacacatacacacacacatactagatacatatccatacttctgttgctcattgcatctcctagttcagcaaattgccaaactgagacatgggaattgatcgtgtcaacacggcagccactggccgcggacgcaccgtctgtgtgaccggcgccggcggtttcatcgcgtcctggctagtgaagctcctcctggagaagggctacgccgtccacggcaccgtccggaaccctgatgacgtggcaaggaatgcgcacctgagagccttggaaggggcgacggagcgactgaccctcttccaggtggacctgcttgacaaggagagcctcgtcgctgctttccaaggatgcgaaggcgtattccacaccgcatgccccgtcaccgatgacccggaaaaaatgatcgagccggcagtgaacggaacgagaaacgtgttcaacgccgcggcagaggtgggcggcatccggcgtgtggtaatgacgtcgtcgatcggctccgtgtacatggatcctcgtcgtagcatcgatggggaggccgatgagacatgttggagcgacctcgagttctgcaagaacacaaagaattggtactgctatgcgaagacggtggcggagcaggccgcatgggagctcgccaaggagaggaagcttgaccttgtggtgatcaacccgtctctagtgttgggccctctgctacagatggcggtgaacgccagtacgtggcatattgccaagtatctggacggctcggtgcagacgtatgccaacgcggcacaggcgtacgtgcacgtccaggacgtcgcggacgcgcacgcgcgtgcgtacgagacgcccgatgcgcatggccggtacctctgcgcggggcgcacgctgcaccgtgccgaggtgtgtcgcatccttgccaagttcttcccggagtaccccgtgcccacgaggtgcaaggaaggggcgggcgagatgaagaagggttgtcggttcagcagtcggaggatcatggatctcggcgtcggcatcacgccggcgagccagtgtctctacgacacggtcaccagccttcaggacaagggcatcttaccacgtcgcgacgctgatatgtcctgacaactccatggtcaccttggtcaagttagcagcatgcatgcccgcttgatgattacaaagtcatggcatttaattctttatttacttcttagttgttcaaatataaggccctgtccagagcacctccaccccacaactccactccccaagttgatggagttacagttgaaaactgtggagcagctatttcctggctccacagctcccagaatttcgtggagctggtggatttccgaacaggccctaagtgtccattgtaaaagaatatgttatgatatgatgtttatccaaaaaaaaaaaaaaaa

SEQ ID NO: 4923 - protein, 336 aa, Triticum aestivum
MGIDRVNTAATGRGRTVCVTGAGGFIASWLVKLLLEKGYAVHGTVRNPDDVARNAHLRALEGATERLTLFQVDLLDKESLVAAFQGCEGVFHTACPVTDDPEKMIEPAVNGTRNVFNAAAEVGGIRRVVMTSSIGSVYMDPRRSIDGEADETCWSDLEFCKNTKNWYCYAKTVAEQAAWELAKERKLDLVVINPSLVLGPLLQMAVNASTWHIAKYLDGSVQTYANAAQAYVHVQDVADAHARAYETPDAHGRYLCAGRTLHRAEVCRILAKFFPEYPVPTRCKEGAGEMKKGCRFSSRRIMDLGVGITPASQCLYDTVTSLQDKGILPRRDADMS

SEQ ID NO: 4924 - DNA, 1247 bp, Glycine max
  CDS (17)..(994)
aaaaaagttgaagaatatgagcagcagtgcagggaagttggtgtgtgtcaccggtgctgccggttatattgcttcatggattgtcaagttcctacttgaacgtggttacactgtcagggccactgttcgaaacccaaatgatcacacgaaggtagaacatttgctaaaacttgaaggtgcaaaggagagactgcacctttttaaggcagatcttttgggtgaaaattcttttgactccattgttgagggctgtgatggcgtctttcatactgcttctccttttattatcaacgtcaaagacccacaggctgacctacttgacccagcagtgaagggaactcttaacgttcttaaatcatgtgtaaaatcgccatctgtgaaacgagtcatcttaacatcttctgtggctgcagttgcatataataaaaggcctaaaagtcctgaagttgtagttgatgaaacctggtggtctgatccagattactgtaaggaattaaagctgtggtatttactttcaaagactttggctgaagatgctgcctggaaatttgccaaagaaaacgaccttgacttggttgttgttaacccagcaatggttgtagggcctcttttgcaagcagagcttaacactagtgctgctattattttaaacctaataaatggttcagaaactttttcaaatgatacatatggatggatcaatgtgaaagatgttgcaaacgcccatattcaggcatatgagattgcttcagctagtggaagatattgtttagttgagagagtggcacactactctgaactcgccaggattttacgtgatcagtacccgacatatcaaattccagaaaagtctgcagacgataagccttatgtaccaacatttcaggtttccaaagaaaaggcaaagaccttggggattgaatttattcctttggaagtgagtcttagagagacagtggaaactttgaaagaaaagaactttgccaacttttagtctctgatatctctgcttgatcaggagtgaacacgttgagaatctcaacggtgtttcgtttgtggttctggttttagaatctcattgcttgaaaataaactattgtactgaaatgtcaagcttgtgtgttgtaataaaacaagattaattgttggttttatttcggtttgtactcatgaaggaaaccaacgtgtggtataaaaagataataattaagtatcaggctatttctagtccaaaaaaaaaaaaaaaa

SEQ ID NO: 4925 - protein, 325 aa, Glycine max
MSSSAGKLVCVTGAAGYIASWIVKFLLERGYTVRATVRNPNDHTKVEHLLKLEGAKERLHLFKADLLGENSFDSIVEGCDGVFHTASPFIINVKDPQADLLDPAVKGTLNVLKSCVKSPSVKRVILTSSVAAVAYNKRPKSPEVVVDETWWSDPDYCKELKLWYLLSKTLAEDAAWKFAKENDLDLVVVNPAMVVGPLLQAELNTSAAIILNLINGSETFSNDTYGWINVKDVANAHIQAYEIASASGRYCLVERVAHYSELARILRDQYPTYQIPEKSADDKPYVPTFQVSKEKAKTLGIEFIPLEVSLRETVETLKEKNFANF

SEQ ID NO: 4926 - DNA, 1379 bp, Glycine max
  CDS (138)..(1124)
gatgtgatagaaaaaggaggaacgcagaccgaggcgtttccagttcgaaagggaaatgaaagtgtctttgttggtgaagggtaggtgagagaaacgaaaggggtgtgtgttgggttgaataggtatagataggatcaatgagcaacaacaacgcaggaaaggtggtgtgtgtgacgggtgcttctggtttcatagcttcatggatcgtcaaattccttctccaacgtggttacactgtcagggccaccgttcgctacccaagtaatctgaaaaaggtagatcacttggttaaacttgagggcgcaaaagagaggttgcagctgtttaaggcagatctgttggaagaaggttcctttgactctgttgtggaaggctgtcatggtgtttttcatactgcttcacctgtccgttttgttgtcaacgacccacaggctgaattgcttgatcctgcagtgaagggaactcttaatgttctcaaatcatgtgcaaaatcaccatctgtcaaacgggttgttttaacttcttctatttctgcagttgcatttaatcgaagacctaaaactcctcaagtggtagttgatgagacatggttttcagatccagatgtctgtagggaattagagttgtggtacacactttcaaagactttggctgaggatgctgcctggaaatttgtaaatgaaaacagcattgacatgatttctattaacccaactatggtggcaggacctctcttacaaccagagattaatgaaagtgttgagccaattttaaacctaataaatggtaaaccatttccaaataaatcttttggatgggtcgatgtgaaagatgttgctaatgctcatattctggcctatgaaattgcttcagctagtggaagatattgtttggttgagagagtcatacactactctgaacttgctacgattttacgtggtctgtaccccacattacaaattccagataagtgtgaggtagatgagccgtatatcccaacataccagatttccacagaaaaggcaaaaaaggacttgggaatagagtttactcctttggaagtgagtctcagggagactgtggaaagctttagagaaaagaagattgtcaactttaatccgtgatctatcctaaataaataaatgtcgatgatctcaaccacgttcaatttgtgactatgataaatgtcaggcttcagaaggaattatcactgtaaaatatggattgcaaacaggttaacattgtttgatgaaggaccgaatataaaaggataaattgtatataaattcctgaactttgggcgaattatgctttgtccttttttatgaatttcaactgtacaatgttcgagtccaaaaaaaaaaaaaaaaaaaaaaaaa

SEQ ID NO: 4927 - protein, 328 aa, Glycine max
MSNNNAGKVVCVTGASGFIASWIVKFLLQRGYTVRATVRYPSNLKKVDHLVKLEGAKERLQLFKADLLEEGSFDSVVEGCHGVFHTASPVRFVVNDPQAELLDPAVKGTLNVLKSCAKSPSVKRVVLTSSISAVAFNRRPKTPQVVVDETWFSDPDVCRELELWYTLSKTLAEDAAWKFVNENSIDMISINPTMVAGPLLQPEINESVEPILNLINGKPFPNKSFGWVDVKDVANAHILAYEIASASGRYCLVERVIHYSELATILRGLYPTLQIPDKCEVDEPYIPTYQISTEKAKKDLGIEFTPLEVSLRETVESFREKKIVNFNP

SEQ ID NO: 4928 - DNA, 1155 bp, Oryza sativa (japonica cultivar-group)
  CDS (1)..(1155)
atgtcgtccaattttgaggccaacaacaacaatggcgagaagcagctggtctgtgtgaccggagcaggtggcttcattgggtcgtgggtggtgaaggagctcctcatccgtggctaccacgtcaggggaacagccagagatcctgctgacagcaagaatgctcacctgcttgagctggagggagccgaccagaggctctccctctgccgtgccgacgtcctcgacgccgccagcctccgcgccgccttcagcgggtgccacggcgtcttccatgtcgcctccccggtgtccaacgaccctgacctggttccggttgcagtggaggggacgaggaacgtgatcaacgcggcggcggacatgggcgtgcggcgcgtggtgttcacgtcgtcctacggcgccgtgcacatgaaccccagcaggagccccgacgccgtcctcgacgagacctgctggagcgactacgaattctgccgccaaaccgacaacctgtactgctgcgccaagatgatggcagagatgacggcgacggaggaggcggcgaagagggggctggagctggcggtggtggtgccgtcgatgacgatgggtcccatgctgcagcagacgctcaacttcagcagcaaccacgtcgcccgctacctcatgggcaccaagaagtcgtaccccaacgccgtcgccgcctacgtcgacgtccgcgacgtcgcccgcgcgcacgtcctcgtctacgagcgccccgacgcacgcggccgctacctctgcatcggcaccgtgctccaccgcgccgagctcctccggatgctcagggacctcttcccccagtaccctgccactgcaaagtgtgaagatgacgggaagccgatggcgaagccgtacaagttctcgaaccagaggctcaaggatttggggttggaattcactccactgaggaagagtttgcatgaggcggtcttatgcatgcagcagaagagtcacctgcctctgatttatcccgttccaaaacatcacgtcgagtttacagtgtttcggcagaaattggagagttatctgaactccagagcactaaagtctgacgacacttttcatagtttggacaggcccgggcagcagtgcaacacctgggcgacgcgtgagggccccagcggcaagccactgtag

SEQ ID NO: 4929 - protein, 384 aa, Oryza sativa (japonica cultivar-group)
MSSNFEANNNNGEKQLVCVTGAGGFIGSWVVKELLIRGYHVRGTARDPADSKNAHLLELEGADQRLSLCRADVLDAASLRAAFSGCHGVFHVASPVSNDPDLVPVAVEGTRNVINAAADMGVRRVVFTSSYGAVHMNPSRSPDAVLDETCWSDYEFCRQTDNLYCCAKMMAEMTATEEAAKRGLELAVVVPSMTMGPMLQQTLNFSSNHVARYLMGTKKSYPNAVAAYVDVRDVARAHVLVYERPDARGRYLCIGTVLHRAELLRMLRDLFPQYPATAKCEDDGKPMAKPYKFSNQRLKDLGLEFTPLRKSLHEAVLCMQQKSHLPLIYPVPKHHVEFTVFRQKLESYLNSRALKSDDTFHSLDRPGQQCNTWATREGPSGKPL

SEQ ID NO: 4930 - DNA, 1035 bp, Saccharomyces cerevisiae
  CDS (1)..(1035)
atgtctaatacagttctagtttctggcgcttcaggttttattgccttgcatatcctgtcacaattgttaaaacaagattataaggttattggaactgtgagatcccatgaaaaagaagcaaaattgctaagacaatttcaacataaccctaatttaactttagaaattgttccggacatttctcatccaaatgctttcgataaggttctgcagaaacgtggacgtgagattaggtatgttctacacacggcctctccttttcattatgatactaccgaatatgaaaaagacttattgattcccgcgttagaaggtacaaaaaacatcctaaattctatcaagaaatatgcagcagacactgtagagcgtgttgttgtgacttcttcttgtactgctattataacccttgcaaagatggacgatcccagtgtggtttttacagaagagagttggaacgaagcaacctgggaaagctgtcaaattgatgggataaatgcttactttgcatccaagaagtttgctgaaaaggctgcctgggagttcacaaaagagaatgaagatcacatcaaattcaaactaacaacagtcaacccttctcttctttttggtcctcaacttttcgatgaagatgtgcatggccatttgaatacttcttgcgaaatgatcaatggcctaattcataccccagtaaatgccagtgttcctgattttcattccatttttattgatgtaagggatgtggccctagctcatctgtatgctttccagaaggaaaataccgcgggtaaaagattagtggtaactaacggtaaatttggaaaccaagatatcctggatattttgaacgaagattttccacaattaagaggtctcattcctttgggtaagcctggcacaggtgatcaagtcattgaccgcggttcaactacagataatagtgcaacgaggaaaatacttggctttgagttcagaagtttacacgaaagtgtccatgatactgctgcccaaattttgaagaaggagaacagattatga

SEQ ID NO: 4931 - protein, 344 aa, Saccharomyces cerevisiae
MSNTVLVSGASGFIALHILSQLLKQDYKVIGTVRSHEKEAKLLRQFQHNPNLTLEIVPDISHPNAFDKVLQKRGREIRYVLHTASPFHYDTTEYEKDLLIPALEGTKNILNSIKKYAADTVERVVVTSSCTAIITLAKMDDPSVVFTEESWNEATWESCQIDGINAYFASKKFAEKAAWEFTKENEDHIKFKLTTVNPSLLFGPQLFDEDVHGHLNTSCEMINGLIHTPVNASVPDFHSIFIDVRDVALAHLYAFQKENTAGKRLVVTNGKFGNQDILDILNEDFPQLRGLIPLGKPGTGDQVIDRGSTTDNSATRKILGFEFRSLHESVHDTAAQILKKENRL

SEQ ID NO: 4932 - DNA, 1110 bp, Arabidopsis thaliana
  CDS (1)..(1110)
atgatgcatgaaatggcatacaaagtgtgtgtggagaaagtgaagagtttgggaattgagttcactactcctatagaagaaaccctcagagacactattgttagccttatggaggattataaagagaggtcaaaggagattatgaacggcggaggaaagttggtctgcgtcaccggagcttccggttacatagcgtcttggattgtcaagcttttgctcctccgtggctacaccgtcaaggccactgttcgagatctaacggacaggaagaaaacagaacatcttcttgcacttgatggtgcaaaagaaagactcaaattgttcaaagcagatcttttggaagaatcttctttcgaacaagctattgaaggatgtgacgctgtcttccacaccgcatctccagttttcttcaccgtcaaagatcctcagactgagctgattgatccagccttaaagggtactatgaacgtccttaatacatgcaaagaaactccctctgtcagaagggtcattctgacatcatccacggctgcggttctctttcgtcagccacctgtggaggcaagcgatgtggtggacgagactttcttctccgatccaagtctatgcagggagacaaagaattggtatccactctccaaaattttggcagagaatgcagcgtgggaatttgccaaagacaacggaatcgacatggtcgtgttgaatccaggatttatattcggaccactcttgcaaccaactctgaacttttcggtagagctaattgtggatttcataaatggtaagaatcctttcaatagtagattctacaggttcgtggacgtaagagatgttgccttagctcatatcaaagctctggagactccttcagccaatggcagatacatcattgatggtccaattatgagtgtaagtgacattatagatattctgcgggagctacttccagacttgtgtattgctgatacgaatgaagaaagtgtgatgaatgaaatgttatgcaaagtgtgtgtggagaaagtgaagaatttgggagttgagttcactccaatgaaatcgagccttagagacactattgttagcctcaaggagaaatgtcttttatga

SEQ ID NO: 4933 - protein, 369 aa, Arabidopsis thaliana
MMHEMAYKVCVEKVKSLGIEFTTPIEETLRDTIVSLMEDYKERSKEIMNGGGKLVCVTGASGYIASWIVKLLLLRGYTVKATVRDLTDRKKTEHLLALDGAKERLKLFKADLLEESSFEQAIEGCDAVFHTASPVFFTVKDPQTELIDPALKGTMNVLNTCKETPSVRRVILTSSTAAVLFRQPPVEASDVVDETFFSDPSLCRETKNWYPLSKILAENAAWEFAKDNGIDMVVLNPGFIFGPLLQPTLNFSVELIVDFINGKNPFNSRFYRFVDVRDVALAHIKALETPSANGRYIIDGPIMSVSDIIDILRELLPDLCIADTNEESVMNEMLCKVCVEKVKNLGVEFTPMKSSLRDTIVSLKEKCLL

SEQ ID NO: 4934 - DNA, 969 bp, Arabidopsis thaliana
  CDS (1)..(969)
atgaactgcggaggaaaggtggtctgcgttaccggagcttccggctacatagcgtcttggattgtcaagcttttgctcctccgtggctacaccgtcaatgccactgttcgagatccaaaggacaagaagaaaacagaacatcttcttgcactagacggtgcaaaagaaagactcaaattgttcaaagcagatcttttggaagaatcttcttttgatcaagctatcgatggttgtgatgctgtcttccacactgcttctccagttctattcactgtcacagatcctcagactgagctgattgatccagccttaaagggtactattaacgtccttaatacatgcaaacaagtttcttctgtcaagagggtcattctgacatcttccacggctgcggttctctctcgtcagcctcctattgggccaaacgacctggtggacgagactttcttctccgatccaagtctatgcagggagacaaagaattggtattcactctccaagattttggccgagaatgcagcgtggcaatttgccaaagacaatggaatcgacatggttgtgttgaatcctggatttatttgcggaccactcttgcaaccaactcttaacatgtcggtagagctaattgtggatttcataaatggtaagaaccctttcaataaaagatactacaggttctcggacgtaagagatgtcgccttggttcatatcaaagcgttggagactccttcagccaatggcagatacatcatcgatggtccaaatatgagtgtaaacgacattatagacattcttcggaagctgttcccagatttgtctattgctgatacgaatgaagaaagtgagatgaatgagatgatatgccaagtgtgtgtggagaaagtgaaaaatttgggagtagagttcactcctatgaaatcaagccttagagacactattgttagcctcaaggagaaatgtcttttatga

SEQ ID NO: 4935 - protein, 322 aa, Arabidopsis thaliana
MNCGGKVVCVTGASGYIASWIVKLLLLRGYTVNATVRDPKDKKKTEHLLALDGAKERLKLFKADLLEESSFDQAIDGCDAVFHTASPVLFTVTDPQTELIDPALKGTINVLNTCKQVSSVKRVILTSSTAAVLSRQPPIGPNDLVDETFFSDPSLCRETKNWYSLSKILAENAAWQFAKDNGIDMVVLNPGFICGPLLQPTLNMSVELIVDFINGKNPFNKRYYRFSDVRDVALVHIKALETPSANGRYIIDGPNMSVNDIIDILRKLFPDLSIADTNEESEMNEMICQVCVEKVKNLGVEFTPMKSSLRDTIVSLKEKCLL

SEQ ID NO: 4936 - DNA, 978 bp, Arabidopsis thaliana
  CDS (1)..(978)
atggctgatggaggaaaggtggtctgcgtaaccggagcttccggttacatagcgtcttggatcgtcaagcttttgctcttccgtggctacaccatcaatgccaccgttcgagacccaaaagatcgaaagaaaacagatcaccttctagcacttgacggcgcaaaagaaagactcaaattattcaaagcagatcttctagatgaaggttcttttgagctcgcaattgatggatgcgagactgtcttccacactgcttcaccggttgcaatcactgtcaagactgatcctcaggttgagctgatcaatccagccgtcaatggtactattaacgtcctaagaacttgcactaaagtgtcttctgtcaagagggtcatcttaacatcgtccatggccgcagttcttgcgcctgagaccaagttgggaccaaacgatgtagtagacgaaaccttcttcactaatccaagttttgctgaggagagaaagcaatggtatgtactttctaagactttggccgaagatgcagcatggcgatttgccaaggacaatgagatcgacttgatcgtactgaatccgggacttgtgactggaccaatcttgcagccaactcttaatttctcggtagctgtgattgtggaacttatgaaaggcaagaatccttttaatactacacatcataggttcgtggacgtgagagatgttgctctagctcatgtaaaggcactcgagactccttcagccaatggcagatatatcattgatggtccggttgtgacaataaaagacattgaaaacgttttgcgcgaattctttcctgatttgtgtattgctgataggaatgaagacattactgagctgaattcagtgactttcaatgtgtgtctggataaagtgaaaagtttgggaataattgagttcactcctacagaaacaagccttagagacactgttcttagtctcaaggagaaatgtcttgtgtga

SEQ ID NO: 4937 - protein, 325 aa, Arabidopsis thaliana
MADGGKVVCVTGASGYIASWIVKLLLFRGYTINATVRDPKDRKKTDHLLALDGAKERLKLFKADLLDEGSFELAIDGCETVFHTASPVAITVKTDPQVELINPAVNGTINVLRTCTKVSSVKRVILTSSMAAVLAPETKLGPNDVVDETFFTNPSFAEERKQWYVLSKTLAEDAAWRFAKDNEIDLIVLNPGLVTGPILQPTLNFSVAVIVELMKGKNPFNTTHHRFVDVRDVALAHVKALETPSANGRYIIDGPVVTIKDIENVLREFFPDLCIADRNEDITELNSVTFNVCLDKVKSLGIIEFTPTETSLRDTVLSLKEKCLV

SEQ ID NO: 4938 - DNA, 969 bp, Arabidopsis thaliana
  CDS (1)..(969)
atggctgacggaggaaaaatggtttgcgtcactggagcgtccggttacgttgcgtcttggattgttaagcttttgctcctccgtggctacactgttagggccaccgttcgagacccaagtgatgaaaagaaaacagaacatcttcttgcactagacggtgcaaaagaaaaactcaaactgttcaaagcagatcttctggaagaaggttctttcgagcaagctattgaaggttgtgacgctgtcttccataccgcttctccagtttcactaactgtaactgatcctcagattgagctgattgacccggcagtaaagggaacacttaacgtccttaaaacttgcgctaaagtttcatctgttaagagggtcatcgtaacatcgtccatggccgcagttctctttcgtgagcctaccttgggaccaaacgacttagtagacgagagttgcttctcggatccaaacttttgcactgagaaaaagctttggtatgcgctctcaaagactttggccgaagatgaagcatggcgattcgcaaaggaaaaagggctcgacttggtcgtaataaatccaggacttgtgctcggaccgctcttgaaaccaagccttactttctcagtaaatgtgattgtggaacttattacaggtaaggacaatttcatcaacaaggattttaggctcgtcgatgtgagggatgttgccctcgctcatatcaaagcgttcgagactccttcagccaacggtagatatattattgagggtccggttgtgacgataaatgacattgagaagattttgcgtgaattctttcctgacttgaatctcggtaacaagggtgaagcaagtgagatcattccagtgatatacaagctatgtgttgagaaagtgaagagtttgggaattgagttcactcccacagaagcaacccttagagacactattcttagcctcaaagagaaatgtcttgtgtga

SEQ ID NO: 4939 - protein, 322 aa, Arabidopsis thaliana
MADGGKMVCVTGASGYVASWIVKLLLLRGYTVRATVRDPSDEKKTEHLLALDGAKEKLKLFKADLLEEGSFEQAIEGCDAVFHTASPVSLTVTDPQIELIDPAVKGTLNVLKTCAKVSSVKRVIVTSSMAAVLFREPTLGPNDLVDESCFSDPNFCTEKKLWYALSKTLAEDEAWRFAKEKGLDLVVINPGLVLGPLLKPSLTFSVNVIVELITGKDNFINKDFRLVDVRDVALAHIKAFETPSANGRYIIEGPVVTINDIEKILREFFPDLNLGNKGEASEIIPVIYKLCVEKVKSLGIEFTPTEATLRDTILSLKEKCLV

SEQ ID NO: 4940 - DNA, 1035 bp, Arabidopsis thaliana
  CDS (1)..(1035)
atgccagtcgacgtagcctcaccggccggaaaaaccgtctgcgtcaccggagctggtggatacatcgcttcttggattgttaagatacttctcgagagaggttacacagtcaaaggaaccgtacggaatccagatgatccgaagaacacacatttgagagaactagaaggaggaaaggagagactgattctgtgcaaagcagatcttcaggactacgaggctcttaaggcggcgattgatggttgcgacggcgtctttcacacggcttctcctgtcaccgacgatccggaacaaatggtggagccggccgtgaatggagccaagtttgtaattaatgctgcggctgaggccaaggtcaagcgcgtggtcatcacctcctccattggtgccgtctacatggacccgaaccgtgaccctgaggctgtcgttgacgaaagttgttggagtgatcttgacttctgcaaaaacaccaagaattggtattgttacggcaagatggtggcggaacaagcggcgtgggagacagcaaaggagaaaggtgttgacttggtggtgttgaatccggtgctggttcttggaccgccgttacagccgacgatcaacgccagtctttaccacgtcctcaaatatctaaccggctcggctaagacttatgctaatttgactcaagcttatgtggatgttcgcgatgtcgcgctggctcatgttctggtctatgaggcaccctcggcctccggacgttatctcctagccgagagtgctcgccaccgcggggaagttgttgagattctggctaagctattcccggagtatcctcttccgaccaagtgcaaggacgagaagaaccctagagccaagccatacaaattcactaaccagaagattaaggacttaggcttagagttcacttccaccaagcaaagcctctacgacacagtcaagagcttacaagagaaaggccatcttgctcctcctcctcctcctccttcagcatcgcaagaatccgtggaaaatggcattaagatcgggtcttga

SEQ ID NO: 4941 - protein, 344 aa, Arabidopsis thaliana
MPVDVASPAGKTVCVTGAGGYIASWIVKILLERGYTVKGTVRNPDDPKNTHLRELEGGKERLILCKADLQDYEALKAAIDGCDGVFHTASPVTDDPEQMVEPAVNGAKFVINAAAEAKVKRVVITSSIGAVYMDPNRDPEAVVDESCWSDLDFCKNTKNWYCYGKMVAEQAAWETAKEKGVDLVVLNPVLVLGPPLQPTINASLYHVLKYLTGSAKTYANLTQAYVDVRDVALAHVLVYEAPSASGRYLLAESARHRGEVVEILAKLFPEYPLPTKCKDEKNPRAKPYKFTNQKIKDLGLEFTSTKQSLYDTVKSLQEKGHLAPPPPPPSASQESVENGIKIGS

SEQ ID NO: 4942 - DNA, 978 bp, Arabidopsis thaliana
  CDS (1)..(978)
atgagcagcgaagaagagaagacagtgtgtgtgacaggagcttcaggttacattgcttcatggatcgttaagcttcttcttctccgtggttacaccgttaaagcctctgttcgtgatccaaatgatccaaggaaaacagagcatttgcttgcattggaaggagcagaggaaaggcttaaattgttcaaagcaaacttgttagaagaaggctctttcgattcagcaatcgatggttgcgaaggagttttccacaccgcatcgccattctatcatgacgtcaaggaccctcaggctgagttacttgatccggcagtgaaaggaacaatcaatgttctaagctcttgtttgaagacttcctcggttaagagagtcgtcttaacctcatcgatagcagctgttgctttcaatggaatgcctcgaacacccgaaaccatagttgacgaaacttggttcgccgatcctgactattgcagagcttccaagctatggtatgtactctcgaagacattagctgaaaacgcagcgtggaaattcgcaaaagagaacaatttacagctggtttcgataaatccggctatggtgattggtcctctcttacagccaacgctaaacactagtgctgctgcagtactaagcttgatcaaaggagcacaaacgtttcctaatgcgacgttcgggtgggttaacgttaaagatgtagcgaacgctcatattcaagcgtttgagaatccagatgctgatgggagatactgtttagtggagagagttgctcattactctgaagttgttaacattttgcatgatctttaccctgattttcaactccctgagaagtgtgcagatgaaaagatatatattccaacatataaagtgtctaaagagaaagcagagtctcttggggttgagtttgtgccattggaagttagcattaaagagactgtagagagcttgagagataaagggttcatcagattttga

SEQ ID NO: 4943 - protein, 325 aa, Arabidopsis thaliana
MSSEEEKTVCVTGASGYIASWIVKLLLLRGYTVKASVRDPNDPRKTEHLLALEGAEERLKLFKANLLEEGSFDSAIDGCEGVFHTASPFYHDVKDPQAELLDPAVKGTINVLSSCLKTSSVKRVVLTSSIAAVAFNGMPRTPETIVDETWFADPDYCRASKLWYVLSKTLAENAAWKFAKENNLQLVSINPAMVIGPLLQPTLNTSAAAVLSLIKGAQTFPNATFGWVNVKDVANAHIQAFENPDADGRYCLVERVAHYSEVVNILHDLYPDFQLPEKCADEKIYIPTYKVSKEKAESLGVEFVPLEVSIKETVESLRDKGFIRF

SEQ ID NO: 4944 - DNA, 960 bp, Arabidopsis thaliana
  CDS (1)..(960)
atgaacggcgaaggaaaggttgtttgcgtcaccggagcttccggatacatagcttcttggattgttaagcttttgctcctccgtggctacaccgtcagggccaccgtccgaaacccaatggatacaaagaaaacaaatcatcttcttacacttgaaggtgcaagtgaaagactaaaactgttcaaatcagatcttttggaagaaggttctttcgatcaagctatagagggatgcgacggtgtcttccatactgcctctccagtttcattaaccgttacagatcctcagactgagatgatcgatccggcggttaatggtactttgaacgttttgagaacgtgcgccaaagtttcttctgtgaagagggtcattgtaacatcgtccactgctgctactctttctattaacccaaacgacgtggtggacgaaaccgtcttcaccgatctaagtgtttacttagcgatgaaggcatggtatggatattcaaaaactttggctgaggaaacagcgtggcggtttgctaaagaaaacgggatcgatttggttgtaatgaatccaggaaacgtgatcggaccagttttgcagccaactcttaattactctgtagaagtgattgtggatctgataaatggtaaaaacccttccaatagtttttactataggttcatggacgtgagagatgtttctcttgctcatatcaaagcgttcgaggtcccttctgctagtggcagatacatacttgctgatccagatgtaacaatgaaagacattcaaaagcttttacatgaactgtttcctgatttgtgccgtgttgataaggataatgagaatgaggtgggtgaaatggcatacaaagtgtgtgtcgataaattgaaaagtttgggaattgagttcactcctatcaaagaatctctcaaggatactgttgttagccttaaggagaggtgtcttcttatatga

SEQ ID NO: 4945 - protein, 319 aa, Arabidopsis thaliana
MNGEGKVVCVTGASGYIASWIVKLLLLRGYTVRATVRNPMDTKKTNHLLTLEGASERLKLFKSDLLEEGSFDQAIEGCDGVFHTASPVSLTVTDPQTEMIDPAVNGTLNVLRTCAKVSSVKRVIVTSSTAATLSINPNDVVDETVFTDLSVYLAMKAWYGYSKTLAEETAWRFAKENGIDLVVMNPGNVIGPVLQPTLNYSVEVIVDLINGKNPSNSFYYRFMDVRDVSLAHIKAFEVPSASGRYILADPDVTMKDIQKLLHELFPDLCRVDKDNENEVGEMAYKVCVDKLKSLGIEFTPIKESLKDTVVSLKERCLLI

SEQ ID NO: 4946 - DNA, 966 bp, Arabidopsis thaliana
  CDS (1)..(966)
atgtctgagtatttggtaactggaggaacaggtttcattgcttcttacatcatcaaatcacttctcgaactcggacacaccgttcgaacaactgtccgaaacccacgtgatgaagaaaaggttggatttttatgggaatttcaaggagcaaaacagaggctaaagattctccaagctgatctaacggtagaaggaagttttgatgaagcagtgaatggtgttgatggagtattccacactgcttctcctgttcttgttccacaggatcataacattcaggagactttggttgatcctattataaagggtacaacaaatgtgatgagctcttgtgccaagtctaaagccacattgaaaaggattgttcttacgtcttcttgctcttcgatacgctaccgtttcgatgcaactgaagcttctcctctcaatgagtctcattggagtgatcctgaatattgcaaacgtttcaatctttggtatggatatgcaaagactttaggagaaagagaggcttggaggatagctgaagagaaaggattagacttggttgttgtgaatccttcgtttgtggttggtccattgcttggaccaaaaccaacaagtactctgcttatgattcttgctattgctaaaggtcttgctggagagtatccaaatttcactgtcgggtttgtgcatatagatgatgttgttgctgcacatgtattggctatggaagagcctaaagcatcagggagaatcatatgttcgagttctgttgctcattggtctgagatcattgagttgatgagaaataagtatcctaattacccatttgagaacaagtgtagtaacaaagaaggagacaatagtccacatagtatggatacaaggaagatacatgagttgggatttggatccttcaagtcactacctgagatgtttgatgattgcatcatcagttttcagaagaagggtctgctctaa

SEQ ID NO: 4947 - protein, 321 aa, Arabidopsis thaliana
MSEYLVTGGTGFIASYIIKSLLELGHTVRTTVRNPRDEEKVGFLWEFQGAKQRLKILQADLTVEGSFDEAVNGVDGVFHTASPVLVPQDHNIQETLVDPIIKGTTNVMSSCAKSKATLKRIVLTSSCSSIRYRFDATEASPLNESHWSDPEYCKRFNLWYGYAKTLGEREAWRIAEEKGLDLVVVNPSFVVGPLLGPKPTSTLLMILAIAKGLAGEYPNFTVGFVHIDDVVAAHVLAMEEPKASGRIICSSSVAHWSEIIELMRNKYPNYPFENKCSNKEGDNSPHSMDTRKIHELGFGSFKSLPEMFDDCIISFQKKGLL

SEQ ID NO: 4948 - DNA, 954 bp, Arabidopsis thaliana
  CDS (1)..(954)
atggctgtaaagcaaaaggtctgtgttactggtgcaggagggtttattgcttcatggctcgtcaagtttcttctctctcgtggctacactgtccatggaaccgttcgagatccttgtgatgaaaagaatgaccatttgaggaaactggataatgcttcaaaaaatctgaaacttttcaaggcagatttgtttgatgatgaaggtcttttctcagccattgatggttgctctggcgttttccatatcgcttctcctgtgccttttgaaggagaagaactgattaaaccagctctcactggcaccaagaatgttctagaagcatgcacagaaaccaaagtgcagaaagttgtggttgtatcatcaatcgctgcagttgtttacaatccaaaatggcctcaagatgttgctaaggacgaggattgttggtcagacactcaataccttcactcacttgagcgttattactatcttgccaaaacattaacggaacgtgaagctttagagtggagtaagagaaactttgctgatgttgttacgctctgtccgtctgtcattataggccctaggcttcaatccacgcttaactctagtagtttgggacttctcaagttcataaaaggtggtataaagtccttgttgagcgatgaactgtatcttgtggatgtgcgtgatgttgcggatgcgcttttgttggtgtatgaaaatcgagaagcaacaggaagatacatatgtaattctcattcactttacactgattctcttatggagaagctcaagaatatgtatcctaaacgcaacttccctgaaagtttcacggaggtaaaagagaaggaagtgaggcctctaagtgcagagaagttgaaaaacttggggtggaagtttaggccattagaagaaaccattgatgattctgttgtgagctttgaagcagctggtgatcttccaaaggcataa

SEQ ID NO: 4949 - protein, 317 aa, Arabidopsis thaliana
MAVKQKVCVTGAGGFIASWLVKFLLSRGYTVHGTVRDPCDEKNDHLRKLDNASKNLKLFKADLFDDEGLFSAIDGCSGVFHIASPVPFEGEELIKPALTGTKNVLEACTETKVQKVVVVSSIAAVVYNPKWPQDVAKDEDCWSDTQYLHSLERYYYLAKTLTEREALEWSKRNFADVVTLCPSVIIGPRLQSTLNSSSLGLLKFIKGGIKSLLSDELYLVDVRDVADALLLVYENREATGRYICNSHSLYTDSLMEKLKNMYPKRNFPESFTEVKEKEVRPLSAEKLKNLGWKFRPLEETIDDSVVSFEAAGDLPKA

SEQ ID NO: 4950 - DNA, 999 bp, Arabidopsis thaliana
  CDS (1)..(999)
atgcttgtcgacgggaaactcgtctgcgtcaccggagccggcggctacattgcttcttggatcgttaagttactcttagagagaggctacaccgttagaggaaccgtaaggaacccaactgatcccaagaacaaccatctcagagagcttcaaggagccaaggaaagactcactcttcacagtgcagatcttctcgactacgaagctctctgtgccacaatcgacggttgcgatggcgttttccacactgcctctccgatgaccgacgatcccgagacaatgttggagccggcggtgaacggagccaagttcgtgattgacgcagcggctaaagccaaggtcaagcgcgtggttttcacgtcatcaattggtgcagtttacatgaaccctaaccgtgacactcaagccattgttgacgaaaactgctggagtgatcttgatttctgcaaaaacactaagaattggtattgctacgggaagatgttggcggaacaatcggcatgggagacggccaaagcaaaaggtgtggacttagtggtgctaaatccggttttggttctcggaccaccgctccagtcagcgatcaacgctagtctagtccatattctcaagtacctcaccggctcagccaagacctacgctaacttgactcaggtctacgtggacgtccgtgacgtggcactaggccatgttctggtctacgaagcaccctccgcctcaggccgttacatcctcgccgagaccgcacttcaccgcggagaggttgttgagattctggccaaattcttcccggagtatccacttcccaccaagtgttcggacgagaagaatccgagggctaagccatacaagtttactacccaaaagataaaagacttaggcttggaatttaaacccatcaagcaatctctttacgaatctgtcaagagcttgcaagagaaaggccatcttcctctacctcaagattcgaaccaaaacgaagtcatcatcgaatcttag

SEQ ID NO: 4951 - protein, 332 aa, Arabidopsis thaliana
MLVDGKLVCVTGAGGYIASWIVKLLLERGYTVRGTVRNPTDPKNNHLRELQGAKERLTLHSADLLDYEALCATIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYESVKSLQEKGHLPLPQDSNQNEVIIES

SEQ ID NO: 4952 - DNA, 957 bp, Arabidopsis thaliana
  CDS (1)..(957)
atggcgaaagagacagtgtgtgtaaccggagctaatggtttcatcggatcttggataatccgaacgttaattgagaaaggatatactaaaatccacgcttcgatttacccaggatccgacccgactcatcttctgcaactacccggatccgattctaagatcaagatctttgaagcggatctcttagactctgatgcaatctccagagctattgatggatgtgcgggagtgttccacgtggcgtcaccttgtacgttggatccaccggtagatccagagaaggagctggtcgaaccggcggttaagggaacgatcaatgtgttggaagctgctaagaggtttaatgtgagacgcgtggtgatcacgtcatctatctccgcattggttcctaaccctaattggccggaaaaagttcccgtcgatgagtcgtcgtggtccgatcttgatttttgcaagtcgaggcagaaatggtatccaatttcgaagacattagctgagaaagcagcttgggaattttcggagaagcatggaaccaacattgtgacgattcatccatcaacatgtctcggaccgcttctgcaaccgaacctaaacgcaagctgtgctgttctgctacagcttttacaaggctcgaccgagacgcaagagcatcactggctcggtgtggttcacgtgaaagatgtggctaaaggtcatgtgatgctattcgaaacacctgacgcttctggacggtttttatgcactaatgggatttatcagttcagtgagtttgctgctcttgtgtctaagctcttccctgagtttgctgttcacaagtttgataaagagactcaacctgggcttacgtcgtgtaatgatgcggctaagcgattgattgagctcgggctggtttttactgcggttgaagatgcggttaaggagacggtccagagtcttagagacaaaggcttcctctga

SEQ ID NO: 4953 - protein, 318 aa, Arabidopsis thaliana
MAKETVCVTGANGFIGSWIIRTLIEKGYTKIHASIYPGSDPTHLLQLPGSDSKIKIFEADLLDSDAISRAIDGCAGVFHVASPCTLDPPVDPEKELVEPAVKGTINVLEAAKRFNVRRVVITSSISALVPNPNWPEKVPVDESSWSDLDFCKSRQKWYPISKTLAEKAAWEFSEKHGTNIVTIHPSTCLGPLLQPNLNASCAVLLQLLQGSTETQEHHWLGVVHVKDVAKGHVMLFETPDASGRFLCTNGIYQFSEFAALVSKLFPEFAVHKFDKETQPGLTSCNDAAKRLIELGLVFTAVEDAVKETVQSLRDKGFL

SEQ ID NO: 4954 - DNA, 981 bp, Arabidopsis thaliana
  CDS (1)..(981)
atggcaaacagtggtgaaggtaaagtggtgtgtgtaacaggagcctccggttacatcgcctcatggctcgtcaagttcctacttagccgtggctacactgttaaggcctccgtccgtgatcccagtgatccgaaaaagacacaacacttagtttcactagaaggtgcaaaggaaagacttcacttgttcaaagcagaccttttggaacaaggttctttcgactctgctattgatggttgccatggagttttccacactgcttctccattttttaatgatgccaaagacccacaggctgaacttattgatcctgcggtcaaggggacgcttaacgttttgaattcgtgcgccaaagcctcttcggttaagagggttgttgtaacctcctccatggctgccgttggttacaatggaaaaccacgcacacctgatgttaccgtcgatgaaacttggttctctgatcctgagctttgcgaggcctccaagatgtggtatgttctatccaagactttggcggaagatgcagcttggaaactcgctaaagagaaaggcttagacattgttactattaacccggctatggtgatcggtcctctcctacagccaactctgaacacgagtgctgctgctatattaaacttaatcaatggtgcaaagactttcccaaacttgagtttcggatgggttaatgtaaaagacgtagccaatgcgcacatccaagcatttgaggtcccttcagctaatgggcgttattgtttggtcgagcgtgtcgttcaccactccgagattgttaacattctacgtgagctttacccaaatctcccactacctgaaaggtgtgtggacgagaatccctacgtgccaacgtatcaagtgtccaaggataaaacgaggagccttggcatagactacatacccttgaaggttagcatcaaggagaccgtcgagtccttgaaggaaaaaggtttcgcacagttctga

SEQ ID NO: 4955 - protein, 326 aa, Arabidopsis thaliana
MANSGEGKVVCVTGASGYIASWLVKFLLSRGYTVKASVRDPSDPKKTQHLVSLEGAKERLHLFKADLLEQGSFDSAIDGCHGVFHTASPFFNDAKDPQAELIDPAVKGTLNVLNSCAKASSVKRVVVTSSMAAVGYNGKPRTPDVTVDETWFSDPELCEASKMWYVLSKTLAEDAAWKLAKEKGLDIVTINPAMVIGPLLQPTLNTSAAAILNLINGAKTFPNLSFGWVNVKDVANAHIQAFEVPSANGRYCLVERVVHHSEIVNILRELYPNLPLPERCVDENPYVPTYQVSKDKTRSLGIDYIPLKVSIKETVESLKEKGFAQF

SEQ ID NO: 4956 - DNA, 1011 bp, Schizosaccharomyces pombe 972h-
  CDS (1)..(1011)
atgagtggaaaattggtccttgttactggtgttacaggatttattggagcccacgtcgctgagcagctcctgcaagccggctaccgtgtgcgtggtacggtgagaagcatggaaaaggcagacgagcttattagactcaatcccggattaaaggataaaattgagtttgtaatcgtcaaggatgtctctgcttctaacgcttttgacggtgttttgaaagatgtggaattgatttgtcatatagcatcaccattctttgtggaaaacgttactgacaacaaatcccaacttttggaccctgccgtgaagggtactctcggcattttagaggctgctcaaggcgtaaagagtattaagcgcattgttattacttcatcttttgccgcagtgggcaatttccaaatcgaccctcataacaataaggtgtatactgagaaggattggaatcccattacctatgaggaggcattgaccactgataatggcattgtagcatactgtgcttcgaagaaactcgccgaagaggctgctcgagagtatgtaaaggaaaagaagccttcttatgatatttgtacgatcaatcctccttatgtgtatggtccaccaattcaccctatgaaaaatatggactctttaaatacctccaatcaaatattttggaaattaatcgatggatcgaaggaagccactccattttattattactatgttgatgtccgtgatgtagctgctgctcacgtttttgcccttgagaacgccaagttgtctaacggccgtatgcttgtctccaagggtgtattcactactggtgatatttgcaaggtccttcgcaaagaattccccaacaagtccgatgttattgccgagcccgtcgatataactgtggatcccagtttcttcaagttagacaactcattttccaagtctcttggattcaaatatcattccgacgaggaatgctatgttgacactgctaagaagttatgggaacgtgctgaggagtttaaataa

SEQ ID NO: 4957 - protein, 336 aa, Schizosaccharomyces pombe 972h-
MSGKLVLVTGVTGFIGAHVAEQLLQAGYRVRGTVRSMEKADELIRLNPGLKDKIEFVIVKDVSASNAFDGVLKDVELICHIASPFFVENVTDNKSQLLDPAVKGTLGILEAAQGVKSIKRIVITSSFAAVGNFQIDPHNNKVYTEKDWNPITYEEALTTDNGIVAYCASKKLAEEAAREYVKEKKPSYDICTINPPYVYGPPIHPMKNMDSLNTSNQIFWKLIDGSKEATPFYYYYVDVRDVAAAHVFALENAKLSNGRMLVSKGVFTTGDICKVLRKEFPNKSDVIAEPVDITVDPSFFKLDNSFSKSLGFKYHSDEECYVDTAKKLWERAEEFK

SEQ ID NO: 4958 - DNA, 981 bp, Oryza sativa (japonica cultivar-group)
  CDS (1)..(981)
atggtcaccggcgtcgagcagatggtgtgcgtgaccggcgccggtggcttcatcgggtcatggctggtgaaggagctcctccaccgcggatacgccgtgagggcagccgtgagagaccctgagggcagaaagaatgctcatttgcatgctctggagagagctaaaagaaggttgtccctccacagagctgatgtgttggactgcaacagccttcgtgctgcgttcaacttatgcgatggtgttttccacgtggcatcaccagtctcagatgaccctgaacttctgccaactgctatcgagggaacaaagaatgtcatcaatgctgctgcggacatgggcatcaagcgtgtggtgtttacttcgtcttatggtgctgcccatatgaaccctaacaggagatcagatcagactcttgatgagacttgttggagtgaccttgagttctgcaaacaaacacagaattggtactgctacgcgaagacggtggccgagaagacggcgacggaggaggcgtcgaagagaggtgtgcagctgttggtggtggtgcctgccgtcaccgtgggggagatgctgcagccgacgctgaacgccagcgtctacagggtggccacctacatgaggggcaccaagagtgcgtacccgaacgccgtcgccgcgtacgtcgacgtgcgcgacgtcgcccgcgcgcacgcgctggtgtacgagcaccccgacgcgcgtggccgctacctctgcatcggcagcgtgctgcaccggtccgagtttgttcgcttgcttagggagctcttcccccagtaccctatcaccaccaggtgtgaggacaacagtaagccaatggtgaaaccttaccaattctctgtacaaaggctggaggctttaggcatgcagttcactcctttgaaagagagcttgtacaagacagtgataagcttacaggacaagggtcacctaccagcaatctcacctcgttcagccctgtga

SEQ ID NO: 4959 - protein, 326 aa, Oryza sativa (japonica cultivar-group)
MVTGVEQMVCVTGAGGFIGSWLVKELLHRGYAVRAAVRDPEGRKNAHLHALERAKRRLSLHRADVLDCNSLRAAFNLCDGVFHVASPVSDDPELLPTAIEGTKNVINAAADMGIKRVVFTSSYGAAHMNPNRRSDQTLDETCWSDLEFCKQTQNWYCYAKTVAEKTATEEASKRGVQLLVVVPAVTVGEMLQPTLNASVYRVATYMRGTKSAYPNAVAAYVDVRDVARAHALVYEHPDARGRYLCIGSVLHRSEFVRLLRELFPQYPITTRCEDNSKPMVKPYQFSVQRLEALGMQFTPLKESLYKTVISLQDKGHLPAISPRSAL

SEQ ID NO: 4960 - DNA, 987 bp, Oryza sativa (japonica cultivar-group)
  CDS (1)..(987)
atggtcaccggccggagcgagcagatggtgtgcgtgaccggcgccggtggcttcatcgggtcgtggctggtgaaggagctcctccaccgcggatacttcgtgaggggagccatgagagaacctgcggacatcaagaatgctcatttgcatgttctggatggagctagagaaggcctgtccctctaccgagctgatgtgctcgaccgcaacagccttcgtgctgcgttcgccttatgcgatggcgttttccacgtggcatcgccagtctcaaatgaccctgaacttctgccagctgctatcgagggaaccaagaatgtcatcaacgctgctgcggacatgggcgtcaagcgtgtggtgtttacttcgtcttatggtgctgtccatatgaaccctaacagaagatctgaccagattgttgatgagagctgttggagtgaccttgagttctgcaaacaaacacagaactggtattgctacgcgaagatgttggccgagaggacggcgatggaggaggcgtcgaagagaggtgtgaatctgttggtggtcgtgccggccgtcaccgtgggggagatgctgcagccgacgctgaacgccagcgtccacagggtggccacctacatgaggggcaccaagagtgcgtacccgaacgccgtcgccgcgtacgtcgacgtgcgcgacgtcgcccgcgcgcacgcgctggtgtacgagcaccccgacgcgcgtggccgctacctctgcatcggcagcgtgctgcaccggtccgagtttgttcgcttgcttagggagctcttcccccagtaccctatcacctccagatgtaaggacaacagtaagccaatggtgaaaccatacaaattctctgtacaaaggctggagactttaggcatgcagttcactcctttgaaagagagtttatacagaacggtaataagcttacaagacaagggtcatctacctgcagcaatctcacgccgttcagccctgtga

SEQ ID NO: 4961 - protein, 328 aa, Oryza sativa (japonica cultivar-group)
MVTGRSEQMVCVTGAGGFIGSWLVKELLHRGYFVRGAMREPADIKNAHLHVLDGAREGLSLYRADVLDRNSLRAAFALCDGVFHVASPVSNDPELLPAAIEGTKNVINAAADMGVKRVVFTSSYGAVHMNPNRRSDQIVDESCWSDLEFCKQTQNWYCYAKMLAERTAMEEASKRGVNLLVVVPAVTVGEMLQPTLNASVHRVATYMRGTKSAYPNAVAAYVDVRDVARAHALVYEHPDARGRYLCIGSVLHRSEFVRLLRELFPQYPITSRCKDNSKPMVKPYKFSVQRLETLGMQFTPLKESLYRTVISLQDKGHLPAAISRRSAL

SEQ ID NO: 4962 - DNA, 1359 bp, Oryza sativa (japonica cultivar-group)
  CDS (1)..(1359)
atgaaggaaaaagatgttatgaaaatcatcccatgcaagccagggcacataaatagaatgactcggcctaaggctccggtagtcgtatgccttgtggactatatccatgaatcacctgcttcagccctagaaaagaagcataattttggaagacaggttattaaaccacttgccacttgtgttggaataagtttcacggtgatcatgaataatggtttgaaaagaaacaaaacgataatccaaggcgaggaggcggcggcggcggcggcggcggcggtgcgagacgagatcgtcgagtccggcaccccacccccgtccttcgcttcacacgaaaaggaagggaggaagatgagctccgagtctgaggcggcgcccgggaccgggaagctggtgtgcgtcaccggcgcgtcggggtacatcgcgtcgtggctcgtcaggctgctcctcgcccgcggctacacggtccgcgccaccatccgggacacctctgacccaaagaaaacactacacctgcgtgccctggatggagccaacgaaagactccatttgttcgaagcaaatctgctggaagagggctctttcgatgctgcggtcaatggttgtgattgtgttttccatacggcttctcccttttaccacaatgttaaagatcctaaggctgagttacttgaccctgcagtcaaaggaacccttaatgttctaggctcctgcaagaaagcttccattagaagagttatcgtgacatcatccatggctgctgttgcctacaatgggaaaccaagaactcctgatgtagttgttgatgagacatggttttcagttccagagatttgtgaaaagcatcagcaatggtatgttctgtccaagaccctagcagaggaggctgcttggaagttttcaaaagataatggatttgaaatagttacggtgaacccagcaatggtcattggtcccctgctgcagccttcactgaatactagtgctgaagcaattctgaagctaatcaatggatcatcctcgacatatcctaatttcagctttggctggataaacgttaaggatgttgccctggcacatatccttgcatatgaagttccttcagcaaatggaagatattgcatggttgaaagagttgcgcactactcagagctcgtccaaatcattcgtgagatgtatcccaatattcctctgccagacaagtgtgcagatgacaagccatcagtgccaatctaccaggtatcaaaggaaaagataaaaagcttgggcctggaactgactcccctgcacacgagcatcaaggagaccatcgagagcttgaaagagaaaggatttgttacttttgattcaagcaacctgtaa

SEQ ID NO: 4963 - protein, 452 aa, Oryza sativa (japonica cultivar-group)
MKEKDVMKIIPCKPGHINRMTRPKAPVVVCLVDYIHESPASALEKKHNFGRQVIKPLATCVGISFTVIMNNGLKRNKTIIQGEEAAAAAAAAVRDEIVESGTPPPSFASHEKEGRKMSSESEAAPGTGKLVCVTGASGYIASWLVRLLLARGYTVRATIRDTSDPKKTLHLRALDGANERLHLFEANLLEEGSFDAAVNGCDCVFHTASPFYHNVKDPKAELLDPAVKGTLNVLGSCKKASIRRVIVTSSMAAVAYNGKPRTPDVVVDETWFSVPEICEKHQQWYVLSKTLAEEAAWKFSKDNGFEIVTVNPAMVIGPLLQPSLNTSAEAILKLINGSSSTYPNFSFGWINVKDVALAHILAYEVPSANGRYCMVERVAHYSELVQIIREMYPNIPLPDKCADDKPSVPIYQVSKEKIKSLGLELTPLHTSIKETIESLKEKGFVTFDSSNL

SEQ ID NO: 4964 - DNA, 1029 bp, Gibberella zeae PH-1
  CDS (1)..(1029)
atgaccaaggttctcctcaccggtggctcgggcttcatcgctgcccataccctggaacagcttctcgaaaaggattacagcatcgtcacaactgtccgctcagaggacaaggcccagaagatccgcaacgcattccccgacaaagtcaaggatggcaagttggagattgtcattgtaaccgacatcgcaaagcccgatgcttttgaccaagtggccaagactcccggcctcgatgccgttattcacgttgcaagcccctttcacttcaacatcaccgatcccaagaaggatctcatagatccagctgtcattggcacaacgggtatcctcaaagcccttcatgcttcagcacccaacgtcaagcgcgtggtcatcacttcatcattcgccgccatcatcgacgaggccaagttcacagacggatctcacgtcttttccgaaaagacatggaaccctgttaccattgacgacatcacccgttccgatacaactgcttaccgcgcttcaaagaccctcgctgaacgtgcagcctgggactttgtcgccgagaagaagccctctttcgatctcgtaacggtttgcccgcctctggttctgggtcccgtatcaaagcacctcgctactctggagagcatcaacacgtccaacgcccgtatcgtgaatcttttgcgaggcgagtggaaggacgagattcctccctgcacgcccgttcctctctggattgatgtgcgagatgctgcgcgcgcacacgttcgaggtcttgaagagcccagcgctggagggaagcgactctttaccacggcaggattattctcacaccgtgagattgtcgacattattgctgagaaattcccagagttcaaggataggctccctgggcctgaagtcaagggcggagaactccctcccaaagaccagatttttggaatcgataataaggagacgaacgagctgctcaagattgactggctcacagtggaaaagagtatgacggatctggttgagtcactcaaggagattggcatctag

SEQ ID NO: 4965 - protein, 342 aa, Gibberella zeae PH-1
MTKVLLTGGSGFIAAHTLEQLLEKDYSIVTTVRSEDKAQKIRNAFPDKVKDGKLEIVIVTDIAKPDAFDQVAKTPGLDAVIHVASPFHFNITDPKKDLIDPAVIGTTGILKALHASAPNVKRVVITSSFAAIIDEAKFTDGSHVFSEKTWNPVTIDDITRSDTTAYRASKTLAERAAWDFVAEKKPSFDLVTVCPPLVLGPVSKHLATLESINTSNARIVNLLRGEWKDEIPPCTPVPLWIDVRDAARAHVRGLEEPSAGGKRLFTTAGLFSHREIVDIIAEKFPEFKDRLPGPEVKGGELPPKDQIFGIDNKETNELLKIDWLTVEKSMTDLVESLKEIGI

SEQ ID NO: 4966 - DNA, 1002 bp, Gibberella zeae PH-1
  CDS (1)..(1002)
atgtctgataagcctatcgtcttggtaactggtgccaatggttacattgccggcagtgtcgttgaggcttttctcaaagcaggatatgctgttcgaggcactgtccgatcaaaggcctctggagattccctcgtaaaggctctttcttcatatggaagtgaccttgagattgttcaagtgccggacattgttgctcctggagctttcgatacagctgtcaaggctgccggcgtgagtttaagcttcacagaccctgatcctgttcttgaagtggccatcaaaggcacggagagcgtcctggagtctgctctcaccgagccgtcaataaaatcggttgtcttgatgtcgtctattgctgccatatctgcaactggcaacccctcttcaaaccgagtcacggaagccgactggaacgatgctgctttggatgccgtcaagaaactcggcaaagcgtcgcccagtccattaatctacgttgcgagtaaagtagctggcgagcgagccttctggaagtttcgcgacgaaaagaagccttctttcacaatgactgctctcaaccctactttcgtcatgggaccacagccaggcctcgagtcaatctccaagattggtggcactactgctttcatttggcaggtgttctcaggccaggatatccccaaaccaatagtcccgaaccccagctttgtcgatgcgcgagatattgcccgagttgcagtatttagtgtcgaccatcctgaaaaggcgaatggggagcgatttctgttgacagcgggccttgtacctccccaggctgctgcggatgtgcttcgcaaggcatatcccgataggcaggacattatcaaggttggacagcctggcgagggatactatcccggttatgcctttcccgaagaaaagatccttgatgcttccaagacgatcaagttgacagggcaggacttttacccggttgagaagtcaatcatcgacacggccaagtctttggagaagttcttgtag

SEQ ID NO: 4967 - protein, 333 aa, Gibberella zeae PH-1
MSDKPIVLVTGANGYIAGSVVEAFLKAGYAVRGTVRSKASGDSLVKALSSYGSDLEIVQVPDIVAPGAFDTAVKAAGVSLSFTDPDPVLEVAIKGTESVLESALTEPSIKSVVLMSSIAAISATGNPSSNRVTEADWNDAALDAVKKLGKASPSPLIYVASKVAGERAFWKFRDEKKPSFTMTALNPTFVMGPQPGLESISKIGGTTAFIWQVFSGQDIPKPIVPNPSFVDARDIARVAVFSVDHPEKANGERFLLTAGLVPPQAAADVLRKAYPDRQDIIKVGQPGEGYYPGYAFPEEKILDASKTIKLTGQDFYPVEKSIIDTAKSLEKFL

SEQ ID NO: 4968 - DNA, 1059 bp, Candida glabrata CBS 138
  CDS (1)..(1059)
atggcttctgataacagcaacacaactgtctttgtctctggtgctactggtttcattgctcagcacgtagttagacaattgcttgaccagaactacaaggttattggttctgttagatctgctgagaagggtgaccacttgaagaatgttatcttcaaaggtggtgacttcaactatgagattgtcaaagacatctctgatccaaccgcatttgaccacgtcttcgagaagcatggcaaggatatcaaggtagtcttacacaccgcctctccattccacttcaacactactgacattgaaaaggatttgttgattccagctgtcaacggtaccaagggtatcttagaatccatcaagaagtacgctgctcaaacagttgagagagttgttgttacttcctcctttgctgccaacacctccacagttgacatgttctacgctaaggattcttccaagacaattactgaagaatcttggaaccaagacacttgggaaagttgtcaatccgatccaatcagaggttactgtggttcaaagaagtttgccgaaaaggcggcttgggacttctacaacgccaacaaggactctgtcaaatttaagttgtctatcatcaacccagtatacgtcttcggtccacaaaactatgtggaaccaggtaagaagattctaaacacttcttctgaagtcatcaacagcttggtccacttgaagaaggatgacccattgccagagtttgcaggtggtcacatcgacgtccgtgatgttgccaaggctcatatcctagcgttccaaaaggacgagttgatcgagcaaagattgatgcttcatgctggtctattcactacccaaaccctgctagatatcattaatgaacaattcccagaactgaaaggtaagattccagctggtaagccaggtaccggtaacccagatgatgcattgactccagttgacaactccaagaccaagaaattgctgggcttcgagtttattgatttgaagaaggacctttacgacaccatctctcaaattttggaagccgagaagaactctaattaa

SEQ ID NO: 4969 - protein, 352 aa, Candida glabrata CBS 138
MASDNSNTTVFVSGATGFIAQHVVRQLLDQNYKVIGSVRSAEKGDHLKNVIFKGGDFNYEIVKDISDPTAFDHVFEKHGKDIKVVLHTASPFHFNTTDIEKDLLIPAVNGTKGILESIKKYAAQTVERVVVTSSFAANTSTVDMFYAKDSSKTITEESWNQDTWESCQSDPIRGYCGSKKFAEKAAWDFYNANKDSVKFKLSIINPVYVFGPQNYVEPGKKILNTSSEVINSLVHLKKDDPLPEFAGGHIDVRDVAKAHILAFQKDELIEQRLMLHAGLFTTQTLLDIINEQFPELKGKIPAGKPGTGNPDDALTPVDNSKTKKLLGFEFIDLKKDLYDTISQILEAEKNSN

SEQ ID NO: 4970 - DNA, 1056 bp, Candida glabrata CBS 138
  CDS (1)..(1056)
atgactgctgctaataacaacactactgtttttgtctccggtgcttccggtttcattgctcaacacatcatcagacaattgctagaccagaactacaaggtcattggttctgttagatctacagagaagggtgacaacctgaagaatgctatcttcaaaagtgctaacttcaactatgagatcgtcaaggatatcgctgatctaaatgcttttgaccctgtcttcgagaagcacggtaaggatatcaaggttgtcctacacaccgcctctcctttaaacttcactactaccgaatacgaaaaggatttgttgattccagctgtcaacggtaccaagggtatcttagagtccatcaagaagtacgctgcccaaacagttgagagagttgttgttacttcctcctttgcttctcacacttccactgttgacatgtgcaacaccaagggtaagataactgaagactcctggaaccaagactcctgggaaaactgtcaaacggatgccgttagagcttacttcggttccaagaaatttgctgaagaagctgcatgggaattcttgaacaagaacaaagatgcagttaagttcaagttggccactgttgacccagtgtacgtcttcggtcctcaaaaccacatcgagcctggcaagaaggtattgaacgtctcatccgaagtcattaaccaattggtacacctgaagaaagacgacccattgccacaagtagcatgtggttacatcgatgtccgtgacattgctaaggctcatatcctagcgttccaaaaggatgaattaatcggtcaaagactgttgctacactctggtttgttcaccgtccaaaccctactggatgctatcaacgagcaattcccagagctaagaggtaagatcccagctggtgagccaggttccaacaagccagaagatctactgactccaattgacaacaccaagaccaagaagctgctaggattcgagttccgtgacctgaagaccatcatccaggacaccgtctctcaaatcctagaagctgagaatgccagtgccaagttgtaa

SEQ ID NO: 4971 - protein, 351 aa, Candida glabrata CBS 138
MTAANNNTTVFVSGASGFIAQHIIRQLLDQNYKVIGSVRSTEKGDNLKNAIFKSANFNYEIVKDIADLNAFDPVFEKHGKDIKVVLHTASPLNFTTTEYEKDLLIPAVNGTKGILESIKKYAAQTVERVVVTSSFASHTSTVDMCNTKGKITEDSWNQDSWENCQTDAVRAYFGSKKFAEEAAWEFLNKNKDAVKFKLATVDPVYVFGPQNHIEPGKKVLNVSSEVINQLVHLKKDDPLPQVACGYIDVRDIAKAHILAFQKDELIGQRLLLHSGLFTVQTLLDAINEQFPELRGKIPAGEPGSNKPEDLLTPIDNTKTKKLLGFEFRDLKTIIQDTVSQILEAENASAKL

SEQ ID NO: 4972 - DNA, 1044 bp, Oryza sativa (japonica cultivar-group)
  CDS (1)..(1044)
atgccgactgacgagacagccgcggcggcgccggccaccaccgcgctctccggccatgggtgcaccgtgtgcgtcaccggcgccggcgggttcatcgcgtcgtggctcgtcaagcgcctcctcgagaagggctacaccgtgcgtggcaccgtccggaaccctatggacccgaagaacgaccacctgagagccctggacggcgccggcgagcgcctcgtcctcctccgcgccgacctcctcgaccccgacagcctcgtcgccgccttcaccggctgcgagggcgtcttccacgctgcctcccccgtcaccgatgatcctgagaagatgatagagccggcgatcagggggacgagatacgtgataacggcggcggccgacaccggcatcaagcgagtggtgttcacgtcctccatcggcactgtctacatgaacccctacagggaccccaacaagcccgtcgacgacacctgctggagtgacctcgaatactgcaagaggacagagaactggtactgctacgcgaagacggtggcggagcagggtgcgtgggaggtggcgcggcggcgtggggtggacctggtcgtagtgaacccggtgctggtgctgggaccgctgctgcaggcgacggtgaacgcgagcacggagcacgtgatgaagtacctgacggggtcggccaagacgtacgtgaacgcagcgcaggcgtacgtccacgtccgcgacgtcgccgaggcgcacgtccgcgtgtacgactgcggcggcgcgcggggccggtacatctgcgccgagagcaccctgcaccgcggcgacctctgccgcgccctcgccaagcttttcccggagtaccccgtcccgagcaggtgcaaggacgaggcggcgccgccggtgaaggggtacctcttctccaaccagcgcctccgtgacctcggcatggacttcgtccccgtccgccagtgcctctacgaaaccgtgcgaagcctccaggacaagggcttgctgccggtgctgccgcccaccgccgacgaccaccaccacccttcctcgtga

SEQ ID NO: 4973 - protein, 347 aa, Oryza sativa (japonica cultivar-group)
MPTDETAAAAPATTALSGHGCTVCVTGAGGFIASWLVKRLLEKGYTVRGTVRNPMDPKNDHLRALDGAGERLVLLRADLLDPDSLVAAFTGCEGVFHAASPVTDDPEKMIEPAIRGTRYVITAAADTGIKRVVFTSSIGTVYMNPYRDPNKPVDDTCWSDLEYCKRTENWYCYAKTVAEQGAWEVARRRGVDLVVVNPVLVLGPLLQATVNASTEHVMKYLTGSAKTYVNAAQAYVHVRDVAEAHVRVYDCGGARGRYICAESTLHRGDLCRALAKLFPEYPVPSRCKDEAAPPVKGYLFSNQRLRDLGMDFVPVRQCLYETVRSLQDKGLLPVLPPTADDHHHPSS

SEQ ID NO: 4974 - DNA, 1080 bp, Kluyveromyces lactis NRRL Y-1140
  CDS (1)..(1080)
atgtctgcaaaggttttattgacaggtgcttcaggttttattgcgctgcatgttttagatcagctgctagctgctggttatgaagtcgttggtacagttcgttctgaagaaaaagctgagccaattaagaaggaattggctaaggaacacccaaatggtaagtaccaattcgaagtcgttgttgatatcgcagctccaaacgctttcgatgctgttttccaaaagcacactgacttgaaatacgtcctgcacactgcttctccattctcgtttggtttgacaaagagcaacgaagaaaactacttgattccggccactcacggtaccaagtctgtccttgagtctattcaaaaatacggtaagaacgtcgaacatgtaattgttacatcttcctatgcagctatcatgcgcttagatcatgccggtgacccaaatttcattcatgatgaaacttcttggaatcctatcacctgggaagaagctcgtgaaaactccgttactgcatacattgcttctaagaaatatgccgaaaagttggcctgggattttgtaaaggacaacaattctacattcaatttgactacagtgaaccctccatacgttttcggtccacaaaaattcactttcggtttggctaagtcttccttgaatacctctgctgatatcgttaatcaagccttgaagacaactccagaatatgaaggcccatttaaccagccagctggtcttgcttgtgatgtccgtgatgtcgccaagttacatgtcttgccattgggtaagaaagaattcaatggtcaaagactattcccggtcagtgacactggatatggaattgaggaatacgaaaaaggtaagttcaacttcgaaaagatcctacgtattttgaacgaaaagttgcctgaattgaagggtaagatttctccaggcggcatcaaggataatgaagctgaattagcgaaattggactactacagaaacaagactacaacagatttgactaagctaacgttctacaagtttgaagatactgtctatgatgccacaaagcaaatcttagattacgaagcctctcaaaagtaa

SEQ ID NO: 4975 - protein, 359 aa, Kluyveromyces lactis NRRL Y-1140
MSAKVLLTGASGFIALHVLDQLLAAGYEVVGTVRSEEKAEPIKKELAKEHPNGKYQFEVVVDIAAPNAFDAVFQKHTDLKYVLHTASPFSFGLTKSNEENYLIPATHGTKSVLESIQKYGKNVEHVIVTSSYAAIMRLDHAGDPNFIHDETSWNPITWEEARENSVTAYIASKKYAEKLAWDFVKDNNSTFNLTTVNPPYVFGPQKFTFGLAKSSLNTSADIVNQALKTTPEYEGPFNQPAGLACDVRDVAKLHVLPLGKKEFNGQRLFPVSDTGYGIEEYEKGKFNFEKILRILNEKLPELKGKISPGGIKDNEAELAKLDYYRNKTTTDLTKLTFYKFEDTVYDATKQILDYEASQK

SEQ ID NO: 4976 - DNA, 1080 bp, Kluyveromyces lactis NRRL Y-1140
  CDS (1)..(1080)
atgtctgctaaagttttattgacaggtgcgtcaggtttcatagcgttgcatgttttagatcagctgctagctgctggttatgaagtcgttggtacagttcgttctgaagaaaaagctgagccaattaagaaggaattggctaaggaacacccaaatggtaagtaccaattcgaagtcgttgttgatatcgcagctccaaacgctttcgatgctgttttccaaaagcacactgacttgaaatacgtcctgcacactgcttctccattctcgtttggtttgacaaagagcaacgaagaaaactacttgattccggccactcacggtaccaagtctgtccttgagtctattcaaaaatacggtaagaacgtcgaacatgtagtagttacttcttcctttgcagccattgtacacagacaccgctctggtgacccaactttcatcaatgatgaaactacttggaacccggtcatttgggaagacgctcgtgaagatgccgctacttcatatgttgcttctaagaaatatgccgaaaagttggcctgggatttcgtgaaggacaacaattctacattcaatttgactacagtgaaccctccatacgttttcggtccacaaaaattcactttcggtttagctagggcttccttaaacacctctgctgacttcgtcaacaaggccttgaagacaactccagaatatgaaggcccatttaaccagccagctggtgttgcttgtgatgtccgtgatgtcgccaagttacatgtcttgccattgggtaagaaagaattcaatggtcaaagactattcccggtcagtgacactggatatggaattgaggaatacgaaaaaggtaagttcaacttcgaaaagatcctacgtattttgaacgaaaagttgcctgaattgaagggtaagatctctccaggcggcatcaaggataatgaagctgaattatcgaaattgacctactacagaaataagatcaccacggattcaaccaagctaacgttctataagcttgaagatactatctatgatgcggcaaagcaaatcttggattatgaagcttctcaaaaataa

SEQ ID NO: 4977 - protein, 359 aa, Kluyveromyces lactis NRRL Y-1140
MSAKVLLTGASGFIALHVLDQLLAAGYEVVGTVRSEEKAEPIKKELAKEHPNGKYQFEVVVDIAAPNAFDAVFQKHTDLKYVLHTASPFSFGLTKSNEENYLIPATHGTKSVLESIQKYGKNVEHVVVTSSFAAIVHRHRSGDPTFINDETTWNPVIWEDAREDAATSYVASKKYAEKLAWDFVKDNNSTFNLTTVNPPYVFGPQKFTFGLARASLNTSADFVNKALKTTPEYEGPFNQPAGVACDVRDVAKLHVLPLGKKEFNGQRLFPVSDTGYGIEEYEKGKFNFEKILRILNEKLPELKGKISPGGIKDNEAELSKLTYYRNKITTDSTKLTFYKLEDTIYDAAKQILDYEASQK

SEQ ID NO: 4978 - DNA, 1014 bp, Debaryomyces hansenii CBS767
  CDS (1)..(1014)
atgacttcagtattcgtttcaggcgctacaggatacattgcacaacatattgtgaaaacattgctcgaaaaaaattataaagtggtaggatctgtgagatctacagaaaagggagaaaagttgaagaagctcttacagtcagccaacttcaactacgaagttgttaatgatattcagaaagaggggagctttaatgacgcattaaaacatcacccagaagtgacagttttcttacacacagcatccccattccatttcaaagctaaggacgtggagaaggagttgttgatccctgcggtcaacgggaccaagaatgcgttgaaggctattaaagactacgcaccgcaggtcaagagggtagttgtaacatcgtcgattgccgctatcaaggttgaggcaaaggaaaacgacagtacgtttgtaacaaccgaggaaacatggaatccaatctcatgggaagaggcactcactaatccagttttagggtaccgtggatctaaaacgtttgcggaaaaagcggcatgggagttcgttgaaatggaaaagcccctgttcatattgtcaacagtcaatccggtgattgtgtttggcccacaggcattcgacagtgaagtcaaagaaacattgaatacttcggcagaaattataaacaacttattgaagttgaaaccagatgatccagttcctcctctgaataatgcgtttatcgatgttcgcgacgttgccaaggcacacgtggtggcatttgagaatgaatatgccgctaaccagagattgttgcttagtgagtccaggtactcatcgcaactagtattggatcttatccacaagaacttccccgagttcaagtcgcggattccccttggaaccccaggtgtctatcccgacacctccaagctctccaagactgacaattccaaaaccaaggccatcgttggcttcccattcattcctctcgaaaaatctgtggtagatactgttctgcagatcgtggcagctgagaaacaccaatga

SEQ ID NO: 4979 - protein, 337 aa, Debaryomyces hansenii CBS767
MTSVFVSGATGYIAQHIVKTLLEKNYKVVGSVRSTEKGEKLKKLLQSANFNYEVVNDIQKEGSFNDALKHHPEVTVFLHTASPFHFKAKDVEKELLIPAVNGTKNALKAIKDYAPQVKRVVVTSSIAAIKVEAKENDSTFVTTEETWNPISWEEALTNPVLGYRGSKTFAEKAAWEFVEMEKPLFILSTVNPVIVFGPQAFDSEVKETLNTSAEIINNLLKLKPDDPVPPLNNAFIDVRDVAKAHVVAFENEYAANQRLLLSESRYSSQLVLDLIHKNFPEFKSRIPLGTPGVYPDTSKLSKTDNSKTKAIVGFPFIPLEKSVVDTVLQIVAAEKHQ

SEQ ID NO: 4980 - DNA, 1005 bp, Debaryomyces hansenii CBS767
  CDS (1)..(1005)
atgtcttctggagcaatattagtaacaggaggaacaggatttgtaggaacttattgtgtaatccagctgcttgaacaaggatatggtgtccatacatccgttagagacttgaagaaggaggccaaattacgtgaagtaatcaaagcaaatagtaatcttgatgatgaaaccattaataaaaaattgaaagtgtttgaagccgatgttaccagagatgagggatgggcagaagcattccagggtgttgatcatgtactccatgttgcgtcgccctttccgctcactgaaccggaagatccaaatgacttgataatcccagccaaagaaggtacattgcgtatattgaggtttgctacttcgttcccgtccgttaaccgtgttgtgcttacatcgtctttcgcagccgtgggttatggacatgctgaacgttccaaaccattcgacgaaaacgattttacgaatcttgacggaactaatgtaacgtacgttaagtcaaagacagttgctgaaatagaagcgtggaagtttgttaagagtgatgccaatactcacgcgcaaagtccaattgcattaaccgttttgaatccagcctacatttttgggcctcctttgaagaagagtcctgataattcgtcatctttgaaaataattgacctgttactcaatggtgcatttgctgatggatgcaagaacatgtatttaagtgccattgatgtgagggacgtggctaatattcatgttcaggctttgcagacaccagagtcagaagggaataggtttatcttgaataccggggaaaacgtttcacttttagaggtggctaatattctagctgaaaacttgccagctgaatatacgaaaaatctaccaaccaaggaattagaagggactaaagatactaagaagccatcgactaatgagaaagccaagagagtatttaattgggaaccaattcccttcaaagacgcacttttagcatctgcaaagggattactaaatatatag

SEQ ID NO: 4981 - protein, 334 aa, Debaryomyces hansenii CBS767
MSSGAILVTGGTGFVGTYCVIQLLEQGYGVHTSVRDLKKEAKLREVIKANSNLDDETINKKLKVFEADVTRDEGWAEAFQGVDHVLHVASPFPLTEPEDPNDLIIPAKEGTLRILRFATSFPSVNRVVLTSSFAAVGYGHAERSKPFDENDFTNLDGTNVTYVKSKTVAEIEAWKFVKSDANTHAQSPIALTVLNPAYIFGPPLKKSPDNSSSLKIIDLLLNGAFADGCKNMYLSAIDVRDVANIHVQALQTPESEGNRFILNTGENVSLLEVANILAENLPAEYTKNLPTKELEGTKDTKKPSTNEKAKRVFNWEPIPFKDALLASAKGLLNI

SEQ ID NO: 4982 - DNA, 1023 bp, Debaryomyces hansenii CBS767
  CDS (1)..(1023)
atgacaagaaccgtatttgtttcaggagcttctggatttatcgcccagaatatcgtcaagttattaatcgagaagggttataatgttattggaacggtaagaaccgctgagaaaggtgagaatttgaaaaagtgcttagctagtgaaaaattcacatatgaaatcgttccagatattagtgttgaaggtgcatttgataaggttttggaaaagcattctgagattaatgttttattgcataccgcttctccgtttttttacgacactactgatccagaaaatgatttggttcttccggctatcaacggtaccaagaacatattaaaggccgtaaagcaatacggagcacagattgaaagggttgtcatcacatcttcagatgctgcaatctactccgcagatgatgagcaaaattccgacctttcattcaacgaaagtaattggaacagcatttcttatgaggatgccattaaagatccgatcgcggcctattatggagcaaagacttttgctgaaaaagcggcgtgggacttcgttaaagaaaacaactccaatttcaagttgactgctgtcaatccagtctatgtttttggaccacaagcgtttgcaagtgaagttaagggcaagttaaatacttccaacgagttaattaatacattaatcaagttgggtccttctgatttatttgataacgataaaggggggttcattgatgtaagagatgttgctaaagcccatgtgatggcttttgaaagtgaggataccattaacaagagactttatttaactaatggccattttagtacccaaatgatgttagacatcgtgaacaaaaatttcccagaattgaagggtaaaattccaattggaaatcctggaacgggatctcaggatattctgactttagcgaagatgagcaatgatgcaaccagacaaattttaaattttgattttaattctttagaaaaggttgttgccgatactgttgcacaaattttagatgccagaaaacgtactttatag

SEQ ID NO: 4983 - protein, 340 aa, Debaryomyces hansenii CBS767
MTRTVFVSGASGFIAQNIVKLLIEKGYNVIGTVRTAEKGENLKKCLASEKFTYEIVPDISVEGAFDKVLEKHSEINVLLHTASPFFYDTTDPENDLVLPAINGTKNILKAVKQYGAQIERVVITSSDAAIYSADDEQNSDLSFNESNWNSISYEDAIKDPIAAYYGAKTFAEKAAWDFVKENNSNFKLTAVNPVYVFGPQAFASEVKGKLNTSNELINTLIKLGPSDLFDNDKGGFIDVRDVAKAHVMAFESEDTINKRLYLTNGHFSTQMMLDIVNKNFPELKGKIPIGNPGTGSQDILTLAKMSNDATRQILNFDFNSLEKVVADTVAQILDARKRTL

SEQ ID NO: 4984 - DNA, 1017 bp, Oryza sativa (japonica cultivar-group)
  CDS (1)..(1017)
atgtcgtccaattttgaggccaacaacaacaacaatggcgagaagcagctggtctgtgtgaccggagcaggtggcttcattgggtcgtgggtggtgaaggagctcctcatccgtggctaccacgtcaggggaacagccagggatcctgctgacagcaagaatgctcacctgcttgagctggagggagccgacgagaggctctccctctgccgcgccgacgtcctcgacgccgccagcctccgcgccgccttcagcgggtgccacggcgtcttccatgtcgcctccccggtgtctaacgaccctgaccttgttccggttgcagtggaggggacgaggaacgtgatcaacgcagcggcggacatgggcgtgcgccgcgtggtgttcacgtcgtcgtacggcgccgtgcacatgaaccccaaccggagccccgacgccgtcctcgacgagacctgctggagcgactacgaattctgcaagcaaacagacaacctgtactgctgcgccaagatgatggcggagatgacggcgacggaggaggcggcgaagagggggctggagctggcggtggtggtgccgtcgatgacgatgggtcccatgcttcagcagacgctcaacttcagcaccaaccacgtcgcccgctacctcatgggcaccaagaagtcctaccccaacgccgtcgcggcctacgtcgacgtccgcgacgtcgcccgcgcacacgtcctcgtctacgagcgccccgaggcacgcggccgctacctctgcatcggcaccgtgctccaccgcgccgagctcctccggatgctcagggagctcttcccacggtaccctgccactgcaaagtgtgaggatgatgggaagccgatggcgaagccgtataagttctcgaaccagaggctcaaggatttgggtttggagttcactccactgaggaagagtttgaatgaggcggtcctatgcatgcagcagaagggtcacctgcctctgatttatcccgttccaaaacgtgcttacctataa

SEQ ID NO: 4985 - protein, 338 aa, Oryza sativa (japonica cultivar-group)
MSSNFEANNNNNGEKQLVCVTGAGGFIGSWVVKELLIRGYHVRGTARDPADSKNAHLLELEGADERLSLCRADVLDAASLRAAFSGCHGVFHVASPVSNDPDLVPVAVEGTRNVINAAADMGVRRVVFTSSYGAVHMNPNRSPDAVLDETCWSDYEFCKQTDNLYCCAKMMAEMTATEEAAKRGLELAVVVPSMTMGPMLQQTLNFSTNHVARYLMGTKKSYPNAVAAYVDVRDVARAHVLVYERPEARGRYLCIGTVLHRAELLRMLRELFPRYPATAKCEDDGKPMAKPYKFSNQRLKDLGLEFTPLRKSLNEAVLCMQQKGHLPLIYPVPKRAYL

SEQ ID NO: 4986 - DNA, 1014 bp, Oryza sativa (japonica cultivar-group)
  CDS (1)..(1014)
atgtcgtccaattttgaggccaacaacaacaatggcgagaagcagctggtctgtgtgaccggagcaggtggcttcattgggtcgtgggtggtgaaggagctcctcatccgtggctaccacgtcaggggaacagccagagatcctgctgacagcaagaatgctcacctgcttgagctggagggagccgaccagaggctctccctctgccgtgccgacgtcctcgacgccgccagcctccgcgccgccttcagcgggtgccacggcgtcttccatgtcgcctccccggtgtccaacgaccctgacctggttccggttgcagtggaggggacgaggaacgtgatcaacgcggcggcggacatgggcgtgcggcgcgtggtgttcacgtcgtcctacggcgccgtgcacatgaaccccagcaggagccccgacgccgtcctcgacgagacctgctggagcgactacgaattctgccgccaaaccgacaacctgtactgctgcgccaagatgatggcagagatgacggcgacggaggaggcggcgaagagggggctggagctggcggtggtggtgccgtcgatgacgatgggtcccatgctgcagcagacgctcaacttcagcagcaaccacgtcgcccgctacctcatgggcaccaagaagtcgtaccccaacgccgtcgccgcctacgtcgacgtccgcgacgtcgcccgcgcgcacgtcctcgtctacgagcgccccgacgcacgcggccgctacctctgcatcggcaccgtgctccaccgcgccgagctcctccggatgctcagggacctcttcccccagtaccctgccactgcaaagtgtgaagatgacgggaagccgatggcgaagccgtacaagttctcgaaccagaggctcaaggatttggggttggaattcactccactgaggaagagtttgcatgaggcggtcttatgcatgcagcagaagagtcacctgcctctgatttatcccgttccaaaacgtgcttacctataa

SEQ ID NO: 4987 - protein, 337 aa, Oryza sativa (japonica cultivar-group)
MSSNFEANNNNGEKQLVCVTGAGGFIGSWVVKELLIRGYHVRGTARDPADSKNAHLLELEGADQRLSLCRADVLDAASLRAAFSGCHGVFHVASPVSNDPDLVPVAVEGTRNVINAAADMGVRRVVFTSSYGAVHMNPSRSPDAVLDETCWSDYEFCRQTDNLYCCAKMMAEMTATEEAAKRGLELAVVVPSMTMGPMLQQTLNFSSNHVARYLMGTKKSYPNAVAAYVDVRDVARAHVLVYERPDARGRYLCIGTVLHRAELLRMLRDLFPQYPATAKCEDDGKPMAKPYKFSNQRLKDLGLEFTPLRKSLHEAVLCMQQKSHLPLIYPVPKRAYL

SEQ ID NO: 4988 - DNA, 1065 bp, Oryza sativa (japonica cultivar-group)
  CDS (1)..(1065)
atgtcgtgcaattctgccgaggtcgcggccaacgacggcagcagcaatggcggtgagaagcagcagcagcaggaggaggaggtggtgtgcgtgacgggagcgggaggcttcatcggatcatgggtggtgaaggagcacctcctccgtggctaccgcgtcaggggaacagccagggatcccaccaagaacgcccacctgctcgcgctcgacggagccggcgagaggctcaccctgtgccgcgccgacgtcctggactccgagagcctgcgcgccgcgttcgccggatgccatggcgtcttccacgtcgcctccccggtgtccaatgaccctaatctggtgccgatcgcggtggaggggacgaggaacgtggtgaacgcggcggcggacatgggcgtgcggcgcgtggtgttcacgtcgtcgtacggcgccgtgcacatgaaccccaaccggagccccgacaccgtcctcgacgagacctgctggagcgaccccaaattctgccgccaaaccgacgtatactgctacgcgaagacgatggcggagaaggcggcggaggaggaggcggcaaagcgaggcgtgcagctggcggtggtgctgccctgcgtgacggtcgggccaatcttgcacccggccatcaacaccagcatcaaccacgtcgtccgctacctcacgggcgccgcgcccacctacccgaacgccgtcgcggcctacgtcgacgtccgcgacgtcgcccgcgcgcacgcactcgtctacgagcgccacgacgcccgcggccgctacctctgcatcggcgccgtgctccaccgcgcccatctcctccagatgctcaaggaacttttcccacagtaccccgtcacttccaagtgcaaggacgatgggaatccgatggtggaaccgtacaagttctcgaaccagaggctcaaggatttgggcttcgaattcacaccaatgaggaagtgtctgtatgacgcagtcgtatgcatgcaacagaaggggcacctcccgctggttggtaccgccgtaccggaccaaaatgtgacctctaatacgagctcgatcgtctaa

SEQ ID NO: 4989 - protein, 354 aa, Oryza sativa (japonica cultivar-group)
MSCNSAEVAANDGSSNGGEKQQQQEEEVVCVTGAGGFIGSWVVKEHLLRGYRVRGTARDPTKNAHLLALDGAGERLTLCRADVLDSESLRAAFAGCHGVFHVASPVSNDPNLVPIAVEGTRNVVNAAADMGVRRVVFTSSYGAVHMNPNRSPDTVLDETCWSDPKFCRQTDVYCYAKTMAEKAAEEEAAKRGVQLAVVLPCVTVGPILHPAINTSINHVVRYLTGAAPTYPNAVAAYVDVRDVARAHALVYERHDARGRYLCIGAVLHRAHLLQMLKELFPQYPVTSKCKDDGNPMVEPYKFSNQRLKDLGFEFTPMRKCLYDAVVCMQQKGHLPLVGTAVPDQNVTSNTSSIV

SEQ ID NO: 4990 - DNA, 1020 bp, Oryza sativa (japonica cultivar-group)
  CDS (1)..(1020)
atgtcgtccaacaattccatggaggccaacaatggcgatgatgagaagaagcaagagcaggtggtgtgcgtgacgggagcgggaggcttcatcgggtcgtgggtggtgaaggagctcctcctccgcggctaccgcgtgaggggaacagccagggatccccgcaagaacgcccacctgcttgatcttgagggagccaaggagaggctgacactgtgccgcgccgacgtcctggacttcgccagcctacgcgccgcgttcgccgggtgccatggcgtcttccacatcgcctccccggtgtccaaggaccctaatctggtgccggtcgcgattgaggggacgaggaacgtgatgaaggcggcggcggacatgggcgtgcggcgcgtggtgttcacgtcgtcgtacggcgccgtgcacatgaaccccaaccggagccccgacgccgtcctcgacgagtcctgctggagcgaccccgaattctgccagcgagaggacatatactgctacgccaagatgatggcggagaagacggcgacggaggaggcgtcgaggcgtcggctgcagctcgcggtggtggtgccgtgcgtgacggtgggtcccatcctgcagccgtccgtcaacttcagctgccaccacgtcgtccgctacctcaccggcgccgcggccacctaccccaacgccgtcgccgcctacgccgacgtccgcgacgtcgcccgcgcccacgtcctcgtctacgagcaccacggcgcgcgcggccgctacctctgcatcggcaccgtcatccaccgcgccgagctcctccggatgctcaaggagctcttcccccagtaccccgtcacttcaaagtgtgaggatgaggggaatcagatggtgaagccgtacaagttctcgaaccagaggctcagggatttgggtttggagtttactccactgaggaagagcttgcatgaggcgatcgaatgtctgcagcgcaagggtcacctgcctgttgtcacggtggcacaacagcgtgcatgtttgtag

SEQ ID NO: 4991 - protein, 339 aa, Oryza sativa (japonica cultivar-group)
MSSNNSMEANNGDDEKKQEQVVCVTGAGGFIGSWVVKELLLRGYRVRGTARDPRKNAHLLDLEGAKERLTLCRADVLDFASLRAAFAGCHGVFHIASPVSKDPNLVPVAIEGTRNVMKAAADMGVRRVVFTSSYGAVHMNPNRSPDAVLDESCWSDPEFCQREDIYCYAKMMAEKTATEEASRRRLQLAVVVPCVTVGPILQPSVNFSCHHVVRYLTGAAATYPNAVAAYADVRDVARAHVLVYEHHGARGRYLCIGTVIHRAELLRMLKELFPQYPVTSKCEDEGNQMVKPYKFSNQRLRDLGLEFTPLRKSLHEAIECLQRKGHLPVVTVAQQRACL

SEQ ID NO: 4992 - DNA, 1020 bp, Oryza sativa (japonica cultivar-group)
  CDS (1)..(1020)
atgtcgtccatttccaacgacaacaatggtgatcagaagcgacagcagcagcagcagctggtgtgcgtgaccggagcaggtggcttcatcgggtcatgggtggtgcgggagctcctcctccgtggctaccgcgtcagggccaccgtcagggaccccgcggaccgcaagaacgcccacctgctcgcgctggagggagcccacgagaggctctccctgcgccgcgccgatgtcctcgacttcgccggcctcctcgccgcgttcgccgggtgccatggcgtcttccacgtcgcctgcccgctgtccaaccgcgatccagagctgatggcggtcgcggtggatgggacgaggaacgtgatgaacgcggcggcggacatgggcgtgcggcgcgtggtgttcacgtcgtcctacggcgccgtgcacatgaaccccaaccggagccccgacgccgtcctcgacgagtcctgctggagcgaccccgaattctgccggcaaaaagacgtcagtctattacacatgtactgctacgcaaagacgatggcggagatggcggcgacggaggaggcggcgaagagggggctggagctggcggtggtggtgccgtcgatgacgatgggccccatgctgcagcgtgcgctcaacctcagcagcacgcacgtcgccaactacctcaccggcgccaagaagtcgtacccgaacgccgtcgcggcctacgtcgacgtccgcgacgtcgcccgcgcgcacgccctcgtctacgagcgccacgacgcgcgcggccgctacctctgcatcggcgccgtgctgcaccgcgcccagctcctccagatgctcatggacctcttcccccagtacaccatcgcttcaaagtgtgatgacaaggggaagccgatggtgaagccgtatgagttttcgaaccagaggctcaaggatttgggcttggaattcaccccgttgaggaagagtttgtacgacgcagtcatgtgcatgcaacgaaacggtcacctgcctgtcgtcttgccatag

SEQ ID NO: 4993 - protein, 339 aa, Oryza sativa (japonica cultivar-group)
MSSISNDNNGDQKRQQQQQLVCVTGAGGFIGSWVVRELLLRGYRVRATVRDPADRKNAHLLALEGAHERLSLRRADVLDFAGLLAAFAGCHGVFHVACPLSNRDPELMAVAVDGTRNVMNAAADMGVRRVVFTSSYGAVHMNPNRSPDAVLDESCWSDPEFCRQKDVSLLHMYCYAKTMAEMAATEEAAKRGLELAVVVPSMTMGPMLQRALNLSSTHVANYLTGAKKSYPNAVAAYVDVRDVARAHALVYERHDARGRYLCIGAVLHRAQLLQMLMDLFPQYTIASKCDDKGKPMVKPYEFSNQRLKDLGLEFTPLRKSLYDAVMCMQRNGHLPVVLP

SEQ ID NO: 4994 - DNA, 1008 bp, Oryza sativa (japonica cultivar-group)
  CDS (1)..(1008)
atgagccgggtgtgcgtcaccggagccgccggctacattgcgacatggctcgtcaagaagctcctcggcagaggctgcgtcgtccatgcaaccctgcgagatctcggggatgagaagaagacggcgctgctgaggaggatgcccggcgcggcggagcggctggtgctgttcgaggcggacatgtacgacgccgccaccttcgagcccgccatcgccggctgcgagttcgtcttcctcatcgccaccccgctgcagcacgaccccagcagcaccaagtacaagaacaacacggaagcggccgtggacgcgatgcgcgtcatcctgcagcagtgcgagcgatccaggacagtgcgccgtgtcatccacacggcctccgtcaccgccgcctcgccgctccgggaggacggcagcggcggctacaaggacttcatcaacgagtccttctggtctccactcaacctcacctacgacttcaccaatgctcatctggacggttatgtgtcatccaagtcgctctccgagaaggagctcctgagctacaactcctctccatcgccggcgttcgaggtggtcaccttggcgtgcgcggtcgtcggcggcgacacgctccagccgtacctgtggagcaccatcccggtgatcatgtcgccgctcaccggcgacgagctctgccacaacgtcctcaagtttctgcaggcgctgctgggctccgtgccgctggtgcacatcgacgacgtctgcgacgcgcacgtcttctgcatggatcagccgtccatcgccggccgcttcctctgcgccgccgggtaccccaacatgaaggactacatcgaccgcttcgccgctaagtacccagagatcgagatcaagctcaaagaggtcattggggagggggtgagggtgcaagctgacaccaagaagcttgtagatttagggttcaagtataagtatggggtggaggagacgctggattgcagtgtggaatgcgcgaagaggttgggagaactctga

SEQ ID NO: 4995 - protein, 335 aa, Oryza sativa (japonica cultivar-group)
MSRVCVTGAAGYIATWLVKKLLGRGCVVHATLRDLGDEKKTALLRRMPGAAERLVLFEADMYDAATFEPAIAGCEFVFLIATPLQHDPSSTKYKNNTEAAVDAMRVILQQCERSRTVRRVIHTASVTAASPLREDGSGGYKDFINESFWSPLNLTYDFTNAHLDGYVSSKSLSEKELLSYNSSPSPAFEVVTLACAVVGGDTLQPYLWSTIPVIMSPLTGDELCHNVLKFLQALLGSVPLVHIDDVCDAHVFCMDQPSIAGRFLCAAGYPNMKDYIDRFAAKYPEIEIKLKEVIGEGVRVQADTKKLVDLGFKYKYGVEETLDCSVECAKRLGEL

SEQ ID NO: 4996 - DNA, 1029 bp, Oryza sativa (japonica cultivar-group)
  CDS (1)..(1029)
atgggtgtcgagaagacgacggcgaacggcggcagtggcgccgcggcggtctccggcggagggcgcaccgtctgcgtcaccggcgccggcgggttcatcgcgtcgtggctcgtcaagctcctcctcgagaagggctacgccgtccgcggcaccgttcggaaccctgatgacgctgccaagaacgcgcatctcatggcgctggccggtgccgcggagcggctgaccctcgtccgggcggagctgctcgacaaggagagcctcgccgccgcgttcgccggctgcgagggcgtcttccacaccgcctcccccatcaccgacgacccggagaagatgatcgagccggcggtgagcggggcgaggaacgtgatcaccgcggcggcggacgcgggcggcgtccgccgcgtggtgatgacgtcgtcgatcggcgccgtgtacatgggcggcggcggcggcgaggaggtggacgagacgtgctggagcgacctcgaccactgcagggacaccggaaactggtactgctacgccaagacggtggcggagcaggcggcgtgggagctcgccaaggagcggcggctggacctcgtcgtcgtcaacccgtcgctggtgctcggcccgctgctgcagcgcggggtgaacgccagcacgtggcacgtgctcaagtacctggacggctcggcgcgcacctacgccgacgcggcgcaggcgtacgtgcacgtccgcgacgtcgcggacgcgcacgcgcgcgcctacgagtcccccgccgcgcgcggccgctacctctgcgccggccgcacgctgcaccgcggcgaggtgtgccgcatcctggccgccctcttcccggggtacccggtgcccaccaggtgcaagggcgacgccggcgagacggccgaggggtgccggttcagcagccgcaagctggcggagctcggtgtcgccgtcatgccggcgagccagtgcctgtacgacaccgtcgtcagcctccaggacaagggcctgcttcccttcgtccctgccgccgccatgccgtga

SEQ ID NO: 4997 - protein, 342 aa, Oryza sativa (japonica cultivar-group)
MGVEKTTANGGSGAAAVSGGGRTVCVTGAGGFIASWLVKLLLEKGYAVRGTVRNPDDAAKNAHLMALAGAAERLTLVRAELLDKESLAAAFAGCEGVFHTASPITDDPEKMIEPAVSGARNVITAAADAGGVRRVVMTSSIGAVYMGGGGGEEVDETCWSDLDHCRDTGNWYCYAKTVAEQAAWELAKERRLDLVVVNPSLVLGPLLQRGVNASTWHVLKYLDGSARTYADAAQAYVHVRDVADAHARAYESPAARGRYLCAGRTLHRGEVCRILAALFPGYPVPTRCKGDAGETAEGCRFSSRKLAELGVAVMPASQCLYDTVVSLQDKGLLPFVPAAAMP

SEQ ID NO: 4998 - DNA, 1086 bp, Oryza sativa (japonica cultivar-group)
  CDS (1)..(1086)
atggagaacactaccaagggcaaggtgtgtgtcactggggcttctggctatgttgcctcttggcttgtgaagcgacttcttgagtcagggtatcatgttcttgggacagtcagagacccaggcaatcacaagaaagtagggcacctgtggaatttaacaggtgcaaaggaaaggctggagcttgtgagagctgacctcttggaagaagggagctttgatgatgctgtgatggcttgtgagggtgtcttccatactgcatcacctgtcatcaccgaaactgactccagcaaggcatgctacactaactgtgaagaccactttcaccctgcaattatgcgactctcctttttatcttggaattcagatttaagatgccatctggttgcagcagtgcttgattcagcgataaacggcaccctgaacgttctgagatcatgcaagaagaacccatccctcaagagggtagtcctcacctcttcatcatcaaccgtgaggctcaaagatgaagctgatctgccacccaacgtgttgctggatgagacatcatggagctccatggagttctgcgagagtctccagatatggtacgccattgccaagacacttgcagagaaggcagcctgggagttcgccaaggagaacggcatcgaccttgtggctgttcttccaaccttcgtggttggacccaatctgtctcatgaattaagtcccactaccaccgatgtcctcggcctattccaaggtgagacaacgaagttcaccatgtacgggaggatggggtacgtccacatcgacgatgtcgcgagctgccacatcctgctctacgagacaccccgtgcagccgggaggtacatctgcaactcggctgtcctggacgtcaacgaactggtcaccttgctcgctaggcgattcccttcgtaccccatcccaaagagtttgccgtgcgtttacggggagcagacttatggtttcagcacggccaaggtgagggagctgggcatgaagttcagagatgtggaggagatgttcgacgacgccgtcgactcgctcagagctcacggctacctgctgaacagcgtaccatga

SEQ ID NO: 4999 - protein, 361 aa, Oryza sativa (japonica cultivar-group)
MENTTKGKVCVTGASGYVASWLVKRLLESGYHVLGTVRDPGNHKKVGHLWNLTGAKERLELVRADLLEEGSFDDAVMACEGVFHTASPVITETDSSKACYTNCEDHFHPAIMRLSFLSWNSDLRCHLVAAVLDSAINGTLNVLRSCKKNPSLKRVVLTSSSSTVRLKDEADLPPNVLLDETSWSSMEFCESLQIWYAIAKTLAEKAAWEFAKENGIDLVAVLPTFVVGPNLSHELSPTTTDVLGLFQGETTKFTMYGRMGYVHIDDVASCHILLYETPRAAGRYICNSAVLDVNELVTLLARRFPSYPIPKSLPCVYGEQTYGFSTAKVRELGMKFRDVEEMFDDAVDSLRAHGYLLNSVP

SEQ ID NO: 5000 - DNA, 1041 bp, Yarrowia lipolytica CLIB122
  CDS (1)..(1041)
atgtcaaccattctcgtcaccggagccaccgggtttattgctggtcaggtcattgcagatctcctgaatcacgggcacaaggtcttgggcaccgtgcgccagctcagcaaggcctccaagctccaggaggcgtttcctgaagcccacaagtccggcaagctgacttttgccacgctttccgatgttcgaagccaggacgagctcaaggcgatttttgcctcacaccccgaaattgcggttgtgatgcacacggcatcgccgtttttctacaactccgaggacgtggtcaaagacctgctggagccggcgctcgagggcacccgttcggtgctccaggtaacccaagacgccggccacaacgtgcacaaggtggtgctgacatcctcggtggcctccatgctcgacccgttcagaaacaaggaccccagctacgtggcaacggaggctacatggaaccccgtcacgtgggaccaggctgctgagtcaaacaacgccgaactggcctacgtagcctccaagacatttgccgagcaggaggcgtggaagttcgtcgagagcaccaagccgcgcttttcgctgactacagtcaaccctgcggcggtgtttggaccccatgcgaccaaaatcgaccccaaggcgctcaacacgtccagcgacgtcatcaacagcctggctctggacaccaagcctggagacacgccgggagactttgcgtttttgtgggttgacgtgcgaaacgtggcccgggcccatacgttggctatcgactccaagctcgacgacaagcggctgctcctgtgcaacggcaagtttgcggcccaggacttggttgatattctcaacaagaacttttccgacattcgaggcacaattgcggaaggtactcccgggaacggaccccgagtcgccgcccagtactttaactacgacaactccaatacccgccagttgctggatttgcagtggattgggctcgagcagtcgattgtggactttaccaagcagtacgaggctgcgaaatcggaatcacgagctgattga

SEQ ID NO: 5001 - protein, 346 aa, Yarrowia lipolytica CLIB122
MSTILVTGATGFIAGQVIADLLNHGHKVLGTVRQLSKASKLQEAFPEAHKSGKLTFATLSDVRSQDELKAIFASHPEIAVVMHTASPFFYNSEDVVKDLLEPALEGTRSVLQVTQDAGHNVHKVVLTSSVASMLDPFRNKDPSYVATEATWNPVTWDQAAESNNAELAYVASKTFAEQEAWKFVESTKPRFSLTTVNPAAVFGPHATKIDPKALNTSSDVINSLALDTKPGDTPGDFAFLWVDVRNVARAHTLAIDSKLDDKRLLLCNGKFAAQDLVDILNKNFSDIRGTIAEGTPGNGPRVAAQYFNYDNSNTRQLLDLQWIGLEQSIVDFTKQYEAAKSESRAD

SEQ ID NO: 5002 - DNA, 1017 bp, Yarrowia lipolytica CLIB122
  CDS (1)..(1017)
atgcccactacactcgtcactggagccaccggatttcttgccggccactgcgtcgaccaactgctcaaggccggccacaatgtcattggcacggttcgaaaccctgcaaaggccgagcgactgacacaggctctgcagagctctgtggactcgggaaaactcaccctggagaccgtcaaggatatccagaacgaggccgagtttgaggcactgttcaagaagcaccccaagcttgactacattcttcatacggcctctccgttcaacttcactgccgaggaccccgaggaagaaatgctcaagccggcaattcagggtactctctccgtgctcaagaccgctaaggcccatgctcccaacgtaaagaagattgtcatcacctcttctgtggccagcaacctcgatgttgccaccttctacgaccctaacaccacttacaccgagaagagctggaaccccatgacctgggagcaagcggctgagaagggcaacccgttcgccaactacatgggctccaagctgtatgctgagaaggccggcattgagttccgtgacaaggagaagccccagttctccataacctggatcaaccccacctacattctggggcccggtgttgctctcgacatgagcgctctcaacacctcgaacgaggtccttgcaaacgttctcgggtccaagaagggccaggaccccgagggagttgccggctggtttgtcgatgtccgagactgtgctcgggcccacgttgttgctctcaagcccgagcttgacggagaacgactcctgctggccaccgccaagttctgcacccaggacattgaggatatcgccaacaagatccccgagttccatggcaagattgcaattggaaaccccgccaaccgggagaaggagctaaaccacgcttcccagtgcgacgctagctactccaagaagctgcttgatatcgactggattcccttcaacaagactgtcgaggattttgccaaccagtggtacgagcagcataagtag

SEQ ID NO: 5003 - protein, 338 aa, Yarrowia lipolytica CLIB122
MPTTLVTGATGFLAGHCVDQLLKAGHNVIGTVRNPAKAERLTQALQSSVDSGKLTLETVKDIQNEAEFEALFKKHPKLDYILHTASPFNFTAEDPEEEMLKPAIQGTLSVLKTAKAHAPNVKKIVITSSVASNLDVATFYDPNTTYTEKSWNPMTWEQAAEKGNPFANYMGSKLYAEKAGIEFRDKEKPQFSITWINPTYILGPGVALDMSALNTSNEVLANVLGSKKGQDPEGVAGWFVDVRDCARAHVVALKPELDGERLLLATAKFCTQDIEDIANKIPEFHGKIAIGNPANREKELNHASQCDASYSKKLLDIDWIPFNKTVEDFANQWYEQHK

SEQ ID NO: 5004 - DNA, 1035 bp, Yarrowia lipolytica CLIB122
  CDS (1)..(1035)
atgtctactacacccaccactctcatcactggagccactggcttcattgccggccattgcatcgagcagcttctgaaggccgaccacaaggtcattggaacgattcgatcgcaggagaagggccagcgattggccgctgctttccccgaggccatcaagaccggccagctggtgtttgagactgtttccgatgtccgatccgagcaggagttcaagactctgttccagaagcacactgacatcaagtatgtgctccacaccgcctctcccttccatttcaacgtcgaggaccccgtcaaggatatgcttgagcctgcggttgagggtactctgaccgtcctcaagaccgccaagcagtacgctccccaggttgagaagttcgtcatcacttcgtctttcgccgccatgatgaactggcacgaggttggcgactcctccgccgtcgtcaccgagaagtcctggaaccccgtcacttgggacgaggctgcccagaagggcaatgttgtcgtaacctacctgggctccaagaagttcgccgagaaggccgcttgggatttcatggagtctgagaagccctcctttggcctcaccactgtcaaccctgcctacgtctttggtcctggtattgctattgatgccaaggctctcaacacctccaacgaggtcattgtccagggagctctctctaccaagcctggtcaggatgctcctgctggccctgcccagatgtgggttgacgtgcgagacgtggccaaggcccacctgtctgccatctccaagaccctagacaaccagcgtctcatgctgtgcgtgtccaagttctgtaaccaggatctccttgacgtgatcaacgagaaggtgcctgagctcaagggaaagattgctaccggaaagcctggaaccggagctgaaactgacaaggagggctttcagtttgataacgaccagacacgaaaggctctcaactacgactggattccccttgacaagtctgtggctgactttgctaaccaatggctgtcgttccagaactaa

SEQ ID NO: 5005 - protein, 344 aa, Yarrowia lipolytica CLIB122
MSTTPTTLITGATGFIAGHCIEQLLKADHKVIGTIRSQEKGQRLAAAFPEAIKTGQLVFETVSDVRSEQEFKTLFQKHTDIKYVLHTASPFHFNVEDPVKDMLEPAVEGTLTVLKTAKQYAPQVEKFVITSSFAAMMNWHEVGDSSAVVTEKSWNPVTWDEAAQKGNVVVTYLGSKKFAEKAAWDFMESEKPSFGLTTVNPAYVFGPGIAIDAKALNTSNEVIVQGALSTKPGQDAPAGPAQMWVDVRDVAKAHLSAISKTLDNQRLMLCVSKFCNQDLLDVINEKVPELKGKIATGKPGTGAETDKEGFQFDNDQTRKALNYDWIPLDKSVADFANQWLSFQN

SEQ ID NO: 5006 - DNA, 1002 bp, Yarrowia lipolytica CLIB122
  CDS (1)..(1002)
atgcccactactcttgttaccggagccaccggctttcttgccggccactgcgtcgaccagctcctcaaggacggccataccgttattggcacagttcgaaacccttccaaggctgagcgacttgccgaggcgttcaagagtgaagttgagagtggcaaactcgaactggagactctcaaggacatccagaacgaggatgagttcgaggccatcttcaagaagcaccctgagattgactacattctccacactgcctcacctcttagtttcaatgtgactgatcctgagaaggacatgttgcagccagccattcgaggcaccacagccgtgctgaaacaggccaaggcacacgctcccaacgtcaagaaggtcgtcatcacctcgtccattgctgcaatgatgaacccggatcctagccacgtccacaacgagcacagctggaaccccatgaccagagagcaggccgcccagaagggcaaccccgtggccaactacgtgggatccaagatttttgccgaaaaggccgggctggagtttctgaacgacgaaaagcccaacttctccatcacttggatcaacccagcctacattctggggcctggcatcactcttgatctgggagccatcaacgcctccaaccagctcatttccagcgtgctggagtccaagcttggcgaggaggtcaaggtgcagagcggctcgtttgtcgacgtccgggactgtgccagagcccatgtcgtggctctccagcctaagtttgacagaaagcgtctcatgctgtgcacagccaaggtgtgcacccaggacattgaggacatttgcaacaagatccccgagctcaagggcaaaattgctgttggaactcctggtgagcgagaaaagcagctgagtaagtcgatcatggatccttccgaaaccaagaagctgttggactttgagtggattccccttgacaagagtgtcactgatttcgccaagcaatggctcgagatcaagcagtga

SEQ ID NO: 5007 - protein, 333 aa, Yarrowia lipolytica CLIB122
MPTTLVTGATGFLAGHCVDQLLKDGHTVIGTVRNPSKAERLAEAFKSEVESGKLELETLKDIQNEDEFEAIFKKHPEIDYILHTASPLSFNVTDPEKDMLQPAIRGTTAVLKQAKAHAPNVKKVVITSSIAAMMNPDPSHVHNEHSWNPMTREQAAQKGNPVANYVGSKIFAEKAGLEFLNDEKPNFSITWINPAYILGPGITLDLGAINASNQLISSVLESKLGEEVKVQSGSFVDVRDCARAHVVALQPKFDRKRLMLCTAKVCTQDIEDICNKIPELKGKIAVGTPGEREKQLSKSIMDPSETKKLLDFEWIPLDKSVTDFAKQWLEIKQ

SEQ ID NO: 5008 - DNA, 996 bp, Yarrowia lipolytica CLIB122
  CDS (1)..(996)
atgctcgttcttctcaccggcggctccggattcattgccgcccacattctcgacggactcgtcaagcggggcattcctgtcgtcaccacagtgcgatccgacaacaaggccaagttccttgctgaaaagtaccctggtcacgacctcaagtttgagattgtgccggacgtggcccagaaggacgccttcaacaatgccctcaagaaccacaagatcacccacattctgcacaccgcctcgcccttcttcctcaaccccaaggatccccagaaggagattctggatcccgccatcaacggcacccgaggcattctggaggctgcgcaggagcacggacctggcgtcgaacacgtggtaatcacctcctccaacgccgccatcacatactacgacgcccgacataaggacccggagaccgtgtacaccgaaaagtgctggtccaacgtgccctgggaggaggccatcaacaaccccgcctcgacatacaaggcttccaagcagtttgccgaggaggccatgtggaacttccagaaggaaaagaaccccaagttccgtctcacggccatcaaccctccttacgtgtttggacccatgaagcacgacgtttccgctgccaccctcaacacctccaacaagattgtgtgggacatcatcaagtccagcaccattggaaaggccggtcctacttactgggtggacgtgcgagacgtggccgagggacacattagagctctggagcgacccgaggagtctgcaaactccagatggtacacagtgggaggcatcttcactccgcaggacgtgctggacgtgcttaatgagatggacgagttcaagggcaagattcctgtgggagagcctggatcgggggtccctcttcactctaccattcccaagtacgacaactctctgaccaacaagcagagcgggcttaagtaccatactctggaggagtccgtcaaggatcttgccaagcagctcaatactctcgagtaa

SEQ ID NO: 5009 - protein, 331 aa, Yarrowia lipolytica CLIB122
MLVLLTGGSGFIAAHILDGLVKRGIPVVTTVRSDNKAKFLAEKYPGHDLKFEIVPDVAQKDAFNNALKNHKITHILHTASPFFLNPKDPQKEILDPAINGTRGILEAAQEHGPGVEHVVITSSNAAITYYDARHKDPETVYTEKCWSNVPWEEAINNPASTYKASKQFAEEAMWNFQKEKNPKFRLTAINPPYVFGPMKHDVSAATLNTSNKIVWDIIKSSTIGKAGPTYWVDVRDVAEGHIRALERPEESANSRWYTVGGIFTPQDVLDVLNEMDEFKGKIPVGEPGSGVPLHSTIPKYDNSLTNKQSGLKYHTLEESVKDLAKQLNTLE

SEQ ID NO: 5010 - DNA, 1029 bp, Yarrowia lipolytica CLIB122
  CDS (1)..(1029)
atgccaccaacttctctcgtcaccggctccactggatttttggccagccacgtggtcgaccagctgctcagcgcaggtcatagagtcatcggtacggttcgatccccccacaaagccgcacgtctggctgaggccttcaagcagcagattgcttcaggccaattggagctggaaacgctttccgacgtgagaaacgccggtgaattcaaggccattttcgaaaaacatcccgagatcaagtacattttgcacacggcttcccccttcaactacaacacgactgaccccgagaaggagatgctccaaccagcggtcgaaggaactacaaccgtactcaaggcagccaaggaccatgcccccaacgtcgagaaggtggttatcacttcttcgctcgctgccattctcaacattgccacgttcaacgatccctccactaccctgaccgagaaggactggaaccccatcacctgggaacaggcggccgagaagggcaacccctatgccaactatattggatcaaaggccatggctgaaaaggcgtctgtggagtttgagaagatggagaaacccaagttcaagctcacctgggtcaaccccgtgctcattctcggtccaggtatcattctcgatccactggccattaacacctccaatgaagccattgtaaccaacgcttttgaaaccaagcccgggcaaaagcctcccgtcaaagctggttactttgttgacgtgcgcgactgcgccaaagcccatgtttctgctctcaaccccgagtttgacggacgaagactcttcctatccacctcaaagtactgcacccaggactttctgaacattgccaaccagctacccgaattcaagggaaagatcgccgagtttgaccctatcgagcgggagaaggagttgcattcgttagcccagatcgacaactcggccacgttgaaactgctcaactacgacctcatctccctggagcattccgtcacagattttgccaaagagtggctttcttacgagcggaacgactag

SEQ ID NO: 5011 - protein, 342 aa, Yarrowia lipolytica CLIB122
MPPTSLVTGSTGFLASHVVDQLLSAGHRVIGTVRSPHKAARLAEAFKQQIASGQLELETLSDVRNAGEFKAIFEKHPEIKYILHTASPFNYNTTDPEKEMLQPAVEGTTTVLKAAKDHAPNVEKVVITSSLAAILNIATFNDPSTTLTEKDWNPITWEQAAEKGNPYANYIGSKAMAEKASVEFEKMEKPKFKLTWVNPVLILGPGIILDPLAINTSNEAIVTNAFETKPGQKPPVKAGYFVDVRDCAKAHVSALNPEFDGRRLFLSTSKYCTQDFLNIANQLPEFKGKIAEFDPIEREKELHSLAQIDNSATLKLLNYDLISLEHSVTDFAKEWLSYERND

SEQ ID NO: 5012 - DNA, 1059 bp, Yarrowia lipolytica CLIB122
  CDS (1)..(1059)
atgtctacagttctcgtcactggagctaccggattcattgcaggtcatgtcgttggcgatctgctggcgtctggacacaaggtcattggcaccattcgacatctcgacaaggctgtcaagctgatggaggccttcccagaggccaattcgtccaaccagctgctgttcgagacgctcaccgacattcgacacgaagacgagctcaagcggatctttgagaaacacaaggacatttccgtcgtgattcacactgcctcgcccttcttcttcaactccaagaacgtggtcaaggatctactcgagccggccgtcgagggtacacgagcagttcttcaggctacccaagttgcaggcaccaacgtcaacaaggttgtggtcacctcttccattgcagcaatgctcgaccccttcaaaaagaacgaccccaactatgtcgccacagaattcacctggaaccctgtaacttggacacaggcagccgactccgacgatggagaacttgcctacgtggcctccaagacttttgccgaacgagaggcctgggactacgtcgagcgaaacaagccccggtacactctgaccaccgtcaatcctgctgcagtgtttggaccccatgcaaccaagatcgaccccaagcagctcaacacatctaatgatgtcatcaacaacctggctcttgatactaagcccggagacccaccttctgagtttgccttcgtttgggtggacgtccgagatgtagctcgagcccatactctggctatcgaccacaaactcgacaaccggcgactactcctgtgtaacggcaagtttgccgcccaggacattctcgatatcatcaacagagacttccccgatatccgaggcaagattgctactggaaaccccggcactggcaaggaggtgacatccaacatttttaactacaacaacgacgtgacccgtcaggagctgccaacgctcaagtggattggactcgagcagtccattgtggacttcaccaagcagtacgaggagattctgcatgagaagaagaagaagcattggtggaatatttag

SEQ ID NO: 5013 - protein, 352 aa, Yarrowia lipolytica CLIB122
MSTVLVTGATGFIAGHVVGDLLASGHKVIGTIRHLDKAVKLMEAFPEANSSNQLLFETLTDIRHEDELKRIFEKHKDISVVIHTASPFFFNSKNVVKDLLEPAVEGTRAVLQATQVAGTNVNKVVVTSSIAAMLDPFKKNDPNYVATEFTWNPVTWTQAADSDDGELAYVASKTFAEREAWDYVERNKPRYTLTTVNPAAVFGPHATKIDPKQLNTSNDVINNLALDTKPGDPPSEFAFVWVDVRDVARAHTLAIDHKLDNRRLLLCNGKFAAQDILDIINRDFPDIRGKIATGNPGTGKEVTSNIFNYNNDVTRQELPTLKWIGLEQSIVDFTKQYEEILHEKKKKHWWNI

SEQ ID NO: 5014 - DNA, 972 bp, Yarrowia lipolytica CLIB122
  CDS (1)..(972)
atgtctgtactgctcaccggatccacaggcttcattgccactcacgtcctcgaccaactgcttagcaagggtctctccgtggtagccacctaccgatccgagtccaaggtggactttctgaagaaacgattcgagggcaagagtgtcgagtttgtgcttctgtcagacattgaatccgagtccgaggtcaaggacatcttcaacaagaacccacaaatcaccaaagtgatccacaccgcatcaccgttccacttcaacttcaccgaccccctgacggaggttcttcagccagccgtgaacggcaccaaggcggtgctgaacgccattcccgagcacgtgactcacgtagttgtcacctcctcggtggcggccgtggtggacatcaagtatattgacgactacaacgagatcatcaccgaggactcgtggaacggaatctcgtgggaggacgccgagaagaagggaggcagcttcacgtaccgaggctccaaaacctttgccgaaaaggcagcgtgggaactgcacaagaaggccaagtacaacctggtcacaattctgcctcctctggtgtttggaccagtctacggacagactgacaccctcaacacctccaacgaacagctggtggacgcgctcaaaaaggggtctaacttcagatacgcaggaacgtatgtcgacgtccgagatacagctgctgcccacgtggctgccattgatgccacggaatcagccagatggctcactattggaggctactacacccgccaggagattctggatatcaccaacaaggagtttcccgaattccatgctgacaaggggactccgggcgactactctggtttgaaacgggccttccgatacgacaactccaagaccaacaaggtgttccctcgaaagtacatcacgttgaagcagacagtggaggacacctttcggggcattgatcccaagtatatcaacaagttgtag

SEQ ID NO: 5015 - protein, 323 aa, Yarrowia lipolytica CLIB122
MSVLLTGSTGFIATHVLDQLLSKGLSVVATYRSESKVDFLKKRFEGKSVEFVLLSDIESESEVKDIFNKNPQITKVIHTASPFHFNFTDPLTEVLQPAVNGTKAVLNAIPEHVTHVVVTSSVAAVVDIKYIDDYNEIITEDSWNGISWEDAEKKGGSFTYRGSKTFAEKAAWELHKKAKYNLVTILPPLVFGPVYGQTDTLNTSNEQLVDALKKGSNFRYAGTYVDVRDTAAAHVAAIDATESARWLTIGGYYTRQEILDITNKEFPEFHADKGTPGDYSGLKRAFRYDNSKTNKVFPRKYITLKQTVEDTFRGIDPKYINKL

SEQ ID NO: 5016 - DNA, 1029 bp, Yarrowia lipolytica CLIB122
  CDS (1)..(1029)
atgtccattcttgtcaccggcgccacgggatttattgccgcccattgcattgaccagctgctgaaaaacggccacagcgtgattggaacgatccgaagcccccagaagggcgccgctctggaagccgccttccccgacgccgttgccaacaagaagctcattctcgagacggtttccgacattcgatctgccaaggagtttgaccaactgttcgacaagcaccccgaaattggcaaagtgctgcacactgcctctcctttccacttcaacatcaaggacccaatcaaggacatgctggagccggccgtggagggcacaaacacagtgctgcagtctgtgctgaaacacggtccccaggtgaccaaggtggtggtcacgtcgtcgtttgtgtccatgctgaccgccgacgacatgttcgatccctccgtgaccgtggacgagaagagctggaaccgaatcacctgggagcagggcgccggcaatgtggagtttctgacctactttgcatccaagaagtttgccgagaaggctgcttgggactttgttgagaacgaaaagccctttttccagctcaccaccgtcaacccttctctggtgtttggcccctccatcaccaagcccgacctcaagagcctcaacacctccaacggagacattgtcactcatgctctggaggtcaaggactctgatgaaggcgtcggacagtacaactccttctgcgtcgacgtgcgagacgttgccaagggtcatgtggttgctctggacgacaagaccaatggaaagcgactcatgctctgttccgacaagttttgctcccagcgactgcttaactacatcaacgaggacttccccgagctcaagggcaagattgccgttggtcatcctgatcaggtcgaagccattgaggccaagaccttcaactttgacaacaccgagaccaagaagctgcttgggttcgagtttactcctctccgagaaaccatccacgacttcgttgcccagtggttggaagttaagaaggaggagtag

SEQ ID NO: 5017 - protein, 342 aa, Yarrowia lipolytica CLIB122
MSILVTGATGFIAAHCIDQLLKNGHSVIGTIRSPQKGAALEAAFPDAVANKKLILETVSDIRSAKEFDQLFDKHPEIGKVLHTASPFHFNIKDPIKDMLEPAVEGTNTVLQSVLKHGPQVTKVVVTSSFVSMLTADDMFDPSVTVDEKSWNRITWEQGAGNVEFLTYFASKKFAEKAAWDFVENEKPFFQLTTVNPSLVFGPSITKPDLKSLNTSNGDIVTHALEVKDSDEGVGQYNSFCVDVRDVAKGHVVALDDKTNGKRLMLCSDKFCSQRLLNYINEDFPELKGKIAVGHPDQVEAIEAKTFNFDNTETKKLLGFEFTPLRETIHDFVAQWLEVKKEE

SEQ ID NO: 5018 - DNA, 1014 bp, Yarrowia lipolytica CLIB122
  CDS (1)..(1014)
atgcctaccacccttgttactggagctaccggctttctggcaggtcattgtgttgaccaactgctcaaggctggtcataccgtcatcggaactattcgaagcccccagaaggccgagcgacttgcggaggcctttaagaacgaggtcgagtccggcaagttcgagcttgagacactcaaggacgtccaggatgaggtcgagttccaggtcatcttcgagaagcaccctgagattgactacattctgcacacggcctcgccttttaacatgaaggctgaggaccccgagaaagatatgcttcagcctgccgtcaaaggaaccactgctgttctgaaaatggccaagactcatgctcccaatgtgaagaagattgtcatcacctcttctttggccgccatcatggacgtgtccaagtacaatgaccctactcacactctgactgagaaggactggaacccaatgacccgagagcaggcggctgagaaaggcaacccctttgccaactacgtgggatccaagctgtatgccgagaaggcaggtctggaattcctgaacaacgagaaacctcacttctccatcacctggatcaacccctcctatatcttcggtcccggtattgccctggacatgtctgctctcaacacctcaaacgagctgattgctgctgttcttcagtccaagaagggccagaaccctgagggctctgcgggctggttcgtcgacgtccgagactgcgctgaggctcacgttattgctctcaagcccgagcttgaccgaaggagactgcttctgggcaccagtgctttctgcacccaagacatcgaagatattgccaacaagatcccccagctggagggtaatatcgccaccggaaaccctgccaaccgagataaggagctcaaaactgtttgtcagctcgactgctccgagacggataaattgctaggaattaagtggatccctcttcagaagagtgtcactgactttgctgagcagtggattaagtctcagtag

SEQ ID NO: 5019 - protein, 337 aa, Yarrowia lipolytica CLIB122
MPTTLVTGATGFLAGHCVDQLLKAGHTVIGTIRSPQKAERLAEAFKNEVESGKFELETLKDVQDEVEFQVIFEKHPEIDYILHTASPFNMKAEDPEKDMLQPAVKGTTAVLKMAKTHAPNVKKIVITSSLAAIMDVSKYNDPTHTLTEKDWNPMTREQAAEKGNPFANYVGSKLYAEKAGLEFLNNEKPHFSITWINPSYIFGPGIALDMSALNTSNELIAAVLQSKKGQNPEGSAGWFVDVRDCAEAHVIALKPELDRRRLLLGTSAFCTQDIEDIANKIPQLEGNIATGNPANRDKELKTVCQLDCSETDKLLGIKWIPLQKSVTDFAEQWIKSQ

SEQ ID NO: 5020 - DNA, 1086 bp, Oryza sativa (japonica cultivar-group)
  CDS (1)..(1086)
atgaccgtgatcgacggcgccgtcgctgccgacgccggcggcgcagccgcggcggtggtgcagccggggaacgggcagaccgtgtgcgtgaccggcgcggccgggtacatcgcgtcgtggctcgtgaagctgctgcttgagaagggctacactgtcaagggcaccgtcaggaacccagatgacccgaagaacgcgcacctgaaggcgctcgacggcgccggcgagcggctggtgctctgcaaggccgacctcctcgactacgacgccatctgccgcgccgtcgccggctgccacggcgtcttccacaccgcctcccccgtcaccgacgaccccgagcagatggtggagccggcggtgagggggacggagtacgtgataaacgcggcggcggaggccggcacggtgcggcgggtggtgttcacgtcgtcgatcggggcggtgaccatggaccccaaccgcgggcccgacgtcgtcgtcgacgagtcctgctggagcgaccttgactactgcaaggaaaccaggaactggtactgctacgggaaggcggtggcggagcaggcggcgtgggaggcggcgcggcggcgaggggtggagctggtggtggtgaacccggtgctggtgatcgggccgctgctgcagccgacggtgaacgccagcgtcgcccacatcctcaagtacctggacggctcggccagcaagttcgccaacgccgtccaggcctacgtcgacgtccgcgacgtcgccgccgcccacctcctcgtcttcgagtccccttccgccgccggccgcttcctctgcgccgagtctgtcctccaccgcgagggtgtcgtccgcatcctcgccaagctcttccccgagtaccctgtccccaccaggtgctccgacgagaagaaccccaggaagcagccgtacaagatgtcgaaccagaagctccgggacctggggctggagttccggccggcgagccagtcgctgtacgagacggtgaagtgcctccaggagaagggccacctgccggtgctcgccgccgagaagacggaggaggaggccggcgaggtccagggcgggattgccatccgagcatga

SEQ ID NO: 5021 - protein, 361 aa, Oryza sativa (japonica cultivar-group)
MTVIDGAVAADAGGAAAAVVQPGNGQTVCVTGAAGYIASWLVKLLLEKGYTVKGTVRNPDDPKNAHLKALDGAGERLVLCKADLLDYDAICRAVAGCHGVFHTASPVTDDPEQMVEPAVRGTEYVINAAAEAGTVRRVVFTSSIGAVTMDPNRGPDVVVDESCWSDLDYCKETRNWYCYGKAVAEQAAWEAARRRGVELVVVNPVLVIGPLLQPTVNASVAHILKYLDGSASKFANAVQAYVDVRDVAAAHLLVFESPSAAGRFLCAESVLHREGVVRILAKLFPEYPVPTRCSDEKNPRKQPYKMSNQKLRDLGLEFRPASQSLYETVKCLQEKGHLPVLAAEKTEEEAGEVQGGIAIRA

SEQ ID NO: 5022 - DNA, 1032 bp, Aspergillus nidulans FGSC A4
  CDS (1)..(1032)
atggacatcaagttcgtcctcgtcacaggcgcaactggctttattggcgcgcacatcgttgacgccctcctaggtcacggcctacgggtgcgcggcgcaacgcgctccctggccaaaggcgaagaaatgttgaaagcacgcctgcactacaaagaacagctcgagttcgtcaagatcaacgattttgagaatcccggtggactagctgaagctgtcaagggcgttgatggtatcattcatacggcgagtcccttcacatacgatacaaaagacaacgaaaaggaactcgtcatccccgccataaacggcgtgaaagctgtctttgaagcggcggccgctgccgacgcatctacaactaaaatcaagcgcatagtcctaacatcctcctttgcgtcggtcatagacgtaaaccgcagagcaggaccaggatcagggccagatggatacttcacctacacagctgccgattggaacccactaagctacgccgaggcaattgatacatccaccaatgcggtagtggcataccgcggatccaagaaattcgccgagctcgcggcgtgggagtttatccgcgacagaaagccgtcgtttgatctcgttactctctgtccgcccatgacctttggcccggttgtgcatcctgttccatcagtggagagtctcaatgagtcgaatgcaatgctgtggaaagtcgctgtcggcgaaccgcttcctgtcgcgcgtgtgcctttctggattgatgtgcgtgatctagcggatgcacatataggcgcattgttgaagcctggagttggagggaggagatatacggttgcggcgccagagagattctcgtatgggcttgcggcggggattatcaaggaggagtttgcagacttgagagagcgggttacggggacaaggcaggacgtggatgagagtcatgggttggatggggagacggccggaagggaattgggtatcagctataggcggttcagagagacggtgcgggatttggtgaggcagggggtggagaggggttggtga

SEQ ID NO: 5023 - protein, 343 aa, Aspergillus nidulans FGSC A4
MDIKFVLVTGATGFIGAHIVDALLGHGLRVRGATRSLAKGEEMLKARLHYKEQLEFVKINDFENPGGLAEAVKGVDGIIHTASPFTYDTKDNEKELVIPAINGVKAVFEAAAAADASTTKIKRIVLTSSFASVIDVNRRAGPGSGPDGYFTYTAADWNPLSYAEAIDTSTNAVVAYRGSKKFAELAAWEFIRDRKPSFDLVTLCPPMTFGPVVHPVPSVESLNESNAMLWKVAVGEPLPVARVPFWIDVRDLADAHIGALLKPGVGGRRYTVAAPERFSYGLAAGIIKEEFADLRERVTGTRQDVDESHGLDGETAGRELGISYRRFRETVRDLVRQGVERGW

SEQ ID NO: 5024 - DNA, 1005 bp, Aspergillus nidulans FGSC A4
  CDS (1)..(1005)
atgcctaaggtattgttgacaggaggcagcggcttcattgctgctcatatcctcgaccaattgctggagagaggctttgatgtcgtcacgacagtgcggtcaaaagagaagggcgagaagatcctagctgctcatccaaatacgccaaaggagaagctttcgtatgtcatcgttaaggacgttgcgcaagatggggcttttgatgaggctgtcaaatctgaccccccgttcgactatgtccttcacacggcgtccccttttcactacaacgtccaggatccggtaagagatttccttgacccggctatcaagggaacaacgggcatcttgaaagctatcaaggcctacgcacccaacgtgaaaagggtgacgatcacttcgtccttcgcagcgatcgtcaacgtgaaaaaccacgcaaaggtctatagtgaggaagtttggaatcctatcacttgggaggaaggtttagactcctcacagacttatcgggcgagcaagaccctggcagaaaaagccgcttgggacttcgtggagaaggagaagcccagctttgaccttgcaacaatcaatccgcccctagttctaggacctgtcgtgcactaccttagctcccttgactccatcaacacctccaatgcgcggatcagcagtttcgtgcgggggttcagtaaggatgcgttaccgccaaccggcacgtatgtttgggtggatgtccgtgatgtcgcgctagcccatgtcagaaccatcgaggtgccggaggccggagggcagcgattcttcatcaccgctggtcactattcgaacaaggacatcgtcgacattatccgtgacgcgtatcctgagctggaggatagactgccgcctaaggacgccccgagtgacatgcctaaagatgtatacggatatgacaactcaaaatcaatgcaggttctgggtcttaagtaccgtgggttaaaggagtcggttgttgacacggtcaagagcctgctggagaatggtgcctag

SEQ ID NO: 5025 - protein, 334 aa, Aspergillus nidulans FGSC A4
MPKVLLTGGSGFIAAHILDQLLERGFDVVTTVRSKEKGEKILAAHPNTPKEKLSYVIVKDVAQDGAFDEAVKSDPPFDYVLHTASPFHYNVQDPVRDFLDPAIKGTTGILKAIKAYAPNVKRVTITSSFAAIVNVKNHAKVYSEEVWNPITWEEGLDSSQTYRASKTLAEKAAWDFVEKEKPSFDLATINPPLVLGPVVHYLSSLDSINTSNARISSFVRGFSKDALPPTGTYVWVDVRDVALAHVRTIEVPEAGGQRFFITAGHYSNKDIVDIIRDAYPELEDRLPPKDAPSDMPKDVYGYDNSKSMQVLGLKYRGLKESVVDTVKSLLENGA

SEQ ID NO: 5026 - DNA, 1038 bp, Candida albicans SC5314
  CDS (1)..(1038): transl_table=12
atgtctggagaaacagtttttgtcactggtgcaactggatatattgctcaacatattattaaacaattattatctaaaggttattctgtaattggatcggttcgatcccaatctaaaggtgaacaattgaaagaattaattactgctcatcatcaagatactactggtgatgctaaatttgattatgttatagtcgaaagtcttattgaaccaggagcatttgattcgattttacaaaatcataaagaagttggagttttcattcatagtgcttcaccaatcccatttgctactgatagtgttgaaaaagatattttacaaccagctatagatgggacaaaaaatgttttaacatcaattaaaaaatatggtaatgagaatattaaaaagttggttataacttcatcaattgctgctgttgaaccattgggtacgggacaaactgaacctaaaacaattctggaaaaagattggaatccaattacttttgaacaaggtcttgctaatccagcagttgcttattatgcttctaaaacattagcagaaagagaagtttggaaatttgtcgatgaaaataaaaaccaattaaattttgatgttgccgtgattaatcctctgtttgtatttggacctcaagcatttggaattaaagataaatcagcagcattaagatcaacgggagaaatcattaattccgtattgaaattgaaatcaaatgatccaattccatcgttagtagcatcatttattgatgttcgtgatgttgctagagcacatattattgcctttgaggatgatgatgctattggtcaacgattaattttagataatgaaatattcactaaagaattgattgctcatttaattaaaaagaatttcccttctttggatatcccagaaggtgatattgttaaaagtgaagaagaaattgcaaattatccttggagagtagatagtaccaaaactgaaaaaattttgggattcaaatatatttcattggataaaagtgttgttgatactgttaatcaattgatttga

SEQ ID NO: 5027 - protein, 345 aa, Candida albicans SC5314
MSGETVFVTGATGYIAQHIIKQLLSKGYSVIGSVRSQSKGEQLKELITAHHQDTTGDAKFDYVIVESLIEPGAFDSILQNHKEVGVFIHSASPIPFATDSVEKDILQPAIDGTKNVLTSIKKYGNENIKKLVITSSIAAVEPLGTGQTEPKTISEKDWNPITFEQGLANPAVAYYASKTLAEREVWKFVDENKNQLNFDVAVINPSFVFGPQAFGIKDKSAALRSTGEIINSVLKLKSNDPIPSLVASFIDVRDVARAHIIAFEDDDAIGQRLILDNEIFTKELIAHLIKKNFPSLDIPEGDIVKSEEEIANYPWRVDSTKTEKILGFKYISLDKSVVDTVNQLI

SEQ ID NO: 5028 - DNA, 1167 bp, Candida albicans SC5314
  CDS (1)..(1167): transl_table=12
atgactgataaaactaattttcctactacagtatttgtatctggtgcttctggattcattgctcaagaattaatcaaacaattgataataaaaggatataatgttataggatcagtaagatccaccactaaaggagaatcaattaaatccaatttaacatcctcatcaaccacacaatcattgaatagtgatttgtttaattatacaattattaaagatatttcatcaccaggagcatttgataatgtattaaaacaatatcccgaaattgagatttttttacatacagcatcaccatttcattttaaagcaggaaatattgaacaagaattattaattccagcaattaatggtactaaaaatgccttattggcaattaaacaatttggtcataaaattaaacatgtagtgattacttcatcagtagttgccgttggaaaatttgggaaatttcctcgtaccagtacgggctcaacatcattgtcttcatcagtggtggttgctgatgaaaattcatggaatccaattacttgggaaatgtcattgaaaaatcctttttatggatattttggttcgaaaacttttgctgaaaaagaagtttggatatttttacaaattgaaaatccaaaatttaatataacgacaattaatccaggtatggtattaggaccacaagcatttcccataaacaaccataatggtggtggtgctggtgctggtggtactaacaatttagaattgaatacttcatcacaagaaatagttcgattattgaatttatcaactgttgatgatgttaataaagttaagatttcaactaaagtagagaatacatttattgatgttagagatgttgcaaaagctcatattatagcatttgaaaaacctcaactaactaaaaataaacgattactattaattgaagatatttataatgaacaaacattacttaatatcattaataacaattttcctcaattaaatttaccaaaaggtgaacctattactggtcaaattgatgaatccaaattaaataatacttggaatactacacaaactaaaaccatttttggtgataaatatattggaattgaaaaaagtgtgattgattcagttaatcaaattcttgaagctaagaatgagggtaatcctcaatgtaaattgtaa

SEQ ID NO: 5029 - protein, 388 aa, Candida albicans SC5314
MTDKTNFPTTVFVSGASGFIAQELIKQLIIKGYNVIGSVRSTTKGESIKSNLTSSSTTQSLNSDLFNYTIIKDISSPGAFDNVLKQYPEIEIFLHTASPFHFKAGNIEQELLIPAINGTKNALLAIKQFGHKIKHVVITSSVVAVGKFGKFPRTSTGSTSLSSSVVVADENSWNPITWEMSLKNPFYGYFGSKTFAEKEVWIFLQIENPKFNITTINPGMVLGPQAFPINNHNGGGAGAGGTNNLELNTSSQEIVRLLNLSTVDDVNKVKISTKVENTFIDVRDVAKAHIIAFEKPQLTKNKRLLLIEDIYNEQTLLNIINNNFPQLNLPKGEPITGQIDESKLNNTWNTTQTKTIFGDKYIGIEKSVIDSVNQILEAKNEGNPQCKL

SEQ ID NO: 5030 - DNA, 1017 bp, Candida albicans SC5314
  CDS (1)..(1017): transl_table=12
atgtccgtttcaaaatctgctacaactgtttttgtatctggggcttctggtttcattgcacaaaatgtaatcaaacaattgttggccaatggatacaaagtcataggatcagtaagatctgaatcaaaaggaaaagaattgacagatattattcaatcaaatgacttccaatttgctgcaatccctgatattagtgctgttggagcatttgatgatgttttgaaatcaaattcacaaatctcagtgtttatccacacagcttccccagtcacttattcggcaaaagatgttcaaaatgaacttatcaaacctgcagtagaaggaacaaggaatgctttgaatgcaataaaactgtatggaccccaaattaaacgagtggttgtgacttcttcatttacagccattgcactggggaaggattttgatcatgacaaatactatacggaaaaagattggaacccagttacaatagaacaggcattatcaaatcctgaagcagcatatgcttatgccaaaaaaatggcagaaaagactgtttgggattttgttgaaactgaatcaccaacttttaaagtaactgttgtcaatccaactgttgtttttggaccacaagcttttggagttaaagataaatcgaaattgaatttactgattgaaatgatcaatgatattcttactttgaaacctgacgatgaaattccaccctatgctagtcgatgtattgatgtgagagatgttgctaaagctcatttggttgcatttgaaaaagaggaggcaatcaatcaaaggttggtgttaataaaccagccattcagtaatgatttgcttgcatatattatcaaaaagagtttccccgttatcaatattccggaaggcaatttggaaagaagtcgagaatgcattgcaaaatcgtgtatcaaaacagatttgacaaagacgcaagaaattcttggatttgattacgttccagtggagaagacaatcctagatacaattcaacaactatatgacgcttga

SEQ ID NO: 5031 - protein, 338 aa, Candida albicans SC5314
MSVSKSATTVFVSGASGFIAQNVIKQLLANGYKVIGSVRSESKGKELTDIIQSNDFQFAAIPDISAVGAFDDVLKSNSQISVFIHTASPVTYSAKDVQNELIKPAVEGTRNALNAIKSYGPQIKRVVVTSSFTAIASGKDFDHDKYYTEKDWNPVTIEQALSNPEAAYAYAKKMAEKTVWDFVETESPTFKVTVVNPTVVFGPQAFGVKDKSKLNLSIEMINDILTLKPDDEIPPYASRCIDVRDVAKAHLVAFEKEEAINQRLVLINQPFSNDLLAYIIKKSFPVINIPEGNLERSRECIAKSCIKTDLTKTQEILGFDYVPVEKTILDTIQQLYDA

SEQ ID NO: 5032 - DNA, 804 bp, Candida albicans SC5314
  CDS (1)..(804): transl_table=12
atgtccactactgtttttgttgctggtgccggcggatacattggaaaacatattgtatctcaattactttcaaagggttataccgttattggatctgttagaaatgatgaaaagggagaacgtcttgtatccttgtttgaaaatgataattttacctacgtagtagttgaggaagcggaggctaaaggtgcatttgacaagccgttgaaggatcacccacatattaaagtctttattgacacagcaagtcctttaccaattggagtcaattacgaaaagcagttgattagacgtacttcaaaaggaatcaagtacattttgagctcaattaaagaccacggacccaatattacaaaggtagtggttaccagttcaattgcctcgtgtatgaatgaaaaacaaagtcatgatcccaattttgttgttgatgaaagtaaatggaatccagataaacatagtgttggtaaaaataatcccacgtcggcctacttttatgcaaaggcatctgctgaacatgaagcctgggacttcatgaaaaagaaaacacatttcacacttgcaacaattcttcctggttatacatttggtccacaatgttttgatgaagatgtttccgatcttcttgaaacctctgttgagattgtcacgaaaatatttgaattaaataagaatgaccctatccccaaagagctgggattgtttgttgatgtcagagatgttgctgctgcacatatacgggcattcgagctaaacgaagctcaaaataaacgtttgatgttagtcacagaacccttttcagcttaa

SEQ ID NO: 5033 - protein, 267 aa, Candida albicans SC5314
MSTTVFVAGAGGYIGKHIVSQLLSKGYTVIGSVRNDEKGERLVSLFENDNFTYVVVEEAEAKGAFDKPLKDHPHIKVFIDTASPLPIGVNYEKQLIRRTSKGIKYILSSIKDHGPNITKVVVTSSIASCMNEKQSHDPNFVVDESKWNPDKHSVGKNNPTSAYFYAKASAEHEAWDFMKKKTHFTLATILPGYTFGPQCFDEDVSDLLETSVEIVTKIFELNKNDPIPKESGLFVDVRDVAAAHIRAFELNEAQNKRLMLVTEPFSA

SEQ ID NO: 5034 - DNA, 1032 bp, Candida albicans SC5314
  CDS (1)..(1032): transl_table=12
atgtcaacaccaattactgttattgtttctggagccacaggatttattgctcaacacgttgttaaacaattattagctaaaaactatcaagtcattggtacagttagatcaacagccaaaggtgatcatttattaaaattattcaacaatccacaaaacttatcttatgaaattgttgaagatgttggaactaaaggtgcctttgataaagtattacaaaaacatggagaagcaaaagtgttcttacatttagcttcaccattccattttaatgtgactgatgttgaaaaagaattgttattgcctgctgttgatggtactaaaaatgtattacaagcaatttataattttggtaacaatattgaaaaagtggttatcacttcatcttatgctgccattagtaccgcttctaaagaagctgataaaaatgcaattattacagaaaaggattggaatgaaatcagttggcaagatgctttacttaatccagttaatggatatcgtggatccaaaaaatttgctgaaaaagctgcttgggattttataaaatctaatgataatgttaaattttcattgtcgacaattaatccatcatttgtatttggtccacaatcatttggttcagaaattaaacaaagtttaaacacttctagtgaaatcattaattctattttgaaattgaaaccaaatgattcaattcctgcgtcaaaaggaggttgggttgatgtaagagatgttgccaaagctcatatcattgcctttgaaaatgaggatgccaaaaatcaaagaatattgttgaattcaggtagatttacatctcaatcacttgttgatattattaatgataaatttccagatttgaaagggaaaataccagttgatgaaccaggttcagataaatctgttattgctgaaagtttggctactattgatgataccaaatctcgtgaattattaggatttgaatattataaccttgaacaatcagtttatgatactgttgaacaaattgttaatgctcataagttgtaa

SEQ ID NO: 5035 - protein, 343 aa, Candida albicans SC5314
MSTPITVIVSGATGFIAQHVVKQLLAKNYQVIGTVRSTAKGDHLLKLFNNPQNLSYEIVEDVGTKGAFDKVLQKHGEAKVFLHLASPFHFNVTDVEKELLLPAVDGTKNVLQAIYNFGNNIEKVVITSSYAAISTASKEADKNAIITEKDWNEISWQDALLNPVNGYRGSKKFAEKAAWDFIKSNDNVKFSLSTINPSFVFGPQSFGSEIKQSLNTSSEIINSILKLKPNDSIPASKGGWVDVRDVAKAHIIAFENEDAKNQRILLNSGRFTSQSLVDIINDKFPDLKGKIPVDEPGSDKSVIAESLATIDDTKSRELLGFEYYNLEQSVYDTVEQIVNAHKL

SEQ ID NO: 5036 - DNA, 1044 bp, Candida albicans SC5314
  CDS (1)..(1044): transl_table=12
atgtcaaaaactgtcattttaacaggagcttcgggttatattggtcaacacattcttggagaattattagaccaaaattataaagtaattgccatagttcgttcccaaaaatcatcagatacattatcaaaactattcaaacaaacccccaaattacaatttgaaattgttgaacaatttgacaaaccacacgcattagataaagttttggaaaaacataaagaagcaacaatttttattagtacagctgctgtggtcacttttcatgctgaagattatgaaagagatgttttagatccagcaattgatctagttaaaaacattttttcaagtatcaaagaacatgctccacaaattactagagtaatattaacatcttccagtgcttcagtagttggattagataaggcattttcatatgatgctgaatactctgataatgattggtctccatttactcgtgaaatgagtacactggatggtaccatggcctattttgcatcaaagaaattggcagagaaagaagcttggaaattccttaaagaagaaaaaccaaattttgatcttgttgtcataatgccagcattgattcttggtccagttcgttttagttctgaattgaaaaacggtaaatttccttccacatctggtatcattggaggattattacatttgaaatctgatgatcctatccaaccaatggcagcaggtgcggttgacgttagagacgttgcaaaggtgcatgttgatgtgattacttcggaaaaagcttcaaaccaaagaattttagttgaaagtggtaaagtaaccaatgataatatcattcaaaccatcattgacaattttcctagttacaaggacaagttacctacccctaacccagtgccacattctaaatttgtgaaacccaaagatgaacgctcaagaaagattattggattctcattaaggtcattaggtgattcagtagttgatttggtcaaacaaatcgatcaggagaattcagtaatcgaatcaattaagaaattagatattaaaaaatag

SEQ ID NO: 5037 - protein, 347 aa, Candida albicans SC5314
MSKTVILTGASGYIGQHILGELLDQNYKVIAIVRSQKSSDTLSKLFKQTPKLQFEIVEQFDKPHALDKVLEKHKEATIFISTAAVVTFHAEDYERDVLDPAIDLVKNIFSSIKEHAPQITRVILTSSSASVVGLDKAFSYDAEYSDNDWSPFTREMSTSDGTMAYFASKKLAEKEAWKFLKEEKPNFDLVVIMPALILGPVRFSSELKNGKFPSTSGIIGGLLHLKSDDPIQPMAAGAVDVRDVAKVHVDVITSEKASNQRILVESGKVTNDNIIQTIIDNFPSYKDKLPTPNPVPHSKFVKPKDERSRKIIGFSLRSLGDSVVDLVKQIDQENSVIESIKKLDIKK

SEQ ID NO: 5038 - DNA, 1026 bp, Candida albicans SC5314
  CDS (1)..(1026): transl_table=12
atgtcttcatctactacagttttcgtttctggtgcttctggttttattgctcaaactttagtcaaacaattgattgaaaaaggttataaagttgttggtactgttagatccaatgaaaaaggtgattccttgaaggaaaacttgaaagcagctaaattgcaatcagaaaatttcacttacgaaattgttaaagatattgctgttaaaggtgcttttgacgatgctttaaagaaacatcctgaagtcactgttttcttacataccgcatctccattccatttcaatgtcactgatattgaaaaagaattattaactccagctgttgaaggtaccaacaatgccttacaagccattaaaacacatggaccacaaattaaacgtgttgttgtcacttcatcatatgctgctgtgggaagatttgctgatttagctgatccatcaatcccagctactgaagaatcttggaatccaatcacctgggaacaatcattatcaaatccacttgctggttatgttggttccaaaaaatttgctgaaaaagctgcttgggattttgttgaaaaggaaaaaccaaatttcactctttctgtgatcaatccagtatatgtatttggtccacaagcttttgaaattaaaaacaaatcccaattgaatacatcatcagaaattattaatggattattaaattctaaaccagattctaaatttgataatttaactggttatttcattgatgttagagatgttgctaaagctcatattgtagcttttgagaaagattcaattcaaggtcaaagattaattttggccgaatctccattttcaactcaaagtattttggatttgattcgaaaagatttcccacaattggattctcaattacctaaaggtgatccatctcaagctgatgcttggaagaaagctgaaagtaagattgagaatgaaaagactagagaattacttggattcaaatttattgatttcaaaaaatccattgacgattcggttgctcaaattattggttaa

SEQ ID NO: 5039 - protein, 341 aa, Candida albicans SC5314
MSSSTTVFVSGASGFIAQTLVKQLIEKGYKVVGTVRSNEKGDSLKENLKAAKLQSENFTYEIVKDIAVKGAFDDALKKHPEVTVFLHTASPFHFNVTDIEKELLTPAVEGTNNALQAIKTHGPQIKRVVVTSSYAAVGRFADLADPSIPATEESWNPITWEQSLSNPLAGYVGSKKFAEKAAWDFVEKEKPNFTLSVINPVYVFGPQAFEIKNKSQLNTSSEIINGLLNSKPDSKFDNLTGYFIDVRDVAKAHIVAFEKDSIQGQRLILAESPFSTQSILDLIRKDFPQLDSQLPKGDPSQADAWKKAESKIENEKTRELLGFKFIDFKKSIDDSVAQIIG

SEQ ID NO: 5040 - DNA, 1014 bp, Candida albicans SC5314
  CDS (1)..(1014): transl_table=12
atgacaaaggttttcataacaggagcatcagggtttattgctcaacacattatcaaattattattatcaaaaggatacgaagttgttggcactgttcgttcaaccaccaaaggtgaacaattgaaatctttcatgccctcagatgccaaatttacatatgagatagttaaagaattgtctacacccaactcctttgatgaagcattgagtaaacacaacgacatagaatatttatttcatactgcatccccattgacatttgataccgaagacccagaaaatgttattcttcaacctgccattaaaggaacggaaaacattttgcatgcagcagctgacctttgtccaaacttgaaacgtgtagtgctcacttcttcagatgctgccatttattccaatactgatgagacaaacccgacattatctttcaatgaaggaagttggaacaatacttcatatcaagatgcattgaaggataatattacagcatattatgcatctaaggcatttgcagaaaaattggcttgggaatttgtcttgatgcaaaaaccagtgtttggattagtggttgtaaacccatcttgggtatttggtccaaaagcatatgattttgatcctaaaagatttaatagttcgaatgaaatgattgatgatttgttaaaattgaaccacgaaaataattcaacttttgagaatgttagtggtggatacatttcggcaacagatatagctaaagttcaagtgtatgcaattgaatccgatgatttggtaaacaaaagattattaatgacaaatgggtatttcacctgtcaacagattcttgatataatcaataaacatttcccagaattaaacctaccaaaaggaaatccgggaactgaagcagaggagtttaagaaactagcaagagtgaacaatgatgctaccagaaaattattgccttgggagtttgagcctttggaaactattgtcgttgatacagtaaaacaaattctagaatctaaacaaaactaa

SEQ ID NO: 5041 - protein, 337 aa, Candida albicans SC5314
MTKVFITGASGFIAQHIIKLLLSKGYEVVGTVRSTTKGEQLKSFMPSDAKFTYEIVKELSTPNSFDEALSKHNDIEYLFHTASPLTFDTEDPENVILQPAIKGTENILHAAADLCPNLKRVVLTSSDAAIYSNTDETNPTLSFNEGSWNNTSYQDALKDNITAYYASKAFAEKLAWEFVLMQKPVFGLVVVNPSWVFGPKAYDFDPKRFNSSNEMIDDLLKLNHENNSTFENVSGGYISATDIAKVQVYAIESDDLVNKRLLMTNGYFTCQQILDIINKHFPELNLPKGNPGTEAEEFKKLARVNNDATRKLLPWEFEPLETIVVDTVKQILESKQN

SEQ ID NO: 5042 - DNA, 1119 bp, Ustilago maydis 521
  CDS (1)..(1119)
atgtcaactagcacaaccacatcgcaaggtcccaaggtactgctcacgggcgtgtccggctttgtaggctcgcatgtgctcgaccagctgctcaagtcgtcccgcagctaccacgtcacctgcgttatccgatccaaggcgaaaacggagccatggctatcgaggcagtttgccgctggtttccaacagaaccgtatcgatgttatcgaggtctccgacctgttggcctccggatgccttgacagtgctgtcgaggccaaagactacattgtccacgtcgcttctccttatgtgctcagtgccaagaacaacaagcgcgacattatcgatcctgctatcaaaatgacgcaaaacgtgctcgacgccgctctgaaagccgaaaacaaggccaaggctgctggcgaaaagcccaaactgaaacgtatcgtcgtcacctcttcatttgctgccattctcaacccattgaagggcatcgagcaacgcgactacacttacacggacaaggactggcagccgatccagtatgctttcatgggaatgttctactctcctctcgcctacctcatctccaagacgcttgccgaaaagtcggtatggaacttcctcgaacaacacaagcccagctttgatgctgctaccgtcaacccaccgaatatctatggacccattattcacgaggtcaagtccgaagatgccatcaatacctcctcggccgagccttggaagctgtacaaagccggggggcctaatggcgatggtaaagtgcctgccgaagccctctggtccttctgcgacgtacgtgatgtggccaaggtgcacgttgccgcgctggacaatcccaaggcgcacaacacgcgctaccttgcgtgcggtggaagcatctcgtggcaagaggtggcggacgagattcacagcaacccagaatacccacaagaacttaaggatcacattccacgcggtacacccggtcaacgacaccgtcctagccccctggctaagctcgacacgagccgggccgagaaggacttgggaatcgagtttctcgactggaaagagtcggtcatcaaggggtcgttgtacagcttcatcgagatcgagaagagttggggtcaccagtaa

SEQ ID NO: 5043 - protein, 372 aa, Ustilago maydis 521
MSTSTTTSQGPKVLLTGVSGFVGSHVLDQLLKSSRSYHVTCVIRSKAKTEPWLSRQFAAGFQQNRIDVIEVSDLLASGCLDSAVEAKDYIVHVASPYVLSAKNNKRDIIDPAIKMTQNVLDAALKAENKAKAAGEKPKLKRIVVTSSFAAILNPLKGIEQRDYTYTDKDWQPIQYAFMGMFYSPLAYLISKTLAEKSVWNFLEQHKPSFDAATVNPPNIYGPIIHEVKSEDAINTSSAEPWKLYKAGGPNGDGKVPAEALWSFCDVRDVAKVHVAALDNPKAHNTRYLACGGSISWQEVADEIHSNPEYPQELKDHIPRGTPGQRHRPSPLAKLDTSRAEKDLGIEFLDWKESVIKGSLYSFIEIEKSWGHQ

SEQ ID NO: 5044 - DNA, 1053 bp, Ustilago maydis 521
  CDS (1)..(1053)
atgtctggcccgttggtactcatcaccgggatcaccggtttcctttcggcgcacgtgcttgacgctgtgctcgcgtctcctgccaactacaaggtccgaggtacgcttcgatctatcagcaagaaggacgagatcctcgctcgtttgagcgcacaagaccgtgagagggtcgaatttgtccaagtggccgatatagcgacgtcggatctgttggctgccgttcgaggagtcgagatcatccaccacgtcgcttcgccttaccagctcaacgtacaggatgccgagcgtgatctgctgattccggctgtcgaaggcactttgaacctgctacgctttgccaagcacgaaaagagcgtcaaaaaaatcgtcatcacctcttcgtttgctgctgtgacaaacttcaaagatggtggcccctaccgtcctggcttcgtctatacagctgattgctggaacccttcttcgtacgaggatgcgattaaagccggcggcgcaggtgcattctcctactcggtcagcaagaagctcgccgagaaagccgcttgggactatttggccaacgaaaagcctcactttgagattgcctgcatcaacccacccatgatctacggcgccacgttgcaacccgttgccaaactgtccagcctcaacacgtcgagcaaaaccatctacggcctcatcaactcggccgactctatgcccgaagaccgtctacctctcttttgccatgctcgcgatgtcggagatgcacatgtcgcgacgaccgagaagcccgatggtatgggtcaacgatggttgctgtgtggaggcaagttcacctgggctcatgcggtcaaattcattgcagagcaatatccagatctgcaggaccgcctgcctaaaggttggaaggaggctagtgccaatccacgcgacttgaacaccattgttgatttggacaccaagccagcacagaccaagctaggaatgcagttccgagactggcaaatcacgctcaaggagtcgctcgatagcttgctcgagttggagaagcgtcctggctggaagaactga

SEQ ID NO: 5045 - protein, 350 aa, Ustilago maydis 521
MSGPLVLITGITGFLSAHVLDAVLASPANYKVRGTLRSISKKDEILARLSAQDRERVEFVQVADIATSDLLAAVRGVEIIHHVASPYQLNVQDAERDLLIPAVEGTLNLLRFAKHEKSVKKIVITSSFAAVTNFKDGGPYRPGFVYTADCWNPSSYEDAIKAGGAGAFSYSVSKKLAEKAAWDYLANEKPHFEIACINPPMIYGATLQPVAKLSSLNTSSKTIYGLINSADSMPEDRLPLFCHARDVGDAHVATTEKPDGMGQRWLLCGGKFTWAHAVKFIAEQYPDLQDRLPKGWKEASANPRDLNTIVDLDTKPAQTKLGMQFRDWQITLKESLDSLLELEKRPGWKN

SEQ ID NO: 5046 - DNA, 1095 bp, Ustilago maydis 521
  CDS (1)..(1095)
atgccggccattcagcctaaatcacatgtgctcgttaccggagggtctggcttcattgccatttggacaatctatcagctgctagaacgcggtcacaatgtgcgagcaacagtccgttccgatgacaagggcaactacctcaagcatgtttttgaaaagtacggcgacaagctgagctacaccatcgccgaggacctcgaaaaggaaggtgcttttgatgatgccgtccagggtgtcgacgctgttctccacaccgcctcgcccttccattataacatcgagggagaccccaagcgaacgctcatcaacccagccgtcaacggcacacgcaacgtgctctcctctattcaaaaacacggcagcaacgtgaagcgcgtcgtcatcacctcatcctatgccgccattcttgactctacacgtcggggaactattgtctacacggaagaggactggaacatctcgagcgtcgagaacgtcgaaaagaagggcaaggaccaggacgcatctgatgcctaccgcgcatccaagaccatggccgaacgtgctgcgtggcaatttgtcgaggagaacaagcccagctgggacctagtcactatcaaccctcctctcgtcttcggccccatcatccaccaggtcaattcgcctgagaagctcaacacgtctgttggcttcgtgtggggcttgctgcacgggtccaagacagaagatgacctgcttacgccctccgggagctgcgtagatgttcgcgatgtcgcgtatgcacatgttgagtctcttgtccgcgacgacgccggtggcaaccgttttgctgtgtctctcaattcctttgtctggcaggacgtggtcgacatcatccataacgacagcagcgtgcctgtcgaatggaagaagcaggtccccactggcaagcaaggcaccggatcatcggtcaagcagaacaggctcgacggttccaaagctacacgccagctcggcctcaattacatccagctcaaggatcttgtgcaggacatggtggccagccttgccgatgccgagaagcgccgctggtctggcgtgccgagcgccaacatcctctcgcgcacaaagcactag

SEQ ID NO: 5047 - protein, 364 aa, Ustilago maydis 521
MPAIQPKSHVLVTGGSGFIAIWTIYQLLERGHNVRATVRSDDKGNYLKHVFEKYGDKLSYTIAEDLEKEGAFDDAVQGVDAVLHTASPFHYNIEGDPKRTLINPAVNGTRNVLSSIQKHGSNVKRVVITSSYAAILDSTRRGTIVYTEEDWNISSVENVEKKGKDQDASDAYRASKTMAERAAWQFVEENKPSWDLVTINPPLVFGPIIHQVNSPEKLNTSVGFVWGLLHGSKTEDDLLTPSGSCVDVRDVAYAHVESLVRDDAGGNRFAVSLNSFVWQDVVDIIHNDSSVPVEWKKQVPTGKQGTGSSVKQNRLDGSKATRQLGLNYIQLKDLVQDMVASLADAEKRRWSGVPSANILSRTKH

SEQ ID NO: 5048 - DNA, 1047 bp, Prosthecochloris aestuarii DSM 271
  CDS (1)..(1047): transl_table=11
atggcacaacatccaatcgtctgcgtcaccggcgctactggttttattgcagcccatctgatcaaaaaactgctgcaacagggctacgctgtacggggaaccgtcaggaaactttcaaaacacagcagttaccggtttcttgaaaacctcgacggagcggcagaacgcctggagctcatcgaggccgatctgctctcccccggctctttcgatgcagccatcgggggaacgcaatatgtcatgcacacggcaagtccttacctgataaacgtcagagacccgcaaaaaaacctcgtagaacctgcactggagggaacacgctcggtgctcgaatcatgcagaaaagcctcaagcgtcaaacgcgtcgtgctcacctcatcaatcgccgctatcaccggcgcaccggacagtaacagggtcttcactgaaaatgactggaacacaacctcctcgctgaaagaaaacccgtatcactactcaaaaacccttgccgagcgggccgcatgggagttcatgcaggagcagccgggttttgacctggttgtcatcaaccccttcatggtgatcggtccttctctcggagcctcgctgaacacgaccaatcagatgatacgcgacattataaccggcgtctatcccggcattcttgatgtcaactggggatttgtcgatgtccgtgatgtcgccctggctcatatccgtgccatagaaaaacccgcagcccatggtcgatacctctgttcagcagaagcgctggatatgcgtaacgtggtcgcaatcctcagaaaggcagggtatggaaacgactataagttgccctctctcgacctgtcgggaaaagcagcgacaacactcatgaaactcgtctcatggagccagccacgcgataccggtgcctacctgagaacacatctcggacgtcgtatgcgctacgataacgataaaatccgaaaggaactcgacatccaattccgaaatatcgaaagctcactgcttgaaaccgtcgaagaccttatcagctgggggcatctgaagaagaagagctga

SEQ ID NO: 5049 - protein, 348 aa, Prosthecochloris aestuarii DSM 271
MAQHPIVCVTGATGFIAAHLIKKLLQQGYAVRGTVRKLSKHSSYRFLENLDGAAERLELIEADLLSPGSFDAAIGGTQYVMHTASPYLINVRDPQKNLVEPALEGTRSVLESCRKASSVKRVVLTSSIAAITGAPDSNRVFTENDWNTTSSLKENPYHYSKTLAERAAWEFMQEQPGFDLVVINPFMVIGPSLGASLNTTNQMIRDIITGVYPGILDVNWGFVDVRDVALAHIRAIEKPAAHGRYLCSAEALDMRNVVAILRKAGYGNDYKLPSLDLSGKAATTLMKLVSWSQPRDTGAYLRTHLGRRMRYDNDKIRKELDIQFRNIESSLLETVEDLISWGHLKKKS

SEQ ID NO: 5050 - DNA, 1017 bp, Flavobacteria bacterium BBFL7
  CDS (1)..(1017): transl_table=11
atgaaaaaagtattagtaacgggaatttcaggatatgttggtctgcacgcagcggtggaattattaaaaaatggatatgcagtcaaaggttcagttaggaatttatccaaaagagacgaattaacacgagcaattcgtagagaagttgagcccaaaggtaatttagagttttgtgaacttaatcttttaaaagatgaaggttggaaggaagcaatgcaagattgtgactatgttcttcatattgcttcgccttatgttgcaagtgagcccaaagatgaaaatgagataataaagcctgctattgatggcacacaacgagctttaaaatttgctaaaagtaatggcgtaaaacgcgtggttttaacttcttctatggtagcaatgtttggtgatgcaaataagtcattaaacatagaacaagatacttggactaatccaaatgctaaaaatatgtccgcctatgtaaaaagtaaaacacttgcagaaaaaagtgcttgggattttattgaaactcaaaaaggtgataataagttggaattggttgttattaatccaggtccaatttggggaccaaccttgtcagataaactctctggtgaatcaatgaatattgttaaggatatgattactggtaaaatgccaatgcttgctaaagtacgcattaatatgtcagatgtgagagatattgccagtattcacgttaaggctttagagaatgagaaggctaatggacaacgatttgttgttgcaactgaaaatccatattcgtttaaagaaatggctcaaatcttaaaatcaaatggaaatgataaagtaagcactttagaaggtccaaatttcttattaaaatttatgtctaattttaatagcgatttaaaaggtatgaagccttttattggaaacacttatgacgcagatgttagcaaaacaaaggaagtgtttaattggaagccgatttcttttgaaaagtccattttagacacagttcaatcagtaaaacaacgattgaacaaatag

SEQ ID NO: 5051 - protein, 338 aa, Flavobacteria bacterium BBFL7
MKKVLVTGISGYVGLHAAVELLKNGYAVKGSVRNLSKRDELTRAIRREVEPKGNLEFCELNLLKDEGWKEAMQDCDYVLHIASPYVASEPKDENEIIKPAIDGTQRALKFAKSNGVKRVVLTSSMVAMFGDANKSLNIEQDTWTNPNAKNMSAYVKSKTLAEKSAWDFIETQKGDNKLELVVINPGPIWGPTLSDKLSGESMNIVKDMITGKMPMLAKVRINMSDVRDIASIHVKALENEKANGQRFVVATENPYSFKEMAQILKSNGNDKVSTLEGPNFLLKFMSNFNSDLKGMKPFIGNTYDADVSKTKEVFNWKPISFEKSILDTVQSVKQRLNK

SEQ ID NO: 5052 - DNA, 984 bp, Eucalyptus gunnii
  CDS (1)..(984)
atgagcgctgcgggcggtgccgggaaggttgtgtgcgtgaccggggcgtcgcgttacatcgcctcgtggctcgtcaagctcctcctgcagcgcggctacaccgtcaaggcctccgtccgcgatccgaatgatccaaaaaagactgaacatttgcttggacttgatggagcgaaagatagacttcaactgttcaaagcaaacctgctggaagagggttcatttgatcctattgttgagggttgtgcaggcgtttttcacactgcctctcccttttatcatgatgtcaaggatccgcaggcagaattacttgatccggctgtgaagggaacactcaatgtcctgaagtcatgttccaaagcaccttctctgcagcgtgtggtcttgacatcatctatggctgcagttgcatacaatagacaaccgcggacacctgaagttgtggtggatgaaagttggttttctgatccagacttgtgcaggcaaaccaatgcgtggtatgtgctttccaagactttggctgaggacgctgcctggaaatttgtgaaagaaaagggcattgacatggttacaattaacccagctatggtgattggtcctcttttgcagccaacacttaacacaagcgctgcagcgatcggaaatttgataaatggtgcaccaacttttccaaatgcaagttttggatgggtcaatgtcaaagatgttgcaaatgctcatatactggcatttgaggtcccatcagccagcggaagatattgtttagttgagagaattgcacactactccgagatcgtgaggatcttacgtgagctttacccttctgcccagcttccagaaaagtccgcggacgacaagcctttcgtgccgatctatcaggtgtccaaggagaaagtgaaaagcttggggatcaactacattcctctggagcagaatttgaaggagactgttgaaagcctgaaggagaagggatttgttaagttctga

SEQ ID NO: 5053 - protein, 327 aa, Eucalyptus gunnii
MSAAGGAGKVVCVTGASRYIASWLVKLLLQRGYTVKASVRDPNDPKKTEHLLGLDGAKDRLQLFKANLLEEGSFDPIVEGCAGVFHTASPFYHDVKDPQAELLDPAVKGTLNVLKSCSKAPSLQRVVLTSSMAAVAYNRQPRTPEVVVDESWFSDPDLCRQTNAWYVLSKTLAEDAAWKFVKEKGIDMVTINPAMVIGPLLQPTLNTSAAAIGNLINGAPTFPNASFGWVNVKDVANAHILAFEVPSASGRYCLVERIAHYSEIVRILRELYPSAQLPEKSADDKPFVPIYQVSKEKVKSLGINYIPLEQNLKETVESLKEKGFVKF

SEQ ID NO: 5054 - DNA, 1011 bp, Eucalyptus gunnii
  CDS (1)..(1011)
atgcccgtcgacgccctccccggttccggccagaccgtctgcgtcaccggcgccggcgggttcatcgcctcctggattgtcaagcttctcctcgagcgaggctacaccgtgcgaggaaccgtcaggaacccagacgacccgaagaatggtcatctgagagagctggaaggagccagcgagaggctgacgctgtacaagggtgatctgatggactacgggagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttggccagaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcgtacgtgcacgtcaaggacgtcgcgcttgcccacgtccttgtcttggagaccccatccgcctcaggccgctatttgtgcgccgagagcgtcctccaccgtggcgatgtggtggaaatccttgccaagttcttccctgagtataatgtaccgaccaagtgctctgatgaggtgaacccaagagtaaaaccatacaagttctccaaccagaagctgagagacttggggctcgagttcaccccggtgaagcagtgcctgtacgaaactgtcaagagcttgcaggagaaaggccacctaccagtcccctccccgccggaagattcggtgcgtattcagggatga

SEQ ID NO: 5055 - protein, 336 aa, Eucalyptus gunnii
MPVDALPGSGQTVCVTGAGGFIASWIVKLLLERGYTVRGTVRNPDDPKNGHLRELEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAAWPEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPSPPEDSVRIQG

SEQ ID NO: 5056 - DNA, 954 bp, Eucalyptus gunnii
  CDS (1)..(954)
atgcccgtcgacgccctccccggttccggccagaccgtttgcgtcaccggcgccggcggcttcatcgcctcctggattgtcaagcttctcctcgagcgaggctacaccgtgcgaggaaccgtcaggaacccagacgacccgaagaatgggcatctgagagagctggaaggagccagcgagaggctgacgctgtacaagggtgatctgatggactacgggagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttggccagaggcgaaggagagaggggttgacctcgtggtgattaaccctgtgctcgtgcttggaccgctccttcagtcgacgatcaatgctagcatcatccacatcctcaagtacttgactggctcagccaagacctacgccaactcggtccaggcgtacgtgcacgtcaaggacgtcgcgcttgcccacgtccttgtcttggagaccccatccgcctcaggccgctatttgtgcgccgagagcgtcctccaccgtggcgatgtggtggaaatccttgccaagttcttccctgagtataacgtaccgaccaagtcgaaactgtcaagagcttgcaggagaaaggccacctacccgtcccctcccccccggaagattcggtgcgtattcagggatgatcttagatccatcacggtgcacatttgtaatccggagaaatga

SEQ ID NO: 5057 - protein, 317 aa, Eucalyptus gunnii
MPVDALPGSGQTVCVTGAGGFIASWIVKLLLERGYTVRGTVRNPDDPKNGHLRELEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAAWPEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKSKLSRACRRKATYPSPPPRKIRCVFRDDLRSITVHICNPEK

SEQ ID NO: 5058 - DNA, 1116 bp, Zea mays
  CDS (1)..(1116)
atgaccgtcgtcgacgccgtcgtctcctccaccgatgccggcgcccctgctgccgccgccaccgcggtaccggcggggaacgggcagaccgtgtgcgtgaccggcgcggccgggtacatcgcctcgtggttggtgaagctgctgctcgagaagggatacactgtgaagggcaccgtcaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcacgcggcgtgggagacggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccacggccgagatgcagcagggagggatcgccatccgtgcctga

SEQ ID NO: 5059 - protein, 371 aa, Zea mays
MTVVDAVVSSTDAGAPAAAATAVPAGNGQTVCVTGAAGYIASWLVKLLLEKGYTVKGTVRNPDDPKNAHLKALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEHAAWETARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPTAEMQQGGIAIRA

SEQ ID NO: 5060 - DNA, 978 bp, Malus domestica
  CDS (1)..(978)
atgagcagcggagcagggaaggtcgtgtgcgtcaccggtgcgtctggatacattgcttcatggctcgttaagcttcttctccagcgcggctacaccgtcaaggcctctattcgcgacccaaatgatccaactaagacagagcacctgcatgcgcttgatggagcccaagacagacttcaacttttcaaagcaaatctgttggaagaaggttcttttgactctgctgttgagggttgtgaaggcgtattccatactgcatctcccttttatcatgatgtcacagacccaaaggcagaactacttgaacctgcggtaaaggggacccttaatgttcttaattcgtgtgcgaaatcaccatcaatcaaacgggtggttttgacatcttctatagccgctgtagcatataatggaaagcctcgaactcctgatgtagtagttgatgagacttggtttacagatccagatgtttgtaaggaatcaaagctttggtacgtgctttcaaagactttggctgaagatgctgcgtggaaatttgtaaaggagaagggtattgacttggttacaattaaccccgcaatggtgataggtcctctgttacagccaactcttaatacaagtgctgcagcagttttaaatgttattaagggagctcgaacttttccaaatgcaagttttggatggattaacgttaaagatgttgccaatgcacatattcaagcatttgagaggcctaccgctagtggcagatattgtttggttgagagagttgcccacttctcagaagttgtgagaattttacgtgagctgtaccctactttgcaacttccagagaagtgtgcagacgacaagccttttgtgccaacatatcaggtgtccaaggagaaggcgaagagcttgggtgtcgaatttattccactagatgttagcctcaaggaaacagttgaaagtctgaaggaaaagggttttgtcaatttctga

SEQ ID NO: 5061 - protein, 325 aa, Malus domestica
MSSGAGKVVCVTGASGYIASWLVKLLLQRGYTVKASIRDPNDPTKTEHLHALDGAQDRLQLFKANLLEEGSFDSAVEGCEGVFHTASPFYHDVTDPKAELLEPAVKGTLNVLNSCAKSPSIKRVVLTSSIAAVAYNGKPRTPDVVVDETWFTDPDVCKESKLWYVLSKTLAEDAAWKFVKEKGIDLVTINPAMVIGPLLQPTLNTSAAAVLNVIKGARTFPNASFGWINVKDVANAHIQAFERPTASGRYCLVERVAHFSEVVRILRELYPTLQLPEKCADDKPFVPTYQVSKEKAKSLGVEFIPLDVSLKETVESLKEKGFVNF

SEQ ID NO: 5062 - DNA, 1017 bp, Populus trichocarpa
  CDS (1)..(1017)
atgcctgttgatgcttcatcactttcaggccaaggccaaactatctgtgtcaccgggggtggtggtttcattgcttcttggatggttaaacttcttttagataaaggttacactgttagaggaactgcgaggaacccagctgatcccaagaattctcatttgagggagcttgaaggagctgaagaaagattaactttatgcaaagctgatcttcttgattatgagtctcttaaagagggtattcaagggtgtgatggtgttttccacactgcttctcctgtcacagatgatccggaagaaatggtggagccagcagtgaacgggaccaaaaatgtgataattgcggcggctgaggccaaagtccgacgagtggtgttcacgtcatcaattggcgctgtgtacatggatcccaataagggcccagatgttgtcattgatgagtcttgctggagtgatcttgaattctgcaagaacaccaagaattggtattgctatggaaaggctgtggcagaacaagctgcatgggatatggctaaggagaaaggggtggacctagtggtggttaacccagtgctggtgcttggaccattgttgcagcccactgtcaatgctagcatcactcacatcctcaagtacctcaccggctcagccaagacatatgctaactctgttcaagcttatgtgcatgttagggatgtggcactagcccacattttagtctttgagacgccttccgcctccggccgttacctttgctctgagagcgttctccaccgtggagaggtggtggaaatccttgcaaagttcttccctgagtaccccatccctaccaagtgctcagatgagaagaacccaagaaaacaaccttacaagttctcaaaccagaagctaagggatctgggtttcgaattcaccccagtaaagcagtgtctgtatgaaactgttaagagtttgcaggaaaagggtcaccttccaatcccaaaacaagctgcagaagagtctttgaaaattcaataa

SEQ ID NO: 5063 - protein, 338 aa, Populus trichocarpa
MPVDASSLSGQGQTICVTGGGGFIASWMVKLLLDKGYTVRGTARNPADPKNSHLRELEGAEERLTLCKADLLDYESLKEGIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLLQPTVNASITHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQEKGHLPIPKQAAEESLKIQ

SEQ ID NO: 5064 - DNA, 1110 bp, Arabidopsis thaliana; identical to SEQ ID NO: 4932
  CDS (142)..(1110)

SEQ ID NO: 5065 - protein, 322 aa, Arabidopsis thaliana
MNGGGKLVCVTGASGYIASWIVKLLLLRGYTVKATVRDLTDRKKTEHLLALDGAKERLKLFKADLLEESSFEQAIEGCDAVFHTASPVFFTVKDPQTELIDPALKGTMNVLNTCKETPSVRRVILTSSTAAVLFRQPPVEASDVVDETFFSDPSLCRETKNWYPLSKILAENAAWEFAKDNGIDMVVLNPGFIFGPLLQPTLNFSVELIVDFINGKNPFNSRFYRFVDVRDVALAHIKALETPSANGRYIIDGPIMSVSDIIDILRELLPDLCIADTNEESVMNEMLCKVCVEKVKNLGVEFTPMKSSLRDTIVSLKEKCLL

SEQ ID NO: 5066 - DNA, 1119 bp, Saccharum officinarum
  CDS (1)..(1119)
atgaccgtcgtcgacgccgtgtccactgatgccgccggcgcccctgcagccgccgcggcaccggtgcagcagcccgggaacgggcagaccgtgtgcgtcaccggtgcggccgggtacatcgcctcgtggctcgtcaagctgctgctcgagaagggatacactgtcaagggaacagtcaggaacccagatgacccgaagaacgcgcacctcaaggcgctggacggcgccgccgagcggctgatcctctgcaaggccgacctcctggactacgacgccatctgccgcgccgtgcagggctgccatggcgtcttccacaccgcctccccggtcaccgacgacccggagcaaatggtggagccggcggtgcgcggcacggagtacgtgatcaacgcggcggcggaggccggcacggtgcggcgggtggtgttcacgtcctccatcggcgcggtgaccatggaccccagccgcgggcccgacgtcgtggtcgacgagtcgtgctggagcgacctcgagttctgcaagaaaaccaggaactggtactgctacggcaaggcggtggcggagcaggcggcgtgggacgcggcccggcagcgcggcgtggacctggtggtggtgaacccggtgctggtggtgggcccgctgctgcagccgacggtgaacgccagcatcgcgcacgtggtcaagtacctggacggctccgcgcgcaccttcgccaacgccgtgcaggcgtacgtggacgtccgcgacgtcgccgacgcgcacctccgcgtcttcgagagcccgcgcgcgtccggccgatacctctgcgccgagcgcgtcctccaccgcgaggacgtcgtccgcatcctcgccaagctcttccccgagtaccccgtccccaccaggtgctccgacgaggtgaacccgcggaagcagccgtacaagttctcgaaccagaagctccgggacctgggcctggagttccggccggtgagccagtcgctgtacgacacggtgaagaaccttcaggagaagggccacctgccggtgctcggagagcagacgacggaggccgacgacaaggaggcggcccccgccgccgccgagctgcagcagggaggaatcgccatccgtgcgtaa

SEQ ID NO: 5067 - protein, 372 aa, Saccharum officinarum
MTVVDAVSTDAAGAPAAAAAPVQQPGNGQTVCVTGAAGYIASWLVKLLLEKGYTVKGTVRNPDDPKNAHLKALDGAAERLILCKADLLDYDAICRAVQGCHGVFHTASPVTDDPEQMVEPAVRGTEYVINAAAEAGTVRRVVFTSSIGAVTMDPSRGPDVVVDESCWSDLEFCKKTRNWYCYGKAVAEQAAWDAARQRGVDLVVVNPVLVVGPLLQPTVNASIAHVVKYLDGSARTFANAVQAYVDVRDVADAHLRVFESPRASGRYLCAERVLHREDVVRILAKLFPEYPVPTRCSDEVNPRKQPYKFSNQKLRDLGLEFRPVSQSLYDTVKNLQEKGHLPVLGEQTTEADDKEAAPAAAELQQGGIAIRA

SEQ ID NO: 5068 - DNA, 1116 bp, Zea mays
  CDS (1)..(1116)
atgaccgtcgtcgacgccgtcgtctcctccaccgatgccggcgcccctgccgccgccgccgcaccggtaccggcggggaacgggcagaccgtgtgcgtcaccggcgcggccgggtacatcgcctcgtggttggtgaagctgctgctcgagaagggatacactgtgaagggcaccgtgaggaacccagatgacccgaagaacgcgcacctcagggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggaggcggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggccacctgccggtgctcggagagcggacgacgacggaggccgccgacaaggatgcccccgcggccgagatgcagcagggagggatcgccatccgtgcctga

SEQ ID NO: 5069 - protein, 371 aa, Zea mays
MTVVDAVVSSTDAGAPAAAAAPVPAGNGQTVCVTGAAGYIASWLVKLLLEKGYTVKGTVRNPDDPKNAHLRALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEQAAWEAARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPAAEMQQGGIAIRA

SEQ ID NO: 5070 - DNA, 1041 bp, Zea mays
  CDS (1)..(1041)
atgccaacagcagaggcgacgacgcccgtgccgccggagctgtcctccgggcaagggcggacggtttgcgtgaccggagctggagggttcattgcctcctggctcgtcaagcgcctcctggagaagggctacacagtccgcggcacggtcaggaaccctgtggatccaaagaacgaccacctgagggcccttgacggcgccgtcgaccgtctcgtcctcctccgggccgacctgctggacccacagagccttgccgaggccttctccggctgtgacggcgtcttccacgccgcctccccggtcaccgatgaccctgagatgatgatcgagccagcgatccggggcacgcgctacgtgatggcggcggcggacgacgccggagtgaagcgcgtcgtgttcacgtcctccatcggcaccgtgtacatgaacccctaccgtgaccccagcaagcctgtggacgacacctgctggagcgacctcgagtattgcaagaacacccagaactggtactgctacgccaagacggtggcggagcagggcgcgtgggaggtggcgcggaagcgagggctggacctggtggtggtgaacccggtgctggtgctgggcccgctgctgcagccgacggtgaacgccagcacggaccacgtgatgaagtacctgacggggtcggccacgacctacgtgaacgcggcgcaggcgtacgtgcacgtcagggacgtggccgaggcgcacgtccgggtgtacgaggcgccccacgcgcacggccgctacatctgcgccgagagcaccctgcaccgcggcgacctctgccgcgtcctcgccaagctcttcccggagtaccccgtacccaccaagtgcaaggaccaggttaaccctccggtggtaggatacaagttcaccaaccagaggctcaaggatctggggatggacttcgtgccggtcctgcagtgcctctacgagacggtcaccagcctccaggagaaaggcatgctgcccgtgcttccgacaaaacaagaccatgaccaactcggcaaatcatga

SEQ ID NO: 5071 - protein, 346 aa, Zea mays
MPTAEATTPVPPELSSGQGRTVCVTGAGGFIASWLVKRLLEKGYTVRGTVRNPVDPKNDHLRALDGAVDRLVLLRADLLDPQSLAEAFSGCDGVFHAASPVTDDPEMMIEPAIRGTRYVMAAADDAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKQDHDQLGKS

SEQ ID NO: 5072 - DNA, 996 bp, Candida albicans
  CDS (1)..(996): transl_table=12
atgtccattactgtttttgttgctggtgccggcggatacattggaaaacatattgtatctcaattactttcaaagggttataccgttattggatctgttagaaatgatgaaaagggagaacgtcttgtatccttgtttgaaaatgataattttacctacgtagtagttgaggaagcggaggctaaaggtgcatttgacaagccgttgaaggatcacccacatattaaagtctttattgacacagcaagtcctttaccaattggagtcaattacgaaaagcagttgattagacgtacttcaaaaggaatcaagtacattttgagctcaattaaagaccacggacccaatattacaaaggtagtggttaccagttcaattgcctcgtgtatgaatgaaaaacaaagtcatgatcccaattttgttgttgatgaaagtaaatggaatccagataaacatagtgttggtaaaaataatcccacgtcggcctacttttatgcaaaggcatctgctgaacatgaagcctgggacttcatgaaaaagaaaacacatttcacacttgcaacaattcttcccggttatacatttggtccacagtgttttgatgaagatgtttccgatcttcttgaaacctctgttgagattgtcacgaaaatatttgaattaaataagaatgaccctatccccaaagagctgggattatttgttgatgtcagagatgttgctgctgcacatatacgggcattcgagctaaacgaagctcaaaataaacgtttgatgttagtctcagaacccttttcagctcaggaaattgttgatattttacacgaaatgtatcccgcggttcaattgccactcggtcaccctggagacaaacctaattacaaattcaacaatatcgaaaccaaaaaaattttaaatactgacttccgctctttaagatcaagcataaaggatgattatgaccaatatttaaggactcatggtattatatcttag

SEQ ID NO: 5073 - protein, 331 aa, Candida albicans
MSITVFVAGAGGYIGKHIVSQLLSKGYTVIGSVRNDEKGERLVSLFENDNFTYVVVEEAEAKGAFDKPLKDHPHIKVFIDTASPLPIGVNYEKQLIRRTSKGIKYILSSIKDHGPNITKVVVTSSIASCMNEKQSHDPNFVVDESKWNPDKHSVGKNNPTSAYFYAKASAEHEAWDFMKKKTHFTLATILPGYTFGPQCFDEDVSDLLETSVEIVTKIFELNKNDPIPKESGLFVDVRDVAAAHIRAFELNEAQNKRLMLVSEPFSAQEIVDILHEMYPAVQLPLGHPGDKPNYKFNNIETKKILNTDFRSLRSSIKDDYDQYLRTHGIIS

SEQ ID NO: 5074 - DNA, 978 bp, Vigna unguiculata
  CDS (1)..(978)
atgagcaccggcgccggacaagtagtgtgtgttaccggagcttccggttacattgcttcctgggtcgttaagtttcttctcgaacgcggctacaccgtgaaggccaccgttcgcgacacaagtgatcccaaaaaggtagatcacttgcttagcctcgatggtgctaaggaaaggctgcatctcgtcaaggcgaatcttctagaagaaggttcctttgactctgccgttgaaggttgtcacgctgtgttccacactgcttctccctttttcgacgatgccaaggacccgcagactgagttgttggatccagctttgaaggggactctgaatgttctgaaatcgtgcgtgaactcgcccacgctgaagcgcgtggttgtcacttcttctattgctgcagtttcgttcaacgacaggcccaaaaaccctgatgtagtggttgacgagacttggtattccgacccagaatactgtaagagaaatgggatatggtataacctctcaaagactttggccgaagatgctgcctggaaatttgcgaaagaaaacaatattgacttggttacagccaaccctgcattggttgttggacctctcttgcaaccagttcttaacactagttctgcagcagttttaaatttaattaatggttcgccaacatttaaaaatgtgactttgggatgggtggacgtgagagatgttgcaattgcccatgttctggcatatgagaatgcttcagctaatggaagatatttactagttgagagagtggcacacttcggagacgttgtgaagattttgcatgatttgtacccaacattgcaacttccacagaagtgtgtagatgataggccatatgatccaatattccaggtttccaaggaaaaagcaaagagcttggggcttgaatttactcctttggaagtgagcatcaaggatactgttgaaagcttgaaggaaaagggttttatcaaattttaa

SEQ ID NO: 5075 - protein, 325 aa, Vigna unguiculata
MSTGAGQVVCVTGASGYIASWVVKFLLERGYTVKATVRDTSDPKKVDHLLSLDGAKERLHLVKANLLEEGSFDSAVEGCHAVFHTASPFFDDAKDPQTELLDPALKGTLNVLKSCVNSPTLKRVVVTSSIAAVSFNDRPKNPDVVVDETWYSDPEYCKRNGIWYNLSKTLAEDAAWKFAKENNIDLVTANPALVVGPLLQPVLNTSSAAVLNLINGSPTFKNVTLGWVDVRDVAIAHVLAYENASANGRYLLVERVAHFGDVVKILHDLYPTLQLPQKCVDDRPYDPIFQVSKEKAKSLGLEFTPLEVSIKDTVESLKEKGFIKF

SEQ ID NO: 5076 - DNA, 1014 bp, Vitis vinifera
  CDS (1)..(1014)
atgggttcacaaagtgaaaccgtgtgcgtcaccggtgcctccggtttcatcggttcatggctggtcatgaggctcctggagcgcggctatactgttcgggccaccgttcgcgatccaactaacgtgaaaaaagtgaagcatttgctggacttgcccaaagcggagacgcatctgactctctggaaggcagatcttgctgatgaaggaagtttcgatgaagctattaaaggctgcaccggcgtcttccatgttgccacacccatggattttgaatcgaaggatcctgagaatgaagtgataaagccaactattgaagggatgttgggcataatgaaatcgtgtgctgccgcaaagactgtcagaaggcttgtattcacatcctccgcaggaactgtgaacattcaagaacaccaactgccagtgtacgatgaaagctgctggagtgatatggaattttgccgggctaaaaagatgactgcatggatgtactttgtctccaagacactggctgagcaagctgcatggaagtatgccaaggaaaataacattgacttcatcactatcataccgactcttgtggttggccccttcataatgtcatcaatgcctccaagcctcataactgctctttccccgatcactggaaacgaagctcattattcaattatacggcagggccaatttgttcacctggatgacctctgcaatgctcatatttacttgtttgagaatcctaaggcagagggacgttacatttgctcctcccacgattgtatcattctcgatcttgcaaaaatgcttagagaaaaataccccgagtataatatccccacagagttcaaaggtgttgatgagaacttgaagagtgtctgtttctcctccaagaagctgacagatttggggtttgagtttaaatacagcttagaggacatgtttactggagctgtggacacatgccgggccaagggattgcttcccccttcacatgagaaacctgtagatggcaagacctag

SEQ ID NO: 5077 - protein, 337 aa, Vitis vinifera
MGSQSETVCVTGASGFIGSWLVMRLLERGYTVRATVRDPTNVKKVKHLLDLPKAETHLTLWKADLADEGSFDEAIKGCTGVFHVATPMDFESKDPENEVIKPTIEGMLGIMKSCAAAKTVRRLVFTSSAGTVNIQEHQLPVYDESCWSDMEFCRAKKMTAWMYFVSKTLAEQAAWKYAKENNIDFITIIPTLVVGPFIMSSMPPSLITALSPITGNEAHYSIIRQGQFVHLDDLCNAHIYLFENPKAEGRYICSSHDCIILDLAKMLREKYPEYNIPTEFKGVDENLKSVCFSSKKLTDLGFEFKYSLEDMFTGAVDTCRAKGLLPPSHEKPVDGKT

SEQ ID NO: 5078 - DNA, 993 bp, Medicago truncatula
  CDS (1)..(993)
atggaacacaaagtgtgtgtaacaggagcttcaggctttttggcttcttggcttattaagcgacttctattatctggatatcatgtcattggaacagttagagatttaggtaagaagcagaaagttgaacatttatggaagttggaaggagcaacagaaagactcaaactagtccaagctgatttaatggaagaaaatagcttcgacaatgcgatcatgggatgcaaaggtgtctttcacattgcctctccagtactcaatcatatatcaaatgatcctaaggcagaaatcttggaaccagcagtccaaggtacgctgaatgttttgcgttcttgtcgaaagaatccagcccttgttcgagtggtgttagcctcatcgtcttcagctgttagagtaagagctgatttcgatccaaacataccaatagacgagtcatcttggagctcattggaattgtgtgagaaactccaggcatggtacccaatgtcaaagacattggcagaaaaagcagcttgggattattgcaaagagaatggaatagacttagtgactattttaccatcattcataattggacctaacttgccaacagatttatgttccactgcatctgatgtgctaggcttgttcaaaggggaaactgagaaatttcaatggcatggaaggatgggatatgttcatatagatgatgttgcactttgtcacatccttctttatgagaacaaagcatctgatggtagatacctttgcagttcaaaaataatggataatgatgatttggttggcatgctagcaaatcgttatcctggttttcccattcccaaaaggttcaagaaactagatagaccacattatgaactaaacactggaaagcttgagagtctgggattcaagtttaaatctgttgaagaaatgtttgatgattgctttgcatcgtttgtggagcagggccatcttactactcttccccaccaaccccgtgttatactctaa

SEQ ID NO: 5079 - protein, 330 aa, Medicago truncatula
MEHKVCVTGASGFLASWLIKRLLLSGYHVIGTVRDLGKKQKVEHLWKLEGATERLKLVQADLMEENSFDNAIMGCKGVFHIASPVLNHISNDPKAEILEPAVQGTLNVLRSCRKNPALVRVVLASSSSAVRVRADFDPNIPIDESSWSSLELCEKLQAWYPMSKTLAEKAAWDYCKENGIDLVTILPSFIIGPNLPTDLCSTASDVLGLFKGETEKFQWHGRMGYVHIDDVALCHILLYENKASDGRYLCSSKIMDNDDLVGMLANRYPGFPIPKRFKKLDRPHYELNTGKLESLGFKFKSVEEMFDDCFASFVEQGHLTTLPHQPRVIL

SEQ ID NO: 5080 - DNA, 981 bp, Medicago truncatula
  CDS (1)..(981)
atgagcagcagcaacttgggaaatgttgtgtgtgtgactggcgcttcaggttacatcgcttcatggctcgtccgattgcttcttcatcgtggctacactgttaaagccaccgttcgcgatccaaatgatcccaagaaggttgaccacttggttaagcttgatggtgctaaggagagattgcaactgttcaaggcaaatctacttgaagaaggtgcctttgattctgttgttcaaggctgtcatggtgtctttcacactgcatctcccttttatcatgatgtcaaggatcctcaggctgaattgattgatcctgctctcaaagggactctcaatgttctcaactcatgtgctaaatccccatcactcaaacgtgttgttttaacttcttctattgctgctgttgcttataatgggaagcctcgaactcctgatgttgttgttgatgagacttggtttacagatgctgatttctgtgctaaatcaaatctgtggtatgtggtttcaaagacattggctgaagaagctgcctggaaatttgttaaagaaaacaacatcgatatggttactattaacccagcaatggtcatagggcctctcttgcaaccagtcctaaacacaagtgctgctgcaattctaaacctgattaatggtgcacagacatttccaaatgctagttttggatgggtcaatgtgaaagatgttgcaaatgcccatattctggcgtacgagaatgcttcagcgagtggaagacattgtttagttgagagagtagcacactactccgaagttgtgaggattttacgtgaactgtacccttcgttgcaactcccagagaagtgtgcggacgataagccatatgtgcctatatatcaggtttccaaagaaaaggcgaaaagcttgggacttgaatatactcctttggaagtgagcatcaaggagactgttgaaagtttgaaagaaaagaagttcgccaacctttaa

SEQ ID NO: 5081 - protein, 326 aa, Medicago truncatula
MSSSNLGNVVCVTGASGYIASWLVRLLLHRGYTVKATVRDPNDPKKVDHLVKLDGAKERLQLFKANLLEEGAFDSVVQGCHGVFHTASPFYHDVKDPQAELIDPALKGTLNVLNSCAKSPSLKRVVLTSSIAAVAYNGKPRTPDVVVDETWFTDADFCAKSNLWYVVSKTLAEEAAWKFVKENNIDMVTINPAMVIGPLLQPVLNTSAAAILNLINGAQTFPNASFGWVNVKDVANAHILAYENASASGRHCLVERVAHYSEVVRILRELYPSLQLPEKCADDKPYVPIYQVSKEKAKSLGLEYTPLEVSIKETVESLKEKKFANL

SEQ ID NO: 5082 - DNA, 969 bp, Medicago truncatula
  CDS (1)..(969)
atgaacagcaacgttgtgtgtgtaactggagcttcaggttacatagcttcatggctcgttcgttaccttctccatcgtggttacactgttaaagccaccgttcgcgacccaagtgatccgaagaagatcaaccacttggttaagcttgaaggtgctaaggagagattacaactgtttaaggcaaatctacttgaacagggagcttttgattctgctgttcaaggctgtcatggtgtgtttcacactgcatctcccttctatcatcatgtcaaagaccctcaggctgagttgattgatcctgcactcaacgggactctcaatgttctcaaatcatgtgccaaatcgccattactcaaacgtgttgtcttaacctcttctgctgctgctgttgcgtacaatgaaaagcctcgaactcctgatgttgttgttgatgaaacttggtttactgatgctgatttctgtgccaaattaaacctgtggtatgcggtttcgaaaacattggctgaagaagctgcatggaaatttgttaaagaaaacaacattgatatggttactattaacccagcaatggtcatagggcctctcttgcaaccagtcctaaacacaagtgctgctgcaattctaaacctgattaatggtacacaaacatttccaaattctactttgggatgggtgtatgtgaaagatgttgcaaatgcccatattctggcgtacgagaatgcttcagctagtggaagacattgtttggttgagagtgtagcgcactactcagaaattgtgaagattttacgtgaactgtacccttcgttgcaactcccagagaagtgtgcggacgataagccatatgtgcctacatatcagttttccaaagaaaaggcaacgagtttgggaattgaatatactcctttggaagtgagcatcaaggaaactgttgaaagtttgaaagaaaagaagttcgtcaacttttaa

SEQ ID NO: 5083 - protein, 322 aa, Medicago truncatula
MNSNVVCVTGASGYIASWLVRYLLHRGYTVKATVRDPSDPKKINHLVKLEGAKERLQLFKANLLEQGAFDSAVQGCHGVFHTASPFYHHVKDPQAELIDPALNGTLNVLKSCAKSPLLKRVVLTSSAAAVAYNEKPRTPDVVVDETWFTDADFCAKLNLWYAVSKTLAEEAAWKFVKENNIDMVTINPAMVIGPLLQPVLNTSAAAILNLINGTQTFPNSTLGWVYVKDVANAHILAYENASASGRHCLVESVAHYSEIVKILRELYPSLQLPEKCADDKPYVPTYQFSKEKATSLGIEYTPLEVSIKETVESLKEKKFVNF

SEQ ID NO: 5084 - DNA, 978 bp, Ocimum basilicum
  CDS (1)..(978)
atgagtgtagcagcagccataaatgtgtgtgtaaccggagcatcgggtttcattgcatcatggctcgtcaaattcctgctccagaaaggttataccgtcaaggcatccgttcgtgaccccaatgaccctaagaagacagagcatttgcttgcacttgatggagctaaggagagactttgcttaatgaaagcaaatctgctggacgaagggtccttcgattccatagttgatggttgtgaaggtgttttccatactgcatctcctttctaccatgcagtcaaagatccacaggcagaattgattgatcctgcattgaaggggactctcaatgttcttggatcatgcgtcaaaacgtcttctgtaaaaaagattgttttgacgtcatctatagctgcggttgcatactgtggtaaacctcgcactcctgaagttatagttgatgaaacttggtggtctgatccagagatttgcaagcagatgcagctctggtatgtgctttcaaagacactggctgaggatgctgcttggaagtttgtgaaggagaaagatattgacatggttgccataaacccagcaatggtgattggcccattgttgcagccaacactaaacacaagtgctgctgcaatattgaacttgataaatggtgcggagacatacccaaattcttcatttggttggataaatgtcaaagatgttgcacatgcacatattttggcatttgagaatgcttcggcaagtggaagatactgtttagtggagagggtcgcccacttttcagaagttgtaaagatattacgtggactgtaccctacatataaacttcctgaaaagtgtgccgatgacaagccgtttgtgccgatataccaggtgtccaaagaaaaggctaagtctctgggtttggagttcactcctcttgaagagggaatcaaggaaactgttgaaaggctgaaagagaaaaatttctttaaaccttaa

SEQ ID NO: 5085 - protein, 325 aa, Ocimum basilicum
MSVAAAINVCVTGASGFIASWLVKFLLQKGYTVKASVRDPNDPKKTEHLLALDGAKERLCLMKANLLDEGSFDSIVDGCEGVFHTASPFYHAVKDPQAELIDPALKGTLNVLGSCVKTSSVKKIVLTSSIAAVAYCGKPRTPEVIVDETWWSDPEICKQMQLWYVLSKTLAEDAAWKFVKEKDIDMVAINPAMVIGPLLQPTLNTSAAAILNLINGAETYPNSSFGWINVKDVAHAHILAFENASASGRYCLVERVAHFSEVVKILRGLYPTYKLPEKCADDKPFVPIYQVSKEKAKSLGLEFTPLEEGIKETVERLKEKNFFKP

SEQ ID NO: 5086 - DNA, 1020 bp, Aspergillus oryzae
  CDS (1)..(1020)
atgtctaaaattctagtaacaggcgccaatggcttcattgccgcgcactgcatctctctccttctttccacaaaccaccacgtccgcggcacagtccgctccgaacaaaaggcgaccgcgacgcaagcagccctgactgccgcaggcgtggacataacgaacctcgaactggtcgttatcagcgacccgactgatgtaacccagtttgcgcccgctgtggccggttgcaagggcatcttgcatctggcgagcgcgttcagctacgatgccacgcccgaagaatttgaggagaagcttcttatccccgccctcaagggaacagttaccgtatgcgaagctgcctcacagtatcccgaagtcaaaaaggtggtgatcatgtcgagctttgcggcggtttatgatgcctcgttggggccgcagcccggaagggtgtatacggagaaggattggtgtccgttaacctatgaagagggaaagaatgcgagcctcgttccaattgcataccgagcgtctaaagtgatagctgagaaagcagcgtgggattacgttcgtgaccacgaagtcagctatcagctggtcacattgtgcccagggatggtctttggcaagatgattcatccgatcgagtcgttatcgcaattgaatgccagcaaccagattgtttgggatgtgttgaagggcaatggaatcccacctacaaaggcacccgtatggattgacgttgaagaccttgcccggactagtctgcaggcactaactgtggatctaccgtctcaccagcgcttcctggtgacggagggatcgtacgacacacaggagatagccgatatagtccgaaaggagcttccggagagccaggataggatcgcagagggagagcccgggaaacgaataaaggatacgcattactcgtgcgattcaggaaaggtgcaactgatgttggatgtgaggtttaagccgttgaaagagagcttggtagcgttggcgagacagctgtatgcgttggagcaggcctcttag

SEQ ID NO: 5087 - protein, 339 aa, Aspergillus oryzae
MSKILVTGANGFIAAHCISLLLSTNHHVRGTVRSEQKATATQAALTAAGVDITNLELVVISDPTDVTQFAPAVAGCKGILHLASAFSYDATPEEFEEKLLIPALKGTVTVCEAASQYPEVKKVVIMSSFAAVYDASLGPQPGRVYTEKDWCPLTYEEGKNASLVPIAYRASKVIAEKAAWDYVRDHEVSYQLVTLCPGMVFGKMIHPIESLSQLNASNQIVWDVLKGNGIPPTKAPVWIDVEDLARTSLQALTVDLPSHQRFLVTEGSYDTQEIADIVRKELPESQDRIAEGEPGKRIKDTHYSCDSGKVQLMLDVRFKPLKESLVALARQLYALEQAS

SEQ ID NO: 5088 - DNA, 1029 bp, Aspergillus oryzae
  CDS (1)..(1029)
atgactatcacacacagcaagactatcctcgtcaccggggcttcaggtttcctcgcaactcatattgtgaaggcctttcttcaacaaggttactatgtccgcgggaccgttcgatccgaccaggccgcagcaaacgtacgcaagggcttttcgcagtacagtgatcggctgtcatttgctgttgttgaggatatatcacaacccggggcattcaatgaagccgtggaaggggtcgatggtataattcataccgcttctccattccagacttcagtccgggacaataaacgagacctcctgtggcccgctattaacggcactacatctattcttcaggcagcccaggagtatgcaccgcgagttagccgtgtcgtgataacatcttcaatggctgccgtgatagacgtcggaaaaggcccgcaacctggctatccatataccgaggaagattggaatcctatgacattcgaacaggctgaaaacgcccatggcatagtcgcatacgctgcttccaaggcacttgcggagaaagccgcttggcgatatatggaaacgaatacgcctgactttagtcttaccacaatttgcccacccatgatctatggccccgtggagcatcacgtttctaccatggagagattgaatacaagtgcgggtgatatctacaggttgttcaatggtagtagcattgagataccgtcggcaattttgccggtctttgcggacgttcgtgacgttgctcaagcccacctctctgcatttgaatcggagaaaggggcaggagagcgctttattgttagttcgggaggctacacctatcaagaagtctgcgatatccttcggtcagtcgtccccgaggtcagggataaagtccctattggtcagcccgggaaacacgaatcggcggtcataaaggtctctaataacaaggtcaagacccttctgggaattactgtccacacgctacaggagactgtaaaggacactgcatatagcttgctggctctggaaaaagcatttaaggcataa

SEQ ID NO: 5089 - protein, 342 aa, Aspergillus oryzae
MTITHSKTILVTGASGFLATHIVKAFLQQGYYVRGTVRSDQAAANVRKGFSQYSDRLSFAVVEDISQPGAFNEAVEGVDGIIHTASPFQTSVRDNKRDLLWPAINGTTSILQAAQEYAPRVSRVVITSSMAAVIDVGKGPQPGYPYTEEDWNPMTFEQAENAHGIVAYAASKALAEKAAWRYMETNTPDFSLTTICPPMIYGPVEHHVSTMERLNTSAGDIYRLFNGSSIEIPSAILPVFADVRDVAQAHLSAFESEKGAGERFIVSSGGYTYQEVCDILRSVVPEVRDKVPIGQPGKHESAVIKVSNNKVKTLLGITVHTLQETVKDTAYSLLALEKAFKA

SEQ ID NO: 5090 - DNA, 1053 bp, Aspergillus oryzae
  CDS (1)..(1053)
atggcccgtcgcgctcttcttaccgggggcaacggcttcatcggatcccacatcctcgcccagcttcttgaccacggctgcaccgtctgctgtgctgttagaacacaagaaaaaggcgacaagatcttgagggacttcgccacccagcagtctcagataactatcacaatcgtccccgacatcgtcgcaccgggggcatatgacacggcggtacagggaacccccgcttttgacgccgtctatcatactgcatccccattcacgtacgcgaacgcgggaagcaatctccagtttctcgagccggcgatcaaggggacattgaacctgctcaaagccgtgaaagacaatgcccctagtgtgaagagagtcatttggaccggcagctgtgccagtgtgattgactacgacaaccttgtcgcggacccaccaaggatttatacggaagcggattggaaccctgttacatgggaagaggcagtgaatggggatccgtcgaaagcatacagaggtagtaagctttttgcagaacgagaagcatggcagtttatgaaggaagaacaaccacattttgacttggtgacgttatctccgccggcgacttttggtcctctgcgacattctattacaagtatcggggagttgaacgagtccaattctcggttgtggaaattctgcttcagctcgacaaaagatgcaccggtaccctatatgcctgtacacacctatgttgacgttcgagatcttgcatatgcacaattcagagctatgattgtcccagaggcaggcaaccaacggtttgtggtgtgcgccaggcaattcgacttccaggatgtttgcgatattctccgatcacaccatcccgaactgagcgaacgcacgccgcttggcaaaccaggaacacgctctttacctccgggtgcatattccattgataattccaaggtgaaaaagtttttaggggtggagttccgaagtctcgaagagacagttctggacgccgcgcggtgcatgttagatattgagcggaacgaaaagcaagctctttccacctag

SEQ ID NO: 5091 - protein, 350 aa, Aspergillus oryzae
MARRALLTGGNGFIGSHILAQLLDHGCTVCCAVRTQEKGDKILRDFATQQSQITITIVPDIVAPGAYDTAVQGTPAFDAVYHTASPFTYANAGSNLQFLEPAIKGTLNLLKAVKDNAPSVKRVIWTGSCASVIDYDNLVADPPRIYTEADWNPVTWEEAVNGDPSKAYRGSKLFAEREAWQFMKEEQPHFDLVTLSPPATFGPLRHSITSIGELNESNSRLWKFCFSSTKDAPVPYMPVHTYVDVRDLAYAQFRAMIVPEAGNQRFVVCARQFDFQDVCDILRSHHPELSERTPLGKPGTRSLPPGAYSIDNSKVKKFLGVEFRSLEETVLDAARCMLDIERNEKQALST

SEQ ID NO: 5092 - DNA, 1029 bp, Aspergillus oryzae
  CDS (1)..(1029)
atggccagcgaaactgtcttgatcacaggtgcatcaggcttcatcgccactcacatcgtcgaatcattcctgcgtgcgggctacaatgtccgcggcacagttcgatccgaacggacggcaaacagggtccgttatgccttccaggagtacaaggacaagttgagctttgtcattgtctccgatgtcgttgctgccaaagccttcgatgaggccgttgaaggggtcactggtgtgatccacaccgcggcgcccttccaaacagaagtcgaagacaaagaacgagatctgctgcaacctgccatcgaaggaactatcaatctcctggactctataaagagaaacggtcaccaagttcgccgagtcatccatacgtcttcttttggcgatatacttgatgcgtcaaagggagaccggccgggtcacatatacaccgaggcagactggaatccaatgacctatgcggaggccctaagtgaaagcacccctgacgtggtatcctactgcgcagggaagacgatggcggagcatgcagcgtgggatttcatggccacagagaacccgtcatttgacctggtcactatctgcccgccgtacgtgtttggtccggtcaagaatgctacaacaagcttggtcaacctaaatacttcgtccatggatgtataccgtctcatgtcgcccatgtcaaagccaagccacgctgtgccacccactttggtgtgggcgtgggcggatgtgcgtgatgttgctgacgcacatctaaaggccttcgaggttcccgaggctggaggacagcggttcttggttgctcaaggtagatacagctatcagcgaatagccgatatccttcgagataaggtggcggaagtgagagatcgtgttcctttgggtaagccacgatccggtatgggagatgtctatggcattgatgcatccaagtcggagaatgtgttggggttgagatatcgtcctttggaagactctatcgtcgacgcggcaaggtcttatctgaagttggagcaggcgaattga

SEQ ID NO: 5093 - protein, 342 aa, Aspergillus oryzae
MASETVLITGASGFIATHIVESFLRAGYNVRGTVRSERTANRVRYAFQEYKDKLSFVIVSDVVAAKAFDEAVEGVTGVIHTAAPFQTEVEDKERDLLQPAIEGTINLLDSIKRNGHQVRRVIHTSSFGDILDASKGDRPGHIYTEADWNPMTYAEALSESTPDVVSYCAGKTMAEHAAWDFMATENPSFDLVTICPPYVFGPVKNATTSLVNLNTSSMDVYRLMSPMSKPSHAVPPTLVWAWADVRDVADAHLKAFEVPEAGGQRFLVAQGRYSYQRIADILRDKVAEVRDRVPLGKPRSGMGDVYGIDASKSENVLGLRYRPLEDSIVDAARSYLKLEQAN

SEQ ID NO: 5094 - DNA, 1023 bp, Aspergillus oryzae
  CDS (1)..(1023)
atgtcacccgcagccccaaaatacatcctcgtaacaggcgccacaggcttcatcggcgcccatgtagtcgacaacctattagcacgcggcctgaccgtgcgtgcagcaacacgctctaagcaaaagggcgaacaaatgaaagccgcaagaccacaacacgcctcccgacttgaattcgtcgagatacaagatttctcgcaaatcggagtattcgacgatatcatggagggtatagacggcgtcatccacgtcgcgagtccattcacatacgacaccaaaaacaacgaacaagaactcatcatcccagccatgaacggggtgaaatctatcctctccgcctcagcgaaacaagccagtgtgaagcgcgttgttcttacctcctcgtttgcatccgtggttgatatctcgagaaagtatgagggcgattttacctacactggctcacactggaatcccttaacctacgaagaagcgattgatcccgccacagacgcggtagtagcataccgaggatcgaagaaattcgccgaactagaagcctggaagttcatcgagcgtgaaaagccctcctttgatctcgttacgctttgtccgcctatgaccttcggtcctgttgtgcatccagtaaatggtgtagcggggttgaacgagtcgaatgcggtgctctggagtgttgcttccggggcggatccgttgcctactgcgagggtttcggcgtggattgatgtgagggatttggcggaggcgcatgtgcaggctttgctgaggagtgaggttggtgggaagcggtttgttcctgcttctggggagccattttcgtatgagttggcggcggatattatcaaggggaggtttgagtgggcgagggagacggttacggggaattataagagtgggaagaagcctgttcaagcttacaagctggatggggatgctgtgacaagggagttgggtgtggagtttaggagctttaaggagacggtggtggatttggtaggccaggttaaggagacttttgcttga

SEQ ID NO: 5095 - protein, 340 aa, Aspergillus oryzae
MSPAAPKYILVTGATGFIGAHVVDNLLARGLTVRAATRSKQKGEQMKAARPQHASRLEFVEIQDFSQIGVFDDIMEGIDGVIHVASPFTYDTKNNEQELIIPAMNGVKSILSASAKQASVKRVVLTSSFASVVDISRKYEGDFTYTGSHWNPLTYEEAIDPATDAVVAYRGSKKFAELEAWKFIEREKPSFDLVTLCPPMTFGPVVHPVNGVAGLNESNAVLWSVASGADPLPTARVSAWIDVRDLAEAHVQALLRSEVGGKRFVPASGEPFSYELAADIIKGRFEWARETVTGNYKSGKKPVQAYKLDGDAVTRELGVEFRSFKETVVDLVGQVKETFA

SEQ ID NO: 5096 - DNA, 1038 bp, Aspergillus oryzae
  CDS (1)..(1038)
atgcaaccatccaagaccattcttgtgacaggagcctccggctttgtagccgctcatatcatcgaagcttttatctctgccggctatgatgtccgaggcacagttcgttctgaagctacggcggagaaggtcaggcgtacattcccacgatacggcgaacagctaagctttgccattgttcccgacattgtcaaggatggtgccttcgacgaagcagtcaaaggcgtcgatggaatcatgcatacggcttgcccaggtgctactgaaacagacagcaacgagcgagatattgtgcaacctgctatcagcgggactattaacattctcaagtccgcccaaaagcatggacttcaggtcaagcgcattgtcattacctcttccttcgcttccatgatcgacatgtccaaaggtacctggcccggtcatacctactccgagaaagactggaaccccatgacctacgaacaggctgtgagcgaaggcacctccagtgtgcaagcatatcttgctgcaaagaaagtcgcagagcgagctgcatgggactttgtcagagacgaaaatacttcctttgacctcgtgaccatcttgccgcctatgatttacggccctaatatcaatgctacacatgtgtcgcagttgaacatcacctcagctgatatataccggttcatgtctccggactcgaagccaagtgatcccatacctgacaatggattctggtcctgggtcgatgtaagagatgttgcgcaggctcatttgaaagcgtacgaagttccagaggctggcggcgagcgtttctttatctgtgctggaaattacagttatcaacaaattgcagatattttgcgggagaaggtccctgaagtaaaggatcgtgtacctatcggaaagcctggctcgggattcgggggtgttgaattgtatacacctgacgccgggaagtctcagagaatacttgggcttcgttatcgaggccttgaggagagtgctgtcgactcggcttatgcctttttggagctagagaaacactcaaattaa

SEQ ID NO: 5097 - protein, 345 aa, Aspergillus oryzae
MQPSKTILVTGASGFVAAHIIEAFISAGYDVRGTVRSEATAEKVRRTFPRYGEQLSFAIVPDIVKDGAFDEAVKGVDGIMHTACPGATETDSNERDIVQPAISGTINILKSAQKHGLQVKRIVITSSFASMIDMSKGTWPGHTYSEKDWNPMTYEQAVSEGTSSVQAYLAAKKVAERAAWDFVRDENTSFDLVTILPPMIYGPNINATHVSQLNITSADIYRFMSPDSKPSDPIPDNGFWSWVDVRDVAQAHLKAYEVPEAGGERFFICAGNYSYQQIADILREKVPEVKDRVPIGKPGSGFGGVELYTPDAGKSQRILGLRYRGLEESAVDSAYAFLELEKHSN

SEQ ID NO: 5098 - DNA, 1011 bp, Codonopsis lanceolata
  CDS (1)..(1011)
atgccgccagtctccaaccaagtcatatgtgtcaccggtgccggcggatttatagcttcatggatggttaaattgctcctggaaaaaggctattccgttcgaggaactgtcagaaatcctgatgatccgaagaatagccatttgagggaccttgaaggagcaaaggatagattaactctctgcaaagctgatctcctcgattatcagagtttgcttgaagctattattgggtgtgacggcgttttccacactgcatcacccgttaccgatgatcctgaacaaatggtggagccggcagtgattggaacgaagaatgtgatagtagcggcagcagaagccaaatgccggcgagtggttttcacttcatcaattggtgcggtctacatggaccctaacaggagccctgatgctgttgttgatgaaacttgctggagcgatctcgagttttgcaagaacactaagaattggtactgttacggaaaggcagtggcggagcaggcagcgtgggatgaggccaaggtgagaggagtggacctagtggtagtcaacccagtgttggtgcttggtccactgttacaacacaccgtaaatgccagcattgttcatgtccagaagtacctcactggctccgctaagacctatgccaactcggttcaggcctatgtccacgttagggacgtggcgttggcacatattcttctcttcgagactccttcagcgtctggccggtacctctgcgctgagagcgtgcttcaccgtggggaggttgtcgaaatcctggccaagtttttccctgaatacccaattcctaccaagtgcaaggatgacggcaagccaagagcaaaaccatacaagttttcgaatcaaaagctaaaagatttggggctggaattcacaccagttaaacaaggcttatacgaaaccgtaaagagcctgcaggagaaaggtcacctcccagttctttctcctcctccccaacaaactgatgactctattcgtattcagtcttaa

SEQ ID NO: 5099 - protein, 336 aa, Codonopsis lanceolata
MPPVSNQVICVTGAGGFIASWMVKLLLEKGYSVRGTVRNPDDPKNSHLRDLEGAKDRLTLCKADLLDYQSLLEAIIGCDGVFHTASPVTDDPEQMVEPAVIGTKNVIVAAAEAKCRRVVFTSSIGAVYMDPNRSPDAVVDETCWSDLEFCKNTKNWYCYGKAVAEQAAWDEAKVRGVDLVVVNPVLVLGPLLQHTVNASIVHVQKYLTGSAKTYANSVQAYVHVRDVALAHILLFETPSASGRYLCAESVLHRGEVVEILAKFFPEYPIPTKCKDDGKPRAKPYKFSNQKLKDLGLEFTPVKQGLYETVKSLQEKGHLPVLSPPPQQTDDSIRIQS

SEQ ID NO: 5100 - DNA, 978 bp, Quercus ilex
  CDS (1)..(978)
  misc_feature (370)..(370): n is a, g, c or t
  misc_feature (592)..(592): n is a, g, c or t
atgagcagtggagctgggaagattgtgtgtgtgactggtgcctctggttacatagcttcatggcttgtcaagcttcttctcaaccgtggctacacagtcaaggcctctgttcgtgaccccaatgatccaaagaaaacaaaccacttacaagtacttgatggggccaaggagagacttcacctattcaaagcaaatctactggaagaaggttcttttgattctgctgttgagggctgtgatggggttttccacactgcatctcccctctatcataatgtcacggacccagaggctgaactacttgaacctgcagtgaagggaacacttaatgttcttaattcgtgtgcgaaatttccatctgttaagcggntggttgtgacatcctctatggctgcagttcattacaataaaaaagctaaaactcctgatgtagttgttgatgagacttggttttctgatccagacctttgtaaggaaacaaagcaatggtatatgctttcaaagacgttggctgaagaaaatgcctggaagtttgcaaaagagaagggtattgacatagttacaattaaccctgcaatggtgattggtcctntcttacagccaacgcttaacacaagtgctgctgcgattttgaacttaataaatggagctcagacatttcccaatgtatcatttggatgggttaatgtcaaagatgttgccaatgcacatattcaagcatatgaaattcctacagctagtggaagatattgtttggttgagagtgttatacaccagtctgaagttgtgagggttttacggaaactttatccctccttacaacttccagagaagtgtgcagatgataagccatttgcgccaacatatcaggtgtccaaagaaaggacaagaagcttgggtattgaatacattccttttgaggtgagcctcaaggaaactgttgaaagcttgaaggaaaagaagtttgtcagtttttaa

SEQ ID NO: 5101 - protein, 325 aa, Quercus ilex
  misc_feature (124)..(124): The Xaa at location 124 stands for Leu, Met, or Val.
  misc_feature (198)..(198): The Xaa at location 198 stands for Ile, Leu, Phe, or Val.
MSSGAGKIVCVTGASGYIASWLVKLLLNRGYTVKASVRDPNDPKKTNHLQVLDGAKERLHLFKANLLEEGSFDSAVEGCDGVFHTASPLYHNVTDPEAELLEPAVKGTLNVLNSCAKFPSVKRXVVTSSMAAVHYNKKAKTPDVVVDETWFSDPDLCKETKQWYMLSKTLAEENAWKFAKEKGIDIVTINPAMVIGPXLQPTLNTSAAAILNLINGAQTFPNVSFGWVNVKDVANAHIQAYEIPTASGRYCLVESVIHQSEVVRVLRKLYPSLQLPEKCADDKPFAPTYQVSKERTRSLGIEYIPFEVSLKETVESLKEKKFVSF

SEQ ID NO: 5102 - DNA, 954 bp, Plantago major
  CDS (1)..(954)
atgaaaacagttgctgtaacaggaggatctggctacatagcttcatggatcatcaaattcctcctccagcgtggctacactgtcaaagcttccgttcgttatcctgatgatccgaagaagactagccacttgcttgcgcttgatggagctaaggagagactcaagctgatcaaagcagatctgcttgatgaaggatcgtttgatgctgtttttgaaggctgtgatggtgttttccacactgcctcgccttttttcctcgaaactgaaaatcctgaggatgatttgcttaccccagcgcttaaggggactttgaatgtgcttaactcagttgcaaaaaccccatctgttaaaagggttgtgctgacatcttcagaagctgcggtttctttcaatggaaaaccacgtacacctgaagtggttgttgatgagacttggttctctgacgaagtcttttgcagagagaataagctctggtatgtgctctcaaagacattggcagaatctgctgcctggaagtttgccaaggaaaaaggcattgatttgatttccatgaaccctgctttggttgttggtccccttttgcagccaacgctcaacacaagttctgctgtagtcttggatatgttgaagggttcagaaacatatgcgaacgttagtgttggatgggttaatgtgaaagatgttgcaaatggacatatcctggcatatgagactccatcagcaagtggaagatatgtcatggttgagagagttgcacattactctgaagctgtgaaaattttgcgtgacttgtaccctgatatgaaactccccactaagtgccaatctgagccattcctgccgatttaccaagtctcgaaagataggatcaaaagcctgggtattgaactcacccctcttgaagtgagcatcaaggaaactgttgacagcctgaaggagaagaacttcatctag

SEQ ID NO: 5103 - protein, 317 aa, Plantago major
MKTVAVTGGSGYIASWIIKFLLQRGYTVKASVRYPDDPKKTSHLLALDGAKERLKLIKADLLDEGSFDAVFEGCDGVFHTASPFFLETENPEDDLLTPALKGTLNVLNSVAKTPSVKRVVLTSSEAAVSFNGKPRTPEVVVDETWFSDEVFCRENKLWYVLSKTLAESAAWKFAKEKGIDLISMNPALVVGPLLQPTLNTSSAVVLDMLKGSETYANVSVGWVNVKDVANGHILAYETPSASGRYVMVERVAHYSEAVKILRDLYPDMKLPTKCQSEPFLPIYQVSKDRIKSLGIELTPLEVSIKETVDSLKEKNFI

SEQ ID NO: 5104 - DNA, 978 bp, Prunus mume
  CDS (1)..(978)
atgagcagcggggctggtaaggtcgtctgcgtcaccggtgcgtccggttacattgcttcatggctcgtgaagctccttcttcaaggcggttacactgtcaaggcctctgttcgcgacccaaatgatccaactaagacagagcacttgctcgggcttgatggagctcaagagagacttcaactcttcaaagcaaatctattggaggaaggttcttttgactctgctgttgacggttgtgaaggggttttccatactgcttctcccttttatcatgatgtcacagatccaaaggcagaactacttgaccctgcagtaaagggaacccttaatgttcttaattcgtgtgcgaaatcccagtctatcagacgggtggtcttgacatcttctatagctgcagttgcatataacggaaaacctcgaactcctgatgtagttgttgatgagacttggtttactgatgcagatttttgtaaggaatcaaagctatggtatgtgctttcaaagactttggctgaggacgctgcctggaaatttgtaaaggagaagggtattgacatggttacaattaaccctgcaatggtgattggtcctctgttacagccaacacttaatacaagtgctgcagcagttttgaatgttattaagggagctcgaacatttcccaatgcaagttttggatggattaatgttaaagatgttgccaatgcacatattcaagcatttgagattccttcagctagtggcagatattgtttggttgagagagttgcacacttctcggaagttgtgagaattttacaggagctgtaccctggtttgcaacttccagagaagtgtgcggatgataagccttttgtgccaacatatcaggtgtccaaggagaaggcaaagaagttgggtgttgaattcattccattagaggttagcctcaaggaaacagttgaaagcctgaaggaaaagaattttgtcgatttctga

SEQ ID NO: 5105 - protein, 325 aa, Prunus mume
MSSGAGKVVCVTGASGYIASWLVKLLLQGGYTVKASVRDPNDPTKTEHLLGLDGAQERLQLFKANLLEEGSFDSAVDGCEGVFHTASPFYHDVTDPKAELLDPAVKGTLNVLNSCAKSQSIRRVVLTSSIAAVAYNGKPRTPDVVVDETWFTDADFCKESKLWYVLSKTLAEDAAWKFVKEKGIDMVTINPAMVIGPLLQPTLNTSAAAVLNVIKGARTFPNASFGWINVKDVANAHIQAFEIPSASGRYCLVERVAHFSEVVRILQELYPGLQLPEKCADDKPFVPTYQVSKEKAKKLGVEFIPLEVSLKETVESLKEKNFVDF

SEQ ID NO: 5106 - DNA, 1038 bp, Kluyveromyces marxianus
  CDS (1)..(1038)
atgacatttacagtggtgacaggcgcaaatggctacattgccaagcacattcttaaatcgttattagaagatggtcatcgcgtaattgggaccgtgagaaacagcaagaaggccgaggaattgaaaaggactgtcaatgatgagaatttgatagtggagttggttcccgacatgttagtggaaaacgcatttgacgagttgttcaagaagtacaacacccaaatcaagtatgtgttccacactgcgtccccggttctcgagacgtcaaaggactatgagaaaagcttgatcgagcccgcgattaccggtgcgaagtcaatggtggaagctatcaggaagtactcattgacatcggtcgagcacattgtgtatacgtcatcgattgctgccagctcgctggaatctgagtttaccgatccaacgctcgttgtcagcgaggatagttggaacccacaaggtttggaagaggcaaagacggagtttttcaccgcttactcgtactcgaagaaaatcgccgagaagacgatgtgggattttgttgaggaatacaaggggactgagcacgaaataaagctcactacggtcaacccatgcttcaacattgggccccaggcgtacgaggcggacgttaccgagactatgaacttcacggcggagttgatcaaccacgttgtgaaaagcaaagtgggcgatccgcttcctccaacgagaattgtgccatacgtcgatgtcagggacactgcgagagcgcatgtcgatgcgttgaagaacgagaagctggcattccaaagactgttggtggtggggccctttttgtcgagccagcagatctacgatattgtgaacgagcgcttcccgcaattgcggggcaagatcgcgcggggcgagcctggcagcgacaagctggaccctgcgaagctggccaagttcgaccacgcccggaccacgcaagctctcgggtgggagttcacgcctatcgagaaggctatagctgacgaggtggcccagatcctccgtgtgggcgcgtaccgtgggtaa

SEQ ID NO: 5107 - protein, 345 aa, Kluyveromyces marxianus
MTFTVVTGANGYIAKHILKSLLEDGHRVIGTVRNSKKAEELKRTVNDENLIVELVPDMLVENAFDELFKKYNTQIKYVFHTASPVLETSKDYEKSLIEPAITGAKSMVEAIRKYSLTSVEHIVYTSSIAASSLESEFTDPTLVVSEDSWNPQGLEEAKTEFFTAYSYSKKIAEKTMWDFVEEYKGTEHEIKLTTVNPCFNIGPQAYEADVTETMNFTAELINHVVKSKVGDPLPPTRIVPYVDVRDTARAHVDALKNEKLAFQRLLVVGPFLSSQQIYDIVNERFPQLRGKIARGEPGSDKLDPAKLAKFDHARTTQALGWEFTPIEKAIADEVAQILRVGAYRG

SEQ ID NO: 5108 - DNA, 1020 bp, Malus domestica
  CDS (1)..(1020)
atggccacccaacaacccatctcaaagaagacggcttgcgtcgtcggcggaaccgggttcgtggcgtctctgctggtcaagctactgctccagaagggctacgccgtcagaaccaccgtcagagaccctgacgaccgcaagaaggtctcccacctcacagcactacaagagttgggtgagctagagattttcgcaggagatctaactgatgaagggagcttcgatgccccaatagcaggctgtgatcttgttttccatgttgcaacccctgtcaactttgcctcacaggacccggagaatgatatgatcaaaccagcaatccaaggggtactaaatgttctgaagtcgtgcgtgaaagccaaaacagttaagcgcgttgttttgacatcatcagctgctacagtttcgatcaatacacttgaaggaacaggtttggtcgtggatgaaaaggattggagtgatttggagttcttgactaatgtaaagccacccacttgggggtaccctgcctccaagacactagctgagaagacagcttggaaatttgccgaagaaaacaacattgatctaatcactgtgatcccttctcttatggccggtccttctctcaccccagacgttcccagcagtatcggccttgccatggctttaatcacaggagatgatttcctcataaatatggccctgaaaggtatgcaaatgctatcaggttcgatatccattgcacatgtggaggacgtctgccgggctcatatatttttggctgagaaagaatctgcatctggtcggtacatttgctgtgctgccaacaccggcgttcctgagcttgctaagttcctcaacaaaagatacccccagtacaaagtccccactgagtttggagattttccgtctgaggccaaactgatcatctcttcagagaagcttatcaaggaggggttcgattttaagtatggcatcgaagaaatatatgaccaaactgtggagtacttcaaggcaaaggggctgctgcagaactag

SEQ ID NO: 5109 - protein, 339 aa, Malus domestica
MATQQPISKKTACVVGGTGFVASLLVKLLLQKGYAVRTTVRDPDDRKKVSHLTALQELGELEIFAGDLTDEGSFDAPIAGCDLVFHVATPVNFASQDPENDMIKPAIQGVLNVLKSCVKAKTVKRVVLTSSAATVSINTLEGTGLVVDEKDWSDLEFLTNVKPPTWGYPASKTLAEKTAWKFAEENNIDLITVIPSLMAGPSLTPDVPSSIGLAMALITGDDFLINMALKGMQMLSGSISIAHVEDVCRAHIFLAEKESASGRYICCAANTGVPELAKFLNKRYPQYKVPTEFGDFPSEAKLIISSEKLIKEGFDFKYGIEEIYDQTVEYFKAKGLLQN

SEQ ID NO: 5110 - DNA, 1020 bp, Malus domestica
  CDS (1)..(1020)
atggccacccaacaacccatctcaaagaagacggcttgcgtcgtcggcggaaccgggttcgtggcgtctctgctggtcaagctactgctccagaagggctacgccgtcagaaccaccgtcagagaccctgacaaccacaagaaggtctcccacctcacagcactacaagagttgggtgagctagagattttggcaggagatctaactgatgaagggagcttcgatgccccaatagcaggctgtgatcttgttttccatgttgcaacccctgtcaactttgcctcacaggacccggagaatgatatgatcaaaccagcaatccaaggggtactaaatgttctgaagtcgtgcgtgaaagccaaaacagttaagcgcgttgttttgacatcatcagctgctacagtttcgatcaatacacttgaaggaacaggtttggtcgtggatgaaaaggattggagtgatttggagttcttgactaatgtaaagccacccacttgggggtaccctgcctccaagacactagctgagaagacagcttggaaatttgccgaagaaaacaacattgatctaatcactgtgatcccttctcttatggccggtccttctctcactccagacgttcccagcagtatcggccttgccatggctttaatcacaggagatgatttcctcataaatatggccctgaaaggtatgcaaatgttatcaggttcgatatccattgcacatgtggaggacgtctgccgggctcatatatttttggctgagaaagaatctgcatctggtcggtacatttgctgtgctgccaacaccggcgttcctgagcttgctaagttcctcaacaaaagatacccccagtacaaagtccccactgagtttggagattttccgtctgaggccaaactgatcatctcttcagagaagcttatcaaggaggggttcgattttaagtatggcatcgaagaaatatatgaccaaactgtggagtacttcaaggcaaaggggctgctgcagaagtag

SEQ ID NO: 5111 - protein, 339 aa, Malus domestica
MATQQPISKKTACVVGGTGFVASLLVKLLLQKGYAVRTTVRDPDNHKKVSHLTALQELGELEILAGDLTDEGSFDAPIAGCDLVFHVATPVNFASQDPENDMIKPAIQGVLNVLKSCVKAKTVKRVVLTSSAATVSINTLEGTGLVVDEKDWSDLEFLTNVKPPTWGYPASKTLAEKTAWKFAEENNIDLITVIPSLMAGPSLTPDVPSSIGLAMALITGDDFLINMALKGMQMLSGSISIAHVEDVCRAHIFLAEKESASGRYICCAANTGVPELAKFLNKRYPQYKVPTEFGDFPSEAKLIISSEKLIKEGFDFKYGIEEIYDQTVEYFKAKGLLQK

SEQ ID NO: 5112 - DNA, 1074 bp, Triticum aestivum
  CDS (1)..(1074)
atgccgatcgaggcggcagacaacgtgccggccgagcttcccggccacggccggacggtgtgcgtcaccggcgccggcggcttcatcgcctcgtggctcgtcaagcgcctcctacagaagggctacaacgtgcggggcaccgttcgcaaccctgttgatccgaagaatgaccacctgagagccttcgacggcgccgccgaccgcctcgtcctcctccgcgccgaccttatggagcccgaaaccctcgtcgaggcgttcacgggctgtgagggcatcttccacgccgcttccccggtcaccgacgaccctgagaagatgatcgagccggcgatccgggggaccaagtatgtgatcactgcagccgcggacatgggcatcaagcgtgtagtgttcacgtccaccatcggcacggtgtacatgaaccccaacagggaccccagcaagcccgtcgacgacacctgctggagcgaccttgaatactgcaaaaagacagcgaactggtactgctacgcgaagacggtggccgagcaggacgcgctggagacggcccggcagcgcggcatcgagctgatcgtggtgaacccggtgctggtgctgggcccgctgctgcagccgacggtgaacgcgagcacggagcacgtgatgaagtacctgacggggtcggccaagacgtacgtgaacgcggcgcaggcgtacgtgcacgtcaaggatgtcgccgaggcgcacgtccgcgtctacgaggcgcccggcgcgcacggccgctacatctgcgccgagggcaccacgctccaccgcggcgagctctgccgcgtcctctgcaagcttttccccgagtaccccgtacccaccaagtgcaaggacgaggtgaacccaccggtgaaagggtacaaattcacgaaccagaggctcaaggacctggggatggagttcgtgccggtgctgcagagcatatacgagacggtgaagagcctccaggagaaagggatgctgccggtgctaccgccaggcgacgacgtccgagacaacctgcatgagcagctcatgatgaagcccgcccagttgctacgtaattaa

SEQ ID NO: 5113 - protein, 357 aa, Triticum aestivum
MPIEAADNVPAELPGHGRTVCVTGAGGFIASWLVKRLLQKGYNVRGTVRNPVDPKNDHLRAFDGAADRLVLLRADLMEPETLVEAFTGCEGIFHAASPVTDDPEKMIEPAIRGTKYVITAAADMGIKRVVFTSTIGTVYMNPNRDPSKPVDDTCWSDLEYCKKTANWYCYAKTVAEQDALETARQRGIELIVVNPVLVLGPLLQPTVNASTEHVMKYLTGSAKTYVNAAQAYVHVKDVAEAHVRVYEAPGAHGRYICAEGTTLHRGELCRVLCKLFPEYPVPTKCKDEVNPPVKGYKFTNQRLKDLGMEFVPVLQSIYETVKSLQEKGMLPVLPPGDDVRDNLHEQLMMKPAQLLRN

SEQ ID NO: 5114 - DNA, 999 bp, Lycopersicon esculentum
  CDS (1)..(999)
atgccatcagaatccggcaaagttgtttgtgtcaccggcgccggcggtttcattgcctcttggctcgttaaactccttctagaaaaaggctacactgtcagaggaaccgttagaaaccctgatgattccaaaaatggtcacctgaaggaacttgaaggtgcaaaggagagactgattctgttgagagctgatcttctagactatcagagtttgagagaagcaatttatggctgtgacggagttttccacaccgcctcccctgtcactgatgatccagaacaaatggtggagccagcagttattgggaccaagaatgtgataacagcagcagcagaaaccaaagttcgcagagttgtgtttacttcttcaattggtacagtatacatggaccccaaccgggcccctgataaagttgtggacgagacttgctggagtgatcttgactactgcaagaatactaagaattggtactgctatgggaagacagtggcggaaaagacagcgcgggatgaggcaagggaaaagggagtggatttggttgtgattaatccagttttggtgcttggaccactgcttcaaccaacagtgaatgccagtgttcttcacatactaaagtacctaactggatctgctaaaacatatgccaattcaattcaggcgtatgttcatgttaaggatgtggcactagcccacatacttctctacgaagctccttctgcatctggccgctatatctgcgcggagcgcgtgcttcatcgcggtgatgtggttgaaattctcgccaaattcttcccggagtatccaatccccaccaagtgctcggatgaaacgaggccaagggcaaaaccgtacatattcacgaaccaaaagctaaaggacttgggtttggagtttacgccagtgaaacaatgcttatatgagacagtgaagagtctgcaggagaagggtcaccttccagttcctactcaaaatgatgaacctattaaaattcactcttaa

SEQ ID NO: 5115 - protein, 332 aa, Lycopersicon esculentum
MPSESGKVVCVTGAGGFIASWLVKLLLEKGYTVRGTVRNPDDSKNGHLKELEGAKERLILLRADLLDYQSLREAIYGCDGVFHTASPVTDDPEQMVEPAVIGTKNVITAAAETKVRRVVFTSSIGTVYMDPNRAPDKVVDETCWSDLDYCKNTKNWYCYGKTVAEKTARDEAREKGVDLVVINPVLVLGPLLQPTVNASVLHILKYLTGSAKTYANSIQAYVHVKDVALAHILLYEAPSASGRYICAERVLHRGDVVEILAKFFPEYPIPTKCSDETRPRAKPYIFTNQKLKDLGLEFTPVKQCLYETVKSLQEKGHLPVPTQNDEPIKIHS

SEQ ID NO: 5116 - DNA, 999 bp, Lycopersicon esculentum
  CDS (1)..(999)
atgccgtcagtctccggtcgggtcgtctgtgttaccggtgccggaggcttcatcgcctcttggctcgttaaacttcttttggaaaaaggctacactgttaggggaactgtaagaaatcctgatgatccaaagaattgtcatttgagagaacttgaaggagcaaaagagaggctaacactatgcagaggtgatcttcttgattatcagagtttgcgtgaagcaatcaatggctgtgacggagttttccacacagcttcaccagttactgatgatccagaacaaatggtggagccagcagtaattggtactaagaatgtgataacagcagcagcagaggccaatgtaagacgcgttgtgtttacttcctcaattggagctgtgtacatggacccaagcagagaccctgaaaaagtggttgacgagacttgctggagcgatcctgatttttgcaagaacactaagaattggtattgttatggtaagatggtggcagaacaagcagcgtgggatgaggcgagggagaaaggagttgatttagtcgcgataaatccagtgttggtgcttggaccattgctacaaaatactgtgaatgctagtgttcttcatatcctcaagtaccttactggctcagctaaaacatatgctaattcagttcaagcatatgtacatgttaaggatgtggctttagctcacatacttctctatgaaactccttcagcatcaggacgttacctctgtgctgagagtgtgcttcatcgtggtgacatcgttgaaattctagccaaattcttccctgaatatcccatccccacaaagtgttcggatgtgacgaagccaagggtaaaaccatacaaattctcaaaccaaaaattgaaggatttggggatggaatttacaccagtgaaacaatgcttatatgagacagtgaagagtctacaagagaaaggtcaccttccaattccaactcaaaaggacgaaattattcgaattcagacttag

SEQ ID NO: 5117 - protein, 332 aa, Lycopersicon esculentum
MPSVSGRVVCVTGAGGFIASWLVKLLLEKGYTVRGTVRNPDDPKNCHLRELEGAKERLTLCRGDLLDYQSLREAINGCDGVFHTASPVTDDPEQMVEPAVIGTKNVITAAAEANVRRVVFTSSIGAVYMDPSRDPEKVVDETCWSDPDFCKNTKNWYCYGKMVAEQAAWDEAREKGVDLVAINPVLVLGPLLQNTVNASVLHILKYLTGSAKTYANSVQAYVHVKDVALAHILLYETPSASGRYLCAESVLHRGDIVEILAKFFPEYPIPTKCSDVTKPRVKPYKFSNQKLKDLGMEFTPVKQCLYETVKSLQEKGHLPIPTQKDEIIRIQT

SEQ ID NO: 5118 - DNA, 969 bp, Eucommia ulmoides
  CDS (1)..(969)
atgagtggagcggggaagacagtgtgcgtcaccggcgcgtctggtttcatagcctcctggatcgtcaagttcttgctccaacgcggctacaccgtccgggctaccgttcgcgatcccaacgatccaaagaagacagagcacttgcgcacacttgaaggagcgagtgagagactccacctgtttaaagcagagctacttgaggatggtgcctttgatgctgtggttgatgggactgatggtgttttccatactgcttctcccttcttctacaacactgataacccacagaaagatttgattgatcctgcagtgaagggatcagttaatgttcttggatcatgtgctaaatccccttctgtcaaaagggttgtcttgacatcttcagttgctgcagttgcgatcaattccaggccaaagaaccctgatgtggttgttgacgagacctggcattctgatgtcgagttttgcacgcaaaggaagctgtggtatgtgctttcaaagacattggccgaggaggctgcctggaaatttgctaaagagaaaggacttgacttagtgactatcaaccctgcaatggttatcggtcctttattgcagccatctctcaacacaagtgctagtgcaattcttaacttcctaaatggggcaaagacgtattcaaattcctcgatggggtggatcgacgtgaggaatgttgccaatgcacatattcaggcattcgagattccttcggccaacggaagatactgtttggttgagagagttgcacattattctgaaattgtgcagattttgcgcaaccattaccctactctcccgcttccagaaaagtgtgcggatgacaaccctttccagccaacattccaggtttcgaaagaaaaggccaagagcttgggcatcgagtttatcccactcgaggtcagcattaaggataccgtcgagagcttgaaggagaagaagtttttctag

SEQ ID NO: 5119 - protein, 322 aa, Eucommia ulmoides
MSGAGKTVCVTGASGFIASWIVKFLLQRGYTVRATVRDPNDPKKTEHLRTLEGASERLHLFKAELLEDGAFDAVVDGTDGVFHTASPFFYNTDNPQKDLIDPAVKGSVNVLGSCAKSPSVKRVVLTSSVAAVAINSRPKNPDVVVDETWHSDVEFCTQRKLWYVLSKTLAEEAAWKFAKEKGLDLVTINPAMVIGPLLQPSLNTSASAILNFLNGAKTYSNSSMGWIDVRNVANAHIQAFEIPSANGRYCLVERVAHYSEIVQILRNHYPTLPLPEKCADDNPFQPTFQVSKEKAKSLGIEFIPLEVSIKDTVESLKEKKFF

SEQ ID NO: 5120 - DNA, 984 bp, Nicotiana tabacum
  CDS (1)..(984)
atgagtttagcagcgaaaacagtatgcgtaacaggagcttcaggttacatagcgtcatggctcgtcaaattcttgctccagcgtggttacactgttaaggcttccgttcgtgacccaaatgatcccaagaaaacacaacatttgctttcccttggtggcggcgcagagaggcttcacttgttcaaagcaaacctcttagaagaaggttcatttgatgctgtggttgatggatatgaaggtgtattccatacagcatctccatttccctactctgttacagatccacaggctgagttacttgcccctgctgtcaaggggacactcaatcttctcggttcatgtgccaaagcaccgtcagtaaaacgagtggttttaacatcttccatagcagttgcttatagtggtcagcctcggacacctgaggttgtggttgatgaaagctggtggaccagtccagactattgcagagaaaaacagctctggtatgttctctcaaagacattggctgaggatgctgcatggaagtttgtgaaggagaaagggattgatatggttgcaataaatcctgctatggttattggtcctttgttacagcctacactcaatactagttctggtgcagtcttgaacttggtaaatggtgccgagacatacccaaattctacctttgggtgggttaacgtcaaagatgtcgcaaatgcacatattctcgcatttgagaatccttcagctaatggaagatatttaatggttgagagagttgcccactactctgatatactgaagatattacgtgatctttaccctactatgcgacttccagaaaagtgtgctgacgacaatccgttgatgcaaaactatcaagtatcaaaggaaagggcgaaaagcttgggtgttgaattcactcctctcgaagaaagcatcaaagaaactgtcgaaagtttgaaggaaaaaaggttttttggaggctcatcggctatgtga

SEQ ID NO: 5121 - protein, 327 aa, Nicotiana tabacum
MSLAAKTVCVTGASGYIASWLVKFLLQRGYTVKASVRDPNDPKKTQHLLSLGGGAERLHLFKANLLEEGSFDAVVDGYEGVFHTASPFPYSVTDPQAELLAPAVKGTLNLLGSCAKAPSVKRVVLTSSIAVAYSGQPRTPEVVVDESWWTSPDYCREKQLWYVLSKTLAEDAAWKFVKEKGIDMVAINPAMVIGPLLQPTLNTSSGAVLNLVNGAETYPNSTFGWVNVKDVANAHILAFENPSANGRYLMVERVAHYSDILKILRDLYPTMRLPEKCADDNPLMQNYQVSKERAKSLGVEFTPLEESIKETVESLKEKRFFGGSSAM

SEQ ID NO: 5122 - DNA, 972 bp, Nicotiana tabacum
  CDS (1)..(972)
atggcgacgaaaacagtatgtgtaacaggatcttcaggctacatagcttcatggttagtgaagtttctgctccagcgtggttataccgttaaggccactgttcgcgatcccagtgatccaaagaagacagatcacttacattcccttagtggagctaaggagaggcttcacttgttcaaagcgaaccttctggaagaaggtgcctttgatgctgtggttgatgggtgtgaaggcgtatttcatacagcatctccattttaccatggagtcaaagatccacaggcagaattaattgatcctgcactgaaggggacacttaatgttcttggatcagttgcaaagacgccatcaattagaagagtggttttgacatcatctgtagcagcagttgctttcaatggaaaaccgcgaacccctgaagtggtagttgatgagacatgggggtcggatcctgacttttgcagagaatcacagctctggtatgtactttcgaagacattggctgaggatgctgcatggaagtttgtgaaagagaaagctatcgatatggttacgataaacccagcaatggttattggcggtttgttacaaccaatacttaatacaagttgcgctgctgtcttacaactgataaatggtgctgaaacatacccaaatgctacacttggatgggttaatgtgaaagatgttgccctcgcgcatattctagcatttgaaaacccttcagctaatggtagatatttaatggttgaggcagttgcacactactctgagttagtgaagatattacgcgagcattatcccacaatgaagcttccagaaaagtgtgttgatgataagccatttcctccgaagtaccaggttaacatagaaagagcaaagcaattgggtgttgagttcactcccttggctgaaagcatcaaagaaactgtcgaaagcttgaaggagaaaaaattctattcagatgcttag

SEQ ID NO: 5123 - protein, 323 aa, Nicotiana tabacum
MATKTVCVTGSSGYIASWLVKFLLQRGYTVKATVRDPSDPKKTDHLHSLSGAKERLHLFKANLLEEGAFDAVVDGCEGVFHTASPFYHGVKDPQAELIDPALKGTLNVLGSVAKTPSIRRVVLTSSVAAVAFNGKPRTPEVVVDETWGSDPDFCRESQLWYVLSKTLAEDAAWKFVKEKAIDMVTINPAMVIGGLLQPILNTSCAAVLQLINGAETYPNATLGWVNVKDVALAHILAFENPSANGRYLMVEAVAHYSELVKILREHYPTMKLPEKCVDDKPFPPKYQVNIERAKQLGVEFTPLAESIKETVESLKEKKFYSDA

SEQ ID NO: 5124 - DNA, 1020 bp, Malus domestica
  CDS (1)..(1020)
atggccacccaacaacccatctcaaagaagacggcttgcgtcgtcggcggaaccgggttcgtggcgtctctgctggtcaagctactgctccagaagggctacgccgtcagaaccaccgtcagagaccctgacaaccacaagaaggtctcccacctcacagcactacaagagttgggtgagctagagattttcgcaggagatctaactgatgaagggagcttcgatgccccaatagcaggctgtgatcttgttttccatgttgcaacccctgtcaactttgcctcacaggacccggagaatgatatgatcaaaccagcaatccaaggggtactaaatgttctgaagtcgtgcgtgaaagccaaaacagttaagcgcgttgttttgacatcatcagctgctacagtttcgatcaatacacttgaaggaacaggtttggtcgtggatgaaaaggattggagtgatttggagttcttgactaatgtaaagccacccacttgggggtaccctgcctccaagacactagctgagaagacagcttggaaatttgccgaagaaaacaacattgatctaatcactgtgatcccttctcttatggccggtccttctctcaccccagacgttcccagcagtatcggccttgccatggctttaatcacaggagatgatttcctcataaatatggccctgaaaggtatgcaaatgctatcaggttcgatatccattgcacatgtggaggacgtctgccgggctcatatatttttggctgagaaagaatctgcatctggtcggtacatttgctgtgctgccaacaccggcgttcctgagcttgctaagttcctcaacaaaagatacccccagtacaaagtccccactgagtttggagattttccgtctgaggccaaactgatcatctcttcagagaagcttatcaaggaggggttcgattttaagtatggcatcgaagaaatatatgaccaaactgtggagtacttcaaggcaaaggggctgctgcagaactag

SEQ ID NO: 5125 - protein, 339 aa, Malus domestica
MATQQPISKKTACVVGGTGFVASLLVKLLLQKGYAVRTTVRDPDNHKKVSHLTALQELGELEIFAGDLTDEGSFDAPIAGCDLVFHVATPVNFASQDPENDMIKPAIQGVLNVLKSCVKAKTVKRVVLTSSAATVSINTLEGTGLVVDEKDWSDLEFLTNVKPPTWGYPASKTLAEKTAWKFAEENNIDLITVIPSLMAGPSLTPDVPSSIGLAMALITGDDFLINMALKGMQMLSGSISIAHVEDVCRAHIFLAEKESASGRYICCAANTGVPELAKFLNKRYPQYKVPTEFGDFPSEAKLIISSEKLIKEGFDFKYGIEEIYDQTVEYFKAKGLLQN

SEQ ID NO: 5126 - DNA, 1017 bp, Vitis vinifera
  CDS (1)..(1017)
atggccacccagcaccccatcggaaagaagaccgcatgtgtcgtcggcggcaccggatttgttgcatctttgctggttaagcttttgctgcagaagggctatgctgtcaacaccactgtcagggaccctgacaatcagaaaaaagtctctcacctcctagaactacaggagttgggtgacctaaaaatctttcgagcagatctaactgacgaattgagctttgaggcccctatagcaggttgcgactttgtcttccatgttgctacgcccgtccactttgcttctgaagatccagagaatgacatgatcaagccagcaattcaaggagtagtgaatgtcatgaaagcttgtacaagggcaaaatcagttaaacgagtcattttgacatcctctgcagctgctgttaccatcaatcagcttgatgggacaggtctggttgtggatgagaagaactggactgatattgagttcttgacttccgcgaagccacctacttggggctatcctgcctccaagacactagctgagaaagcagcttggaaatttgccgaagaaaataacattgatctgatcactgtcatccctactctgatggccggttcctctcttacttcagatgtccccagcagcattggacttgcaatgtccttgattacagggaatgaattcctcataaacggtatgaaaggtatgcagatgctgtcaggttcagtctccattgcacatgtggaagatgtttgccgggcacatatatttgtagctgagaaagaatcagcttctggccgatacatctgctgtgctgccaataccagtgttcctgagctagcaaagttcctgagcaaaagataccctcagtacaaagtcccaactgattttggagacttcccccctaaatcgaagttgataatctcctcagagaagcttgtgaaagaggggttcagttttaagtacgggattgaagaaatttatgatgaaagtgtggagtatttcaaggccaaggggctattgcagaattga

SEQ ID NO: 5127 - protein, 338 aa, Vitis vinifera
MATQHPIGKKTACVVGGTGFVASLLVKLLLQKGYAVNTTVRDPDNQKKVSHLLELQELGDLKIFRADLTDELSFEAPIAGCDFVFHVATPVHFASEDPENDMIKPAIQGVVNVMKACTRAKSVKRVILTSSAAAVTINQLDGTGLVVDEKNWTDIEFLTSAKPPTWGYPASKTLAEKAAWKFAEENNIDLITVIPTLMAGSSLTSDVPSSIGLAMSLITGNEFLINGMKGMQMLSGSVSIAHVEDVCRAHIFVAEKESASGRYICCAANTSVPELAKFLSKRYPQYKVPTDFGDFPPKSKLIISSEKLVKEGFSFKYGIEEIYDESVEYFKAKGLLQN

SEQ ID NO: 5128 - DNA, 1011 bp, Oryza sativa
  CDS (1)..(1011)
atgagctccgagtctgaggcggcgcccgggaccgggaagctggtgtgcgtcaccggcgcgtcggggtacatcgcgtcgtggctcgtcaggctgctcctcgcccgcggctacacggtccgcgccaccatccgggacacctctgacccaaagaaaacactacacctgcgtgccctggatggagccaacgaaagactccatttgttcgaagcaaatctgctggaagagggctctttcgatgctgcggtcaatggttgtgattgtgttttccatacggcttctcccttttaccacaatgttaaagatcctaaggctgagttacttgaccctgcagtcaaaggaacccttaatgttctaggctcctgcaagaaagcttccattagaagagttatcgtgacatcatccatggctgctgttgcctacaatgggaaaccaagaactcctgatgtagttgttgatgagacatggttttcagttccagagatttgtgaaaagcatcagcaatggtatgttctgtccaagaccctagcagaggaggctgcttggaagttttcaaaagataatggatttgaaatagttacggtgaacccagcaatggtcattggtcccctgctgcagccttcactgaatactagtgctgaagcaattctgaagctaatcaatggatcatcctcgacatatcctaatttcagctttggctggataaacgttaaggatgttgccctggcacatatccttgcatatgaagttccttcagcaaatggaagatattgcatggttgaaagagttgcgcactactcagagctcgtccaaatcattcgtgagatgtatcccaatattcctctgccagacaagtgtgcagatgacaagccatcagtgccaatctaccaggtatcaaaggaaaagataaaaagcttgggcctggaactgactcccctgcacacgagcatcaaggagaccatcgagagcttgaaagagaaaggatttgttacttttgattcaagcaacctgtaa

SEQ ID NO: 5129 - protein, 336 aa, Oryza sativa
MSSESEAAPGTGKLVCVTGASGYIASWLVRLLLARGYTVRATIRDTSDPKKTLHLRALDGANERLHLFEANLLEEGSFDAAVNGCDCVFHTASPFYHNVKDPKAELLDPAVKGTLNVLGSCKKASIRRVIVTSSMAAVAYNGKPRTPDVVVDETWFSVPEICEKHQQWYVLSKTLAEEAAWKFSKDNGFEIVTVNPAMVIGPLLQPSLNTSAEAILKLINGSSSTYPNFSFGWINVKDVALAHILAYEVPSANGRYCMVERVAHYSELVQIIREMYPNIPLPDKCADDKPSVPIYQVSKEKIKSLGLELTPLHTSIKETIESLKEKGFVTFDSSNL

SEQ ID NO: 5130 - DNA, 975 bp, Oryza sativa
  CDS (1)..(975)
atgatggctaaggctgaagggggcaaaatggtatgtgtgacaggagcaggaggcttcattgggtcgtgggtggtgaaggagctcctgctccgtggctatgccgtgagaggaactgcaagagatccatctagtcaaaagaactcccatttgcaaaaacttgaaggagccaaagagaggctctgtctgaactatgcagatgtgatggactatgatagtctttctgttgcatttaatggatgtgaaggtgtattccatgttgcctcacctgtatctgttgatccgcgacttgtgcctgttgctgttgaaggaactaagaacgtgatcaacgctgcagcagacatgggcgtacgacgcgtggtgttcacatcaaccttcggtgctgtacacatggacccaaataggagccatgatacagtcgtggatgagagctgctggagtaaccttgagttctgcaaacaaaaagactggtactgttatgccaaaacggttgctgagatggtagcagcagagcaggcatcgaagagagggattcagctagtggtggtgcttcctgccatgacactaggccagatgttgcaatcaaccataaaccctagcatcagacatatcgccgatttcttgaacggaagcaggaaaacccaccggaatgctgtcgctgggtatgttgatgcgcgcgatgtggcccgtgcacatgcactggtgtatgaagaccccaaggcgcatgggcgttatctctgcattgctagtgtgcttcaccggtccgagcttattcagatgatcagagaactctttccacagtatccaatcacctgtaacaagtgtgaagacagcaagcagatggtccaacctttcaagttctctaatcaaaggctgagagacttgggcctcacattcacccccataaaagaaagtttgtacaacacactgatatgcctacgggagaaggggcacctaccgccttattcatctctttga

SEQ ID NO: 5131 - protein, 324 aa, Oryza sativa
MMAKAEGGKMVCVTGAGGFIGSWVVKELLLRGYAVRGTARDPSSQKNSHLQKLEGAKERLCLNYADVMDYDSLSVAFNGCEGVFHVASPVSVDPRLVPVAVEGTKNVINAAADMGVRRVVFTSTFGAVHMDPNRSHDTVVDESCWSNLEFCKQKDWYCYAKTVAEMVAAEQASKRGIQLVVVLPAMTLGQMLQSTINPSIRHIADFLNGSRKTHRNAVAGYVDARDVARAHALVYEDPKAHGRYLCIASVLHRSELIQMIRELFPQYPITCNKCEDSKQMVQPFKFSNQRLRDLGLTFTPIKESLYNTLICLREKGHLPPYSSL

SEQ ID NO: 5132 - DNA, 966 bp, Oryza sativa
  CDS (1)..(966)
atgttgggcggcgacgggagaacgaagacggtgtgcgtgaccggcgccgggggcttcgtggcgtcgtggctcgtcaagctcctcctctcccgcggctgctacaccgtccatggcaccgtccgtgatccaggcgacgccaagaacgcccacctgatgtctctggacggcgccgcggagaggctgcggctgttcaaggccgacctgctcgactacggcagcgtggcggcggccatcgccggctgcgacgacgtcttccatgtggcctgccccgtgctcctctccgcccccaacccagaggttgatatacttgctcctgctgtaacgggcacgacgaatgtgctgaaggcttgttcagaagctaaggttgggagggttgtggtggtgtcatctgtctctgctgcgatggtgaatcctaactggtctgagggcaaggccatagatgaagattgctggtctgatgtcgattactgcagagccactaagaattggtatacccttgggaaaacacttgcggagattgaggcctttgattatgcgaagagaagtggattggatcttgtgacactctgcccatcgttggtgattggacctttgctgcaaccaactgtgaatgcgagcagtacagtcatacttggatgtctgaaaggtgattgtgaggtaaaaatcaaactgaggaactttgtggatgtcagggatgttgccgatgctcttcttttactgtatgaaaccccaggggtctccggacgatacatctgcagttcacacgcaagaaggatgcctcatatcattgacttactaaagagctggtatcccggttacaaatttgccgacaagtttgtggaagtgagcgatgagccgcaattcaactcggggaagctagagaagctaggatggaaaatcaagccatttgaggaaacactcagggacagtgttgaatcttatagagctgcaggtgtcctggattga

SEQ ID NO: 5133 - protein, 321 aa, Oryza sativa
MLGGDGRTKTVCVTGAGGFVASWLVKLLLSRGCYTVHGTVRDPGDAKNAHLMSLDGAAERLRLFKADLLDYGSVAAAIAGCDDVFHVACPVLLSAPNPEVDILAPAVTGTTNVLKACSEAKVGRVVVVSSVSAAMVNPNWSEGKAIDEDCWSDVDYCRATKNWYTLGKTLAEIEAFDYAKRSGLDLVTLCPSLVIGPLLQPTVNASSTVILGCLKGDCEVKIKLRNFVDVRDVADALLLLYETPGVSGRYICSSHARRMPHIIDLLKSWYPGYKFADKFVEVSDEPQFNSGKLEKLGWKIKPFEETLRDSVESYRAAGVLD

SEQ ID NO: 5134 - DNA, 1011 bp, Eucalyptus globulus
  CDS (1)..(1011)
  misc_feature (9)..(9): s is g or c
  misc_feature (486)..(486): y is t or c
atgcccgtsgacgccctccccggttccggccagaccgtctgcgtcaccggcgccggcggcttcatcgcctcctggattgtcaagctgctcctcgagcgaggctacaccgtgcgaggaactgtcaggaacccagacgacccgaagaatgggcatctgagagatctggaaggagccagcgagaggctgacgctgtacaagggtgatctgatggactacgggagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccagacgttgtggtggacgagtcttgttggagcgacctcgaattttgcaagagcactaagaactggtattgytacggcaaggcagtggcggagaaggccgcttgcgcagaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcgtacgtgcacgtcaaggacgtcgcgcttgcccacgtccttgtcttggagaccccatccgcctcaggccgctatttgtgcgccgagagcgtcctccaccgtggcgatgtggtggaaatccttgccaagttcttccctgagtataacgtaccgaccaagtgctctgatgaggtgaacccaagagtaaaaccatacaagttctccaaccagaagctgagagacttggggctcgagttcaccccggtgaagcagtgcctgtacgaaactgtcaagagcttgcaggagaaaggccacctacccgtccctcccccgccggaagattcggtgcgtattcagggatga

SEQ ID NO: 5135 - protein, 336 aa, Eucalyptus globulus
MPVDALPGSGQTVCVTGAGGFIASWIVKLLLERGYTVRGTVRNPDDPKNGHLRDLEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPPPPEDSVRIQG

SEQ ID NO: 5136 - DNA, 1011 bp, Eucalyptus globulus
  CDS (1)..(1011)
atgcccgtcgacgccctccccggttccggccagaccgtctgcgtcaccggcgccggcggcttcatcgcctcctggattgtcaagctgctcctcgagcgaggctacaccgtgcgaggaaccgtcaggaacccagacgacccgaagaatgggcatctgagagagctggaaggagccagcgagaggctgacgctgtacaagggtgatctgatggactacggtagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccagacgttgtggtggacgagtcttgttggagcgacctcgaattttgcaagagcactaagaactggtattgctacggcaaggcagtggcggagaaggccgcttgcgcagaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcgtacgtgcacgtcaaggacgttgcgcttgcccacgtccttgtcttggagaccccatccgcctcaggccgctatttgtgcgccgagagcgtcctccaccgtggcgatgtggtggaaatccttgccaagttcttccctgaatataacgtaccgaccaagtgctctgatgaggtgaacccaagagtaaaaccatacaagttctccaaccagaagctgaaagacttggggctcgagttcaccccggtgaagcagtgcctgtacgaaactgtcaagagcttgcaggagaaaggccacctacccgtccctcccccgccggaagattcggtgcgtattcagggatga

SEQ ID NO: 5137 - protein, 336 aa, Eucalyptus globulus
MPVDALPGSGQTVCVTGAGGFIASWIVKLLLERGYTVRGTVRNPDDPKNGHLRELEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 5138 - DNA, 1011 bp, Eucalyptus globulus
  CDS (1)..(1011)
  misc_feature (523)..(523): k is g or t
atgcccgtcgacgccctccccggttccggccagaccgtctgcgtcaccggcgccggcggcttcatcgcctcctggattgtcaagctgctcctcgagcgaggctacaccgtgcgaggaaccgtcaggaacccagacgacccgaagaatgggcatctgagagagctggacggagccagcgagaggctgacgctgtacaagggtgatctgatggactacgagagcttgagagaagccatcatggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttgcgcakaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcatacgtgcacgtcaaggacgtcgcgcttgcccatgtccttgtcttggagaccccatccgcctcaggccgctatttgtgcgccgagagcgtcctccaccgtggcgatgtggtggaaatccttgccaagttcttccctgagtataacgtaccgaccaagtgctctgatgaggtgaacccaagagtaaaaccatacaagttctccaaccagaagctgaaagacttggggctcgagttcaccccggtgaagcagtgcctgtacgaaactgtcaagagcttgcaggagaaaggccacctacccgtccctcccccgccggaagattcggtgcgtatccagggatga

SEQ ID NO: 5139 - protein, 336 aa, Eucalyptus globulus
  misc_feature (175)..(175): The Xaa at location 175 stands for Stop, or Glu.
MPVDALPGSGQTVCVTGAGGFIASWIVKLLLERGYTVRGTVRNPDDPKNGHLRELDGASERLTLYKGDLMDYESLREAIMGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAXAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 5140 - DNA, 1011 bp, Eucalyptus cordata
  CDS (1)..(1011)
  misc_feature (10)..(10): k is g or t
  misc_feature (19)..(19): y is t or c
  misc_feature (28)..(28): s is g or c
  misc_feature (39)..(39): s is g or c
  misc_feature (42)..(42): y is t or c
  misc_feature (94)..(94): k is g or t
atgcccgtckacgccctcyccggttccsgccagaccgtstgygtcaccggcgccggcggcttcatcgcctcctggattgtcaagcttctcctckagcgaggctacaccgtgcgaggaaccgtcaggaacccagacgacccgaagaatggtcatctgagagatctggaaggagccagcgagaggctgacgctgtacaagggtgatctgatggactacgggagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttgcgcagaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcgtacgtgcacgtcaaggacgtcgcgcttgcccacgtccttgtcttggagaccccatccgcctcaggccgctatttgtgcgccgagagcgtcctccaccgtggcgatgtggtggaaatccttgccaagttcttccctgagtataacgtaccgaccaagtgctctgatgaggtgaacccaagagtaaaaccatacaagttctccaaccagaagctgagagacttggggctcgagttcaccccggtgaagcagtgcctgtacgaaactgtcaagagcttgcaggagaaaggccacctacccgtccctcccccgccggaagattcggtgcgtattcagggatga

SEQ ID NO: 5141 - protein, 336 aa, Eucalyptus cordata
  misc_feature (4)..(4): The Xaa at location 4 stands for Asp, or Tyr.
  misc_feature (7)..(7): The Xaa at location 7 stands for Pro, or Ser.
  misc_feature (10)..(10): The Xaa at location 10 stands for Arg, or Gly.
  misc_feature (32)..(32): The Xaa at location 32 stands for Stop, or Glu.
MPVXALXGSXQTVCVTGAGGFIASWIVKLLLXRGYTVRGTVRNPDDPKNGHLRDLEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPPPPEDSVRIQG

SEQ ID NO: 5142 - DNA, 1014 bp, Camellia sinensis
  CDS (1)..(1014)
atggaagcccaaccgacagctccgaaggccgcatgtgttgttggtggcaccggcttcgtggcggcgacgctcatcaagttgttgcttgagaaaggctatgcggtcaacaccactgtcagggacccaggcaatcagaaaaagacctctcaccttctagcactaaagggttcaggcaacctaaaaatcttccgagcagacctcaccgatgaacagagctttgacacccctgtagcgggttgtgacctggtcttccatgtcgctacaccggtcaactttgcttccgaggatccagagaatgacatgataaaaccagcaattcaaggagtagtcaatgttctaaaagcttgtgcaaaagcaggaacggttaaacgtgtcattttaacatcatcagcagctgctgtatcgatcaataagctcaatgggaccggcctggtcatggatgagagtcactggactgacaccgagtttttgaattctgcgaagccgcccacttgggggtaccctttatcgaaaacactagctgagaaagctgcttggaagtttgccgaagaaaataacattaatcttatcactgtcatccctactctcatggccggtccgtctcttactgcagatgtccctagcagtattggtcttgccatgtccttgatcacagggaatgaatttctcataaatgggttgaaaggtatgcaaatgctgtcaggctcaatctccatctcccacgtggaggacgtttgtcgtgcccacgtgtttgtggcagagaaagaatcggcctctggtcgatacatttgttgcgctgtcagcaccagtgttcccgagctagccaagttcctcaacaaaagatatccagagtacaatgtccctactgattttggagattttccatcaaaagcgaagttgatcctctcgtcagagaagcttaccaaagagggattcagtttcaagtatgggatcgaagaaatttacgatcaatctgtggagtacttcaaggctaaggggattttgaagaattga

SEQ ID NO: 5143 - protein, 337 aa, Camellia sinensis
MEAQPTAPKAACVVGGTGFVAATLIKLLLEKGYAVNTTVRDPGNQKKTSHLLALKGSGNLKIFRADLTDEQSFDTPVAGCDLVFHVATPVNFASEDPENDMIKPAIQGVVNVLKACAKAGTVKRVILTSSAAAVSINKLNGTGLVMDESHWTDTEFLNSAKPPTWGYPLSKTLAEKAAWKFAEENNINLITVIPTLMAGPSLTADVPSSIGLAMSLITGNEFLINGLKGMQMLSGSISISHVEDVCRAHVFVAEKESASGRYICCAVSTSVPELAKFLNKRYPEYNVPTDFGDFPSKAKLILSSEKLTKEGFSFKYGIEEIYDQSVEYFKAKGILKN

SEQ ID NO: 5144 - DNA, 1074 bp, Oryza sativa
  CDS (1)..(1074)
atgaccgtcgtcgtcgttgccgatgacgccgccgccgccgcagcggcggcgcagcagcaggaggagctgccgccggggcacggccaaacggtgtgtgtcaccggcgccgccgggtacatcgcgtcgtggctcgtcaagctgctgctggagaggggctacaccgtgaagggcacagtgagaaacccagatgacccgaagaacgcccacctgaaggcgctggacggcgccgacgagaggctggtcctctgcaaggccgacctcctcgactacgactccatccgcgccgccgtcgacggctgccacggcgtgttccacaccgcctcccccgtcaccgatgaccctgagcagatggtggagccggcggtgcgggggacggagtacgtgataaaggcggcggcggaggccggcacggtgcgccgggtggtgttcacgtcgtccatcggcgccgtcaccatggaccccaaccgcggccccgacgtggtcgtcgacgagtcctgctggagcgacctcgagttctgcaagaaaaccaagaactggtactgctacggtaaggcggtggcagagcaggaggcgtgcaaggcggccgaagagcgcggcgtcgacctcgtcgtcgtcagccccgtgctggtggtcggcccgctgctgcagccgacggtgaacgccagcgccgtgcacatcctcaagtacctcgacggctcggccaagaagtacgccaatgccgtgcaggcgtacgtggacgtgcgcgacgtcgcggctgcgcacgtccgcgtcttcgaggcgccggaggcctccggccggcacctctgcgccgagcgcgtcctgcaccgtgaggacgtcgtccacatcctcggcaagctcttccccgagtatcctgtgcccacaaggtgctctgacgaggtgaacccacggaagcagccgtacaagatgtccaacaagaagctgcaggatcttggcctccacttcatacctgtgagcgactcgctctacgagacggtgaagagcctccaggagaaggggcaccttccagttctgagcaaagagatcccagaagagttgaatggtgtgccagcatga

SEQ ID NO: 5145 - protein, 357 aa, Oryza sativa
MTVVVVADDAAAAAAAAQQQEELPPGHGQTVCVTGAAGYIASWLVKLLLERGYTVKGTVRNPDDPKNAHLKALDGADERLVLCKADLLDYDSIRAAVDGCHGVFHTASPVTDDPEQMVEPAVRGTEYVIKAAAEAGTVRRVVFTSSIGAVTMDPNRGPDVVVDESCWSDLEFCKKTKNWYCYGKAVAEQEACKAAEERGVDLVVVSPVLVVGPLLQPTVNASAVHILKYLDGSAKKYANAVQAYVDVRDVAAAHVRVFEAPEASGRHLCAERVLHREDVVHILGKLFPEYPVPTRCSDEVNPRKQPYKMSNKKLQDLGLHFIPVSDSLYETVKSLQEKGHLPVLSKEIPEELNGVPA

SEQ ID NO: 5146 - DNA, 1017 bp, Citrus sinensis
  CDS (1)..(1017)
atgggctctatagctgagactgtgtgcgtgactggcgcttctgggtttatcggttcatggctcatcatgagattgctcgagcgtggctatgctgttcgtgctactgttcgcgatcctgataacaaaaagaaagtgaaacatttgctggagttgccgaaggcaagcactcacctgactttatggaaagccgatttagccgaagagggaaactttgatgaagcgattcgaggctgcactggagtttttcatctggccacgcctatggactttgagtccaaggatcctgagaatgaagtgataaggccgacaataaatgggatggtaagcatcatgagagcgtgtaaaaatgcgaagactgtgaggaggttagtgttcacatcatcagcgggaactttggatgttgaggagcaccgaaagccagtttatgatgaaacctcctggagtgacttggattttgttcggtctgttaagatgactggatggatgtattttgtgtccaagacactggcagagcaagctgcgtggaagtttgctgaagaaaataacattgattttatcagtataatcccaagtcttgttgttggtccattccttacgtcgtcaatgccacccagtctcataactgcactctcgcccattacaagaaatgaagcgcattatccaattataaagcaaggccaatttgtgcatttggatgatctctgcagtgctcatatatttttgtttgagcatcctaacgcgaagggccgctacatttgctcttctcacccggcaaccattcttgagcttgcaaaattcctcagggaaaaataccccgaattcaatgtgcccacagagttcgaagatgttgatgagaatatgaaaaatatgctcttctcttctaagaagctgacagatttgggatttaagttcaagtacagcctagatgacatgttcacaggtgctgtggatacttgcagagccaagggattgcttcctcttctttgtgaaaatcatgtcagcgaagtatccatataa

SEQ ID NO: 5147 - protein, 338 aa, Citrus sinensis
MGSIAETVCVTGASGFIGSWLIMRLLERGYAVRATVRDPDNKKKVKHLLELPKASTHLTLWKADLAEEGNFDEAIRGCTGVFHLATPMDFESKDPENEVIRPTINGMVSIMRACKNAKTVRRLVFTSSAGTLDVEEHRKPVYDETSWSDLDFVRSVKMTGWMYFVSKTLAEQAAWKFAEENNIDFISIIPSLVVGPFLTSSMPPSLITALSPITRNEAHYPIIKQGQFVHLDDLCSAHIFLFEHPNAKGRYICSSHPATILELAKFLREKYPEFNVPTEFEDVDENMKNMLFSSKKLTDLGFKFKYSLDDMFTGAVDTCRAKGLLPLLCENHVSEVSI

SEQ ID NO: 5148 - DNA, 1017 bp, Populus tomentosa
  CDS (1)..(1017)
atgccggttgatgcttcatcactttcaggccaaggccaaactatctgtgtcaccggggctggtggtttcattgcttcttggatggttaaacttcttttagataaaggttacactgttagaggaactgcgaggaacccagctgatcccaagaattcccatttgagggagcttgaaggagctcaagaaagattaactttatgcaaagctgatcttcttgattatgagtctcttaaagaggctattcaagggtgtgatggtgttttccacactgcttctcccgtcacagatgatccggaagaaatggtggagccagcagtgaacgggaccaaaaatgtgatcattgcggcggctgaggccaaagtccgacgagtggtgttcacgtcctcaattggtgctgtgtacatggatcccaataagggcccagatgttgtcattgatgaatcttgctggagtgatcttgaattctgcaagaacaccaagaattggtattgccatggaaaggcggtggcagaacaagctgcgtgggatatggctaaggagaaaggggtggacctagtggtggttaacccagtgctggtgctcggaccattgttgcagcccactgtcaatgctagcatcgttcacatcctcaagtacctcaccggctcagccaagacatatgctaactctgttcaagcttatgtgcatgttagggatgtggcactagcccacattttagtctttgagacgccttccgcctccggccgttacctttgctctgagagcgttctccaccgtggagaggtggtggaaatccttgcaaagttcttccccgagtaccccatccctaccaagtgctcagatgagaagaacccaagaaaacaaccttacaagttctcaaaccagaagctaagggatctgggcttcgagttcacaccagtgaagcagtgtctgtatgaaactgttaagagcttgcaggaaaggggccaccttccaatcccaaaacaagctgcagaagagtctgtgaagattcaataa

SEQ ID NO: 5149 - protein, 338 aa, Populus tomentosa
MPVDASSLSGQGQTICVTGAGGFIASWMVKLLLDKGYTVRGTARNPADPKNSHLRELEGAQERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCHGKAVAEQAAWDMAKEKGVDLVVVNPVLVLGPLLQPTVNASIVHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQERGHLPIPKQAAEESVKIQ

SEQ ID NO: 5150 - DNA, 981 bp, Quercus suber
  CDS (1)..(981)
atgagcggtggagctgggaagattgtgtgtgtgactggtgcctctggttacatagcttcatggcttgtcaagcttcttctcaaccgtggctacacagtcaaggcctctgttcgtgaccccaatgattcaaagaaaacaaaccacttacaagtacttgatggggccaaggagagacttcacctattcaaagcaaatctactggaagaaggttcttttgattctgctgttgagggctgtgatggggttttccacactgcatctcccttctatcataatgtcacagacccagaggcagaattacttgaacctgcagtgaagggaacacttaatgttcttaattcttgtgcgaaatttccatctgttaagcgggtagttgtgacatcctctatggctgcagttcattgcaataaaaaagctaaagctcctgatgtagttgttgatgagacttggttttctgatccagatgtttgtaaggaaacaaagcaatggtatatgctttcaaagacgttggctgaagaaaatgtctggaagtttgcaaaagagaagggtattgacatagttacaattaaccctgcaatggtgattggtcctctcttacagccaacgcttaacacaagtgctgctgcgattttgaacttaataaatggaactcatcagacatttcccaatgtagcatttggatgggttaatgtcaaagatgttgccaatgcacatattcaagcatatgaaattcctacagctagtggaagatattgtttggttgagagcgttatacaccattctgaagttgtgagggttttacgaaaactttatccctctgtacaacttccagagaagtgtgcagatgataagccatttgcgccaacatatcaggtgtccaaagaaaggacaagaagcttgggtattgaatacattccttttgaggtgagcctcaaggaaactgttgaaagcttgaaggaaaagaagtttatcagtttttaa

SEQ ID NO: 5151 - protein, 326 aa, Quercus suber
MSGGAGKIVCVTGASGYIASWLVKLLLNRGYTVKASVRDPNDSKKTNHLQVLDGAKERLHLFKANLLEEGSFDSAVEGCDGVFHTASPFYHNVTDPEAELLEPAVKGTLNVLNSCAKFPSVKRVVVTSSMAAVHCNKKAKAPDVVVDETWFSDPDVCKETKQWYMLSKTLAEENVWKFAKEKGIDIVTINPAMVIGPLLQPTLNTSAAAILNLINGTHQTFPNVAFGWVNVKDVANAHIQAYEIPTASGRYCLVESVIHHSEVVRVLRKLYPSVQLPEKCADDKPFAPTYQVSKERTRSLGIEYIPFEVSLKETVESLKEKKFISF

SEQ ID NO: 5152 - DNA, 1017 bp, Vitis vinifera
  CDS (1)..(1017)
atggccacccagcaccccatcggaaagaagaccgcatgtgtcgtcggcggcaccggatttgttgcatctttgctggttaagcttttgctgcagaagggctatgctgtcaacaccactgtcagggaccctgacaatcagaaaaaagtctctcacctcctagaactacaggagttgggtgacctaaaaatctttcgagcagatctaactgacgaattgagctttgaggcccctatagcaggttgcgactttgtcttccatgttgctacgcccgtccactttgcttctgaagatccagagaatgacatgatcaagccagcaattcaaggagtagtgaatgtcatgaaagcttgtacaagggcaaaatcagttaaacgagtcattttgacatcctctgcagctgctgttaccatcaatcagcttgatgggacaggtctggttgtggatgagaagaactggactgatattgagttcttgacttccgcgaagccacctacttggggctatcctgcctccaagacactagctgagaaagcagcttggaaatttgccgaagaaaataacattgatctgatcactgtcatccctactctgatggccggttcctctcttacttcagatgtccccagcagcattggacttgcaatgtccttgattacagggaatgaattcctcataaacggtatgaagggtatgcagatgctgtcaggttcagtctccattgcacatgtggaagatgtttgccaggcacatatatttgtagctgagaaagaatcagcttctggccgatacatctgctgtgctgccaataccagtgttcctgagctagcaaagttcctgagcaaaagataccctcagtacaaagtcccaactgattttggagacttcccccctaaatcgaagttgataatctcctcagagaagcttgtgaaagaggggttcagttttaagtacgggattgaagaaatttatgatgaaagtgtggagtatttcaaggccaaggggctattgcagaattga

SEQ ID NO: 5153 - protein, 338 aa, Vitis vinifera
MATQHPIGKKTACVVGGTGFVASLLVKLLLQKGYAVNTTVRDPDNQKKVSHLLELQELGDLKIFRADLTDELSFEAPIAGCDFVFHVATPVHFASEDPENDMIKPAIQGVVNVMKACTRAKSVKRVILTSSAAAVTINQLDGTGLVVDEKNWTDIEFLTSAKPPTWGYPASKTLAEKAAWKFAEENNIDLITVIPTLMAGSSLTSDVPSSIGLAMSLITGNEFLINGMKGMQMLSGSVSIAHVEDVCQAHIFVAEKESASGRYICCAANTSVPELAKFLSKRYPQYKVPTDFGDFPPKSKLIISSEKLVKEGFSFKYGIEEIYDESVEYFKAKGLLQN

SEQ ID NO: 5154 - DNA, 993 bp, Oryza sativa
  CDS (1)..(993)
atggtgatctcatccaagggcaaagtgtgtgtaactggtgcttcaggcttcgtcgcctcttggctcatcaagaggcttcttgaggcgggctatcatgtgataggaactgtgagagacccaagcaatcgcgataaagtgtcacacctttggagattaccaagtgcaaaggagaggctgcaacttgtgagagctgatctgatggaagaagggagctttgacgatgctgtgatggcttgcgaaggcgtcttccacactgcatcgcctgtccttgccaaatctgattccaattgcaaggaagaaatgcttgttcctgcgataaatggtactctgaatgtgctgaaatcttgcaagaagaatccatttctgaaaagggttgttcttacatcctcatcatccacggtaagaatcagggatgagagtaaacatccagaaatctcactggatgaaacaatatggagctctgtggcactctgtgaaaagctacagctatggtatgccctggcaaagatatctgcagagaaagcggcatgggagtttgccaaggagaacaacattgaccttgtaactgttcttccatcatttgtgattgggcccagtttatcacatgaactgtctgtcactgcttcagacatccttggcttacttcaaggtgacacagatagattcatctcgtatgggagaatgggatatgttcacatcgacgatgtggcgagctgccacattctggtgtacgaagcacctcaggctactgggagatatctctgcaactccgttgttcttgacaacaacgaattagtcgccttgcttgcgaagcaatttccaatttttcccatcccaaggagcttgaggaacccatatgagaaacagtcatatgagctaaacacatccaagatccagcagctgggtttcaagttcaaaggggtgcaagagatgtttggtgattgtgtcgagtcgctgaaagatcagggacacttgctggagtgcccgttgtaa

SEQ ID NO: 5155 - protein, 330 aa, Oryza sativa
MVISSKGKVCVTGASGFVASWLIKRLLEAGYHVIGTVRDPSNRDKVSHLWRLPSAKERLQLVRADLMEEGSFDDAVMACEGVFHTASPVLAKSDSNCKEEMLVPAINGTLNVLKSCKKNPFLKRVVLTSSSSTVRIRDESKHPEISLDETIWSSVALCEKLQLWYALAKISAEKAAWEFAKENNIDLVTVLPSFVIGPSLSHELSVTASDILGLLQGDTDRFISYGRMGYVHIDDVASCHILVYEAPQATGRYLCNSVVLDNNELVALLAKQFPIFPIPRSLRNPYEKQSYELNTSKIQQLGFKFKGVQEMFGDCVESLKDQGHLLECPL

SEQ ID NO: 5156 - DNA, 1020 bp, Fragaria ananassa
  CDS (1)..(1020)
atgcctgctgatcacagctcttcactttccggccatggccaaactgtgtgtgtcaccggagccggaggcttcatcgcttcttggttggtgaagctcctgctggagagaggctataatgtgagaggaaccgtcagaaacccagaggacccaaagaatgctcatctgagggagctggaaggagccaaagagaggctgagcttgcggaaagccgatcttctggatttcgagagcctgaaagaagccattaacggctgtgatggcgttttccacactgcatcgcctgtaactgatgatccggaacaaatggtggaaccggcagtgaatggaacaaagaatgtgatcgttgccgctgctgaagccaaggttaaacgcgtcgtcttcacgtcttcaatcggtgccgtctacatggacccagcccgaggtcccgatgtcgttgtcgacgagtcttgttggagtgacctcgagttttgcaagaacaccaagaactggtactgctacggcaaagctgtggcggagcaagcagcgtgggaagaggccaaagagagaggagtggacttggtggtggtgaacccagttctggtgcttggaccactgctccaaccaaccatcaacgccagcatcatccacatcctcaagtacttgactggctcggccaagacttatgccaattctgttcaggcctatgtgcatgtcaaggatgtggcattagcacacatactggtgtacgaaactccctcggcatctggccgttatctctgcgccgagagcgtccttcaccgtggagatgtggtcgaaatcctcgccaagttcttccctgaataccccatacccagcaagttgaaagatgatgggaaacccagagcaataccctacaagttttcaaaccagaagctacaagacttgggtttggagttcacttctgtgaaacagagcctatatgacactgtcaagagcttgcaggagaagggtcaccttaaggttcctacaaagcaagaagaagagtccatcaagatccaataa

SEQ ID NO: 5157 - protein, 339 aa, Fragaria ananassa
MPADHSSSLSGHGQTVCVTGAGGFIASWLVKLLLERGYNVRGTVRNPEDPKNAHLRELEGAKERLSLRKADLLDFESLKEAINGCDGVFHTASPVTDDPEQMVEPAVNGTKNVIVAAAEAKVKRVVFTSSIGAVYMDPARGPDVVVDESCWSDLEFCKNTKNWYCYGKAVAEQAAWEEAKERGVDLVVVNPVLVLGPLLQPTINASIIHILKYLTGSAKTYANSVQAYVHVKDVALAHILVYETPSASGRYLCAESVLHRGDVVEILAKFFPEYPIPSKLKDDGKPRAIPYKFSNQKLQDLGLEFTSVKQSLYDTVKSLQEKGHLKVPTKQEEESIKIQ

SEQ ID NO: 5158 - DNA, 1026 bp, Zea mays
  CDS (1)..(1026)
atgccaacagcagaggcgacgacgcccgtgccgccggagctgtcctccgggcaagggcggacggtttgcgtgaccggagctggagggttcattgcctcctggctcgtcaagcgcctcctggagaagggctacacagtccgcggcacggtcaggaaccctgtggatccaaagaacgaccacctgaggtcccttgacggcgccgacgaccgtctcgtcctcctccgcgccgacctgctggacccagagagccttgccgaggccttctccggctgtgacggcgtcttccacgccgcctccccggtcaccgatgaccctgagatgatgatcgagccagcgatccggggcacgcgctacgtgatggcggcggcggacgacgccggagtgaagcgcgtcgtgttcacgtcctccatcggcaccgtgtacatgaacccctaccgtgaccccagcaagcctgtggacgacacctgctggagcgacctcgagtattgcaagaacacccagaactggtactgctacgccaagacggtggcggagcagggcgcgtgggaggtggcgcggaagcgagggctggacctggtggtggtgaacccggtgctggtgctgggcccgctgctgcagccgacggtgaacgccagcacggaccacgtgatgaagtacctgacggggtcggccacgacctacgtgaacgcggcgcaggcgtacgtgcacgtcagggacgtggccgaggcgcacgtccgggtgtacgaggcgccccacgcgcacggccgctacatctgcgccgagagcaccctgcaccgcggcgacctctgccgcgtcctcgccaagctcttcccggagtaccccgtacccaccaagtgcaaggaccaggttaaccctccggtggtaggatacaagttcaccaaccagcgcctcaaggatctggggatggacttcgtgccggtcctccagtgcctctacgagacggtcaccagcctccaggagaaaggcatgctgcccgtgcttccgacaaaacacgaccatgcatga

SEQ ID NO: 5159 - protein, 341 aa, Zea mays
MPTAEATTPVPPELSSGQGRTVCVTGAGGFIASWLVKRLLEKGYTVRGTVRNPVDPKNDHLRSLDGADDRLVLLRADLLDPESLAEAFSGCDGVFHAASPVTDDPEMMIEPAIRGTRYVMAAADDAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKHDHA

SEQ ID NO: 5160 - DNA, 1041 bp, Zea mays
  CDS (1)..(1041)
atgccaacagcagaggcgacgacgcccgtgccgccggagctgtcctccgggcaagggcggacggtttgcgtgaccggagctggagggttcattgcctcctggctcgtcaagcgcctcctggagaagggctacacagtccgcggcacggtcaggaaccctgtggatccaaagaacgaccacctgagggcccttgacggcgccgtcgaccgtctcgtcctcctccgcgccgacctgctggacccacagagccttgccgaggccttctccggctgtgacggcgtcttccacgccgcctccccggtcaccgatgaccctgagatgatgatcgagccagcgatccggggcacgcgctacgtgatggcggcggcggcagacgccggagtgaagcgcgtcgtgttcacgtcctccatcggcaccgtgtacatgaacccctaccgtgaccccagcaagcctgtggacgacacctgctggagcgacctcgagtattgcaagaacacccagaactggtactgctacgccaagacggtggcggagcagggcgcgtgggaggtggcgcggaagcgagggctggacctggtggtggtgaacccggtgctggtgctgggcccgctgctgcagccgacggtgaacgccagcacggaccacgtgatgaagtacctgacggggtcggccacgacctacgtgaacgcggcgcaggcgtacgtgcacgtcagggacgtggccgaggcgcacgtccgggtgtacgaggcgccccacgcgcacggccgctacatctgcgccgagagcaccctgcaccgcggcgacctctgccgcgtcctcgccaagctcttcccggagtaccccgtacccaccaagtgcaaggaccaggttaaccctccggtggtaggatacaagttcaccaaccagaggctcaaggatctggggatggacttcgtgccggtcctgcagtgcctctacgagacggtcaccagcctccaggagaaaggcatgctgcccgtgcttccgacaaaacaagaccatgaccaactcggcaaatcatga

SEQ ID NO: 5161 - protein, 346 aa, Zea mays
MPTAEATTPVPPELSSGQGRTVCVTGAGGFIASWLVKRLLEKGYTVRGTVRNPVDPKNDHLRALDGAVDRLVLLRADLLDPQSLAEAFSGCDGVFHAASPVTDDPEMMIEPAIRGTRYVMAAAADAGVKRVVFTSSIGTVYMNPYRDPSKPVDDTCWSDLEYCKNTQNWYCYAKTVAEQGAWEVARKRGLDLVVVNPVLVLGPLLQPTVNASTDHVMKYLTGSATTYVNAAQAYVHVRDVAEAHVRVYEAPHAHGRYICAESTLHRGDLCRVLAKLFPEYPVPTKCKDQVNPPVVGYKFTNQRLKDLGMDFVPVLQCLYETVTSLQEKGMLPVLPTKQDHDQLGKS

SEQ ID NO: 5162 - DNA, 1047 bp, Malus domestica
  CDS (1)..(1047)
atgggatccgagtccgaatccgtttgtgtcaccggggcgtccggtttcatcggctcttggctcgtcatgagactcctagagcacgggtacaccgtccgcgccaccgtgcgtgaccccacgaatcagaagaaggtgaagcatctgttggacttgccgaaggcggagacgcacctgacgctgtggaaggcggacttggcggatgagggaagctttgatgaagccatacaaggctgcagcggagtgttccatgttgctacacctatggactttgaatccaaggaccccgagaatgaagtgatcaagcccacaatcaatggactgttggacatcctgaaggcatgccagaaagcaaaaacagttcgaaagcttgtgttcacatcctcagcaggaaccgtgaatgtggaggagcatcaaaagccggtctacgacgagtccaactggagtgacgttgaattttgccgctccgtcaagatgactggttggatgtacttcgtctccaagactctagctgagcaagctgcatggaaatatgccaaagaaaacaacattgatttcatcaccattatcccaactcttgtgattgggccatttctcatgccatccatgccaccaagcctcatcactggactttcgccgatcttaagaaatgaatcacattatggcatcatcaagcagggccagtatgttcacttggacgacctctgcctttctcacatttatctttacgagcatccgaaagccgaaggccgttacatttgttcgtcacatgatgctacaattcacgaacttgtaaaaatgctcagagaaaaataccccgaatacaatatacccacaaagttcaagggcatcgacgacaacttagaaccagttcatttttcttcaaagaagttgagggagatagggtttgagttcaagtacagcttggaggacatgtttgtgggggctgtcgatgcgtgccgggcaaagggcttgattccgattccgattccggcagagaaaactgaggctgctgaggagagcaacctcgttgatgtcaaagctggttaa

SEQ ID NO: 5163 - protein, 348 aa, Malus domestica
MGSESESVCVTGASGFIGSWLVMRLLEHGYTVRATVRDPTNQKKVKHLLDLPKAETHLTLWKADLADEGSFDEAIQGCSGVFHVATPMDFESKDPENEVIKPTINGLLDILKACQKAKTVRKLVFTSSAGTVNVEEHQKPVYDESNWSDVEFCRSVKMTGWMYFVSKTLAEQAAWKYAKENNIDFITIIPTLVIGPFLMPSMPPSLITGLSPILRNESHYGIIKQGQYVHLDDLCLSHIYLYEHPKAEGRYICSSHDATIHELVKMLREKYPEYNIPTKFKGIDDNLEPVHFSSKKLREIGFEFKYSLEDMFVGAVDACRAKGLIPIPIPAEKTEAAEESNLVDVKAG

SEQ ID NO: 5164 - DNA, 1017 bp, Medicago truncatula
  CDS (1)..(1017)
atggctagtatcaaacaaatagaaatagaaaagaagaaggcatgtgtgataggtggcactggttttgtggcatcattgctgatcaagcagttgcttgaaaagggttatgctgttaatactactgttagagacctagatagtgcaaacaaaacatctcacctcatagcactgcaaagtttgggggaactgaatctatttaaagcagaattaacaattgaagaagattttgatgctcctatatcaggatgtgaacttgtcttccaacttgctacacctgtgaactttgcttctcaagatcctgagaatgacatgataaaaccagcaatcaaaggtgtattgaatgtgttgaaagcatgtgtaagagcaaaagaagtcaaaagagttatcttaacatcttcagcagctgctgtgactataaacgaactcgaagggactggtcatgttatggatgaaaccaattggtctgatgttgagtttttgaacactgcaaagccacccacttggggttatcctgtttcaaaagtactagctgaaaaggctgcgtggaaatttgctgaagaaaataacattgatctaatcactgtgatacctactctaacaattggtccttctctaactcaagatatcccatctagtgttgccatgggaatgtcacttctaacaggcaatgatttcctcataaatgctttgaaaggaatgcagtttctatcgggttcaatatcaattactcatgtcgaggatatttgtcgggctcatatttttgtggcagagaaagaatcaacttctggtcgatacatttgctgtgctcacaataccagtgttcccgagcttgcaaagtttctcagcaaacgataccctcagtataaagttccaactgaatttgatgatttccccagcaaggcaaagttgataatctcttctggaaagcttatcaaagaaggtttcagtttcaagcatagtattgctgaaacttttgaccaaactgtggagtatttgaagactcaggggatcaagtga

SEQ ID NO: 5165 - protein, 338 aa, Medicago truncatula
MASIKQIEIEKKKACVIGGTGFVASLLIKQLLEKGYAVNTTVRDLDSANKTSHLIALQSLGELNLFKAELTIEEDFDAPISGCELVFQLATPVNFASQDPENDMIKPAIKGVLNVLKACVRAKEVKRVILTSSAAAVTINELEGTGHVMDETNWSDVEFLNTAKPPTWGYPVSKVLAEKAAWKFAEENNIDLITVIPTLTIGPSLTQDIPSSVAMGMSLLTGNDFLINALKGMQFLSGSISITHVEDICRAHIFVAEKESTSGRYICCAHNTSVPELAKFLSKRYPQYKVPTEFDDFPSKAKLIISSGKLIKEGFSFKHSIAETFDQTVEYLKTQGIK

SEQ ID NO: 5166 - DNA, 1011 bp, Eucalyptus globulus
  CDS (1)..(1011)
atgcccgtcgacgccctccccggttccggccagaccgtctgcgtcaccggcgccggcggcttcatcgcctcctggattgtcaagcttctcctcgagcgaggctacaccgtgcgaggaaccgtcaggaacccagacgacccgaagaatgggcatctgagagagctggacggagccagcgagaggctgacgctgtacaagggtgatctgatggactacgagagcttgagagaagccatcatggggtgcgacggcgtcgtccacaccgcctctccggtcaccgacgatcctgagcaaatggtggagccagcggtgatcgggacgaaaaatgtgatcgtcgcagcagcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggccgcttgcgcagaggcgaaggagagaggggttgacctcgtggtgattaaccctgtgctcgtgcttggaccgctccttcagtcgacgatcaatgcgagcatcatccacatcctcaagtacttgactggctcagccaagacctacgccaactcggtccaggcatacgtgcacgtcaaggacgtcgcgcttgcccatgtccttgtcttggagaccccatccgcctcaggccgctatttgtgcgccgagagcgtcctccaccgtggcgatgtggtggaaatccttgccaagttcttccctgagtataacgtaccgaccaagtgctctgatgaggtgaacccaagagtaaaaccatacaagttctccaaccagaagctgagagacttggggctcgagttcaccccggtgaagcagtgcctgtacgaaactgtcaagagcttgcaggagaaaggccacctacccgtccctcccccgccggaagattcggtgcgtattcagggatga

SEQ ID NO: 5167 - protein, 336 aa, Eucalyptus globulus
MPVDALPGSGQTVCVTGAGGFIASWIVKLLLERGYTVRGTVRNPDDPKNGHLRELDGASERLTLYKGDLMDYESLREAIMGCDGVVHTASPVTDDPEQMVEPAVIGTKNVIVAAAEAKVRRVVFTSSIGAVTMDPNRGPDVVVDESCWSDLEFCKSTKNWYCYGKAVAEKAACAEAKERGVDLVVINPVLVLGPLLQSTINASIIHILKYLTGSAKTYANSVQAYVHVKDVALAHVLVLETPSASGRYLCAESVLHRGDVVEILAKFFPEYNVPTKCSDEVNPRVKPYKFSNQKLRDLGLEFTPVKQCLYETVKSLQEKGHLPVPPPPEDSVRIQG

SEQ ID NO: 5168 - DNA, 999 bp, Solanum tuberosum
  CDS (1)..(999)
atgccatcagaatccggcaaagttgtttgtgttaccggcgccggaggtttcattgcctcttggctcgttaaactccttctagaaaaaggctacactgtcagaggaaccgttagaaaccctgatgatcctaaaaatggtcacttgaaggaacttgaaggtgcaaaggagagactgattctgctgagagctgatcttctggattatcagagtttgagagaagcaatttatggctgtgacggggttttccacaccgcctcccctgtcactgatgatccagaacaaatggtggagccagcggttatagggactaagaatgtgataacagccgcagcagaagccaaagttggaagagttgtgtttacttcgtcaattggtacagtatacatggaccccaaccgggccccggataaagttgtggacgagacttgctggagtgatcttggcttctgcaagaatactaagaattggtactgctacgggaagacggtggcggaaaagacagcatgggatgaggcaagggaaaaaggagtggatttggtggtgatcaatccagtgttggtgcttggaccactgcttcaaccaacagtgaatgctagtgttcttcacatactaaagtacctaactggctctgctaaaacatatgccaattcaattcaggcgtatgttcatgttaaggatgtggcactagcccacatacttctctatgaagctccttctgcatctggccgctatatctgtgctgagagcgtccttcatcgcggcgatgtggttgaaattctcgccaaattcttcccggagtatccaatacctaccaagtgctcggatgaaacgaggccaagggcaaaaccgtacaaattcacgaaccaaaagctaaaggacttgggtttggggtttacgccagtgaaacagtgcttatatgagacagtgaagagtctgcaggagaagggtcaccttccaattcctactcaaaatgatgaacctattaaaattcactcttaa

SEQ ID NO: 5169 - protein, 332 aa, Solanum tuberosum
MPSESGKVVCVTGAGGFIASWLVKLLLEKGYTVRGTVRNPDDPKNGHLKELEGAKERLILLRADLLDYQSLREAIYGCDGVFHTASPVTDDPEQMVEPAVIGTKNVITAAAEAKVGRVVFTSSIGTVYMDPNRAPDKVVDETCWSDLGFCKNTKNWYCYGKTVAEKTAWDEAREKGVDLVVINPVLVLGPLLQPTVNASVLHILKYLTGSAKTYANSIQAYVHVKDVALAHILLYEAPSASGRYICAESVLHRGDVVEILAKFFPEYPIPTKCSDETRPRAKPYKFTNQKLKDLGLGFTPVKQCLYETVKSLQEKGHLPIPTQNDEPIKIHS

SEQ ID NO: 5170 - DNA, 1047 bp, Hordeum vulgare
  CDS (1)..(1047)
atgaccgtcgtcgacgccgccgccgccgtcgcgcaggagctgcccgggcacgggcagaccgtgtgcgtcaccggcgccgccgggtacatcgcgtcgtggctcgtcaagctgctcctggagaggggctacaccgtcaagggcacagtgaggaacccagatgacccgaagaatgcacacctgaaggcgctggacggcgccgccgagaggctggtcctctgcaaggccgacctcctcgactacgacgccatctgcgccgccgtcgagggctgccacggcgtgttccacaccgcctcccccgtcaccgacgaccctgagcagatggtggagccggcggtgaggggcacggaatacgtgatcgacgcggcggcggacgccggcaccgtgcgccgggttgtgttcacgtcgtccatcggcgccgtcaccatggaccccaaccgcgggcccgacgtggtcgtcgacgagtcctgctggagcgatcttgagttctgcaagaaaaccaagaactggtactgctacggcaaggcggtggcggagcaggcggcgtgggagaaggcgagggcgcgcggcgtggacctggtggtggtgaacccggtgctggtggtcgggccgctgctgcagccgacggtgaacgccagcgccgcgcacatcctcaagtacctcgacggctccgccaggaagtacgccaacgcggtgcaggcgtacgtggacgtgcgcgacgtcgccggcgcgcacctccgggtcttcgaggcgccccaggcctccggccgctacctctgcgccgagcgcgtcctgcaccgccaggacgtcgtccacatcctcgccaagctcttccccgagtaccccgtcccaacaaggtgctctgacgaggtgaacccacggaagcagccttacaagatgtccaaccagaagctgcaggatcttggcctcaagttcactcctgtgaacgactctctgtacgagacggtgaagagcctccaggagaaggggcacctcccggtgccgaggaaggatatcctcgcaccacagctggacggtgcaacagcgtga

SEQ ID NO: 5171 - protein, 348 aa, Hordeum vulgare
MTVVDAAAAVAQELPGHGQTVCVTGAAGYIASWLVKLLLERGYTVKGTVRNPDDPKNAHLKALDGAAERLVLCKADLLDYDAICAAVEGCHGVFHTASPVTDDPEQMVEPAVRGTEYVIDAAADAGTVRRVVFTSSIGAVTMDPNRGPDVVVDESCWSDLEFCKKTKNWYCYGKAVAEQAAWEKARARGVDLVVVNPVLVVGPLLQPTVNASAAHILKYLDGSARKYANAVQAYVDVRDVAGAHLRVFEAPQASGRYLCAERVLHRQDVVHILAKLFPEYPVPTRCSDEVNPRKQPYKMSNQKLQDLGLKFTPVNDSLYETVKSLQEKGHLPVPRKDILAPQLDGATA

SEQ ID NO: 5172 - DNA, 981 bp, Arabidopsis thaliana
  CDS (1)..(981)
atggcaaacagtggtgaaggtaaagtggtgtgtgtaacaggagcctccggttacatcgcctcatggctcgtcaagttcctacttagccgtggctacactgttaaggcctccgtccgtgatcccagtgatccgaaaaagacacaacacttagtttcactagaaggtgcaaaggaaagacttcacttgttcaaagcagaccttttggaacaaggttctttcgactctgctattgatggttgccatggagttttccacactgcttctccattttttaatgatgccaaagacccacaggctgaacttattgatcctgcggtcaaggggacgcttaacgttttgaattcgtgcgccaaagcctcttcggttaagagggttgttgtaacctcctccatggctgccgttggttacaatggaaaaccacgcacacctgatgttaccgtcgatgaaacttggttctctgatcctgagctttgcgaggcctccaagatgtggtatgttctatccaagactttggcggaagatgcagcttggaaactcgctaaagagaaaggcttagacattgttactattaacccggctatggtgatcggtcctctcctacagccaactctgaacacgagtgctgctgctatattaaacttaatcaatggtgcaaagactttcccaaacttgagtttcggatgggttaatgtaaaagacgtagccaatgcgcacatccaaacatttgaggtcccttcagctaatgggcgttattgtttggtcgagcgtgtcgttcaccactccgagattgttaacattctacgtgagctttacccaaatctcccactacctgaaaggtgtgtggacgagaatccctacgtgccaacgtatcaagtgtccaaggataaaacgaggagccttggcatagactacatacccttgaaggttagcatcaaggagaccgtcgagtccttgaaggaaaaaggtttcgcacagttctga

SEQ ID NO: 5173 - protein, 326 aa, Arabidopsis thaliana
MANSGEGKVVCVTGASGYIASWLVKFLLSRGYTVKASVRDPSDPKKTQHLVSLEGAKERLHLFKADLLEQGSFDSAIDGCHGVFHTASPFFNDAKDPQAELIDPAVKGTLNVLNSCAKASSVKRVVVTSSMAAVGYNGKPRTPDVTVDETWFSDPELCEASKMWYVLSKTLAEDAAWKLAKEKGLDIVTINPAMVIGPLLQPTLNTSAAAILNLINGAKTFPNLSFGWVNVKDVANAHIQTFEVPSANGRYCLVERVVHHSEIVNILRELYPNLPLPERCVDENPYVPTYQVSKDKTRSLGIDYIPLKVSIKETVESLKEKGFAQF

SEQ ID NO: 5174 - DNA, 999 bp, Arabidopsis thaliana
  CDS (1)..(999)
atgcctgtcgacgggaaactcgtctgcgtcaccggagccggcggctacattgcttcttggatcgttaagttactcttagagagaggctacaccgttagaggaaccgtaaggaacccaactgatcccaagaacaaccatctcagagagcttcaaggagccaaggaaagactcactcttcacagtgcagatcttctcgactacgaagctctctgtgccgcaatcgacggttgcgatggcgttttccacactgcctctccgatgaccgacgatcccgagacaatgttggagccggcggtgaacggagccaagttcgtgattgacgcagcggctaaagccaaggtcaagcgcgtggttttcacgtcatcaattggtgcagtttacatgaaccctaaccgtgacactcaagccattgttgacgaaaactgctggagtgatcttgatttctgcaaaaacactaagaattggtattgctacgggaagatgttggcggaacaatcggcgtgggagacggccaaagcaaaaggtgtggacttagtggtgctaaatccggttttggttctcggaccaccgctccagtcagcgatcaacgctagtctagtccatattctcaagtacctcaccggctcagccaagacctacgctaacttgactcaggtctacgtggacgtccgtgacgtggcactaggccatgttctggtctacgaagcaccctccgcctcaggccgttacatcctcgccgagaccgcacttcaccgcggagaggttgttgagattctggccaaattcttcccggagtatccacttcccaccaagtgttcggacgagaagaatccgagggctaagccatacaagtttactacccaaaagataaaagacttaggcttggaatttaaacccatcaagcaatctctttacgaatatgtcaagagcttgcaagagaaaggtcatcttcctctacctcaagattcgaaccaaaacgaagtcatcatcgaaccttag

SEQ ID NO: 5175 - protein, 332 aa, Arabidopsis thaliana
MPVDGKLVCVTGAGGYIASWIVKLLLERGYTVRGTVRNPTDPKNNHLRELQGAKERLTLHSADLLDYEALCAAIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYILAETALHRGEVVEILAKFFPEYPLPTKCSDEKNPRAKPYKFTTQKIKDLGLEFKPIKQSLYEYVKSLQEKGHLPLPQDSNQNEVIIEP

SEQ ID NO: 5176 - DNA, 978 bp, Neurospora crassa
  CDS (1)..(978)
atgaccaaggttctgttgactggtggttcgggcttcattgctgctcacatcctcgagcagcttcttgccaagggccacaccgtggtcaccaccgtccggtctgaagataaggcgcaaaacatccgcgaggcctaccctgataaggccagcagcggcgagctcaaggtcgtcattgttcccgatatcgccaagctcgatgctttcgatgaggttgtgaaggagcccggtcttgaggttgtcttgcacactgcttcacctttccacttcaagttcactcccaaagaggaccccaagaccgagctcatcgaccccgccgtcaacggcacaaccggcatcctcaaagccatcgcccgctccgcgcccactgtccgccgcgtcgtcatcacctcctccttcgccgccatcttggacgagaacaagatcacggacccgaaccacaccttcagtgaagcctcctggaaccccgtcaccatcgacgacatccaccgcaaccccgcgaccgcctatcgggcctctaagacgctcgccgagaaggccgcctgggactttgtccgcgacccggctaacaatgtcaagttcgacctggccaccatcaacccgcccatggtgtttggtcctgtcgtccaccacctcgccagcctgagcagcatcaacaccagcaacgaacgcattgttgatttgctgcagggcaagtggaaggagggcgtgccatccaccggtgccgccaccatttggattgatgtgcgcgatgttgctagggcgcatatccgtgcaggtttggaggtgccagaggcgggtggcaagagattgttcaccactgctgggacgttcagcaacagtgagattgcagagaaggtgcgcaagaatttccccgagtatggggataagttgccggaggagaggcgctcaagagcggcgagctgccgccggatgatcagcggttcaaggtcgataacaaggcgacgaatgagttgctga

SEQ ID NO: 5177 - protein, 325 aa, Neurospora crassa
MTKVLLTGGSGFIAAHILEQLLAKGHTVVTTVRSEDKAQNIREAYPDKASSGELKVVIVPDIAKLDAFDEVVKEPGLEVVLHTASPFHFKFTPKEDPKTELIDPAVNGTTGILKAIARSAPTVRRVVITSSFAAILDENKITDPNHTFSEASWNPVTIDDIHRNPATAYRASKTLAEKAAWDFVRDPANNVKFDLATINPPMVFGPVVHHLASLSSINTSNERIVDLLQGKWKEGVPSTGAATIWIDVRDVARAHIRAGLEVPEAGGKRLFTTAGTFSNSEIAEKVRKNFPEYGDKLPEERRSRAASCRRMISGSRSITRRRMSC

SEQ ID NO: 5178 - DNA, 1089 bp, Lolium perenne
  CDS (1)..(1089)
atgaccatcgccgaggtcgtggctgccggagacaccgccgccgcggtggtgcagcccgccgggaacgggcagaccgtgtgcgtgaccggcgccgccgggtacatcgcgtcgtggctcgtcaagctgctgctggagaaggggtacaccgtcaagggcaccgtcaggaacccagacgacccgaagaacgcgcacctgagggcgctcgacggcgccgccgaccggctggtcctctgcaaggccgacctcctcgactacgacgccatccgccgcgccatcgacggctgccacggcgtcttccacaccgcgtcccccgtcaccgacgaccccgagcaaatggtggagccggcggtgaggggcacgcagtacgtcatagacgcggcggcggaggccggcacggtgcggcggatggtgctcacctcctccatcggcgccgtcaccatggaccccaaccgcgggccggacgtggtcgtcgacgagtcgtgctggagcgacctcgacttctgcaagaaaaccaggaactggtactgctacgggaaggcggttgcggagcaggcggcatcggagttggcgcggcagcgcggcgtggaccttgtggtggtgaacccggtgctggtgatcggccccctgctgcagccgacggtgaacgccagcatcggccacatcctcaagtacctggacgggtcggccagcaagttcgccaacgccgtgcaggcgtacgtggacgtccgcgacgtggccgacgcccacctccgcgtcttcgagtgcgccgccgcgtccggccgccacctctgcgccgagcgcgtcctccaccgcgaggacgtcgtgcgcatcctcgccaagctcttccccgagtaccccgtccccaccaggtgctctgatgagacgaacccgaggaagcagccatacaagatgtcgaaccagaagctccaggacctcggactcgagttcaggccggtgagccagtccctgtacgagacggtgaagagcctccaggagaagggccaccttccggtgctcagcgagcaggcagaggcggacaaggaaaccctagctgccgagctgcaggcaggggttaccatccgagcatga

SEQ ID NO: 5179 - protein, 362 aa, Lolium perenne
MTIAEVVAAGDTAAAVVQPAGNGQTVCVTGAAGYIASWLVKLLLEKGYTVKGTVRNPDDPKNAHLRALDGAADRLVLCKADLLDYDAIRRAIDGCHGVFHTASPVTDDPEQMVEPAVRGTQYVIDAAAEAGTVRRMVLTSSIGAVTMDPNRGPDVVVDESCWSDLDFCKKTRNWYCYGKAVAEQAASELARQRGVDLVVVNPVLVIGPLLQPTVNASIGHILKYLDGSASKFANAVQAYVDVRDVADAHLRVFECAAASGRHLCAERVLHREDVVRILAKLFPEYPVPTRCSDETNPRKQPYKMSNQKLQDLGLEFRPVSQSLYETVKSLQEKGHLPVLSEQAEADKETLAAELQAGVTIRA

SEQ ID NO: 5180 - DNA, 975 bp, Pinus taeda
  CDS (1)..(975)
atgactgcaggtaaacaaaccgaggaaggccagactgtctgtgttacaggagccggaggattcatcgcctcatggctggtgaagctgctgcttgaaaggggctataccgtgcgaggaacagttcgcaaccctgaggatcagaagaatgctcatctcaagcagctggaaggtgcagaagagaggctgacattggtaaaagcagatcttatggactacaacagccttttgaatgccatcaacggctgccaaggagtcttccatgttgcttctcctgtcacagatgatcccgaagaaatggtggagccagctgtgaatggaacaaagaacgtcctggatgcttgtgcagtggctggagtgcgccgtgtggtgtttacttcctccattggggcagtttacatggacccaagtagggattatgatgctcttgtggatgagaactgttggagcaaccttgactattgcaaggagacaaagaactggtactgctatggaaaaacagtggccgagaaggctgcatgggaaagagcgaaggacaaggggttggacctggtagtggtaaatccatgtgtggtattgggtcctgtgctgcaatcctccattaactccagcataattcatatactcaagtatttgactggatctgctaagacctatgccaactcagttcaggcctatgtccatgtcagagatgttgcagaggctcacatcctggtttatgaaagcccatcagcttcaggccgctatttatgtgccgagagtgttctccaccgtggtgatgtggttgactcgctggcatcgatgttccctcaatatccaattcctaccaaggtcaaggaagatgggaagccaagggtgaagccttggaaggtttccaaccaaaagctcaaggacctcggattagaatttacaccagcgaaacaatgcctgtatgagacagttatcagcttacaagaaaaagggcatatttccaagtga

SEQ ID NO: 5181 - protein, 324 aa, Pinus taeda
MTAGKQTEEGQTVCVTGAGGFIASWLVKLLLERGYTVRGTVRNPEDQKNAHLKQLEGAEERLTLVKADLMDYNSLLNAINGCQGVFHVASPVTDDPEEMVEPAVNGTKNVLDACAVAGVRRVVFTSSIGAVYMDPSRDYDALVDENCWSNLDYCKETKNWYCYGKTVAEKAAWERAKDKGLDLVVVNPCVVLGPVLQSSINSSIIHILKYLTGSAKTYANSVQAYVHVRDVAEAHILVYESPSASGRYLCAESVLHRGDVVDSLASMFPQYPIPTKVKEDGKPRVKPWKVSNQKLKDLGLEFTPAKQCLYETVISLQEKGHISK

SEQ ID NO: 5182 - DNA, 996 bp, Zea mays
  CDS (1)..(996)
atggtgacctcaagcaagggcaaggtatgcgtaaccggggcctcaggctttgttgcctcttggcttatcaaacggctcctcgagtctggatatcatgtggtagggactgtcagggacccaggaaatcaccaaaaaacagcccacctttggaaattacctggcgctaaagagaggctgcaaatcgtgcgagctaatctgttggaagaagggagcttcgacagcgccgtgatggcctgtgagggtgtattccacactgcatcccccgtcctcgctaaacccgactctactagcaaggaggacacgctcgtccctgcggtgaacggtactctgaacgtgctgagatcgtgcaagaagaaccccttcctgaaaagggtcgtccttacgtcttcgtcgtctgcggtgaggatcagggacgacggtggccagtccagtaacatctcgctggacgaaacgacatggagctccgtgccactctgcgagaagatgcatctatggtatgccctagccaaggtatttgcagagaaagcggcgtgggagttcgccaaggagaacggcatcgaccttgtgactgtcctcccgtcgttcgtgatcgggcccagtttgtcccacgagctatgcgttaccgcttcagacgtcctaggcctattccaaggcgacacggcaaggttcagctcgtacggaagaatggggtacgtccacatcgacgacgttgcgagcagccacatcctggtgtacgaggtcccccaggccgccgggaggtacctgtgcagctcagtggtgctggacaacgacgagctggtctcctcgctcgcgaaacgctacccgatattccccataccccggaggctgaacagcccctacggcaagcagtcgtaccagctgaacacgtcgaagctgcaggggctgggcttcaagttcagaggggtgcaggagatgttcgacgactgcgtgcagtcgctcaaagaccagggccacctgctggagtgccccctgtga

SEQ ID NO: 5183 - protein, 331 aa, Zea mays
MVTSSKGKVCVTGASGFVASWLIKRLLESGYHVVGTVRDPGNHQKTAHLWKLPGAKERLQIVRANLLEEGSFDSAVMACEGVFHTASPVLAKPDSTSKEDTLVPAVNGTLNVLRSCKKNPFLKRVVLTSSSSAVRIRDDGGQSSNISLDETTWSSVPLCEKMHLWYALAKVFAEKAAWEFAKENGIDLVTVLPSFVIGPSLSHELCVTASDVLGLFQGDTARFSSYGRMGYVHIDDVASSHILVYEVPQAAGRYLCSSVVLDNDELVSSLAKRYPIFPIPRRLNSPYGKQSYQLNTSKLQGLGFKFRGVQEMFDDCVQSLKDQGHLLECPL

SEQ ID NO: 5184 - DNA, 999 bp, Arabidopsis thaliana
  CDS (1)..(999)
atgcttgtcgacgggaaactcgtctgcgtcaccggagccggcggctacattgcttcttggatcgttaagttactcttagagagaggctacaccgttagaggaaccgtaaggaacccaactgatcccaagaacaaccatctcagagagcttcaaggagccaaggaaagactcactcttcacagtgcagatcttctcgactacgaagctctctgtgccacaatcgacggttgcgatggcgttttccacactgcctctccgatgaccgacgatcccgagacaatgttggagccggcggtgaacggagccaagttcgtgattgacgcagcggctaaagccaaggtcaagcgcgtggttttcacgtcatcaattggtgcagtttacatgaaccctaaccgtgacactcaagccattgttgacgaaaactgctggagtgatcttgatttctgcaaaaacactaagaattggtattgctacgggaagatgttggcggaacaatcggcatgggagacggccaaagcaaaaggtgtggacttagtggtgctaaatccggttttggttctcggaccaccgctccagtcagcgatcaacgctagtctagtccatattctcaagtacctcaccggttcagccaagacctacgctaacttgactcaggtctacgtggacgtccgtgacgtggcactaggccatgttctggtctacgaagcaccctccgcctcaggccgttacatcttcgccgagaccgcacttgaccgcggagaggttgttgagattctggccaaattcttcccggagtatccacttcccaccaagtgttcggacgagaagaatccgagggctaagccatacaagtttactacccaaaagataaaagacttaggcttggaatttaaacccatcaagcaatctctttacgaatctgtcaagagcttgcaagagaaaggccatcttcctctacctcaagattcgaaccaaaacgaagtcatcatcgaatcttag

SEQ ID NO: 5185 - protein, 332 aa, Arabidopsis thaliana
MLVDGKLVCVTGAGGYIASWIVKLLLERGYTVRGTVRNPTDPKNNHLRELQGAKERLTLHSADLLDYEALCATIDGCDGVFHTASPMTDDPETMLEPAVNGAKFVIDAAAKAKVKRVVFTSSIGAVYMNPNRDTQAIVDENCWSDLDFCKNTKNWYCYGKMLAEQSAWETAKAKGVDLVVLNPVLVLGPPLQSAINASLVHILKYLTGSAKTYANLTQVYVDVRDVALGHVLVYEAPSASGRYIFAETALDRGEVVEILAKFFPEYPLPTKCSDEKNPRAKPYKFTTQKIKDLGLEFKPIKQSLYESVKSLQEKGHLPLPQDSNQNEVIIES

SEQ ID NO: 5186 - DNA, 933 bp, Arabidopsis thaliana
  CDS (1)..(933)
atgaacggcgaaggaaaggttgtttgcgtcaccggagcttccggatacatagcttcttggattgttaagcttttgctcctccgtggctacaccgtcagggccaccgtccgaaacccaagtgcaagtgaaagactaaaactgttcaaatcagatcttttggaagaaggttctttcgatcaagctatagagggatgcgacggtgtcttccatactgcctctccagtttcattaaccgttacagatcctcaggctcttttgcagactgagatgatcgatccggcggttaatggtactttgaacgttttgagaacgtgcgccaaagtttcttctgtgaagagggtcattgtaacatcgtccactgctgctactctttctattaacccaaacgacgtggtggacgaaaccgtcttcaccgatctaagtgtttacttagcgatgaaggcatggtatggatattcaaaaactttggctgaggaaacagcgtggcggtttgctaaagaaaacgggatcgatttggttgtaatgaatccaggaaacgtgatcggaccagttttgcagccaactcttaattactctgtagaagtgattgtggatctgataaatggtaaaaacccttccaatagtttttactataggttcatggacgtgagagatgtttctcttgctcatatcaaagcgttcgaggtcccttctgctagtggcagatacatacttgctgatccagatgtaacaatgaaagacattcaaaagcttttacatgaactgtttcctgatttgtgccgtgttgataaggataatgagaatgaggtgggtgaaatggcatacaaagtgtgtgtcgataaattgaaaagtttgggaattgagttcactcctatcaaagaatctctcaaggatactgttgttagccttaaggagaggtgtcttcttatatga

SEQ ID NO: 5187 - protein, 310 aa, Arabidopsis thaliana
MNGEGKVVCVTGASGYIASWIVKLLLLRGYTVRATVRNPSASERLKLFKSDLLEEGSFDQAIEGCDGVFHTASPVSLTVTDPQALLQTEMIDPAVNGTLNVLRTCAKVSSVKRVIVTSSTAATLSINPNDVVDETVFTDLSVYLAMKAWYGYSKTLAEETAWRFAKENGIDLVVMNPGNVIGPVLQPTLNYSVEVIVDLINGKNPSNSFYYRFMDVRDVSLAHIKAFEVPSASGRYILADPDVTMKDIQKLLHELFPDLCRVDKDNENEVGEMAYKVCVDKLKSLGIEFTPIKESLKDTVVSLKERCLLI

SEQ ID NO: 5188 - DNA, 1035 bp, Arabidopsis thaliana
  CDS (1)..(1035)
atgccagtcgacgtagcctcaccggccggaaaaaccgtctgcgtcaccggagctggtggatacatcgcttcttggattgttaagatacttctcgagagaggttacacagtcaaaggaaccgtacggaatccagatgatccgaagaacacacatttgagagaactagaaggaggaaaggagagactgattctgtgcaaagcagatcttcaggactacgaggctcttaaggcggcgattgatggttgcgacggcgtctttcacacggcttctcctgtcaccgacgatccggaacaaatggtggagccggccgtgaatggagccaagtttgtgattaatgctgcggctgaggccaaggtcaagcgcgtggtcatcacctcctccattggtgccgtctacatggacccgaaccgtgaccctgaggctgtcgttgacgaaagttgttggagtgatcttgacttctgcaaaaacaccaagaattggtattgttacggcaagatggtggcggaacaagcggcgtgggagacagcaaaggagaaaggtgttgacttggtggtgttgaatccggtgctggttcttggaccgccgttacagccgacgatcaacgccagtctttaccacgtcctcaaatatctaaccggctcggctaagacttatgctaatttgactcaagcttatgtggatgttcgcgatgtcgcgctggctcatgttctggtctatgaggcaccctcggcctccggacgttatctcctagccgagagtgctcgccaccgcggggaagttgttgagattctggctaagctattcccggagtatcctcttccgaccaagtgcaaggacgagaagaaccctagagccaagccatacaaattcactaaccagaagattaaggacttaggcttagagttaacttccaccaagcaaagcttctacgacacagtcaagagcttacaagagaaaggccatcttgctcctcctcctcctcctccttcagcatcgcaagaatccgtggaaaatggcattaagatcgggtcttga

SEQ ID NO: 5189 - protein, 344 aa, Arabidopsis thaliana
MPVDVASPAGKTVCVTGAGGYIASWIVKILLERGYTVKGTVRNPDDPKNTHLRELEGGKERLILCKADLQDYEALKAAIDGCDGVFHTASPVTDDPEQMVEPAVNGAKFVINAAAEAKVKRVVITSSIGAVYMDPNRDPEAVVDESCWSDLDFCKNTKNWYCYGKMVAEQAAWETAKEKGVDLVVLNPVLVLGPPLQPTINASLYHVLKYLTGSAKTYANLTQAYVDVRDVALAHVLVYEAPSASGRYLLAESARHRGEVVEILAKLFPEYPLPTKCKDEKNPRAKPYKFTNQKIKDLGLELTSTKQSFYDTVKSLQEKGHLAPPPPPPSASQESVENGIKIGS

SEQ ID NO: 5190 - DNA, 1017 bp, Populus trichocarpa
  CDS (1)..(1017)
atgcctgttgatgcttcatcactttcaggccaaggccaaactatctgtgtcaccggggctggtggtttcattgcttcttggatggttaaacttcttttagataaaggttacactgttagaggaactgcgaggaacccagctgatcccaagaattctcatttgagggagcttgaaggagctgaagaaagattaactttatgcaaagctgatcttcttgattatgagtctcttaaagaggctattcaagggtgtgatggtgttttccacactgcttctcctgtcacagatgatccggaagaaatggtggagccagcagtgaacgggaccaaaaatgtgataattgcggcggctgaggccaaagtccgacgagtggtgttcacgtcatcaattggcgctgtgtacatggatcccaataagggcccagatgttgtcattgatgagtcttgctggagtgatcttgaattctgcaagaacaccaagaattggtattgctatggaaaggctgtggcagaacaagctgcatgggatatggctaaggagaaaggggtggacctagtggtggttaacccagtgctggtgcttggaccattgttgcagcccactgtcaatgctagcatcactcacatcctcaagtacctcaccggctcagccaagacatatgctaactctgttcaagcttatgtgcatgttagggatgtggcactagcccacattttagtctttgagacgccttccgcctccggccgttacctttgctctgagagcgttctccaccgtggagaggtggtggaaatccttgcaaagttcttccctgagtaccccatccctaccaagtgctcagatgagaagaacccaagaaaacaaccttacaagttctcaaaccagaagctaagggatctgggtttcgaattcaccccagtaaagcagtgtctgtatgaaactgttaagagtttgcaggaaaagggtcaccttccaatcccaaaacaagctgcagaagagtctttgaaaattcaataa

SEQ ID NO: 5191 - protein, 338 aa, Populus trichocarpa
MPVDASSLSGQGQTICVTGAGGFIASWMVKLLLDKGYTVRGTARNPADPKNSHLRELEGAEERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLLQPTVNASITHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQEKGHLPIPKQAAEESLKIQ

SEQ ID NO: 5192 - DNA, 1011 bp, Eucalyptus saligna
  CDS (1)..(1011)
atgcccgtcgacgccctccccggttccggccagaccgtctgcgtcaccggcgccggcggcttcatcgcctcctggattgtcaagcttctcctcgagcgaggctacaccgtgcgaggaaccgtcaggaacccagacgacccgaagaatgggcatctgagagatctggaaggagccagcgagaggctgacgctgtacaagggtgatctgatggactacgggagcttggaagaagccatcaaggggtgcgacggcgtcgtccacaccgcctctccggtcaccgacgatcctgagcaaatggtggagccagcggtgatcgggacgaaaaatgtgatcgtcgcagcggcggaggccaaggtccggcgggttgtgttcacctcctccatcggtgcagtcaccatggaccccaaccggggtccggacgttgtggtggacgagtcttgttggagcgacctcgaattttgcaagagcactaagaactggtattgctacggcaaggcagtggcggagaaggcccgttgcgcagaggcaaaggagagaggggttgacctcgtggtgattaaccctgtgctcgtgcttggaccgctccttcagtcgacgatcaatgcgagcatcatccacatcctcaagtacttgactggctcagccaagacctatgccaactcggtccaggcatacgtgcacgtcaaggacgtcgcgcttgcccacgtccttgtcttggagaccccatccgcctcaggccgctatttgtgcgacgagagtgtcctccaccgtggcgatgtggtggaaatccttgccaagttcttccctgagtataacgtaccgaccaagtgctctgatgaggtgaacccaagagtaaaaccatacaagttctccaaccagaagctgaaagacttggggctcgagttcaccccggtgaagcagtgcctgtacgaaactgtcaagagcttgcaggagaaaggccacctacccgtccctcccccgccggaagattcggtgcgtattcagggatga

SEQ ID NO: 5193 - protein, 336 aa, Eucalyptus saligna
MPVDALPGSGQTVCVTGAGGFIASWIVKLLLERGYTVRGTVRNPDDPKNGHLRDLEGASERLTLYKGDLMDYGSLEEAIKGCDGVVHTASPVTDDPEQMVEPAVIGTKNVIVAAAEAKVRRVVFTSSIGAVTMDPNRGPDVVVDESCWSDLEFCKSTKNWYCYGKAVAEKARCAEAKERGVDLVVINPVLVLGPLLQSTINASIIHILKYLTGSAKTYANSVQAYVHVKDVALAHVLVLETPSASGRYLCDESVLHRGDVVEILAKFFPEYNVPTKCSDEVNPRVKPYKFSNQKLKDLGLEFTPVKQCLYETVKSLQEKGHLPVPPPPEDSVRIQG

SEQ ID NO: 5194 - DNA, 1035 bp, Lolium perenne
  CDS (1)..(1035)
atgactgttgtcaacaccgtcgcgcagcaactgcctggccatgggcagaccgtgtgtgtcaccggcgctgccggatacatcgcgtcttggctcgtcaagctgctcctggagagaggctacaccgtgaagggcacagtgaggaacccagatgatcccaagaacgctcacctgaaggcgctggacggcgccgtcgagaggctgatcctctgcaaagccgacctcctcgactatgatgccatatgcgccgccgccgagggctgccatggcgtgttccacaccgcctctccggtcaccgatgatcctgagcagatggtggagccggcggtgcggggcacggagtacgtgatcaacgcagcggcggatgcaggaacggtgcgccgggtggtgttcacgtcgtccatcggcgccgtcaccatggaccccaaccgcggtcctgacgtagttgtcgacgagtcctgctggagcgacctcgaattctgcaagaagaccaagaactggtactgctacggcaaggcggtggcggagcaggctgcgtgggaggcagccaggaagcgtggcatcgacctcgttgtcgtgaaccctgtgctcgtggtcgggccactgctgcagccaacggtgaacgctagcgccgcacacatcctcaagtacctcgacggctcggccaagaagtatgccaacgccgtgcagtcatacgtggacgtgcgtgatgtagccgacgcgcacatccgcgtgttcgaggcgcccgaggcctcgggccggtacctctgcgccgagcgcgtgctgcaccgtggggacgttgtccaaatcctcagcaaactcttccctgagtaccctgtgccaacaaggtgctctgacgaagtgaacccacggaagcagccttataagatgtccaaccagaagctgcaggatcttggcctccagttcactcctgtgaacgactctctgtatgagaccgtgaagagcctccaggagaagggacacctcctagtaccaagcaaaaatataccagagggattgaacggtgtaacggcatga

SEQ ID NO: 5195 - protein, 344 aa, Lolium perenne
MTVVNTVAQQLPGHGQTVCVTGAAGYIASWLVKLLLERGYTVKGTVRNPDDPKNAHLKALDGAVERLILCKADLLDYDAICAAAEGCHGVFHTASPVTDDPEQMVEPAVRGTEYVINAAADAGTVRRVVFTSSIGAVTMDPNRGPDVVVDESCWSDLEFCKKTKNWYCYGKAVAEQAAWEAARKRGIDLVVVNPVLVVGPLLQPTVNASAAHILKYLDGSAKKYANAVQSYVDVRDVADAHIRVFEAPEASGRYLCAERVLHRGDVVQILSKLFPEYPVPTRCSDEVNPRKQPYKMSNQKLQDLGLQFTPVNDSLYETVKSLQEKGHLLVPSKNIPEGLNGVTA

SEQ ID NO: 5196 - DNA, 1014 bp, Populus tremuloides
  CDS (1)..(1014)
atgcctgttgatgcttcatcactttcaggccaaggccaaacttgtgtcaccggggctggtggtttcattgcttcttggatggttaaacttcttttagataaaggttacactgttagaggaactgcgaggaacccagctgatcccaataattctcatttgagggagcttgaaggagctcaagaaagattaactttatgcaaagctgatcttcttgattatgagtctcttaaagaggctattcaagggtgtgatggtgttttccacactgcttctcccgtcacagatgatccggaagaaatggtggagccagcagtgaacgggaccaaaaatgtgatcattgcggcggctgaggccaaagtccgacgagtggtgttcacgtcctcaattggtgctgtgtacatggatcccaataagggcccagatgttgtcattgatgaatcttgctggagtgatcttgaattctgcaagaacaccaagaattggtattgctatggaaaggctgtggcagaacaagctgcatgggatatggctaaggagaaaggggtggacctagtggtggttaacccagtgctggtgctcggaccattgttccagcccactgtcaatgctagcatcgttcacatcctcaagtacctcaccggctcagccaagacttatgctaactctgttcaagcttatgtgcatgttagggatgtggcactagcccacattttagtctttgagacgccttccgcctctggccgttacctttgctctgagagcgttctccaccgtggagaggtggtggaaattcttgcaaagttcttccccgagtaccccatccctaccaagtgctcagatgagaagaacccaagaaaacaaccttacaagttctcaaaccagaagctaagggatctgggcttcgaattcacccctgtgaagcagtgtctgtatgaaactgttaagagcttgcaggaaaggggtcaccttccaatcccaaaacaagctgcagaagagtctgtgaaaattcaataa

SEQ ID NO: 5197 - protein, 337 aa, Populus tremuloides
MPVDASSLSGQGQTCVTGAGGFIASWMVKLLLDKGYTVRGTARNPADPNNSHLRELEGAQERLTLCKADLLDYESLKEAIQGCDGVFHTASPVTDDPEEMVEPAVNGTKNVIIAAAEAKVRRVVFTSSIGAVYMDPNKGPDVVIDESCWSDLEFCKNTKNWYCYGKAVAEQAAWDMAKEKGVDLVVVNPVLVLGPLFQPTVNASIVHILKYLTGSAKTYANSVQAYVHVRDVALAHILVFETPSASGRYLCSESVLHRGEVVEILAKFFPEYPIPTKCSDEKNPRKQPYKFSNQKLRDLGFEFTPVKQCLYETVKSLQERGHLPIPKQAAEESVKIQ

SEQ ID NO: 5198 - DNA, 963 bp, Arabidopsis thaliana
  CDS (1)..(963)
atggctgtaaagcaaaaggtctgtgttactggtgcaggagggtttattgcttcatggctcgtcaagtttcttctctctcgtggctacactgtccatggaaccgttcgagatccttgtgatgaaaagaatgaccatttgaggaaactggataatgcttcaaaaaatctgaaacttttcaaggcagatttgtttgatgatgaaggtcttttctcagccattgatggttgctctggcgttttccatatcgcttctcctgtgccttttgaaggagaagaactgattaaaccagctctcactggcaccaagaatgttctagaagcatgcacagaaaccaaagtgcagaaagttgtggttgtatcatcaatcgctgcagttgtttacaatccaaaatggcctcaagatgttgctaaggacgaggattgttggtcagacactcaataccttcactcacttgagggttattggcgttattactatcttgccaaaacattaacggaacgtgaagctttagagtggagtaagagaaactttgctgatgttgttacgctctgtccgtctgtcattataggccctaggcttcaatccacgcttaactctagtagtttgggacttctcaagttcataaaaggtggtataaagtccttgttgagcgatgaactgtatcttgtggatgtgcgtgatgttgcggatgcgcttttgttggtgtatgaaaatcgagaagcaacaggaagatacatatgtaattctcattcactttacactgattctcttatggagaagctcaagaatatgtatcctaaacgcaacttccctgaaagtttcacggaggtaaaagagaaggaagtgaggcctctaagtgcagagaagttgaaaaacttggggtggaagtttaggccattagaagaaaccattgatgattctgttgtgagctttgaagcagctggtgatcttccaaaggcataa

SEQ ID NO: 5199 - protein, 320 aa, Arabidopsis thaliana
MAVKQKVCVTGAGGFIASWLVKFLLSRGYTVHGTVRDPCDEKNDHLRKLDNASKNLKLFKADLFDDEGLFSAIDGCSGVFHIASPVPFEGEELIKPALTGTKNVLEACTETKVQKVVVVSSIAAVVYNPKWPQDVAKDEDCWSDTQYLHSLEGYWRYYYLAKTLTEREALEWSKRNFADVVTLCPSVIIGPRLQSTLNSSSLGLLKFIKGGIKSLLSDELYLVDVRDVADALLLVYENREATGRYICNSHSLYTDSLMEKLKNMYPKRNFPESFTEVKEKEVRPLSAEKLKNLGWKFRPLEETIDDSVVSFEAAGDLPKA

SEQ ID NO: 5200 - DNA, 978 bp, Vigna radiata
  CDS (1)..(978)
atgagcaccgccgctggaaaactagtctgtgtcaccggcgcttccggttacatcgcttcctggctcgtcaagtttcttctcgaacgcggctacaccgtgaaggccaccgttcgcgacacgaatgatcccaaaaaggtagatcacttgctcagccttgatggtgcgaaggagagattgcatctcgtgaaggcgaatcttctagaagaaggttcctttgactctgccgttgaaggtgttcacgctgtgtttcacactgcttctccctttttcaacgatgccaaagatccgcagactgagttgttggacccggcagtgaaggggactctgaatgttctgaaatcgtgtgtgaactcgcccacgctgaaacgcgtcgttttaacttcttctattgctgcagttgcgttcagcgacaggcctaaaaaccctgatgttgtggttgacgagacttggtattctgacccggaatactgtaagagaacagggttatggtataacctttcaaagactctggccgaagatgctgcctggaaatttgcgaaagaaaacaacattgacctggttacaatgaacccagcattggttgttggacctctcttgcaaccagtgcttaatactagcgctgctatagttttaggtttagttaatggggcgaaaacatttaaaaatgcttctttgggatgggtcgacgtgaaagatgttgcattggcccatattctagcatatgagaatgcttcggctaatggaagatatttactagttgagagagtagcacactttggagatgctgccaagattttacgagatttatacccaacattgcaaattccagacaagtgtgaagacgataagccattagaaccaatatttcaggtttcgaaggaaaaagcaaagagcttggggattgactatattcctttggaagtgagcctcaaggacactgtggagagcttgaaggaaaagaagtttctgaaagtttaa

SEQ ID NO: 5201 - protein, 325 aa, Vigna radiata
MSTAAGKLVCVTGASGYIASWLVKFLLERGYTVKATVRDTNDPKKVDHLLSLDGAKERLHLVKANLLEEGSFDSAVEGVHAVFHTASPFFNDAKDPQTELLDPAVKGTLNVLKSCVNSPTLKRVVLTSSIAAVAFSDRPKNPDVVVDETWYSDPEYCKRTGLWYNLSKTLAEDAAWKFAKENNIDLVTMNPALVVGPLLQPVLNTSAAIVLGLVNGAKTFKNASLGWVDVKDVALAHILAYENASANGRYLLVERVAHFGDAAKILRDLYPTLQIPDKCEDDKPLEPIFQVSKEKAKSLGIDYIPLEVSLKDTVESLKEKKFLKV

SEQ ID NO: 5202 - DNA, 1017 bp, Zygosaccharomyces rouxii
  CDS (1)..(1017)
atgacaaaagtcttcgtaacaggtgccaacggattcgttgctcaacacgtcgttcatcaactattagaaaagaactatacagtggttggatctgtccgttcaactgagaaaggtgataaattagctaaattgctaaacaatccaaaattttcatatgagattattaaagatatggtcaattcgagagatgaattcgataaggctttacaaaaacattcagatgttgaaattgtcttacatactgcttcaccagtcttcccaggtggtattaaagatgttgaaaaagaaatgatccaaccagctgttaatggtactagaaatgtcttgttatcaatcaaggataacttaccaaatgtcaagagatttgtttacacttcttcattagctgctgtccgtactgaaggtgctggttatagtgcagacgaagttgtcaccgaagattcttggaacaatattgcattgaaagatgccaccaaggatgaaggtacagcttatgaggcttccaagacatatggtgaaaaagaagtttggaatttcttcgaaaaaactaaaaatgttaatttcgattttgccatcatcaacccagtttatgtctttggtcctcaattatttgaagaatacgttactgataaattgaacttttccagtgaaatcattaatagtataataaaaggtgaaaagaaggaaattgaaggttatgaaattgatgttagagatattgcaagagctcatatctctgctgttgaaaatccagcaactacacgtcaaagattaattccagcagttgcaccatacaatcaacaaactatcttggatgttttgaatgaaaacttcccagaattgaaaggtaaaatcgatgttgggaaaccaggttctcaaaatgaatttattaaaaaatattataaattagataactcaaagaccaaaaaagttttaggttttgaattcatttcccaagagcaaacaatcaaagatgctgctgctcaaatcttgtccgttaaaaatggaaaaaaataa

SEQ ID NO: 5203 - protein, 338 aa, Zygosaccharomyces rouxii
MTKVFVTGANGFVAQHVVHQLLEKNYTVVGSVRSTEKGDKLAKLLNNPKFSYEIIKDMVNSRDEFDKALQKHSDVEIVLHTASPVFPGGIKDVEKEMIQPAVNGTRNVLLSIKDNLPNVKRFVYTSSLAAVRTEGAGYSADEVVTEDSWNNIALKDATKDEGTAYEASKTYGEKEVWNFFEKTKNVNFDFAIINPVYVFGPQLFEEYVTDKLNFSSEIINSIIKGEKKEIEGYEIDVRDIARAHISAVENPATTRQRLIPAVAPYNQQTILDVLNENFPELKGKIDVGKPGSQNEFIKKYYKLDNSKTKKVLGFEFISQEQTIKDAAAQILSVKNGKK

SEQ ID NO: 5204 - DNA, 1047 bp, Malus domestica
  CDS (1)..(1047)
atgggatccgagtccgaatccgtttgtgtcaccggggcgtccggtttcatcggctcttggctcgtcatgagactcctagagcacgggtacaccgtccgcgccaccgtgcgtgaccccacgaatcagaagaaggtgaagcatctgttggacttgccgaaggcggagacgcacctgacgctgtggaaggcggacttggcggatgagggaagctttgatgaagccatacaaggctgcagcggagtgttccatgttgctacacctatggactttgaatccaaggaccccgagaatgaagtgatcaagcccacaatcaatggactgttggacatcctgaaggcatgccagaaagcaaaaacagttcgaaagcttgtgttcacatcctcagcaggaaccgtgaatgtggaggagcatcaaaagccggtctacgacgagtccaactggagtgacgttgaattttgccgctccgtcaagatgactggttggatgtacttcgtctccaagactctagctgagcaagctgcatggaaatatgccaaagaaaacaacattgatttcatcaccattatcccaactcttgtgattgggccatttctcatgccatccatgccaccaagcctcatcactggactttcgccgatcttaagaaatgaatcacattatggcatcatcaagcagggccagtatgttcacttggacgacctctgcctttctcacatttatctttacgagcatccgaaagccgaaggccgttacatttgttcgtcacatgatgctacaattcacgaacttgtaaaaatgctcagagaaaaataccccgaatacaatatacccacaaagttcaagggcatcgacgacaacttagaaccagttcatttttcttcaaagaagttgagggagatagggtttgagttcaagtacagcttggaggacatgtttgtgggggctgtcgatgcgtgccgggcaaagggcttgattccgattccgattccggcagagaaaactgaggctgctgaggagagcaacctcgttgatgtcaaagttggttaa

SEQ ID NO: 5205 - protein, 348 aa, Malus domestica
MGSESESVCVTGASGFIGSWLVMRLLEHGYTVRATVRDPTNQKKVKHLLDLPKAETHLTLWKADLADEGSFDEAIQGCSGVFHVATPMDFESKDPENEVIKPTINGLLDILKACQKAKTVRKLVFTSSAGTVNVEEHQKPVYDESNWSDVEFCRSVKMTGWMYFVSKTLAEQAAWKYAKENNIDFITIIPTLVIGPFLMPSMPPSLITGLSPILRNESHYGIIKQGQYVHLDDLCLSHIYLYEHPKAEGRYICSSHDATIHELVKMLREKYPEYNIPTKFKGIDDNLEPVHFSSKKLREIGFEFKYSLEDMFVGAVDACRAKGLIPIPIPAEKTEAAEESNLVDVKVG

SEQ ID NO: 5206 - DNA, 993 bp, Oryza sativa
  CDS (1)..(993)
atggtgatctcatccaagggcaaagtgtgtgtaactggtgcttcaggcttcgtcgcctcttggctcatcaagaggcttcttgaggcgggctatcatgtgataggaactgtgagagacccaagcaatcgcgagaaagtgtcacacctttggagattaccaagtgcaaaggagaggctgcaacttgtgagagctgatctgatggaagaagggagctttgacgatgctgtgatggcttgcgaaggcgtcttccacactgcatctcctgtccttgccaaatctgattccaattgcaaggaagaaatgcttgttcctgcgataaatggtactctgaatgtgctgaaatcttgcaagaagaatccatttctgaaaagggttgttcttacatcctcatcatccacggtaagaatcatggatgagagtaaacatccagaaatctcactggatgaaacaatatggagctctgtggcactctgtgaaaagctacagctatggtatgccctggcaaagatatctgcagagaaagcggcatgggagtttgccaaggagaacaacattgaccttgtaactgttcttccatcatttgtgattgggcccagtttatcacatgaactgtctgtcactgcttcagacatccttggcttacttcaaggtgacacagatagattcatctcgtatgggagaatgggatatgttcacatcgacgatgtggcgagctgccacattctggtgtacgaagcacctcaggctactgggagatatctctgcaactccgttgttcttgacaacaacgaattagtcgccttgcttgcgaagcaatttccaatttttcccatcccaaggagcttgaggaacccatatgagaaacagtcatatgagctaaacacatccaagatccagcagctgggtttcaagttcaaaggggtgcaagagatgtttggtgattgtgtcgagtcgctgaaagatcagggacacttgctggagtgcccgttgtaa

SEQ ID NO: 5207 - protein, 330 aa, Oryza sativa
MVISSKGKVCVTGASGFVASWLIKRLLEAGYHVIGTVRDPSNREKVSHLWRLPSAKERLQLVRADLMEEGSFDDAVMACEGVFHTASPVLAKSDSNCKEEMLVPAINGTLNVLKSCKKNPFLKRVVLTSSSSTVRIMDESKHPEISLDETIWSSVALCEKLQLWYALAKISAEKAAWEFAKENNIDLVTVLPSFVIGPSLSHELSVTASDILGLLQGDTDRFISYGRMGYVHIDDVASCHILVYEAPQATGRYLCNSVVLDNNELVALLAKQFPIFPIPRSLRNPYEKQSYELNTSKIQQLGFKFKGVQEMFGDCVESLKDQGHLLECPL

SEQ ID NO: 5208 - DNA, 1014 bp, Vitis vinifera
  CDS (1)..(1014)
atgggttcacaaagtgaaaccgtgtgcgtcaccggtgcctccggtttcatcggttcatggctggtcatgaggctcctggagcgccggctcactgttcgggccaccgttcgcgatccaactaacgtgaaaaaagtgaagcatttgctggacttgcccaaagcggagacgcatctgactctctggaaggcagatcttgctgatgaaggaagtttcgatgaagctattaaaggctgcaccggcgtcttccatgttgccacacccatggattttgaatcgaaggatcctgagaatgaagtgataaagccaactattgaagggatgttgggcataatgaaatcgtgtgctgccgcaaagactgtcagaaggcttgtattcacatcctccgcaggaactgtgaacattcaagaacaccaactgccagtgtacgatgaaagctgctggagtgatatggaattttgccgggctaaaaagatgactgcatggatgtactttgtctccaagacactggctgagcaagctgcatggaagtatgccaaggaaaataacattgacttcatcactatcataccgactcttgtggttggccccttcataatgtcatcaatgcctccaagcctcataactgctctttccccgatcactggaaacgaagctcattattcaattatacggcagggccaatttgttcacctggatgacctctgcaatgctcatatttacttgtttgagaatcctaaggcagagggacgttacatttgctcctcccacgattgtatcattctcgatcttgcaaaaatgcttagagaaaaataccccgagtataatatccccacagagttcaaaggtgttgatgagaacttgaagagtgtctgtttctcctccaagaagctgacagatttggggtttgagtttaaatacagcttagaggacatgtttactggagctgtggacacatgccgggccaagggattgcttcgcccttcacatgagaaacctgtagatggcaagacctag

SEQ ID NO: 5209 - protein, 337 aa, Vitis vinifera
MGSQSETVCVTGASGFIGSWLVMRLLERRLTVRATVRDPTNVKKVKHLLDLPKAETHLTLWKADLADEGSFDEAIKGCTGVFHVATPMDFESKDPENEVIKPTIEGMLGIMKSCAAAKTVRRLVFTSSAGTVNIQEHQLPVYDESCWSDMEFCRAKKMTAWMYFVSKTLAEQAAWKYAKENNIDFITIIPTLVVGPFIMSSMPPSLITALSPITGNEAHYSIIRQGQFVHLDDLCNAHIYLFENPKAEGRYICSSHDCIILDLAKMLREKYPEYNIPTEFKGVDENLKSVCFSSKKLTDLGFEFKYSLEDMFTGAVDTCRAKGLLRPSHEKPVDGKT

SEQ ID NO: 5210 - DNA, 1029 bp, Saccharomyces cerevisiae
  CDS (1)..(1029)
atgtcagttttcgtttcaggtgctaacgggttcattgcccaacacattgtcgatctcctgttgaaggaagactataaggtcatcggttctgccagaagtcaagaaaaggccgagaatttaacggaggcctttggtaacaacccaaaattctccatggaagttgtcccagacatatctaagctggacgcatttgaccatgttttccaaaagcacggcaaggatatcaagatagttctacatacggcctctccattctgctttgatatcactgacagtgaacgcgatttattaattcctgctgtgaacggtgttaagggaattctccactcaattaaaaaatacgccgctgattctgtagaacgtgtagttctcacctcttcttatgcagctgtgttcgatatggcaaaagaaaacgataagtctttaacatttaacgaagaatcctggaacccagctacctgggagagttgccaaagtgacccagttaacgcctactgtggttctaagaagtttgctgaaaaagcagcttgggaatttctagaggagaatagagactctgtaaaattcgaattaactgccgttaacccagtttacgtttttggtccgcaaatgtttgacaaagatgtgaaaaaacacttgaacacatcttgcgaactcgtcaacagcttgatgcatttatcaccagaggacaagataccggaactatttggtggatacattgatgttcgtgatgttgcaaaggctcatttagttgccttccaaaagagggaaacaattggtcaaagactaatcgtatcggaggccagatttactatgcaggatgttctcgatatccttaacgaagacttccctgttctaaaaggcaatattccagtggggaaaccaggttctggtgctacccataacacccttggtgctactcttgataataaaaagagtaagaaattgttaggtttcaagttcaggaacttgaaagagaccattgacgacactgcctcccaaattttaaaatttgagggcagaatataa

SEQ ID NO: 5211 - protein, 342 aa, Saccharomyces cerevisiae
MSVFVSGANGFIAQHIVDLLLKEDYKVIGSARSQEKAENLTEAFGNNPKFSMEVVPDISKLDAFDHVFQKHGKDIKIVLHTASPFCFDITDSERDLLIPAVNGVKGILHSIKKYAADSVERVVLTSSYAAVFDMAKENDKSLTFNEESWNPATWESCQSDPVNAYCGSKKFAEKAAWEFLEENRDSVKFELTAVNPVYVFGPQMFDKDVKKHLNTSCELVNSLMHLSPEDKIPELFGGYIDVRDVAKAHLVAFQKRETIGQRLIVSEARFTMQDVLDILNEDFPVLKGNIPVGKPGSGATHNTLGATLDNKKSKKLLGFKFRNLKETIDDTASQILKFEGRI

SEQ ID NO: 5212 - DNA, 1044 bp, Saccharomyces cerevisiae
  CDS (1)..(1044)
atgactactgataccactgttttcgtttctggcgcaaccggtttcattgctctacacattatgaacgatctgttgaaagctggctatacagtcatcggctcaggtagatctcaagaaaaaaatgatggcttgctcaaaaaatttaataacaatcccaaactatcgatggaaattgtggaagatattgctgctccaaacgcctttgatgaagttttcaaaaaacatggtaaggaaattaagattgtgctacacactgcctccccattccattttgaaactaccaattttgaaaaggatttactaacccctgcagtgaacggtacaaaatctatcttggaagcgattaaaaaatatgctgcagacactgttgaaaaagttattgttacttcgtctactgctgctctggtgacacctacagacatgaacaaaggagatttggtgatcacggaggagagttggaataaggatacatgggacagttgtcaagccaacgccgttgccgcatattgtggctcgaaaaagtttgctgaaaaaactgcttgggaatttcttaaagaaaacaagtctagtgtcaaattcacactatccactatcaatccgggattcgtttttggtcctcaaatgtttgcagattcgctaaaacatggcataaatacctcctcagggatcgtatctgagttaattcattccaaggtaggtggagaattttataattactgtggcccatttattgacgtgcgtgacgtttctaaagcccacctagttgcaattgaaaaaccagaatgtaccggccaaagattagtattgagtgaaggtttattctgctgtcaagaaatcgttgacatcttgaacgaggaattccctcaattaaagggcaagatagctacaggtgaacctgcgaccggtccaagctttttagaaaaaaactcttgcaagtttgacaattctaagacaaaaaaactactgggattccagttttacaatttaaaggattgcatagttgacaccgcggcgcaaatgttagaagttcaaaatgaagcctaa

SEQ ID NO: 5213 - protein, 347 aa, Saccharomyces cerevisiae
MTTDTTVFVSGATGFIALHIMNDLLKAGYTVIGSGRSQEKNDGLLKKFNNNPKLSMEIVEDIAAPNAFDEVFKKHGKEIKIVLHTASPFHFETTNFEKDLLTPAVNGTKSILEAIKKYAADTVEKVIVTSSTAALVTPTDMNKGDLVITEESWNKDTWDSCQANAVAAYCGSKKFAEKTAWEFLKENKSSVKFTLSTINPGFVFGPQMFADSLKHGINTSSGIVSELIHSKVGGEFYNYCGPFIDVRDVSKAHLVAIEKPECTGQRLVLSEGLFCCQEIVDILNEEFPQLKGKIATGEPATGPSFLEKNSCKFDNSKTKKLLGFQFYNLKDCIVDTAAQMLEVQNEA

SEQ ID NO: 5214 - DNA, 1120 bp, Brassica napus
  CDS (75)..(1061)
cttaccttcagcatggtggatacacatgttatataaactattcgggtgtgataccatcgttaccagccagtaaaatggataaaccaaaaggaaaagtttgtgtgactggagcttcaggcttcttagcttcttggcttgttaagaggcttctccttgagggatatgaagttatcggaacagtcagagatccaggaaatgagaagaagcttgcgcaccttcggaagttggaaggggcaaaggagagactaaggttggtgaaggcagatctaatggaagatggaagttttgataaagccataatgggatgccaaggagttttccatactgcttctcctgttctcaaacctacctctaatccagaggaggagattttgaaaccagctatagagggcacactgaatgtactgagatcatgcgggaagaatcagtctttgaagcgtgtggtcctcacctcctcctcctcaacagtaaggatcagagatgattttaatcctaatatacctcttgacgaatctgtttggacctctttggaactctgcaagcgttttcaggtctggtatgcattatcaaagacattagccgagcaagctgcatggaaattctgtgaagaaaatagtattgaccttgtcactgttctaccatcgttcctcgttggacccagcctgcctcctgatctgtgttctacagcatctgatgtcctcggattgctgaaaggagaaacagagaaatttcaatggcatggacagatggggtacgttcatatcgatgacgtggcaagagcccacatcctcgttttcgaacacgaagcagccggggacagatatatttgcagctctaacgttgtcagtctagaggaactggtgtccttcctctccgcacgttacccatcactccctatccccaagagatttgagaagctaaacaggctgcattacgactttgacacatcgaagataaagagcctcgggctcaagttcaagtcccttgaagagatgttcgatgactgcattgcctcttttgtagagaaaggctatttatctcatgtcgttacatcacaataaatatcaataaaagtgtagacaaaggtaaagaagaatgatcttacaaaaaaaaaaaaaaa

SEQ ID NO: 5215 - protein, 328 aa, Brassica napus
MDKPKGKVCVTGASGFLASWLVKRLLLEGYEVIGTVRDPGNEKKLAHLRKLEGAKERLRLVKADLMEDGSFDKAIMGCQGVFHTASPVLKPTSNPEEEILKPAIEGTLNVLRSCGKNQSLKRVVLTSSSSTVRIRDDFNPNIPLDESVWTSLELCKRFQVWYALSKTLAEQAAWKFCEENSIDLVTVLPSFLVGPSLPPDLCSTASDVLGLLKGETEKFQWHGQMGYVHIDDVARAHILVFEHEAAGDRYICSSNVVSLEELVSFLSARYPSLPIPKRFEKLNRLHYDFDTSKIKSLGLKFKSLEEMFDDCIASFVEKGYLSHVVTSQ

SEQ ID NO: 5216 - DNA, 999 bp, Brassica napus
  CDS (1)..(999)
atgcctgccgacgggaaacttgtttgcgtcactggagccggtggctacattgcttcttggatcgttaagttactcttggagagaggctacaccgttagaggaaccgtgcggaacccagctgatcccaagaacaaccacctcagagagctcgatggagccaaagaaagactcactcttcacagtgctgatcttctcgactacgaagctctttgtgccgcaatagatggctgcgatggcgttttccacaccgcttctccgatgaccgatgaccccgagacaatgttggaaccggcggtgaacggagccaagttcgtgatcgacgcggcggctaaagccaaggtgaagcgtgtggtgttcacgtcatctatcggtgctgtttacatgaaccctaaccgtgaccctcaaaccatagtcaacgaagattgttggagtgatcttgatttctgcaaaaacacaaagaattggtattgctatgggaagatggtggcggaacaatcagcatgggagacggcgaaggctaaaggtgtggacttggtggtgctaaacccggttctagttcttggaccaccgctccagtcagcggtcaacgctagcctagtccatattctcaagtatctcaccggctcagccaagacctatgctaaccttactcaggtctacgtggacgtccgtgatgtggcactaggccatgttatggtctacgaatcatcctctgcctcaggccgttacatcctcgccgagaccgcgcttcaccgcggcgaggttgtcgagattcttgctaaattcttcccggagtatccacttcccaccaagtgttcggacgataagaatccaagggcaaagccatacaagttcactactcagaagataaaagacttagggttggagtttacacccatcaagcaatctctctacgattctgtcaagagcttgcaagagaaaggtcatcttcctcttcctcaatattccaaccaagacaacgtcacaatcgaatcctag

SEQ ID NO: 5217 - protein, 332 aa, Brassica napus
MPADGKLVCVTGAGGYIASWIVKLLLERGYTVRGTVRNPADPKNNHLRELDGAKERLTLHSADLLDYEALCAAIDGCDGVFHTASPMTDDPETMLEPAVNGAKFVIDAAAKAKVKRVVFTSSIGAVYMNPNRDPQTIVNEDCWSDLDFCKNTKNWYCYGKMVAEQSAWETAKAKGVDLVVLNPVLVLGPPLQSAVNASLVHILKYLTGSAKTYANLTQVYVDVRDVALGHVMVYESSSASGRYILAETALHRGEVVEILAKFFPEYPLPTKCSDDKNPRAKPYKFTTQKIKDLGLEFTPIKQSLYDSVKSLQEKGHLPLPQYSNQDNVTIES

SEQ ID NO: 5218 - DNA, 1038 bp, Brassica napus
  CDS (1)..(1038)
atggcaaccgttgatcagaccgctgtaaccaccggaactaagaaggcttgtgtcatcggtggcacaggaaacttagcctctattctgatcaagcatttgcttcaaagcggctacaaagttaacaccacagttagagatccagagaatgagaagaaaatggctcaccttaaggtacttcaacagctcggggacctcaagatcttcaaggcggatttaacggatgaagggagtttcacttcaccaatctcgggctgtgaatatgtgttccatgtcgcaacaccaatcagctttacatctcaagatcccgagaaagacatgatcaaaccagcggtacaaggagtgatcaacgtgttgaaatcttgcttaaaatcgaactcaatcaagcgcgtgatctacacttcttcagctgctgcggtttctatcaacaacctttcggaacctggacttgtgatgaccgaagaaaactggtctgacgttgattttctcacaaaggagaagccgtttaactggggttacccagtctcaaagactttagcagaaaaggaagcttataaatttgcggaagagaataagattgatctcgttactgtggttccagcactcatagccggaaactctctcctctctgatcctccgagcagtttatctctctcgatgtctttaatcactgggaaagaaatgcatctgagcggtctcaaggaaatgcagaagctatctggatccatctcgttcatccacgtggacgacctagctcgtgcacatatgtttcttgcggagaaagaaacagcttctggtcgctacatttgctgttattacaacacaaatgttccagagattgcggattttctcaggcgaagatatactaagtacaatgttttgtcagaatttgaagagtgcttatcaagtgcgaaactgacgctatcctcggaaaaactcatcaaggaaggctttcgatttgaatatgggatcagtgagatgtatgatgagatgacggagtacttcgagtcaaaaggattgatcaaacctaaagtatcttga

SEQ ID NO: 5219 - protein, 345 aa, Brassica napus
MATVDQTAVTTGTKKACVIGGTGNLASILIKHLLQSGYKVNTTVRDPENEKKMAHLKVLQQLGDLKIFKADLTDEGSFTSPISGCEYVFHVATPISFTSQDPEKDMIKPAVQGVINVLKSCLKSNSIKRVIYTSSAAAVSINNLSEPGLVMTEENWSDVDFLTKEKPFNWGYPVSKTLAEKEAYKFAEENKIDLVTVVPALIAGNSLLSDPPSSLSLSMSLITGKEMHLSGLKEMQKLSGSISFIHVDDLARAHMFLAEKETASGRYICCYYNTNVPEIADFLRRRYTKYNVLSEFEECLSSAKLTLSSEKLIKEGFRFEYGISEMYDEMTEYFESKGLIKPKVS

SEQ ID NO: 5220 - DNA, 960 bp, Glycine max
  CDS (1)..(960)
atgcctgagttttgcgtgacaggtggtactgggttcatcgcatcttacctggtcaaggccttactagagaagggtcacacagtgaggaccaccgtgagaaacccaggggatgtggagaaggttggttttctgactgaactaagtggagccaaagagagactgaagattttgaaagcagatctattagtggaaggaagctttgatgaggcagtgagaggagttgatggtgtctttcatatggcgtcccctgtgcttattccttatgatgagaacgttcagcaaaatttgattgatccctgtataaaaggaactttgaatgtgcttaactcttgtgtaaaagcaactgtgaaacattttgtgctcacctcttcttgctcttccataagataccgtgatgatgtgcaagaagtgtgtcctcttaatgaatctcattggactgatctagagtattgcaaacgctataagctgtggtatgcatatgcaaagacaatagcagaaagagaggcttggaggattgcaaaagaaaatggcatggatctagtggtggttaatccctcttttgttgttggtcctctgcttgcaccacaaccaactagcacactgctcttgatactaagcattgtcaaaggcatgaagggagaatatccaaatacaacagtggggtttgtacacataaacgatgtggtagctgctcacttgctggctatggaggaccccaaggcatctggaaggcttatttgttcaagcacagtagctcactggtcgcaaatcattgaaatgcttcgtgccaaatacccttcctatccgtacgaaaacgagtgtagcagccaggaaggagataataacccgcacagcatggacactaccaaaattactcagttggggtttcctccattcaaaactcttgaacaaatgtttgatgactgcatcaaaagttttcaagacaagggcttcctatga

SEQ ID NO: 5221 - protein, 319 aa, Glycine max
MPEFCVTGGTGFIASYLVKALLEKGHTVRTTVRNPGDVEKVGFLTELSGAKERLKILKADLLVEGSFDEAVRGVDGVFHMASPVLIPYDENVQQNLIDPCIKGTLNVLNSCVKATVKHFVLTSSCSSIRYRDDVQEVCPLNESHWTDLEYCKRYKLWYAYAKTIAEREAWRIAKENGMDLVVVNPSFVVGPLLAPQPTSTLLLILSIVKGMKGEYPNTTVGFVHINDVVAAHLLAMEDPKASGRLICSSTVAHWSQIIEMLRAKYPSYPYENECSSQEGDNNPHSMDTTKITQLGFPPFKTLEQMFDDCIKSFQDKGFL

SEQ ID NO: 5222 - DNA, 1247 bp, Brassica napus
  CDS (37)..(942)
cacaaaccgaagcatatactttcgaccgctggaaaaatgccactcgccgaatcctcaccggccgggaaaaccgtgtgcgtcaccggagctggtggatacatagcttcttggattgttaagttactcctcgagagaggctacaccgtcaaaggaaccgtacggaatccagatgatccaaagaatacacatttgagagaactcgaaggagccaaggagagactgattctgtgcaaggcagatcttcaggactacgaggctcttaaaacggcgattgatggctgcgacggcgtgtttcacacggcttctccggtcactgacgatcccgagcaaatggtggaacctgccgtgaacggagccaagttcgtaattaatgcggctgctgaagcaaaggtcaagcgcgtggtcatcacctcctcaattggtgccgtctacatggacccgaaccgtgaccctgaagccgtcgttgacgaaagttgttggagtgatcttgagttttgcaaaaacacaaagaactggtattgttacggcaagatggtggcggagcaagccgcgtgggagacggcgaaggagaaaggtgttgacctggtggttttgaatccggtgctggttcttggaccgccgttacagccgacgatcaacgccagtctcttccatgtcctcaagtacctaaccgggtcagctaagacttatgctaatttgactcaggcttatgtggatgttcgcgatgtcgcgctggctcatgtactggtctacgaggcacccacggcctctggacgttatctcctcgccgaaagcgcccttcaccgaggcgaagttgttgagattctggctaagttattcccggagtacccacttccaaccaaattttccttcgcccaagtcaaccagtcacacaaccgtatatcagggttcaggttatcttcaatgtggcgcaccccctgaggatgtcaaaaaaggttcatcatatcattatcaagcattgtggtccaaatataattcatgtatattatatacttggcacccatgcaccaataacgcgtagtaaccacatagttttccacttctttagatataaagaacaaaaagaaatgaaatatgtagctattaagagaatgacctgtctcaaccctcaagtactcttctttgttaacagcattatttcgattatttttgtgtaagactttatgttatacagttacatgtatggcacacgtgctcattattcaaaaaagaaaaaaaaaaaaaaa

SEQ ID NO: 5223 - protein, 301 aa, Brassica napus
MPLAESSPAGKTVCVTGAGGYIASWIVKLLLERGYTVKGTVRNPDDPKNTHLRELEGAKERLILCKADLQDYEALKTAIDGCDGVFHTASPVTDDPEQMVEPAVNGAKFVINAAAEAKVKRVVITSSIGAVYMDPNRDPEAVVDESCWSDLEFCKNTKNWYCYGKMVAEQAAWETAKEKGVDLVVLNPVLVLGPPLQPTINASLFHVLKYLTGSAKTYANLTQAYVDVRDVALAHVLVYEAPTASGRYLLAESALHRGEVVEILAKLFPEYPLPTKFSFAQVNQSHNRISGFRLSSMWRTP

SEQ ID NO: 5224 - DNA, 966 bp, Glycine max
  CDS (1)..(966)
atgtcgaaggtggtttgtgtcaccggagccagtggcgccattggatcatgggtggccctcctcctcctccagcgtggttatacggtccatgccaccgtccaagacatcaaggatgaaaatgagacgaaacatttggaggaaatggaaggagcaaagagtcgtctccatttttttgaaatggatcttcttgacatcgactccattgccgctgccataaagggttgctccggcgtaatccacctcgcatgtcctaacatcatcggtcatgtcgaagatcctgagaagcagatactggagccggcgataaaaggaacaattaatgtgttgaaggcggcgaaggaagcgggggtggagcgcgtggtggcgacttcgtcgatctcatccattatgccaagccctaactggccagctgataagattaaggcagaagagtgttggacagaccttgaatactgcaaacagaaggggttgtactatcccattgcaaagactctagcagagaaagcgggttgggaatttgcaaaggagacaggttttgatgttgtcatgataaaccctggtacagctttgggccctctgcttccaccaagaatcaattcaagcatggaaatgcttgttagtgttctcaaagggggcaaagagacgtacgaggacttctttatgggaatggctcacttcaaagacatagcattggcacatattttggcacttgagaacaagaaagcagcaggaaggcacttgtgtgtggaatctattcgtcactttagtgatcttgtggacaaggtttctgagttataccctgaatacgatgtggtcaagttgccaaaggatacccagccagggttgttgagggcaagtacaaaggatgcatcaacaaagctgattgatttaggtctagagttcactcctgtagaccaaatcatcaaggatgcagtggagagtctgaagagcaagggctatgtctga

SEQ ID NO: 5225 - protein, 321 aa, Glycine max
MSKVVCVTGASGAIGSWVALLLLQRGYTVHATVQDIKDENETKHLEEMEGAKSRLHFFEMDLLDIDSIAAAIKGCSGVIHLACPNIIGHVEDPEKQILEPAIKGTINVLKAAKEAGVERVVATSSISSIMPSPNWPADKIKAEECWTDLEYCKQKGLYYPIAKTLAEKAGWEFAKETGFDVVMINPGTALGPLLPPRINSSMEMLVSVLKGGKETYEDFFMGMAHFKDIALAHILALENKKAAGRHLCVESIRHFSDLVDKVSELYPEYDVVKLPKDTQPGLLRASTKDASTKLIDLGLEFTPVDQIIKDAVESLKSKGYV

SEQ ID NO: 5226 - DNA, 1251 bp, Glycine max
  CDS (36)..(1046)
ccgttctactttcccttcccaacaacaacaagaagatgccttctgcagaagcttcctccgaaaccatttgtgtcaccggcgctggtggcttcatcgcctcttggatggtcaaactcctcttggaaaaaggctacactgtccgaggaaccctcagaaatccagatgatcccaagaacgggcacttgaaggagtttgaaggagcctccgagaggttaactctgcataaggttgacctccttcatcttgactccgttagatcagttattaacggttgccatggtgtctttcacactgcttctcccgtcaccgataaccccgaagaaatggtggagccagcggtgagtggagctaagaatgtgatcatagctgctgcagaggctaaagttagacgtgtggtgttcacctcatccattggtgccgtctatatggaccccagtaggagcatcgatttggtggttgacgagtcctgttggagtgatttggaatattgcaagaacaccaagaattggtattgctatgggaaggctgtggctgaacaagcagcatgggacacagcaaaagagaatggggtggacttggttgtagtgaacccagttttggttcttggaccattactgcagcccacaatcaatgctagtacaattcacatcctcaagtacctcactggctctgctaagacctatgcaaatgccacacaggcttatgtgcatgttagggatgtggcattggcccacatacttgtttatgagaagccttctgcctctggtagatacctatgtgccgaaagctccctccaccgtggagaattagttgaaattctcgccaagtatttcccggagtacccagttcccaccaagtgttcagatgaaaagaatccgagagcaaaaccctacactttttcaaatcaaaagctgaaagatttgggattggaattcactccagtgagtcagtgtctatatgaaacagtgaagagcctgcaggagaaaggccaccttccagttcctgcaaagcagcaggaagaagattcaactaccgtgaaatcctaaatgagcagctagttgtccactaaggcaagaagctgcagcttgtggcaatctgtgctcatcttatatattataatagagaatcctacattagaagactgctgtatttggattttgttaaaaagacatcaactaaattgttgccgtgtatgaacttataatattaatgaaatttattcccctcgttgagttgaaaaaaaaaaaaaaa

SEQ ID NO: 5227 - protein, 336 aa, Glycine max
MPSAEASSETICVTGAGGFIASWMVKLLLEKGYTVRGTLRNPDDPKNGHLKEFEGASERLTLHKVDLLHLDSVRSVINGCHGVFHTASPVTDNPEEMVEPAVSGAKNVIIAAAEAKVRRVVFTSSIGAVYMDPSRSIDLVVDESCWSDLEYCKNTKNWYCYGKAVAEQAAWDTAKENGVDLVVVNPVLVLGPLLQPTINASTIHILKYLTGSAKTYANATQAYVHVRDVALAHILVYEKPSASGRYLCAESSLHRGELVEILAKYFPEYPVPTKCSDEKNPRAKPYTFSNQKLKDLGLEFTPVSQCLYETVKSLQEKGHLPVPAKQQEEDSTTVKS

SEQ ID NO: 5228 - DNA, 966 bp, Glycine max
  CDS (1)..(966)
atggcagcaaagaaggtgtgtgtaacaggtgctggaggattcgtagcgtcttggcttgttaagcttcttctttccaaaggctacattgtccatggaactgtgagagaccctgaacctgctactcagaaatatgaacacttgctcaaactccacggagcttctgaaaacctcactctcttcaaggcagatctcttgaactacgaatctcttcgctcagcaatttctggatgcactgcagttttccatcttgcttgccctgtaccctcaatcagtgttcccaaccctcaggttgaaatgattgagcctgctgtgaaaggaacaactaatgtacttgaagctagccttgaagctaaagtgcaacgacttgtctttgtatcatctttagctgctatttccaatagccccaatttgcctaaagataaagtgattgatgagtcctattggtctgataaagattactgcaaaacaactcagaactggtactgtttttccaagacagaggcggaggagcaggccttggactttgccaaaagaactggccttgatgtggtaagcatttgcccttcccttgttctcgggccaattttacagtcaaccactgttaatgcaagtagcctggctctcctcaaacttttaaaaggtgtcaactcaatggagaataagatccgttggatagtcgatgtacgagatgtagctgatgcaatacttttggcttatgagaagcttgaggcagaagggagatacatatgccattcacataccatcaagacacgggatatgctggagaaactaaagagtatatatcccaactacaaataccctgcgaagtatactgaggtggatgattacataagtttcagctcagagaaactgcaaaggttgggttggaaatacaggtcactggaggaaacactcgttgattctgttgagagctatcgggaagctggccatctgcaatcagaataa

SEQ ID NO: 5229 - protein, 321 aa, Glycine max
MAAKKVCVTGAGGFVASWLVKLLLSKGYIVHGTVRDPEPATQKYEHLLKLHGASENLTLFKADLLNYESLRSAISGCTAVFHLACPVPSISVPNPQVEMIEPAVKGTTNVLEASLEAKVQRLVFVSSLAAISNSPNLPKDKVIDESYWSDKDYCKTTQNWYCFSKTEAEEQALDFAKRTGLDVVSICPSLVLGPILQSTTVNASSLALLKLLKGVNSMENKIRWIVDVRDVADAILLAYEKLEAEGRYICHSHTIKTRDMLEKLKSIYPNYKYPAKYTEVDDYISFSSEKLQRLGWKYRSLEETLVDSVESYREAGHLQSE

SEQ ID NO: 5230 - DNA, 1204 bp, Brassica napus
  CDS (15)..(1007)
caaatctaagagaaatggcaaacagtggtgaaggtaaagtggtgtgtgtaacaggagcatctggttacatcgcttcttggcttgtcaagttcctccttagccgtggctacaccgttaaggcatctgttcgtgaccccagtgatccgaaaaaaacacaacacttgctttcgttggatggtgcaaaggaaagacttcacttgttcaaagcagaccttttggaagaaggatctttcgactcagcgattgatggatgtgaaggagttttccacactgcctctcctttttatcatgatgtcaaagacccacaggctgaacttattgatcctgctgtcaagggaacacttaacgttttgaactcgtgcaccaaagcatcttctgtcaaaagggttgttgttacctcctccatggcagccgttgcttacaatggtaaaccacgcacacctgatgtaaccgtcgacgagacttggttctctgatccagaggtttgcaagacttctaagatgtggtatgttctctccaagaccttggcggaagatgctgcttggaagttcgctaaagagaaaggcttggacattgttacgatcaacccagcaatggtgattggtcctctcctacagccaactctcaacacaagtgctgctgctatactaaactttattaatggtgcaaagacattctctaactcaactttcggatgggttaatgtaaaggacgttgccaatgcgcacatccaagcatatgagatcccttcagctaatggacgttattgtatggtcgagagagtccttcatcactctgagattgtgaacattctgcgtcagctttacccaaatctccaactccctgaaagttgtgccgatgagaatccgtttgttccgacgtatgaagtgtccaaggagaaaataaagagcattggcatagactacatacccttggaagttagcatcaaggagaccgtcgagtccttgaaggagaaaggtttcataaacgtccgagcaagcatttgagccaacgggttttaaacaaataaggaaaaaatatttggaacatgtcatttcatggagagattagtatgttgtcgtcgtaatctgttgtcttgttggttccatcaaaacttaaaatgaattaagcaataattattgtgatcttctgacacttctatcagtttatgacaagagctttcatcgtcaaaaaaaaaaaaaaa

SEQ ID NO: 5231 - protein, 330 aa, Brassica napus
MANSGEGKVVCVTGASGYIASWLVKFLLSRGYTVKASVRDPSDPKKTQHLLSLDGAKERLHLFKADLLEEGSFDSAIDGCEGVFHTASPFYHDVKDPQAELIDPAVKGTLNVLNSCTKASSVKRVVVTSSMAAVAYNGKPRTPDVTVDETWFSDPEVCKTSKMWYVLSKTLAEDAAWKFAKEKGLDIVTINPAMVIGPLLQPTLNTSAAAILNFINGAKTFSNSTFGWVNVKDVANAHIQAYEIPSANGRYCMVERVLHHSEIVNILRQLYPNLQLPESCADENPFVPTYEVSKEKIKSIGIDYIPLEVSIKETVESLKEKGFINVRASI

SEQ ID NO: 5232 - DNA, 1325 bp, Brassica napus
  CDS (22)..(987)
tgagctcatacgttatcaccaatggcgaaggagacagtgtgtgtaactggcgccaacggtttcatcggatcctggattatccaaacattactcgacaacggatacaccaaaatccacgcctctatctacccaggatccgacccggctcatctcctcaaactaccaagacccgacgacacaaacaccgagatcaagatcttcgaagccgatctcctagaccccgacgccatcgccagagccgtagatggatgcgcaggagtgttccacgtggcgtcgccttgtacgttggatccaccggaggatcccgagaaggagctggtcgaaccggcggttaagggaacgatcaacgtgttgttagcagctaataggttcaacgtgaggcgcgtggtgatcacttcctctatttcggctttggttccgaacccaaattggccggaaggaaaacccgtcgatgagtcgtcgtggaccgatcttgattattgcaagtcgatgcagaaatggtatccaatttcgaagacgctagctgagaaagcggcttgggaattttcggagaagcatggaaccaacgttgtgaccatccatccatccacatgcctcggaccacttctgcaacctagccttaacgcaagctgcgccgttttgctacagctcttacaaggctcgacggagacacaagagtatcactggctcggtgtggtgcacgtgagagatgtggcgaaagctcacgtgatgctgttcgaaacacctgaagcttctggtcggtttctgtgcagtaatgggatctatcagttcagtcagtttgctgctcttgtgtccaaactcttccctgagtttgatgttcacaggtttgataaaaaaacgcaacctgggcttacgccttgtaaagatgcggctaagagattgattgagctggggatggtgtttactccggtcgaagatgcggttaaggagacggtccagagtcttagagacaaaggcttcctctgaatgaataaaatatctttgagagttccaaactatgtgacctttattgtataatgcaagtagaggaactaagaagtaaactggtggttaatatgatacatctatgtatcgagtacaatgtattataattctcgctgttgtctgtgaggttttattggaggtgagagtagcttcagctggtggaaacagggagcatctggctacttctctgggattgcgttctgaaacgcaggaagatccttgtatgactcgtaacattttgtctgtgaggttttattaaaggaagggcaatacggacactaaaaaaaaaaaaaaaaaaaaaaaaaaaaaaaaaaaaaaaa

SEQ ID NO: 5233 - protein, 321 aa, Brassica napus
MAKETVCVTGANGFIGSWIIQTLLDNGYTKIHASIYPGSDPAHLLKLPRPDDTNTEIKIFEADLLDPDAIARAVDGCAGVFHVASPCTLDPPEDPEKELVEPAVKGTINVLLAANRFNVRRVVITSSISALVPNPNWPEGKPVDESSWTDLDYCKSMQKWYPISKTLAEKAAWEFSEKHGTNVVTIHPSTCLGPLLQPSLNASCAVLLQLLQGSTETQEYHWLGVVHVRDVAKAHVMLFETPEASGRFLCSNGIYQFSQFAALVSKLFPEFDVHRFDKKTQPGLTPCKDAAKRLIELGMVFTPVEDAVKETVQSLRDKGFL

SEQ ID NO: 5234 - DNA, 1047 bp, Glycine max
  CDS (1)..(1047)
atgggttcagcatccgaaagtgtttgcgttacaggagcttctggtttcatcgggtcatggcttgtcatgagactcatcgagcgtggctacaccgttcgagccaccgtacgcgacccagtaaacatgaagaaggtgaagcatttggtggaactaccaggcgcaaagagcaaactgtctctgtggaaggctgatcttgctgaagagggaagctttgatgaagccattaaaggctgcaccggagttttccacgtggccacccccatggactttgaatccaaagaccctgagaatgaagtgataaagcctacaataaatggggtactagacatcatgaaagcatgcttgaaggcaaaaactgtgcgaaggctaatattcacgtcctcagccggaaccctcaacgttattgagcgccaaaagcccgttttcgacgacacatgctggagtgacgttgagttttgccgtagagttaagatgactggttggatgtattttgtttctaaaacactggcggagaaagaagcatggaaatttgccaaagagcagggcctggacttcatcactatcattccacctcttgttgtcggtccctttctgatgccaaccatgccacctagcctaatcacggctctatcgccaatcacaggaaatgaggaccattactcgatcataaagcaaggtcaattcgtccacttagatgatctctgtcttgctcacatatttctgtttgaggaaccagaagtggaagggaggtacatatgcagtgcatgtgacgctaccattcatgacattgccaaattaattaaccaaaaataccctgagtacaaggtccccaccaagttcaagaatattccagatcaattggagcttgtgagattttcttccaagaagatcacagacttgggattcaaatttaaatacagcttagaggacatgtacactggagcaattgacacatgcagagacaaagggcttcttccgaaacctgcagaaaaagggctttttactaaacctgcagaaactccagtgaatgccatcatgcataaatag

SEQ ID NO: 5235 - protein, 348 aa, Glycine max
MGSASESVCVTGASGFIGSWLVMRLIERGYTVRATVRDPVNMKKVKHLVELPGAKSKLSLWKADLAEEGSFDEAIKGCTGVFHVATPMDFESKDPENEVIKPTINGVLDIMKACLKAKTVRRLIFTSSAGTLNVIERQKPVFDDTCWSDVEFCRRVKMTGWMYFVSKTLAEKEAWKFAKEQGLDFITIIPPLVVGPFLMPTMPPSLITALSPITGNEDHYSIIKQGQFVHLDDLCLAHIFLFEEPEVEGRYICSACDATIHDIAKLINQKYPEYKVPTKFKNIPDQLELVRFSSKKITDLGFKFKYSLEDMYTGAIDTCRDKGLLPKPAEKGLFTKPAETPVNAIMHK

SEQ ID NO: 5236 - DNA, 1174 bp, Triticum aestivum
  CDS (50)..(1015)
cgggcgcacggcagaggggactagagccggagcggggagaagaaagagcatggcggcggcggcgaggaagtgcgtgtgcgtgaccggcgcaggaggcttcgtcgcctcgtggctcgtcaagctcctcctctccaagggtcactacacagtccgcggcaccgtgcgcgatcccggtaatgctaagaatgctcaccttaaggcgctagaaggtgctggggaaagattgcagctgctcagcgctgacctgctggactacgacagcattgcgtccgctgttgctggctgtgagggcgtctttcatgttgctagccctgtcccttctggcaagtcaaccaatcctgaggaagaagttatagcccctgctgtaacaggcacactgaatgtcttgaaggcttgctacgaggcgaaagttaagcgagttgtcatggtgtcttcagttgttgctgtgtccaataatgctaactggcctaagggtaaattatttgatgaagatagctggtcagacgaggatctctgcagaaagggtgaggattggtatttcctttccaaaacgctcgcagagcgtgaggcttttgcttatgcagcaaaaactgggctggatattgtaactatttgcccgtcgttggtaattggccccttgatgcagtctacagtaaatacgagcagtaatattctccttaattatctcaaaggggaacgtgatactgtagaaaataaactcaggaatctagtggatgttcgtgatgttgccgatgctcttctattggcgtatgaaaatccagaggcgtctggacgttacatctgcagttcagtaccagttaaagtttctgatatgataagcatactgaagaccttatatccaatgtacacttatcccaaaaatttcaccgaagtggagggaaataccatttatagttcggagaaacttcagaagctagggtggaccttcaggcctttagagaagaccctgggggacagcgtggaatcctacagagcatctggcgtcctgaactgagcatccaaccagggaaagtttggctgttaatgctcgcaaactccatgtggttcatgtaagcagtgaaacaaattaagttggtgacacaatcgtcaggagaatcgtgtgaacatgagcaaagcttgaatcttatgtgtgcctttcaaaaaaaaaaaaaaa

SEQ ID NO: 5237 - protein, 321 aa, Triticum aestivum
MAAAARKCVCVTGAGGFVASWLVKLLLSKGHYTVRGTVRDPGNAKNAHLKALEGAGERLQLLSADLLDYDSIASAVAGCEGVFHVASPVPSGKSTNPEEEVIAPAVTGTLNVLKACYEAKVKRVVMVSSVVAVSNNANWPKGKLFDEDSWSDEDLCRKGEDWYFLSKTLAEREAFAYAAKTGLDIVTICPSLVIGPLMQSTVNTSSNILLNYLKGERDTVENKLRNLVDVRDVADALLLAYENPEASGRYICSSVPVKVSDMISILKTLYPMYTYPKNFTEVEGNTIYSSEKLQKLGWTFRPLEKTLGDSVESYRASGVLN

SEQ ID NO: 5238 - DNA, 1236 bp, Triticum aestivum
  CDS (23)..(1015)
gccgccggaagagcacgaggagatgggctccgggacggggaaggtggtgtgcgtcaccggcggctcgggctacatcgcctcctggctcgtcaagttcctcctccagcgcggctacaccgtccgcgccaccgtcagggacaccgccgaccccaagaaaacattgcacctgcaggccctggatggagccaaggacaggctgcacttgttcaaagcaagcttgttggaagaaggctctttcgatgctgccgttgccggctgcgattgtgtcttccacacggcttctcccttttatcacaatgtcaaggatcccaaggctgagttacttgacccagctgtcgatggaacgctcaatgttctccgttcctgcaagaaagcctctatcaagagagtgatcgtaacctcatccatggctgctgttgcctacaatgggaagccaaggactcctgatgtagtggttgacgagacatggttttcaagtgcagaagtctgcgaaaagaataagcaatggtatgtgctatccaagacccttgccgaggaggctgcatggaagtacgcaaatgataatggattagaaataattacaataaacccaacaatggtcatcggtcccctgttgcagcctacactgaatactagcacagaagcaatattgaagtttataaatggattatcttctacatacgccaatttctgctttggatggataaacgttaaagatgttgccctggcacatatccttgcatatgaagttccttcagcaaacggaagatattgtatggttgaaagagtcattcaccactcggaccttgtcaagatcattcacgagatgtatcctgaatttccagtgccagacaagtgtgcagatgatgcgccgtttgccccaatctaccaggtatcaaaggacaagataagaagtctgggcatggagctgacacccctggagacgagcctcaaggagactatcgagagcttgaaagagaaaggatttgtcacttctgagtcgagccatctgtgaaactttctttgctttggcaccactagtggcagacgctggatgcacacatgtttatgtgcacctgaaataaatcgaggcatagtgtattcttgagacatgtatttgtggatctgctgtgtttcaatggattcaagttcctagacatgtataaccagtacacaagaatgtatgatgaatgcttctagaaagattatccatcctgtattaaaaaaaaaaaaaaa

SEQ ID NO: 5239 - protein, 330 aa, Triticum aestivum
MGSGTGKVVCVTGGSGYIASWLVKFLLQRGYTVRATVRDTADPKKTLHLQALDGAKDRLHLFKASLLEEGSFDAAVAGCDCVFHTASPFYHNVKDPKAELLDPAVDGTLNVLRSCKKASIKRVIVTSSMAAVAYNGKPRTPDVVVDETWFSSAEVCEKNKQWYVLSKTLAEEAAWKYANDNGLEIITINPTMVIGPLLQPTLNTSTEAILKFINGLSSTYANFCFGWINVKDVALAHILAYEVPSANGRYCMVERVIHHSDLVKIIHEMYPEFPVPDKCADDAPFAPIYQVSKDKIRSLGMELTPLETSLKETIESLKEKGFVTSESSHL

SEQ ID NO: 5240 - DNA, 1035 bp, Triticum aestivum
  CDS (1)..(1035)
atggcaccaccgcggcgcgtgtgcgtgaccggcggcggcgggtacatcgcctcgtggctcgtcaagctgctcctctcccggggctatgccgtccacgccaccgtccgcaacccacgtgattccaagaacgcgcatctgatgcagctggacggggcggcggagagcctgcggctgttcaaggcagacgtgctggacagcgccgcgctcgccgccgccgtcgaggggtgcgagggcgtcttccacgtcgcctcccccgtccccgcggataagatcgtcgatcctgagtcagaagtgatggtgcctgctgtgaagggcaccgtaaatattcttgaagtttgttcatctatgaaggttcagaaagttgtggtggtgtcatccacttcttctgttcattttaaccccaactggcctcaggctaaacccaaagatgagagttgctggcccgacaaaaaaatatgcgtggataatgagctctggtactgtcttgctaaaactgttgctgaagaaacagcctgggaatatgcagaaaagaatgggctaaatgttgttacagtatgcccttgtattgttttaggcccacaactgcaacccattgtcagtaccagcagcgaacttctcgtctatgttataaaaggaggtcctaatgcgatgaaggacatgctgttgcacatagtcgatgtccgtgatgtggcagatgctttgcttctggtatacgagaaaccagaatcatctgggagatatatcagcgcaccaaattacattagcacaaaagccatgctggagttgctgaagaagacgtaccctgactacaattatgtaaactgcaaggctgagatggatcacaactctcctatcaccccaatctcgtcggcaaagctgaggaatctgggctggaagccaagggaattggaggagacgctcctggatagcatcgaatactaccggaagacgggaattctgcaggatggcgagggagagggacacgcttgccgcttacctgatatcttccggatgtttcatgcctccgaggaatga

SEQ ID NO: 5241 - protein, 344 aa, Triticum aestivum
MAPPRRVCVTGGGGYIASWLVKLLLSRGYAVHATVRNPRDSKNAHLMQLDGAAESLRLFKADVLDSAALAAAVEGCEGVFHVASPVPADKIVDPESEVMVPAVKGTVNILEVCSSMKVQKVVVVSSTSSVHFNPNWPQAKPKDESCWPDKKICVDNELWYCLAKTVAEETAWEYAEKNGLNVVTVCPCIVLGPQLQPIVSTSSELLVYVIKGGPNAMKDMLLHIVDVRDVADALLLVYEKPESSGRYISAPNYISTKAMLELLKKTYPDYNYVNCKAEMDHNSPITPISSAKLRNLGWKPRELEETLLDSIEYYRKTGILQDGEGEGHACRLPDIFRMFHASEE

SEQ ID NO: 5242 - DNA, 984 bp, Triticum aestivum
  CDS (1)..(984)
atggcgttggccggcggagatggtcgcggcgagctcgtctgcgtgaccggcggcagcggcttcatcggctcctggctcgtccgcctcctcctcgaccgcggctacaccgtccacgccaccgtccagaacctccaggacgagggcgagacgaagcacctgcaggctctggatggcgcggacacgcggctccggctgttccagatggacctcctcgaccctgcctccgtcaggccggccatccagggcgtccacggcgtcttccacctggcctcccctgtgatactgcagcccgcacaagaccccgagaacgagctgctgctgccggcggtcaacggcgcgctcaacgtcctccgcgcagccaaagacagcggcgtcaagcgtgtcgtgatggtgtcttcgcagacggccatgtgtccgactgccgactggccggccgacaaggtcatagacgacgactgctgggccgacgttgagatcctcaagaaactcgagctttggtacaacgtctccaaaacgctggccgagaaggcggcgtgggacttcgccggagaggaaggactgaagctggttgtgctgaatccagggctggtgctgggcccgacgttgaccccagcacctactggtagtctccgtctgctgatgctgcttctgggaggccagaagcttgacatggaacccttcttcgttggctgcgttgacgtcagagatgtggcacaatctctggtggtgctctatgagaacccgtcggcgcagggacgccacctgtgcatggagtccgccgtacgcctcgtcgatttccacgatgaacttgctaatctttaccctgaattcccggttcacaggatccaggaggacaaacagggctgggtggtgagatcaaaggctccgtccaagaaactgatcgagttgggtgttcgtttcaccccattcgacaagactgtcagggagacggtggattgcttaaggagcaaaggggaaatctag

SEQ ID NO: 5243 - protein, 327 aa, Triticum aestivum
MALAGGDGRGELVCVTGGSGFIGSWLVRLLLDRGYTVHATVQNLQDEGETKHLQALDGADTRLRLFQMDLLDPASVRPAIQGVHGVFHLASPVILQPAQDPENELLLPAVNGALNVLRAAKDSGVKRVVMVSSQTAMCPTADWPADKVIDDDCWADVEILKKLELWYNVSKTLAEKAAWDFAGEEGLKLVVLNPGLVLGPTLTPAPTGSLRLLMLLLGGQKLDMEPFFVGCVDVRDVAQSLVVLYENPSAQGRHLCMESAVRLVDFHDELANLYPEFPVHRIQEDKQGWVVRSKAPSKKLIELGVRFTPFDKTVRETVDCLRSKGEI

SEQ ID NO: 5244 - DNA, 960 bp, Zea mays
  CDS (1)..(960)
atggagccggtgcggaagagcgtgtgcgtgaccggcgctggcggcttcgtcgcgtcggagctggtgaagctcctcctctcccggggccaatacgcggtccgcggcaccgtgcgcgaccctggtgctagcaagaatgcccatctcaaggtgctggaaggagctgaggaaaggttgcagcttctcaaggctgatctgatggactacaacagcattgcatcagcagttgccggctgtgagggtgtcttccatgtagccagtcctgtcctttcccatcgaccctccaaccctgaggtggaggtcatagctcccgctgtaataggtacaaccaatgtgttaaaggcttgctatgaggcaaaagttaggcgagttgtggtggtgtcttcatgtggagctgtgtatgctaatcctatttatccgaagggtaaggtgtttgatgaagactgctggtcagatgaggattactgcaggaagaaggaggattggtatttagtttccaaaacactgtcggaacgagaagctcttgcttttgcagcaaaaacagggctggacgttgtaactgtttgtccgtcattagtatttggacccttgatgcagcctacagtaaatttgagcagcgaaatgatccttaaatatttcaaagatctcgagactgttgaaaatgtactcagtaatatggtggatattcgtgatgttgctgatgctcttcttctgacttacgaaaagccagaagcgtctggacgatacatctgcagttcacatgcaataaaaatttctgatatgataaacatactgaagaccatgtatccgtcttacccttatcccaaaaattttgtggaagatgatgtcaactctgtatacagctctgagaaactgcagaagctggggtggaccttcaagcctatagaggaatccctccgtgacactgttgaatcctacaaggcatttggcatcctgaattga

SEQ ID NO: 5245 - protein, 319 aa, Zea mays
MEPVRKSVCVTGAGGFVASELVKLLLSRGQYAVRGTVRDPGASKNAHLKVLEGAEERLQLLKADLMDYNSIASAVAGCEGVFHVASPVLSHRPSNPEVEVIAPAVIGTTNVLKACYEAKVRRVVVVSSCGAVYANPIYPKGKVFDEDCWSDEDYCRKKEDWYLVSKTLSEREALAFAAKTGLDVVTVCPSLVFGPLMQPTVNLSSEMILKYFKDLETVENVLSNMVDIRDVADALLLTYEKPEASGRYICSSHAIKISDMINILKTMYPSYPYPKNFVEDDVNSVYSSEKLQKLGWTFKPIEESLRDTVESYKAFGILN

SEQ ID NO: 5246 - DNA, 1229 bp, Zea mays
  CDS (36)..(1004)
gctgagccgagcagggagaaggacgcgagagcagcatggagacggcggagaggggcatcaccgtgtgcgtgaccggcgcggggggctttgtggcatcgtggctcgtcaagctcctcctctccaccggccgctacaccgtccggggcaccgtgcgtcatctcggtgatggcaagaatgcccatcttaagacactggaagatgctgaggagaggttgcagttggtcaaggctgacatgctggactatggcagcgttgcgtccgcggtcgccggctgtcagggtgtcttccatgtcgcgagccctgtcccctccggcaaatcctccaaccctgaggaagatgtcatagctcctgctgtaactggcacactgaatgtgttgaaagcttgctatgaggccaaagcgaagagagttgttgtggtatcttcagtggcggctgtgttcaataatcctgactggcctaagggcgaggcctttactgaggatagctggtcagatggggaatattgcagaaaaaatgaggaatggtatttcctttctaaaacattggcagaacatgaggcttttgcttatgcagccaaaactgggctagacattgtaactatttgcccatcattggtaattggacctttgttgcaacctgcagtaaatacaagtgttaaagtcttcctcagttatatcaaaggagatcaggagatagttaaagatggacccaaaaatcttgtggatgttcgtgatgtcgctggtgcccttctgttggcttacgaaaatctgcaggcatcaggacgatacctctgcagttcaccagcaataagagtctctgatattgtaaacatactgaagaccgaatatccaacatacacttaccctcaaaaattcgttgaagcggaaggtagcaacacatacaacacggagaagcttcggaagctagggtggacctctaggcccatggaggacaccctccgagacagcatcgaatgctacagagctatgggcatcctgaactgagcttcccttcagctttgggctttggctgctgctgctgctactacttttcagtttctttcttcttcatgtaaacagtgaatcagaaattcagaatacgctggtataggaactagagaagtggatcatggaagatgctgctgctaaaaatgaatttggatactatccatcatttgtgcctgccggattgagggcaaattaattaagtacttatatttgcaaaaaaaa

SEQ ID NO: 5247 - protein, 322 aa, Zea mays
METAERGITVCVTGAGGFVASWLVKLLLSTGRYTVRGTVRHLGDGKNAHLKTLEDAEERLQLVKADMLDYGSVASAVAGCQGVFHVASPVPSGKSSNPEEDVIAPAVTGTLNVLKACYEAKAKRVVVVSSVAAVFNNPDWPKGEAFTEDSWSDGEYCRKNEEWYFLSKTLAEHEAFAYAAKTGLDIVTICPSLVIGPLLQPAVNTSVKVFLSYIKGDQEIVKDGPKNLVDVRDVAGALLLAYENLQASGRYLCSSPAIRVSDIVNILKTEYPTYTYPQKFVEAEGSNTYNTEKLRKLGWTSRPMEDTLRDSIECYRAMGILN

SEQ ID NO: 5248 - DNA, 1215 bp, Linum usitatissimum
  CDS (82)..(1041)
cggagcattgaatcaatccttctacaaggactatagaccgattctctgaggagcagctcacattctctcttcatcaatcctatggcggcggcgaagggcttagtttgtgtgaccggcgccggaggtttcttaggttcttgggtcgtccgtatcctcctctccaacgactattcagtccacggcactgtcagagacccctcggatgagaagtatgcccacctgaagcaactccccaaggcatccacaaacctaaagctcgtaaaggccgatttactagattaccctacccttgtttctgcatttcaaggctgctccggggtttttcacgtcgccagccctgttcctgctttctctgtatcaaacccccaggttgaagtgctggagccagcggtgactggcactcgaaatgtacttaaagcatgtgttgaaacgaaggtcaatcgagctgttgttgtgtcctctggcgctgctgttgccttgaacccaagctggccaaaggatcagcccatggacgagtcttgctggtctgataaggaatactgcagaactacggagaactggtattgcgcctccaagacggaagctgagattctggcttttgagtatggcaaagagtatggacttgatgtagtaagtgtttgtcccaatttgatattggggcctatcctgcagcctactgtgaatgcaagtaccatggtcctcaccaggcttctgaaagaaggcctggactcggtagagaacaagcataggatgattgtggacgtgcgagacgtagctgaagcgttggttttggtgtacgagaagcctgaggcacaagggagatacatatgctctaaacattcggtctatgctcagcaaatggttgagattttgaaagaaaaatatcccaactacaatttccctaagagcttcgtggagggacctgaaaagcgagaaatgagctcagagaagttgcagaggttaggatggagttaccgtccattggaggaaacccttgttgactctgttgagagttataagaaggctggcatattggagtagaacaaattaaaacccttgttttatcggatgattaattatgtgagtgagtgaagggctagcacatcctgacgtatgatccattcaacgcataagggagaaagcagtcggaacaccaatcaaggaaggtgcaaaatgagaataaaaaatatatttccattcaaaaaaaaaaaaaaa

SEQ ID NO: 5249 - protein, 319 aa, Linum usitatissimum
MAAAKGLVCVTGAGGFLGSWVVRILLSNDYSVHGTVRDPSDEKYAHLKQLPKASTNLKLVKADLLDYPTLVSAFQGCSGVFHVASPVPAFSVSNPQVEVLEPAVTGTRNVLKACVETKVNRAVVVSSGAAVALNPSWPKDQPMDESCWSDKEYCRTTENWYCASKTEAEILAFEYGKEYGLDVVSVCPNLILGPILQPTVNASTMVLTRLLKEGLDSVENKHRMIVDVRDVAEALVLVYEKPEAQGRYICSKHSVYAQQMVEILKEKYPNYNFPKSFVEGPEKREMSSEKLQRLGWSYRPLEETLVDSVESYKKAGILE

SEQ ID NO: 5250 - DNA, 1056 bp, Linum usitatissimum
  CDS (1)..(1056)
atggttagtgaaatggtttgcagcgctgttggggaaaacaagactgtctgcgtaacgggggcttctgggttcatcgggtcatggcttacgatgaggttgcttgaacaaggatataccgttcgagccacagttcgtaaccctgaggatgagaggaaagtgaagcatctagtggagctgccaaacgcaaagactcatttgacgttgtggaaagccgacctttcggtggcagggagcttcgacgacgctatccatggctgctccggtgtgtttcacgtggccactccgatggatttcgagtcctccgaccctgagaatgaagtgataaagccgacggtggaaggggtgctggacataatgagagcaagcgccaaggccaaaacagtaaagagaatagtgttcacttcgtcggcggggacagtggacgtggaagagcaccataaagcagtctacgacgagaacgattggagcgatctcgatttcgtccaaagagttaaaatgaccggatggatgtactttgtgtcgaagagcttagcagagaaagaggcctggaaatttgcagaggagaacaacttggatttcataagcatcattccaagtgtggtggtggggcctttcattatgccctccatgcctcccagcctcatcactgctctctccctcatcaccaggaatgaagcacactattcgatcatagagcaggggcatttcgtgcacttggacgacctctgcaacgcccacatcttcttgctggagcatccaaatgctcagggccgttacatgtgcaactctcacgacatcaacatttaccaacttgcccactttctatccaacaaataccccgactacaacatcccaacagagttcgaagggatcgaaaagggaaagctgaagaaggtgattttctcgtccgagaaggtgaagaagttaggattcgagttcaagtacggactggaggagatgtttgaaggagctgtggagacttgcaaggaaaagggtttgcttccatcatcgactgttgtgaaggctagtggccatgttgaaaaccattcgctgtag

SEQ ID NO: 5251 - protein, 351 aa, Linum usitatissimum
MVSEMVCSAVGENKTVCVTGASGFIGSWLTMRLLEQGYTVRATVRNPEDERKVKHLVELPNAKTHLTLWKADLSVAGSFDDAIHGCSGVFHVATPMDFESSDPENEVIKPTVEGVLDIMRASAKAKTVKRIVFTSSAGTVDVEEHHKAVYDENDWSDLDFVQRVKMTGWMYFVSKSLAEKEAWKFAEENNLDFISIIPSVVVGPFIMPSMPPSLITALSLITRNEAHYSIIEQGHFVHLDDLCNAHIFLLEHPNAQGRYMCNSHDINIYQLAHFLSNKYPDYNIPTEFEGIEKGKLKKVIFSSEKVKKLGFEFKYGLEEMFEGAVETCKEKGLLPSSTVVKASGHVENHSL

SEQ ID NO: 5252 - DNA, 1194 bp, Linum usitatissimum
  CDS (9)..(986)
ggaaaagaatgagcgaggaggaagggaaaggaaaggtagtctgtgtgactggagcttcaggctacatagcctcatggctggtgaagttacttcttcaacgaggatacactgttaaagctacagtccgtgacccaaatgatgccaagaagactgaacatttgcttgcacttgagggagccaaggagcggttgaaactgttcaaggcagacttgctggatgaaggatcatttgataatgttgttgagggatgtgaaggtgttttccacaccgcttccccatttttcttcaatgcgactgatcctcaggttgaactggttgaccccgcggtgaagggaactctcaatgtactaacatcatgcgctaaagtcccttcaatcaagagagtggtcatcacatcatccatggcagcagttgcattcaatggaaggactcttgctcctgatgtggtaattgatgagacttggttctctaatgcagaattctgcagaaaatcaaagttgtggtatatgctggcgaaaacactggctgaagaacttgcttggaagttctcaaaagagaatggtatggatatagtttcactaaatccaggacttgtaattggccctctcttgcaaccgacattgaatacgagcgcagagtcagttctgaaccttgtaaagggggtggaaaagtatccaaacacaacatacaggtgggtagatgttagagatgttgcttatgcccatatatatgccatggagaatccttcagctggtggaagatactgcttagtcggagcagttttacatgcttctgaagctgtgaagatgttgcatgagcttttccatgacctcaacatccctcaagaatgtgcggatgacaagccacctatggcgatatatcaagtgtcgaaagaaagagttgaaagcctaggcgtcaaatacagtcctctcaagactagcttgaaagacacagtggaaagcttgaaggaaaagaagttattttgatttgcttctgagtgtctttatgttttggtgcaactttcctgagttgagcattgtcgaatggaactgaagctagcgggctgtaccatgtatgcgagtatccaaacttctaaagatgtctgtaataatagctttcataacatactcaagctagaattgggactggaatgaagtgcagttttacgttaagaagttcaaaaaaaaaaaaaaa

SEQ ID NO: 5253 - protein, 325 aa, Linum usitatissimum
MSEEEGKGKVVCVTGASGYIASWLVKLLLQRGYTVKATVRDPNDAKKTEHLLALEGAKERLKLFKADLLDEGSFDNVVEGCEGVFHTASPFFFNATDPQVELVDPAVKGTLNVLTSCAKVPSIKRVVITSSMAAVAFNGRTLAPDVVIDETWFSNAEFCRKSKLWYMLAKTLAEELAWKFSKENGMDIVSLNPGLVIGPLLQPTLNTSAESVLNLVKGVEKYPNTTYRWVDVRDVAYAHIYAMENPSAGGRYCLVGAVLHASEAVKMLHELFHDLNIPQECADDKPPMAIYQVSKERVESLGVKYSPLKTSLKDTVESLKEKKLF

SEQ ID NO: 5254 - DNA, 1029 bp, Linum usitatissimum
  CDS (1)..(1029)
atggccacacctaccactgtcgtccagcctccgtcggggaagaaaactgcatgtgtgataggaggcaccgggttcgtggcgtctaggctggtcaagttactcttggaaaatggctactcggtccggaccactgtccggaaccctgacaaccagaggaggatttcacacctgatgccgctgaaagaattgggggagctggagattttcgccgcagagttaactgacgaggagagtttcatcgctccggtggcagggtccgacttggtattcctcgtcgcaaccccggtcaattttgcttctaaggatcctgagaatgacatgataaagccagcaatccaaggtgtggaaaacgtgctgaaagcttgcgccaaggccaaaacggtgaaaagggtggtgcttacttcctctgcagcagccgttactattaataatgtcgagggaacaggtttggtcatggacgagaataactggaccaatgttcagtttctaacctcacacaagcctccaacttgggggtacgctgtttcgaagacactagctgagaaagcagcatggaaatttgctgaagaaaacaagattgatcttgtgacagtgattccttcacttgtagctggtcctcctctcactgctgacgtacctagcagcattaaccttgcactctccatgctcacagggaatgaaatgctcataaatgggctgaaaggaatggaaaagctgtcgggttcgatctcgattacacacgttgaggatgtttgtagagcacatttgttcgttgcggagaaggaatctgcttctggcagattcatatgctgtgctgctaatactagtgtcgctaagctagccaaattcttcagcttgagatatccacagtacaaagtccagccccagattggagatgttccggaacacgcgaagctgacgatttcttcagagaagctgatcggagaaggattcagtttcaagcatgggttggaagagatttatgacgagacagtggaatatttcaaagctgtaggaaatttgaaatga

SEQ ID NO: 5255 - protein, 342 aa, Linum usitatissimum
MATPTTVVQPPSGKKTACVIGGTGFVASRLVKLLLENGYSVRTTVRNPDNQRRISHLMPLKELGELEIFAAELTDEESFIAPVAGSDLVFLVATPVNFASKDPENDMIKPAIQGVENVLKACAKAKTVKRVVLTSSAAAVTINNVEGTGLVMDENNWTNVQFLTSHKPPTWGYAVSKTLAEKAAWKFAEENKIDLVTVIPSLVAGPPLTADVPSSINLALSMLTGNEMLINGLKGMEKLSGSISITHVEDVCRAHLFVAEKESASGRFICCAANTSVAKLAKFFSLRYPQYKVQPQIGDVPEHAKLTISSEKLIGEGFSFKHGLEEIYDETVEYFKAVGNLK

SEQ ID NO: 5256 - DNA, 1029 bp, Linum usitatissimum
  CDS (1)..(1029)
atgccagcagtacctgacaccacatccctcatcgtcggccatggccagaccgtctgcgtcaccggcgccggcggcttcattggctcatggatcgttaaacttctcctccacagaggctactccgtcagaggaaccgtcaggaatccagaggatccgaagaatggacacctgaaagagctacaaggagccaatgagcggctgaccctgtgggaagccgacctactggattacgacagtctccgacgagccattgatggatgtcatggcgttttccacaccgcttcccctatctccgatgatcctgacgaaatgctagagccggcggtggacgggactaaaaatgtaataatagcggcatcggaagcaagagtccggcgtgttgtgttcacgtcgtccatcggcgccgtctacatggatcccaaccgaaaccatgacgtggagatggatgagtccttttggagcgatctcgactattgcaagaacaccaagaactggtactgctacggcaaaacggcagcggagctgagagcatggaaattggcgaaagagaagggtgtggatttggttgtggtcaaccctgtggttgtggtcggaccattgctccaaccaactgtcaacgctagcagcgtgcacatactcaagtacctagccggttgggtaaaaacctacgccaatgcagttcaagggtacgttcacgttagagacgtggcactagcccacatcctcgtattcgagaacatgtatgcatctggtcgctacctttgcgtcgaaagtgtcctccaccgcggtgaggtggttgagattctcgacgagttgttccccggttatcccctcccaaccaagtgcaaggacgagaagagccctagagccaaacctcacaagttttcgtgccaaaagttgaaggacattggtttggagttcactccggtgagacagtgtttgtacgaaacggtgaagtccctgcaggaacatggccatctcgttgctcttccaaaacaaaatttcgaaaagttgagttttgaaccatga

SEQ ID NO: 5257 - protein, 342 aa, Linum usitatissimum
MPAVPDTTSLIVGHGQTVCVTGAGGFIGSWIVKLLLHRGYSVRGTVRNPEDPKNGHLKELQGANERLTLWEADLLDYDSLRRAIDGCHGVFHTASPISDDPDEMLEPAVDGTKNVIIAASEARVRRVVFTSSIGAVYMDPNRNHDVEMDESFWSDLDYCKNTKNWYCYGKTAAELRAWKLAKEKGVDLVVVNPVVVVGPLLQPTVNASSVHILKYLAGWVKTYANAVQGYVHVRDVALAHILVFENMYASGRYLCVESVLHRGEVVEILDELFPGYPLPTKCKDEKSPRAKPHKFSCQKLKDIGLEFTPVRQCLYETVKSLQEHGHLVALPKQNFEKLSFEP

SEQ ID NO: 5258 - DNA, 1457 bp, Linum usitatissimum
  CDS (106)..(1146)
ctgattcctcctcccattccgacgaccaattcagctttcccccctttccctgcctccttcctcctcatcctttcatcccaaaaaatcaacttgtcacaaacaacgatgccggctgacagctcatccttacccggccacggccacaccatctgcgtcaccggcgccggcggcttcattgcctcatggatggttaaacttcttctcgaaagaggctactccgtcaaaggaactgtcaggaatccagatgatccgaagaacagtcatctgagagaactggaaggagcgagcgagcggctaactctgtgcaaagccgatcttctcgactatgagagcctccgagaagccattgccggctgccagggtgttttccacaccgcttcccctgtcaccgatgatccagaacaaatggtggagccggctgtggttggtacgaacaatgtaataaatgctgcatctgaagccaaagtccggcgggttgtcttcacgtcatcaattggcgctgtctacatggaccccaaccggagcccggacgttgtcgtcgatgaatcgtgttggagcgatctggaattttgcaaaaacaccaagaattggtactgttatgggaagatggtggcggagcaggcggcgtgggagactgctaaagagaagggagtggatgtagtggcggtgaaccctgttctggtaatgggaccattgttgcaatcaaccatcaacgccagcacaattcacatcctcaagtacctaactggttcggcaaagacttacgccaattcggtgcaagcctatgttgatgtcagggacgtggcactagctcacatcatcgtcttcgagaacccggcggcctccggccggtacctctgcgccgagagtgttctccaccgtggcgaggttgtcgatatccttgccaagttattccccgagtatcccgtccccaccaagtgttcagatgagaagaacccaagagcaaagccctacaagttctcgtgccaaaaactgaaggacctgggactggaattcacaccaacaaagcagagtctgtatgaagcagtcaagtcccttgaggaaaagggtcatctttctccccctaaacagcagcagcagcagcacaaggaggaggaacccatcaaaattcagtcctcttcttaataataattgaatctctctactacttgcctaacaaacggcagcagtcctcgttcgtttgcataattaaaaaatatatgaaaaaccagcaaacattagatttaccagggaagacggctgatctgatttgagcaactatgtcttgttgtttgttactgttttgattgtattggggttctattatatattctacaatcctttgtatcggttggtcattcatatgatgaaggcatcaatctcaagtcctgtgttgtaattggtgttttttaaaccctgcaatagttaaacaaaccccccccaaaaaaaaaaaaaaa

SEQ ID NO: 5259 - protein, 346 aa, Linum usitatissimum
MPADSSSLPGHGHTICVTGAGGFIASWMVKLLLERGYSVKGTVRNPDDPKNSHLRELEGASERLTLCKADLLDYESLREAIAGCQGVFHTASPVTDDPEQMVEPAVVGTNNVINAASEAKVRRVVFTSSIGAVYMDPNRSPDVVVDESCWSDLEFCKNTKNWYCYGKMVAEQAAWETAKEKGVDVVAVNPVLVMGPLLQSTINASTIHILKYLTGSAKTYANSVQAYVDVRDVALAHIIVFENPAASGRYLCAESVLHRGEVVDILAKLFPEYPVPTKCSDEKNPRAKPYKFSCQKLKDLGLEFTPTKQSLYEAVKSLEEKGHLSPPKQQQQQHKEEEPIKIQSSS

SEQ ID NO: 5260 - DNA, 1135 bp, Zea mays
  CDS (46)..(1068)
ggaccgaccggaggaggacgtagtgcggccctgtagtggagcgggatggcgtcgccgcagtcgccgcgcgtgtgcgtaaccggtggcggcgggtacgtcgcctcatggctcgtcaaactcctcctctcccgcggctacgccgtgcatgccactgtccgcgacccaagtgatcccaagaacgaccacctccggcggatggacggggcatcggagagcttgctcctgttcaaggccgacatgctcgatcgcgacgccctggcggcggcggtctctgggtgcgagggggtcttccacgtcgcctcccctgtgcccgcagataaggtcctcgatcctgaggcagaggtactgtctcctgctgtcaaaggcactctgaacgttcttcaggcttgctcggcaaataatgttcggaaagttatcgtggtttcatccacagctgctgtccattttaatccgagttggccccaaggtataatccaagacgagagttgctggtcagataaaactttttgcactaagaatgaggaatggtacattgctgccaagacaattgctgaagagacagcactggagtatggagagaagaatgggctacttgttgttacagtttgcccttgtgtcgttttaggtccactcctgcagcctctaatcaacaccacgagtgaagtattcgtctacattataaaaggaggtcctagagcgatgaaaaacatcacctggaacatcgttgatgtccgtgatgtagccgatgctttgcttttggtatatgagaaagtggaatcatctgggagatacatttgtgcaccaaatcggatcagcacttacgacatagcgaacttgtttagaaagttctaccccaactacaattatgtgaactgcagcgacgaggaccatgaatctgaaatgccgccggttacatcagagaaacttaagagcctaggttggaaaccaagaaaattggaggaaactctgctggacagcattgagcactacgagaaggcagggtttctgcaggatgtagagggctgcccttgtcgtcttccttaccttttccattttgcttctaactaataaagtaaactatgtattacagttacagttactacttaaactgcctttggacaatcaaaaaaaaaaa

SEQ ID NO: 5261 - protein, 340 aa, Zea mays
MASPQSPRVCVTGGGGYVASWLVKLLLSRGYAVHATVRDPSDPKNDHLRRMDGASESLLLFKADMLDRDALAAAVSGCEGVFHVASPVPADKVLDPEAEVLSPAVKGTLNVLQACSANNVRKVIVVSSTAAVHFNPSWPQGIIQDESCWSDKTFCTKNEEWYIAAKTIAEETALEYGEKNGLLVVTVCPCVVLGPLLQPLINTTSEVFVYIIKGGPRAMKNITWNIVDVRDVADALLLVYEKVESSGRYICAPNRISTYDIANLFRKFYPNYNYVNCSDEDHESEMPPVTSEKLKSLGWKPRKLEETLLDSIEHYEKAGFLQDVEGCPCRLPYLFHFASN

SEQ ID NO: 5262 - DNA, 969 bp, Zea mays
  CDS (1)..(969)
atgtgtaaccggggcctcaggctttgtgcctcttggcttatcaaacggctcctcgagtctggatatcatgtggtagggactgtcagggacccaggaaatcaccaaaaaacagcccacctttggaaattacctggcgctaaagagaggctgcaaatcgtgcgagctgatctgttggaagaagggagcttcgacagcgccgtgatggcctgtgagggtgtattccacactgcatcccccgtcctcgctaaaccagactctactagcaaggaggaaacgctcgttcctgcggtgaacggtactctgaacgtgctgagatcgtgcaagaagaaccccttcctgaaaagggtcgtccttacgtcttcgtcgtctgcggtgaggatcagggacgacggccagtccagcagtaacatctcgctggacgaaacggcatggagccccgtgccactctgcgagaagatgcatctatggtatgccctagccaaggtatttgcagagaaagcggcgtgggagttcgccaaggagaacggcatcgaccttgtgactgtcctcccgtcgttcgtgatcgggcccagtttgtcccacgagctatgcgttaccgcttcagacgtcctaggcctattccaaggcgacacggcaaggttcagctcgtacggaagaatgggatacgtccacatcgacgacgttgcgagcagccacatcctggtgtacgaggccccccaggccgccgggaggtacctgtgcagctcagtggtgctggacaacgacgagctggtctcctcgctcgcgaaacgctacccgatattccccataccccggaggctgaacagcccctacggcaagcagtcgtaccagctgaacacgtcgaagctgcaggggctgggcttcaagttcagaggggtgcaggagatgttcgacgactgcgtacagtcgctcaaagaccagggacacctgctggagtgccccctgtga

SEQ ID NO: 5263 - protein, 322 aa, Zea mays
MCNRGLRLCASWLIKRLLESGYHVVGTVRDPGNHQKTAHLWKLPGAKERLQIVRADLLEEGSFDSAVMACEGVFHTASPVLAKPDSTSKEETLVPAVNGTLNVLRSCKKNPFLKRVVLTSSSSAVRIRDDGQSSSNISLDETAWSPVPLCEKMHLWYALAKVFAEKAAWEFAKENGIDLVTVLPSFVIGPSLSHELCVTASDVLGLFQGDTARFSSYGRMGYVHIDDVASSHILVYEAPQAAGRYLCSSVVLDNDELVSSLAKRYPIFPIPRRLNSPYGKQSYQLNTSKLQGLGFKFRGVQEMFDDCVQSLKDQGHLLECPL

SEQ ID NO: 5264 - DNA, 963 bp, Zea mays
  CDS (1)..(963)
atggcggcggcggcaaagagcgtatgcgtgaccggcgcgggcggcttcatcgcgtcttggctcgtgaagctcctcctctcccgtggccagtacgtggtccgcggcaccgtgcgcgaccctggtgctagcaagaatgctcatctcaaggagctggagcgggctggggaaagattgcagcttctccaggctgatttgttggactacagcagtgttgcatcagcaattgctggctgtgagggtgtcttccatgtagcttgccctgtcccttctggtcggtcctccaaccccgaggtggaggtcataggtcctgctgtagtaggaacaaccaatgtgttaaaggcttgctatgaggcaaaagttaagcgagttgtggtggtgtcttctgtttcagctgtattcagtaaccctaattggcctaaggacaaggtctttgatgaagattcttggtcagacgaggattattgcaggaagaatgaggattggtattatctttctaaaactctatccgaacgtgaagcttttgcttttgcagcaaaatcggggctggatgttgtaactatttgcccgtccttggtatttggacccttgatgcagtctatagtaaatacgagcagtaaagtactccttaattatttcaaaggagatcgtgagactgttgaaaacagactcagaaatatggtggatgttcgtgatgttgctgatgctcttgttctggcttacgaaaatccagaagcatctggacgatacatctgcagctcgcatccattaaaagtttctgatatgataaacatattgaagaccttatatccatcttacccttatcctaaacactttgtggaaacggatggcaacatcacctgcagttctgagaaacttcagaagctagggtggaccttcagggctatagaggaaaccctgcgtgatagtgttgaatcctacaaagcatttggcatccttaactga

SEQ ID NO: 5265 - protein, 320 aa, Zea mays
MAAAAKSVCVTGAGGFIASWLVKLLLSRGQYVVRGTVRDPGASKNAHLKELERAGERLQLLQADLLDYSSVASAIAGCEGVFHVACPVPSGRSSNPEVEVIGPAVVGTTNVLKACYEAKVKRVVVVSSVSAVFSNPNWPKDKVFDEDSWSDEDYCRKNEDWYYLSKTLSEREAFAFAAKSGLDVVTICPSLVFGPLMQSIVNTSSKVLLNYFKGDRETVENRLRNMVDVRDVADALVLAYENPEASGRYICSSHPLKVSDMINILKTLYPSYPYPKHFVETDGNITCSSEKLQKLGWTFRAIEETLRDSVESYKAFGILN

SEQ ID NO: 5266 - DNA, 1026 bp, Hordeum vulgare
  CDS (1)..(1026)
atggcgacgtcgtcgccgccccgcgtgtgcgtcaccggcggcaacggcttcataggctcgtgcctcgtcaagctgctcctctcccgcggctacgccgtccacgccaccgtccgcgacccacgtgacccgaagaacgcgttcctgacggagctggacggagccccggcgaacctgcggctgttcaaggcggacgtgctcgactacgacaccgtgacggccgccttcgccggctgcgagggcgtcttccatgtcgccactccggtgcccgacaaaaagatggttgatccacagaaagagatgatggaacctgctgtcaagggcaccatgaatgtgctcaaggcttgctcggctacgaaagttcataaactcatcgtggtctcgtccatcgccactagttgcttcaacccggattggcctcgagataaaatcaaagatgagagctgctggtcagacaaggagctctgcaaacagagtgagaactggtattctcttgcaaagactgaagccgaggagatggccctggaatacggagagaagaacgggttgcacgtcgtcacattttgccctggtctggttttaggccctctgttgcagcatgtggcggtcaataccagcagcaaggtcctcgtctacatgataaaaggaggccctgacacgatgaacaacaagttctttcccatagtagacgttcgcgatgttgccgatgcgttgctcctgttgtacaacaaggcagggccatctgagagatacatatgctcactggagcaaatggacctaaaggatctgctggcaatcatgaagagcatgtaccctaattacagttatgtagacaagatggttgatgtggatttcaacgttggagtcacttcggaaaagctgaagaatctagggtggaaaccaaggaagatcgaggagacactcgcggatagtatcgagtcctacaaaaaagcagggcttcttggggtttcagatgacgaaccatgccggcttccattcatctaccgaatgccgcctatccaggaatga

SEQ ID NO: 5267 - protein, 341 aa, Hordeum vulgare
MATSSPPRVCVTGGNGFIGSCLVKLLLSRGYAVHATVRDPRDPKNAFLTELDGAPANLRLFKADVLDYDTVTAAFAGCEGVFHVATPVPDKKMVDPQKEMMEPAVKGTMNVLKACSATKVHKLIVVSSIATSCFNPDWPRDKIKDESCWSDKELCKQSENWYSLAKTEAEEMALEYGEKNGLHVVTFCPGLVLGPLLQHVAVNTSSKVLVYMIKGGPDTMNNKFFPIVDVRDVADALLLLYNKAGPSERYICSLEQMDLKDLLAIMKSMYPNYSYVDKMVDVDFNVGVTSEKLKNLGWKPRKIEETLADSIESYKKAGLLGVSDDEPCRLPFIYRMPPIQE

SEQ ID NO: 5268 - DNA, 1197 bp, Hordeum vulgare
  CDS (42)..(1061)
gaattcccgggtcgacttcgcttcgacgatttcgtaaagccatggcagagaagcagcgacaaggactgaacgtggaggaggggagctccggagcagcggggaagctcgtctgcgtcaccggcgcgtccgggtacatcgcgtcctggatcgtcaagctcctcctcgaccgcggctacaccgtccatggcaccgtccgggacaccgctgacccaaataaaacattgcacctgcgtgctcttgatggagcaaacgataggctgcacctgttcaacgcaaacttgttagaggaaggctctttcgacgctgccattgacggttgcgagtgtgtgttccatgcggcttctccagttttcttcgctgccaaagatcccaaggctgagttacttgattcagcagtcagtggaacgcttaatgttttgcgttcctgcaagaaggcttctgtcagaagagtggtcataacatcgtctatggcttctgttatcgtcaacgggaaaccaagaacccctgatgtaattgttgatgaaacatggttttcactaccagagctttgtaaaaagaatcagcaatggtataccttgtctaagacccttgcagaggaggctgcttggaagttctctaaagataacgaacaagaaataattgtaatgaaccccacaatggtcattggtcctctgctgcagcctacacttaacgctagtgttgaagcagtcttaaacctaatcaatggatcatctcctacatgccctaattatgcccatggctgggtaaatgtcagagatgtggccctggcacatatccttgcatatgaagttccttcagcaaatggaagatattgcattgttgaaagagttgctcactactcggagcttgtcaagatcatatgcaagatgtatccgaacattccactcccagataagtgtgcagatgatgaaccactttttccaacctaccaagtatccaaggacaagataagaagcttgggtatggaactgattcctctagagactagcattaaagagactatagaaagcttcaaagaaaagggttttgttgcattctgagtctagatatttgtgcaaatatagaaataaaaagtttatgtttatttgacgagataatccctgctatacctaacctgtacttattcaaaagatacacttggtgtgtgcgctgccacaatttaaaaaaaaaaaaaaa

SEQ ID NO: 5269 - protein, 339 aa, Hordeum vulgare
MAEKQRQGLNVEEGSSGAAGKLVCVTGASGYIASWIVKLLLDRGYTVHGTVRDTADPNKTLHLRALDGANDRLHLFNANLLEEGSFDAAIDGCECVFHAASPVFFAAKDPKAELLDSAVSGTLNVLRSCKKASVRRVVITSSMASVIVNGKPRTPDVIVDETWFSLPELCKKNQQWYTLSKTLAEEAAWKFSKDNEQEIIVMNPTMVIGPLLQPTLNASVEAVLNLINGSSPTCPNYAHGWVNVRDVALAHILAYEVPSANGRYCIVERVAHYSELVKIICKMYPNIPLPDKCADDEPLFPTYQVSKDKIRSLGMELIPLETSIKETIESFKEKGFVAF

SEQ ID NO: 5270 - DNA, 1392 bp, Hordeum vulgare
  CDS (47)..(1081)
gcggcagcaaggagcaagacatcccgtaggtggaaggacgaggaggatggcaccgccgcggcgcgtgtgcgtgaccggcggcggcgggtacatcgcctcgtggctcgtcaagctgctcctctcccggggctacgccgtccacgccaccgtccgcgacccatgtgattccaagaacgcgcatctgatgcagctggacggggcggcggagaacctgcgtctgttcaaggccgacgtgctcgacagcgccgcgctggccgccgccgtcgaggggtgcgagggcgtcttccatgtcgcctcccccgtccctgcggataagatcctcgatcctgagtcagaagtgatggtgcctgccgtgaagggcaccgtaaatatccttgaagtttgttcatctatgaaggttcagaaagttgtggtggtgtcatccacttcttctgttcatttcaaccccagctggcctcagggtaaacccaaggatgagagttgctggtcggacaaaaaagtgtgcgcacaacatgagctctggtactgtcttgctaaaactgtcgctgaagagacggctttgggatatgcagaaaagaatgggctcaatgttgttacagtatgcccttgtattgtttttggcccacaactacagcctgttgtcaacaccagcagcgagcttctcgtctatgttctaaaaggaggtcctaatgcgatgaacggcatgctgtggcacatagtcgatgtccgtgatgtggctgatgctttgcttctagtatatgagaaaccagaatcatctgggagatatatcagcgcaccaaattacattaccacaaaagcgattctggacttgctgaagaagacataccctgactacaattacgttaactgcaaggctgaggtggatcataattatcctatcaccccaatctcgtctgcaaaactgaagaatctgggctggaagccaagggaattggaggagacactcctggatagcatcgaatactaccggaagacgggaattctgcaggatggcgagggagacggacacccttgccgccttcctgatctcttccgtttctttcatgccgccgaagaatgaaccgagcgtggcattggcggtgccagtgcggcagtgctcctcctaatcatcctagatatgcgattctgcatgtgatgttgctgaatatctagtgacgttatattctaatatgagaaagctatcaatcttcaagggagggggtgcctcatttcaccaccatattgatgcgagtggagaccaatagatctgctgcgtaggtagcatattccccgtgcgccttgtaaacgaaaataactgcgatgatgctgtgccaacatctctgaatcttgtccctgcaagtgtcgaaaaattcagtcaaaaaaaaaaaaaaa

SEQ ID NO: 5271 - protein, 344 aa, Hordeum vulgare
MAPPRRVCVTGGGGYIASWLVKLLLSRGYAVHATVRDPCDSKNAHLMQLDGAAENLRLFKADVLDSAALAAAVEGCEGVFHVASPVPADKILDPESEVMVPAVKGTVNILEVCSSMKVQKVVVVSSTSSVHFNPSWPQGKPKDESCWSDKKVCAQHELWYCLAKTVAEETALGYAEKNGLNVVTVCPCIVFGPQLQPVVNTSSELLVYVLKGGPNAMNGMLWHIVDVRDVADALLLVYEKPESSGRYISAPNYITTKAILDLLKKTYPDYNYVNCKAEVDHNYPITPISSAKLKNLGWKPRELEETLLDSIEYYRKTGILQDGEGDGHPCRLPDLFRFFHAAEE

SEQ ID NO: 5272 - DNA, 969 bp, Hordeum vulgare
  CDS (1)..(969)
atggaggcggcggcgaagaggagcgttgtgtgcgtgaccggcgcaggaggcttcgtcgcctcatggctcgtcaagctcctcctctccaaggcccactacactgtccgcggcaccgtgcgcgatcccggtaatgctaagaatgctcatctcaaggcgctagaaggtgctggggaaaggctgcagctgctcagcgctgacctgctggactacgacagcattgcgtcggcggttgctggctgtgagggcgtcttccatgttgctagccctgtcccttctggtagatcgaccaaccctgaggaagaagttatagcccctgctgtaacaggcacactgaatgtgttgaaggcttgcaacgaggcaaaagttaagcgagttgtcatagtgtcttcatgtgctgctgtgttcaacaatcctaactggcccaagggcaaagtatttactgaagacagctggtcagacgaggatctgtgcagaaagggtgaggattggtatttgctttccaaaacgcgcgcagagcgtgaggcttttgcttatgcagcgaaaactgggatggatgttgtagctattctaccatcattggtacttggccccttgatgcagccaacagtgaatgcgagcagtaaaattctcctcaaatatctcaaaggagaacatgagactgtagaaaatagattctggaatctagtggatgtccgtgatgttgccgatgctcttcttctggcatatgaaaatccagaggcatctggacggtacatctgcagtccagtacgaataaaagtttctgatgtcataaacattctgaagaccttatatccaacatacacttatcccaaaaactttacggaggtggaagaaggtaaagttatgagttctgagaaacttcagaagctagggtggaccttcaggcctgtagagaagaccctcggagacagtgtcgaatcctacaaagcatctggcatcctgaactga

SEQ ID NO: 5273 - protein, 322 aa, Hordeum vulgare
MEAAAKRSVVCVTGAGGFVASWLVKLLLSKAHYTVRGTVRDPGNAKNAHLKALEGAGERLQLLSADLLDYDSIASAVAGCEGVFHVASPVPSGRSTNPEEEVIAPAVTGTLNVLKACNEAKVKRVVIVSSCAAVFNNPNWPKGKVFTEDSWSDEDLCRKGEDWYLLSKTRAEREAFAYAAKTGMDVVAILPSLVLGPLMQPTVNASSKILLKYLKGEHETVENRFWNLVDVRDVADALLLAYENPEASGRYICSPVRIKVSDVINILKTLYPTYTYPKNFTEVEEGKVMSSEKLQKLGWTFRPVEKTLGDSVESYKASGILN

SEQ ID NO: 5274 - DNA, 1256 bp, Helianthus annuus
  CDS (91)..(1065)
tctggtgactagatcgtttttgtggcgaaatctggattttccgacatcacttcgttctaccagtctgctatttatccgaacctaagacaaatggctggagaagggaaggtggtttgcgttacaggtgcttctgggtacatagcttcatggctcgttaaactcttgcttgaccacggttacaccgttcatgctaccgtccgatctctagatgatccaaaaaagacagaacatttacttgctcttgatggagctaaggaaagactatctttgtttgaggctaacttaagtgtagaaggctcttttgactctgcatttaatggctgcgtttgtgtctttcacacagcatctcctgtaacttttgcttcacttgatgacccacagatggaattgctagatccagcagtgaagggaacactgaatgtgcttaaatcagctgcgaaagttcaatcgctgaagagagtggtcttcacgtcttcactggctgcagttatatatggttacaaacctccaagtggtgtagtggatgaaacctggttttcagatccagtcttttgtgagcagacaaagttgtggtatcatctttcaaagactctggctgagactgccgctgtgaatttttcaaaagagaatggtctggatttggtggtcataaatcctggctttgtaattggtcctatcttacaacctactctcaacttcacttctgaggcatttatgagctttatagaaactggaaaggaagtctttgcagatggaatatacatgcttgttgatgtgagagatatcgctatcgcgcacatattagcatttgagaaagcagaagctaatggtagatattgcatagtcggggatgtggttcgatcatctgaaatcaagatgatcttagacaaactctaccctgatcttggcttttctcaacggtataaagacaagtgtgtcgaggcgcaactatatagtatatcaaaggtgaaggcggaaagtctaggtgttgattttactccattggaggtaagcctcagagataccattgaaagccttaaagagaagaaatttatgaagctataagttcatatgttagtgtgaaaaaaaattacatgcgtgaaaaataataatggttgtgtgaaaaaaactatgtatgtatatgtgtacctattttactggatctggcttagtctccttgccggtaaattatcattaaattctcatattacataaagaaatgtacaaataaattttgaatgaaaaaaaaaaaaaaa

SEQ ID NO: 5275 - protein, 324 aa, Helianthus annuus
MAGEGKVVCVTGASGYIASWLVKLLLDHGYTVHATVRSLDDPKKTEHLLALDGAKERLSLFEANLSVEGSFDSAFNGCVCVFHTASPVTFASLDDPQMELLDPAVKGTLNVLKSAAKVQSLKRVVFTSSLAAVIYGYKPPSGVVDETWFSDPVFCEQTKLWYHLSKTLAETAAVNFSKENGLDLVVINPGFVIGPILQPTLNFTSEAFMSFIETGKEVFADGIYMLVDVRDIAIAHILAFEKAEANGRYCIVGDVVRSSEIKMILDKLYPDLGFSQRYKDKCVEAQLYSISKVKAESLGVDFTPLEVSLRDTIESLKEKKFMKL

SEQ ID NO: 5276 - DNA, 1220 bp, Helianthus annuus
  CDS (21)..(995)
agcgaagagtactgaaaaagatggcgcaatcaaacacgaagatcgtgtgcgtaaccggcggcagtggcttcatcggctcgtggctcgtccgcctcctactggaccgcggctacaccgtcaacgccaccgttaaagatctcaaggacgaaaaggaaacaaagcatctagaagcgttagaaggtgcagaatcgcgtctccgattgtttcaaatcgatcttctggattatgactctattgtcgcggctgttaccggcgtaaccggtgtgttccacgtggcttctccttgcaccgttgataaagttcatgatcccgagaatgagctattggcacctgcaatcaagggtacaatcaatgtactgacagcagcaaaggagctgggagttaagcgcgtggttgtcacttcatctgtttcagccattgtgcctagtccttcctggccgtcagatgtcccaaagaacgaggattgctggaccgatgaagaattttgcaagcagaaggagttgtggtatccactctcaaaaacactagctgagaaagctgcatgggatttttctaaagagaaaggtttagatatagttgtggtgaaccctggaacagtaatgggccccattcttcctccaacaattaatgcaagcatgcagatgattcgtcttcttatccaaggatgtacggatgaatatgagaatttcttcatgggcgctgttcatgttaaagatgtggcgctagctcatatattggtgtatgaaaatacatcagcaacaggaagacatatgtgtgttgaatccatctgtcattatggtgatttcgccgctaaggttgcagaattataccccacgtataacatccccaggttaccaaaggacacccagccggggttaatgagatcaaagaagggaggtaagaagctcatggatttggggcttgagttcatccctatggagcagattatcagggacagtgttgagactttgaaagccaaaggctatctatcttgaatggcgttagaaactattgggtatttaagtgattgttgttgtgtgccctgtttttggttttatgacgtgtgtgtcacaagaatgccagtttgcctttaatatgtgactacctaggatttctcctcttaaaatcccttttttgttttcttcttcacttcctctcaacaatatctttttctctctctataatatttcactcataattcaaggaaaaaaaaaaaaaaa

SEQ ID NO: 5277 - protein, 324 aa, Helianthus annuus
MAQSNTKIVCVTGGSGFIGSWLVRLLLDRGYTVNATVKDLKDEKETKHLEALEGAESRLRLFQIDLLDYDSIVAAVTGVTGVFHVASPCTVDKVHDPENELLAPAIKGTINVLTAAKELGVKRVVVTSSVSAIVPSPSWPSDVPKNEDCWTDEEFCKQKELWYPLSKTLAEKAAWDFSKEKGLDIVVVNPGTVMGPILPPTINASMQMIRLLIQGCTDEYENFFMGAVHVKDVALAHILVYENTSATGRHMCVESICHYGDFAAKVAELYPTYNIPRLPKDTQPGLMRSKKGGKKLMDLGLEFIPMEQIIRDSVETLKAKGYLS

SEQ ID NO: 5278 - DNA, 987 bp, Helianthus annuus
  CDS (1)..(987)
atggagaaaggatgcatttgtgtgaccggaggaacagggtttttagcatcatggatcatcaagagactgcttcaggatgggtattctgttaataccaccatcagatctcatgcagcagggtcaaagaaagatgtgagctaccttacaaacctaccctgtgcatcagagaagcttaaaattttcgatgcggatttaagcaaaccggagaccttcgaggcaccaatcaaaggctgcattggtgtctttcatgttgcccacccgatggatgggagcaacgatgctatagaagccgtaaccgaaaaatcaatgaaggccagtttaggtattttacaagcatgtgttgattcaaagacagtaaagaaggttgtgtacacatctagcgtgtcagcagtaatgtttaacgagaaaaaacacaatggcgttgtagacgaggaatcttggagtgacgttgattatattcgcactcatgttaaattcggagattggtatcatatttcaaagacattgaccgagaaggcaatcctcgagtttggtgagaaagaaggactagatgtcgcaacggtccatccttcgtttattcatggtccatttcttggccctcgctgcccacaatctgtgcgcgacgtgatggctatgatatttggggacactcatctttatgcgatgctacgaagagcgccttatgttcatgttgatgatgtcgcaagcgcacatattcatctttttgagcaccctaatgcgaaggggagatatatttgttcgaaaactgaagttcctatagaggagctgtacaaactattatccaccaaatatccagaatacaaaataccaagtatcgactttttgaagtctgaggatggtgaaaaattgatgttccctagcgtctcatcgaaaaagctcttaggcactggatttgagttcaaatatgggattgaagagatgtttgatgatgcaattgaatgttgtaagcgaaacaacatactataa

SEQ ID NO: 5279 - protein, 328 aa, Helianthus annuus
MEKGCICVTGGTGFLASWIIKRLLQDGYSVNTTIRSHAAGSKKDVSYLTNLPCASEKLKIFDADLSKPETFEAPIKGCIGVFHVAHPMDGSNDAIEAVTEKSMKASLGILQACVDSKTVKKVVYTSSVSAVMFNEKKHNGVVDEESWSDVDYIRTHVKFGDWYHISKTLTEKAILEFGEKEGLDVATVHPSFIHGPFLGPRCPQSVRDVMAMIFGDTHLYAMLRRAPYVHVDDVASAHIHLFEHPNAKGRYICSKTEVPIEELYKLLSTKYPEYKIPSIDFLKSEDGEKLMFPSVSSKKLLGTGFEFKYGIEEMFDDAIECCKRNNIL

SEQ ID NO: 5280 - DNA, 1241 bp, Brassica napus
  CDS (66)..(1088)
cggaatttccgggtcgacgacttcgtcgaagaccgaagctttcactttcgaccacaccggaaaaaatgccggtcgacgaatctacagcggtcgggaaaacagtttgcgtcaccggagctggtggatacatcgcttcttggattgttaagttactacttgagagaggctacacggtcaaaggaaccgtacggaatccagatgatcccaagaatacacatttgagagaactcgaaggagccaaggagagactgattctgtgcaaagcagatcttcaggactacgatgctcttaagtcggctatcgatggttgtgacggcgtctttcatacggcttctccggtcactgacgatcccgagcagatggtggagccggccgtgaacggagccaagtttgtaattaatgctgcagctgaagccaaggttaagcgcgtggtaatcacctcctcaattggtgcggtctacatggacccgagccgtgaccctgaagccgtcgttgacgaaagttgttggagtgatcttgagttctgcaaaaacaccaagaattggtattgttacggcaagatggtggcggagcaagccgcgtgggaaacggcagaggagaaaggtgttgacatggtggttttgaatccagtgctggttcttggcccaccgttacagccgacgatcaacgctagtctcttccacgttctcaagtatctaaccggctccgctaagacttacgctaatttgactcaggcttatgtggatgttcgtgatgtcgcactagctcatgttctggtctacgaggccccctcggcctctggacgttatctcctggcggagagcgcacttcaccgcggtgaagttgttgagattctggctaagttattcccggagtacccaattccaaccaagtgtaaggacgagaagaaccctagagccaagccgtacaagttcactaatcaaaagattaaggacttaggcttagagttcacatccaccaagcaaagcctctacgacacagttaagagcttgcaagagaaaggtcatctccctcctccttcaacatctcaagaatccagccaaaatggcatcaagatcgagtcttgaataacttattccctggtgtattatccttagccactggcgtttcctttgttttagaaaaataaaccagatgtttaattattgtctctggttatgtgaaacctttgtttcaaaatgtcttgctctctgtttactcggatctttagccaagaacgt

SEQ ID NO: 5281 - protein, 340 aa, Brassica napus
MPVDESTAVGKTVCVTGAGGYIASWIVKLLLERGYTVKGTVRNPDDPKNTHLRELEGAKERLILCKADLQDYDALKSAIDGCDGVFHTASPVTDDPEQMVEPAVNGAKFVINAAAEAKVKRVVITSSIGAVYMDPSRDPEAVVDESCWSDLEFCKNTKNWYCYGKMVAEQAAWETAEEKGVDMVVLNPVLVLGPPLQPTINASLFHVLKYLTGSAKTYANLTQAYVDVRDVALAHVLVYEAPSASGRYLLAESALHRGEVVEILAKLFPEYPIPTKCKDEKNPRAKPYKFTNQKIKDLGLEFTSTKQSLYDTVKSLQEKGHLPPPSTSQESSQNGIKIES

SEQ ID NO: 5282 - DNA, 1156 bp, Brassica napus
  CDS (75)..(1040)
tcccgggtcgacgatttcgtcttaaaatcaagcattttataggaagagatctgtgagctcatacgttatcaccaatggcgaaggagacagtgtgtgtaaccggagccaacggtttcatcggatcctggattatccaaacattactcgacaacggatacaccaaaatccacgcctccatctacccaggatccgacccgactcatctcctcaaactaccaagacccgacgacacaaacaccgagatcaagatcttcgaagcagatctcctagaccccgacgccatcgccagagccgtagacggatgcgcaggagtgttccacgtggcgtcgccttgtacgttggatccaccggagaatcccgagaaggagctggtcgaaccagcggttaagggaacgatcaacgtgttgctagcagctaataggttcaacgtgaggcgcgtggtgatcacttcctctatttcggctttggttccgaacccaaattggccggaaggaaaacccgtcgatgagtcgtcgtggaccgatcttgattattgcaagtcgatgcagaaatggtatccaatttcgaagacgctagctgagaaagcggcttgggaattttcggagaagcatggaaccaacgttgtgaccatccatccatccacatgcctcggaccacttctgcaacctagccttaacgcaagctgcgccgttttgctacagctcttacaaggctcgacggagacacaagagtatcactggctcggtgtggtgcacgtgagagatgtggcgaaagctcacgtgatgctgttcgaaacacctgaagcttctggtcggtttctgtgcagtaatgggatctatcagttcagtcagtttgctgctcttgtgtccaaactcttccctgagtttgatgttcacaggtttgataaaaaaacgcaacctgcgcttacgccttgtaaagatgcggctaagagattgattgagctggggatggtgtttactccggtcgaagatgcggttaaggagacggtccagagtcttagagacaaaggcttcctctgaatagaaataaaatatctttgagagttccaaactatgtgacctttattgtataatgcaagtagaggaactaagaagtaaactggtggttaatatgatacatctatgtatcgagtaca

SEQ ID NO: 5283 - protein, 321 aa, Brassica napus
MAKETVCVTGANGFIGSWIIQTLLDNGYTKIHASIYPGSDPTHLLKLPRPDDTNTEIKIFEADLLDPDAIARAVDGCAGVFHVASPCTLDPPENPEKELVEPAVKGTINVLLAANRFNVRRVVITSSISALVPNPNWPEGKPVDESSWTDLDYCKSMQKWYPISKTLAEKAAWEFSEKHGTNVVTIHPSTCLGPLLQPSLNASCAVLLQLLQGSTETQEYHWLGVVHVRDVAKAHVMLFETPEASGRFLCSNGIYQFSQFAALVSKLFPEFDVHRFDKKTQPALTPCKDAAKRLIELGMVFTPVEDAVKETVQSLRDKGFL

SEQ ID NO: 5284 - DNA, 1171 bp, Brassica napus
  CDS (61)..(1032)
gaaagagttactttactgtctgaaactgaaacgctctaactctctaagcaaaaatcatcaatgtcgacggaacgagaagtagtctgtgtcaccggcgcaagtggctgcatcgggtcgtggctcgtccatctgctcctcctccgcggctactccgttcacgccaccgtgaaaaacctccaggatgagaaagagaccaaacatctggaagctctcgaaggagcagccacgcgcctccatctattcgagatggatctactgaagtacgacactgtttccgccgccgtcaacggatgtgccggcgttttccacctcgcatctccctgtatcgtcgacgaagtccaagatccacagaagcaactacttgatccagcggttaaggggacattaaatgtactgacggcggcgaaagaagccggcgtgaagagggttgtggtgacgtcttccatatcggcgataaccccaagccccaactggcctgctgataagatcaagaacgaggagtgttgggctgatgaagacttctgcaagcaaaatggattgtggtatccactttctaagacgcttgctgagaaggcggcttgggagtttgccgaggagaagggattggatgtggttgtggtgaatccaggaaccgtcatgggtcctgtcattcctccatccatcaacgctagcttactcatgcttcaacgcctccttgaggggtgtacagagacatacgagaacttcttcatgggttcggtgcatttcaaggatgtggcattagctcatatacttgtctatgagaacccatctgctaaaggaagacacctgtgcgttgaggccatctctcactacggtgatttcgtagccaaagtagctgaactctatcctaattacagtgtccccaagttaccgagagagactcaaccgggtttactccgagccaagaacgcagcaaagaagctgatggaattggggttagagttcagttccacggaggttatcatcaaggatggtgtggagagtcttaaaagcaaaggatttatctcttaaactcatttgcttgatctagcagtgagcaaattatggtggcagcagaatcatatcatgttatatatataagactttgtaatttgaataagctgcacattgttgtaatatacaagatccaactattatttattccctgtga

SEQ ID NO: 5285 - protein, 323 aa, Brassica napus
MSTEREVVCVTGASGCIGSWLVHLLLLRGYSVHATVKNLQDEKETKHLEALEGAATRLHLFEMDLLKYDTVSAAVNGCAGVFHLASPCIVDEVQDPQKQLLDPAVKGTLNVLTAAKEAGVKRVVVTSSISAITPSPNWPADKIKNEECWADEDFCKQNGLWYPLSKTLAEKAAWEFAEEKGLDVVVVNPGTVMGPVIPPSINASLLMLQRLLEGCTETYENFFMGSVHFKDVALAHILVYENPSAKGRHLCVEAISHYGDFVAKVAELYPNYSVPKLPRETQPGLLRAKNAAKKLMELGLEFSSTEVIIKDGVESLKSKGFIS

SEQ ID NO: 5286 - DNA, 1217 bp, Brassica napus
  CDS (61)..(1092)
ggaacgagcattaatcattttcttcacaaaccgaagcatatactttaaaccgccggaaaaatgccagtcgacgaatcctcaccggccggaaaaaccgtctgcgtcaccggagctggtggatacatagcttcttggattgttaagttactcctcgagagaggctacaccgtcaaaggaaccgtacggaatccagatgatccaaagaatacacatttgagagaactcgaaggagccaaggagagactgattctgtgcaaggcagatcttcaggactacgaggctcttaaaacggcgattgatggctgcgacggcgtgtttcacacggcttctccggtcactgacgatcccgagcaaatggtggagccggccgtgaacggagccaagttcgtaattaatgcggcagctgaagccaaggtcaagcgcgtggtcatcacctcctcaattggtgcagtctacatggacccgaaccgtgaccctgaagccgtcgttgacgaaagttgttggagtgatcttgagttttgcaaaaacacaaagaattggtattgttacggcaagatggtggcggagcaagccgcgtgggagacggcgaaggagaaaggtgttgacctggtggttttgaatcccgtgctggtcctgggaccaccgctacagccgacgatcaacgccagtctcttccacgtcctcaagtatctaaccggctccgctaagacttacgctaatctgactcaggcttatgtggatgttcgcgatgtcgcgctggcccatgtgctggtctacgaggcaccctcggcctctggacgttatctcctcgcagagagcgcctttcaccgcggcgaagttgttgagattctggctaagttattcccggaatacccacttccgaccaagtgcaaggacgagaagaacccaagagccaagccatacaaattcactaaccaaaagattaaggacttgggcttagagttcacttccaccaagcaaagcctttatgatacagttaagagcttgcaagagaagggtcatcttcctccacctcctcctccttcaacatcacaagaatccagccaaaatggcatcaagatcgagtcttgaataacttattccctggtgtattatccttagcactggcgtttcctttgttttacaaaaataaaccagatgtttaattattgtctctgttatgtgaaacctttgtttcaaaatgtcttgctctctgt

SEQ ID NO: 5287 - protein, 343 aa, Brassica napus
MPVDESSPAGKTVCVTGAGGYIASWIVKLLLERGYTVKGTVRNPDDPKNTHLRELEGAKERLILCKADLQDYEALKTAIDGCDGVFHTASPVTDDPEQMVEPAVNGAKFVINAAAEAKVKRVVITSSIGAVYMDPNRDPEAVVDESCWSDLEFCKNTKNWYCYGKMVAEQAAWETAKEKGVDLVVLNPVLVLGPPLQPTINASLFHVLKYLTGSAKTYANLTQAYVDVRDVALAHVLVYEAPSASGRYLLAESAFHRGEVVEILAKLFPEYPLPTKCKDEKNPRAKPYKFTNQKIKDLGLEFTSTKQSLYDTVKSLQEKGHLPPPPPPSTSQESSQNGIKIES

SEQ ID NO: 5288 - DNA, 1120 bp, Brassica napus
  CDS (36)..(1067)
acaaaccgaagcatatactttcgaccgctggaaaaatgccactcgccgaatcctcaccggccggaaaaaccgtctgcgtcaccggagctggtggatacatagcttcttggattgttaagttactcctcgagagaggctacaccgtcaaaggaaccgtacggaatccagatgatccaaagaatacacatttgagagaactcgaaggagccaaggagagactgattctgtgcaaggcagatcttcaggactacgaggctcttaaaacggcgattgatggctgcgacggcgtgtttcacacggcttctccggtcactgacgatcccgagcaaatggtggaacctgccgtgaacggagccaagttcgtaattaatgcggctgctgaagcaaaggtcaagcgcgtggtcatcacctcctcaattggtgccgtctacatggacccgaaccgtgaccctgaagccgtcgttgacgaaagttgttggagtgatcttgagttttgcaaaaacacaaagaactggtattgttacggcaagatggtggcggagcaagccgcgtgggagacggcgaaggagaaaggtgttgacctggtggttttgaatcccgtgctggtccttggaccgccgctacagccgacgatcaacgccagtctcttccatgtcctcaagtatctaaccggctccgctaagacttacgctaatctgactcaggcttatgtggatgttcgcgatgtcgcgctggcccatgtgctggtctacgaggcaccctcggcctctggacgttatctcctcgcagagagcgcctttcaccgcggcgaagttgttgagattctggctaagttattcccggaatacccacttccgaccaagtgcaaggacgagaagaacccaagagccaagccatacaaattcactaaccaaaagattaaggacttgggcttagagttcacttccaccaagcaaagcctttatgatacagttaagagcttgcaagagaagggtcatcttcctccacctcctcctccttctacatcacaagaatcgagccaaaatggcatcaagatcgagtcttgaatagcttattccctgaagtatcatcctcagcgattgatatatgctttctattt

SEQ ID NO: 5289 - protein, 343 aa, Brassica napus
MPLAESSPAGKTVCVTGAGGYIASWIVKLLLERGYTVKGTVRNPDDPKNTHLRELEGAKERLILCKADLQDYEALKTAIDGCDGVFHTASPVTDDPEQMVEPAVNGAKFVINAAAEAKVKRVVITSSIGAVYMDPNRDPEAVVDESCWSDLEFCKNTKNWYCYGKMVAEQAAWETAKEKGVDLVVLNPVLVLGPPLQPTINASLFHVLKYLTGSAKTYANLTQAYVDVRDVALAHVLVYEAPSASGRYLLAESAFHRGEVVEILAKLFPEYPLPTKCKDEKNPRAKPYKFTNQKIKDLGLEFTSTKQSLYDTVKSLQEKGHLPPPPPPSTSQESSQNGIKIES

SEQ ID NO: 5290 - DNA, 1185 bp, Brassica napus
  CDS (61)..(1032)
gaaagagttactttactgtctgaaactgaaacgctctaactctctaagcaaaaatcatcaatgtcgacggaacgagaagtagtctgtgtcaccggcgcaagtggctgcatcgggtcgtggctcgtccatctgctcctcctccgcggctactccgttcacgccaccgtgaaaaacctccaggatgagaaagagaccaaacatctggaagctctcgaaggagcagccacgcgcctccatctattcgagatggatctactgaagtacgacactgtttccgccgccgtcaacggatgtgccggcgttttccacctcgcatctccctgtatcgtcgacgaagtccaagatccacagaagcaactacttgatccagcggttaaggggaccttaaatgtactgacggcggcgaaagaagccggcgtgaagagggttgtggtgacgtcttccatatcggcgataaccccaagccccaactggcctgctgataagatcaagaacgaggagtgttgggctgatgaagacttctgcaagcaaaatggattgtggtacccactttctaagacgcttgctgagaaggcggcttgggagtttgctgaggagaagggattggatgtggttgtggtgaatccaggaaccgtcatgggtcctgttattcctccatccatcaacgctagcatgctcatgcttcaacgcctccttgaggggtgtacagagacatacgagaacttcttcatgggttcggtgcatttcaaggatgtggcattagctcatatacttgtctacgagaacccatctgctaaaggaagacacttgtgcgttgaggccatctctcactacggtgatttcgtagccaaagtagctgaactctatcctaattacagtgtccccaagttaccgagagagactcaaccgggtttactccgagccaagaacgcagcaaagaagctgatggaattggggttagagttcagttccatggaggttatcatcaaggatggtgtggagagtcttaaaagcaaaggatttatctcttaaactcatttgcttgatctagcagtgagcaaattatggtggcagcagaatcatgtcatgttatatatataagactttgtaatttgaataagctgcacattgttgtaatatacaagatccaactattagaaaaaaaaaaaaaaaaaaaaaaaaaaa

SEQ ID NO: 5291 - protein, 323 aa, Brassica napus
MSTEREVVCVTGASGCIGSWLVHLLLLRGYSVHATVKNLQDEKETKHLEALEGAATRLHLFEMDLLKYDTVSAAVNGCAGVFHLASPCIVDEVQDPQKQLLDPAVKGTLNVLTAAKEAGVKRVVVTSSISAITPSPNWPADKIKNEECWADEDFCKQNGLWYPLSKTLAEKAAWEFAEEKGLDVVVVNPGTVMGPVIPPSINASMLMLQRLLEGCTETYENFFMGSVHFKDVALAHILVYENPSAKGRHLCVEAISHYGDFVAKVAELYPNYSVPKLPRETQPGLLRAKNAAKKLMELGLEFSSMEVIIKDGVESLKSKGFIS

SEQ ID NO: 5292 - DNA, 1149 bp, Brassica napus
  CDS (34)..(1002)
taatactagtcgtcagaaagtgagtggagatatatgaacggtggaggaaaagtggtttgtgtcaccggagcttccggttacatagcgtcttggattgtgaagcttttgcttctccgtggctacaccgtcaaggctactgttcgagacccaaaggatcaaaagaaaacagatcatcttcttgcacttgacggtgcaagagaaagacttcaattattcaaagcaagtcttttagaagaaggttctttcgagcatgcaattgatgcatgtcacgctgtcttccacaccgcttcaccagtcaaaatcattgccactgatccacaggctgagctgatagaaccagccgtcaagggaactattaacgtactagcaacatgcactaaagtgtcttctgtcaagaggatcattttaacgtcgtccatggccacacttcattctcctaacttccccttggaaccaaacgtcttactagacgaaacaaccttctctgatccaagtgtctgtgaggaggaaaagcaatggtatatactctccaagactttggccgaaaatgcggcatggacgtttgccaagcacaacaacttggacttggtcataatgaatccaggactcgttattggaccagtcctacaaccaactattaatttctcagtagatgtggttatagattttataaaaggtaagaacacttttaataggaagcatcatagacttgtggacgtgagggatgttgctctagctcatatcaaggcgctcgagactccttcagccaaaggcagatacatcattgatgctccgattgtcacaacggaggagattgagaaaatcttacgtgaattctttcctgatttgtgtattgctcatgagaatgaagagattgatttgaattcgatgacttacaaagtaaatgtagaaaaggtgaaaagtttggggattgagtttactcctacagaaacaagccttagagacactgttcttagtctcaaggagaaacatcttgtgtgaccatccccttttgttaacaaaaggcactatgaatatatgcttttgtgtttgtttttatttataatcatagcatatatactctaaatgtttaaatactccctttgttttatactgtaaacagttttacctaaaaaaagcatgttaatc

SEQ ID NO: 5293 - protein, 322 aa, Brassica napus
MNGGGKVVCVTGASGYIASWIVKLLLLRGYTVKATVRDPKDQKKTDHLLALDGARERLQLFKASLLEEGSFEHAIDACHAVFHTASPVKIIATDPQAELIEPAVKGTINVLATCTKVSSVKRIILTSSMATLHSPNFPLEPNVLLDETTFSDPSVCEEEKQWYILSKTLAENAAWTFAKHNNLDLVIMNPGLVIGPVLQPTINFSVDVVIDFIKGKNTFNRKHHRLVDVRDVALAHIKALETPSAKGRYIIDAPIVTTEEIEKILREFFPDLCIAHENEEIDLNSMTYKVNVEKVKSLGIEFTPTETSLRDTVLSLKEKHLV

SEQ ID NO: 5294 - DNA, 1077 bp, Brassica napus
  CDS (34)..(1002)
taatactagtcgtcagaaagtgagtggagatatatgaacggtggaggaaaagtggtttgtgtcaccggagcttccggttacatagcgtcttggattgtgaagcttttgcttctccgtggctacaccgtcaaggctactgttcgagacccaaaggatcaaaagaaaacagatcatcttcttgcacttgacggtgcaagagaaagacttcaattattcaaagcaagtcttttagaagaaggttctttcgagcatgcaattgatggatgtgacgctgtcttccacaccgcttcaccagtcaaaatcattgccactgatccacaggctgagctgatagaaccagccgtcaagggaactattaacgtactagcaacatgcactaaagtgtcttctgtcaagagggtcattttaacgtcgtccatggccacacttcattctcctaacttccccttgggaccaaacgtcttactagacgaaacaaccttctctgatccaagtgtctgtgaggaggaaaagcaatggtatatactctccaagactttggccgaaaatgcggcatggacgtttgccaaggacaacaacttggacttggtcgtaatgaatccaggactctttattggaccagtcctacaactaactattaatttctcagtagatgtggttatagattttataaaaggtaagaacacttttaataggaagcatcatagacttgtggacgtgagggatgttgctctagctcatatcaaggcgctcgagactccttcagccaaaggcagatacatcattgatgctccgattgtcacaacggaggagattgagaaaatcttacgtgaattctttcctgatttgtgtattgctcatgagaatgaagagattgatttgaattcgatgacttacaaagtaaatgtagaaaaggtgaaaagtttggggattgagtttactcctacagaaacaagccttagagacactgttcttagtctcaaggagaaacatcttgtgtgaccatccccttttgttaacaaaaggcagtatgaatatatgcttttgtgtttgtttttatttataatcatagcatat

SEQ ID NO: 5295 - protein, 322 aa, Brassica napus
MNGGGKVVCVTGASGYIASWIVKLLLLRGYTVKATVRDPKDQKKTDHLLALDGARERLQLFKASLLEEGSFEHAIDGCDAVFHTASPVKIIATDPQAELIEPAVKGTINVLATCTKVSSVKRVILTSSMATLHSPNFPLGPNVLLDETTFSDPSVCEEEKQWYILSKTLAENAAWTFAKDNNLDLVVMNPGLFIGPVLQLTINFSVDVVIDFIKGKNTFNRKHHRLVDVRDVALAHIKALETPSAKGRYIIDAPIVTTEEIEKILREFFPDLCIAHENEEIDLNSMTYKVNVEKVKSLGIEFTPTETSLRDTVLSLKEKHLV

SEQ ID NO: 5296 - DNA, 1397 bp, Glycine max
  CDS (198)..(1199)
ctacgcgggggtgccacatcaccatattccatagccagcgagctactagcatcttcttccatcaccacattcatcttaattaatattctctagtggtgcttcccaatcaatatcctttaattttgcctcaattcctttctttctcattcaccaatccatacttcattttgataatttcttaaaccaacaccaccaagatgccaactgacacatcatcagtttccggcggcaaaatcgtgtgtgtgaccggtgccggcggtttcatagcctcttggcttgtcaaacatctcttagagaaaggctacactgtgagaggaaccgtgagaaacccagatgatccgaagaatggtcatttgaaagagttggaaggaggcaaggagaggctaactctgcataaagttgatctcttcgatattgactccattaaagaagctcttaacggttgccacggtgtcttccacaccgcttctccagtcaccgacaaccctgaagagatggtagagccagcagtgaaaggaacgaagaatgtgatcacagcagcagcagaagcaaaagtgcgacgggtggtgttcacttcgtcaattggcacagtctacatggaccccaatacgagtagggatgcgttggtcgatgaatcattctggagtgatttggagtactgcaagaacaccaagaattggtattgctacggaaagacggtggcagaacaaacagcatgggatgtagcaaaagagagaggggtggacttggttgtggtgaacccagttttggtaattggaccattactgcaaccaaccattaatgctagtacaattcacatcctaaagtaccttactggctctgccaaaacttatgtaaatgcaactcaggcttacgtacatgtgagggatgtggcattagcccacatacttgtttatgagaaaccttcagcttctggtcgatacatatgtgccgaaagctcgctgcatcgtggtgagctagttgaaattttggccaagtttttccccgagtacccaattcctaccaaatgttcagatgaaaagaacccgagagtaaaaccctacatattttcaaatcaaaagctgaaagatttgggattggaattcaccccagtgaagcagtgtctatatgacaccgttaaaaatctgcaagagaatggccaccttcctgtccccccaaagcaaaaagattcctattgaagttagatcctacctagctaggttgccataaattaattaacaagtttaattctggtacaaattacaattgtagttgttaatcaatttatatttaatccttagaagtacgtattttcagtttttaagacacacaccacacaaattgttgccttttgtaaaagtataaccgataacattaatggattatattttgtcccc

SEQ ID NO: 5297 - protein, 333 aa, Glycine max
MPTDTSSVSGGKIVCVTGAGGFIASWLVKHLLEKGYTVRGTVRNPDDPKNGHLKELEGGKERLTLHKVDLFDIDSIKEALNGCHGVFHTASPVTDNPEEMVEPAVKGTKNVITAAAEAKVRRVVFTSSIGTVYMDPNTSRDALVDESFWSDLEYCKNTKNWYCYGKTVAEQTAWDVAKERGVDLVVVNPVLVIGPLLQPTINASTIHILKYLTGSAKTYVNATQAYVHVRDVALAHILVYEKPSASGRYICAESSLHRGELVEILAKFFPEYPIPTKCSDEKNPRVKPYIFSNQKLKDLGLEFTPVKQCLYDTVKNLQENGHLPVPPKQKDSY

SEQ ID NO: 5298 - DNA, 1869 bp, Glycine max
  CDS (466)..(1569)
ccccattggacaagtttttttaccccccgccatcagtccagagctttttgatggcatgtaaggggccaaaatcgagaaccccaatcgtggggaattatttttcgcaaaaggaggtaggtggtccttaaaagtggttttaaaatggggatttttgaagggggcaaatcaaacttcaaggcattttgagtttctttatggccaatcccaacaggtccccggtttttgatattttttggggaatttctcaagtttttgaaattgctggtaatattcttaagccagctttttttgttccacaggctactgccagatcttctgaaaacgcggaatcctctgcatgatctggaattcgtgttttctttcgcttgttcgtttgtttaattcaataaaggaaattaggcatgaccctcttgttgagtatgctctgcctatctgaaaatttccacacctcttttaattgtcgtaatgatgtgggaaccgtaccgagcagctctgatctcactcaccaacctctttctttgttccgttctactttcccttcccaacaacaacaagaagatgccttctgcagaagcttcctccgaaaccatttgtgtcaccggcgctggtggcttcatcgcctcttggatggtcaaactcctcttggaaaaaggctacactgtccgaggaaccctcagaaatccagatgatcccaagaacgggcacttgaaggagtttgaaggagcctccgagaggttaactctgcataaggttgacctccttcatcttgactccgttagatcagttattaacggttgccatggtgtctttcacactgcttctcccgtcaccgataaccccgaagaaatggtggagccagcggtgagtggagctaagaatgtgatcatagctgctgcagaggctaaagttagacgtgtggtgttcacctcatccattggtgccgtctatatggaccccagtaggagcatcgatttggtggttgacgagtcctgttggagtgatttggaatattgcaagaacaccaagaattggtattgctatgggaaggctgtggctgaacaagcagcatgggacacagcaaaagagaatggggtggacttggttgtagtgaacccagttttggttcttggaccattactgcagcccacaatcaatgctagtacaattcacatcctcaagtacctcactggctctgctaagacctatgcaaatgccacacaggcttatgtgcatgttagggatgtggcattggcccacatacttgtttatgagaagccttctgcctctggtagatacctatgtgccgaaagctccctccaccgtggagaattagttgaaattctcgccaagtatttcccggagtacccagttcccaccaagtgttcagatgaaaagaatccgagagcaaaaccctacactttttcaaatcaaaagctgaaagatttgggattggaattcactccagtgagtcagtgtctatatgaaacagtgaagagcctgcaggagaaaggccaccttccagttcctgcaaagcagcaggaagaagattcaactaccgtgaaatcctaaatgagcagctagttgtccactaaggcaagaagctgcagcttgtggcaatctgtgctcatcttatatattataatagagaatcctacattagaagactgctgtatttggattttgttaaaaagacatcaactaaattgttgccgtgtatgaacttataatattaatgaaatttattcccctcgttgagttgaataaaaaaaaaaaaaaaaaaaaaaaaaaaactcgagggggggcccggtacccaattcgccctatagtgagtcgtattacgcgcgctcactggccgtcgttttacaacgt

SEQ ID NO: 5299 - protein, 367 aa, Glycine max
MMWEPYRAALISLTNLFLCSVLLSLPNNNKKMPSAEASSETICVTGAGGFIASWMVKLLLEKGYTVRGTLRNPDDPKNGHLKEFEGASERLTLHKVDLLHLDSVRSVINGCHGVFHTASPVTDNPEEMVEPAVSGAKNVIIAAAEAKVRRVVFTSSIGAVYMDPSRSIDLVVDESCWSDLEYCKNTKNWYCYGKAVAEQAAWDTAKENGVDLVVVNPVLVLGPLLQPTINASTIHILKYLTGSAKTYANATQAYVHVRDVALAHILVYEKPSASGRYLCAESSLHRGELVEILAKYFPEYPVPTKCSDEKNPRAKPYTFSNQKLKDLGLEFTPVSQCLYETVKSLQEKGHLPVPAKQQEEDSTTVKS

SEQ ID NO: 5300 - DNA, 1308 bp, Glycine max
  CDS (89)..(1108)
gtcgacgatttcgttctgatctcactcaccattcaccaacctgcttctctgttctcttctttcccttcccaagaagaagaagaagaagatgccttcttcagaatcatcaacaggcttctccgaaaccatttgtgtgaccggcgctggtggcttcatcgcctcttggatggtcaaactcctcttggagaaaggctacactgtccgaggaaccctcagaaacccagatgatcccaagaacgggcacttaaaagagtttgaaggagcttcccagagactaactctgcataaggttgacctccttcatcttgactccgttagatctgttattaacggctgtcatggtgtctttcacactgcttctcccgtcaccgataaccccgaagaaatggtggagccagcggtgagtggagctaagaatgtgatcatagctgctgcagaggctaaagttagacgtgtggtgttcacctcatccattggtgccgtctatatggaccccagtaggagcatcgatttggtggttgacgagtcctgttggagtgatttggaatattgcaagaacaccaagaattggtattgctatgggaaggctgtggctgaacaagcagcatgggacacagcaaaagagaatggggtggacttggttgtagtgaacccagttttggttcttggaccattactgcaacccacaatcaatgctagtacaattcacatcctcaagtacctcactggctctgctaagacctatgcaaatgccacacaggcttatgtgcatgttagggatgtggcattggcccacatacttgtttatgagaagccttctgcctctggtagatacctatgtgccgaaagctccctccaccgtggagaattagttgaaattctcgccaagtatttcccggagtacccagttcccaccaagtgttcagatgaaaagaatccgagagcaaaaccctacactttttcaaatcaaaagctgaaagatttgggattggaattcactccagtgagtcagtgtctatatgaaacagtgaagagcctgcaggagaaaggccaccttccagttcctgcaaagcagcaggaagaagattcaactaccgtgaaatcctaaatgagcagctagttgtccactaaggcaagaagctgcagcttgtggcaatctgtgctcatcttatatattataatagagaatcctacattagaagactgctgtatttggattttgttaaaaagacatcaactaaattgttgccgtgtatgaacttataatattaatgaaatttattcccctcgttgagttgaaaaaaaaaa

SEQ ID NO: 5301 - protein, 339 aa, Glycine max
MPSSESSTGFSETICVTGAGGFIASWMVKLLLEKGYTVRGTLRNPDDPKNGHLKEFEGASQRLTLHKVDLLHLDSVRSVINGCHGVFHTASPVTDNPEEMVEPAVSGAKNVIIAAAEAKVRRVVFTSSIGAVYMDPSRSIDLVVDESCWSDLEYCKNTKNWYCYGKAVAEQAAWDTAKENGVDLVVVNPVLVLGPLLQPTINASTIHILKYLTGSAKTYANATQAYVHVRDVALAHILVYEKPSASGRYLCAESSLHRGELVEILAKYFPEYPVPTKCSDEKNPRAKPYTFSNQKLKDLGLEFTPVSQCLYETVKSLQEKGHLPVPAKQQEEDSTTVKS

SEQ ID NO: 5302 - DNA, 1672 bp, Zea mays
  CDS (280)..(1395)
cgcgccactccaacgcccacccttctcattggggccctcgaggccggccgggaggatgaatcggaagagagaatcctaccaaacctagctaccaactcgatcgtcgtcatcacgctcgaccgcacaactgcaccgaggggggaggagacctaaaaactactacatcttttatagctacacatctagctaaagatcgagaggggtaaataaggacacaagcgagcgcgagccagaagagcagctgcaggtactaccatcatcgtcgtcgtcgtcgccaggatgaccgtcgtcgacgccgtcgtctcctccaccgatgccggcgcccctgctgccgccgccaccgcggtaccggcggggaacgggcagaccgtgtgcgtgaccggcgcggccgggtacatcgcctcgtggttggtgaagctgctgctcgagaagggatacactgtgaagggcaccgtcaggaacccagatgacccgaagaacgcgcacctcaaggcgctggacggcgccgccgagcggctgatcctctgcaaggccgatctgctggactacgacgccatctgccgcgccgtgcagggctgccagggcgtcttccacaccgcctcccccgtcaccgacgacccggagcaaatggtggagccggcggtgcgcggcaccgagtacgtgatcaacgcggcggcggaggccggcacggtgcggcgggtggtgttcacgtcgtccatcggcgccgtgaccatggaccccaagcgcgggcccgacgtcgtggtcgacgagtcgtgctggagcgacctcgagttctgcgagaaaaccaggaactggtactgctacggcaaggcggtggcggagcaggcggcgtgggagacggcccggcggcggggcgtggacctggtggtggtgaaccccgtgctggtggtgggccccctgctgcaggcgacggtgaacgccagcatcgcgcacatcctcaagtacctggacggctcggcccgcaccttcgccaacgccgtgcaggcgtacgtggacgtgcgcgacgtggccgacgcgcacctccgcgtcttcgagagcccccgcgcgtccggccgccacctctgcgccgagcgcgtcctccaccgcgaggacgtcgtccgcatcctcgccaagctcttccccgagtaccccgtcccagccaggtgctccgacgaggtgaatccgcggaagcagccgtacaagttctccaaccagaagctccgggacctggggctgcagttccggccggtcagccagtcgctttacgacacggtgaagaacctccaggagaagggacacctgccggtgctcggagagcggacgacgacggaggccgccgacaaggatgcccccgcggccgagatgcagcagggagggatcgccatccgtgcctgagagggcgatgccacacatgaacacaaagcaatgttcatactgctgccctgcacctgctgtgtaaacaggcctgtgtttgttctggctgatagtgatgtaccctaagacttgtaacgtcatgttcgttcttgtgaactatagcgagtgaataaaattggttaatgttggatgttcaaaaaaaaaaaaaaaaaaaacatagcggccgctctagaggatccaagcttacgtacgcgtgcatgcgacgtcatagctcttaaaagtgtcacctaattcaagc

SEQ ID NO: 5303 - protein, 371 aa, Zea mays
MTVVDAVVSSTDAGAPAAAATAVPAGNGQTVCVTGAAGYIASWLVKLLLEKGYTVKGTVRNPDDPKNAHLKALDGAAERLILCKADLLDYDAICRAVQGCQGVFHTASPVTDDPEQMVEPAVRGTEYVINAAAEAGTVRRVVFTSSIGAVTMDPKRGPDVVVDESCWSDLEFCEKTRNWYCYGKAVAEQAAWETARRRGVDLVVVNPVLVVGPLLQATVNASIAHILKYLDGSARTFANAVQAYVDVRDVADAHLRVFESPRASGRHLCAERVLHREDVVRILAKLFPEYPVPARCSDEVNPRKQPYKFSNQKLRDLGLQFRPVSQSLYDTVKNLQEKGHLPVLGERTTTEAADKDAPAAEMQQGGIAIRA

SEQ ID NO: 5304 - DNA, 1282 bp, Zea mays
  CDS (48)..(1010)
gcggcggcgtgacaacgagagcaagaaagtatcaaaacccgagagcaatggaggcggtggggaagagcgtgtgcgtgaccggcgcgggcggcttcatcgcgtcgtggctggtgaagctcctcctctgccggggccaatacaaggtccgcggcaccgtgcgcgaccctggtgctagcaagaatgctcatctcaaggtgctggaaggagctggggaaaggttgcagcttgtcaaggctgatttgttggactacagcagtgttgcttcagcaattgccggctgtgagggtgtcttccatgtagctagccctgtcccttccggtcggtcctccaaccctgaggtggaggtcataggtcctgctgtaacaggtacaaccaatgtgttaaaggcttgctatgaggcaaaagttgggcgagttgtggtggtgtcttcatgtgcagctgtctatgctaatcctaattatcccaagggtaaggtctttgatgaagactgctggtcagatgaagcttactgcaggaagaacgaggattggtattttgtttccaagacactggcggaacgagaggcttttgcttatgcagcaaaaacagggctggatgttgtaactatttgcccgtcattagtatttggacccttgatgcagcctacagtaaattcgagcagcaaaatcatccttaaatatttcacaggagatcgcgagactgttgaaaacatactcagaaatatggtggatgttcgtgatgttgctgatgctcttcttctggcttacgaaaagccagaagcgtctggacgatacatctgcagttcacatgcaataaaagttgctgatatgataaacatactgaagaccttgtatccatcttacccttatcccaaaaatttcgtggaagatgatgacaactctgtatacagctctgagaaactgcagaagctggggtggagcttcaagcctatagaggaatccctccgtgacactgttgaatcctacaaagcatttggcatcctgaattgaacatccagctaggactgttccatctgctgtttttgcctccgaactctttctgaataatgtatgtaggcagtgaaacagcattgccagcaggttaatcctggcatcatgctggagcagcactgtagttctatctttttcttttttttttccatccccaatactatctagtggttcaggaccaaataagtaggcccagtgctgactggtttatggcttaaaaaaaattgtcgctgctaaaactagaagcgttcgtaccaaaaaaaaaaaaaaaa

SEQ ID NO: 5305 - protein, 320 aa, Zea mays
MEAVGKSVCVTGAGGFIASWLVKLLLCRGQYKVRGTVRDPGASKNAHLKVLEGAGERLQLVKADLLDYSSVASAIAGCEGVFHVASPVPSGRSSNPEVEVIGPAVTGTTNVLKACYEAKVGRVVVVSSCAAVYANPNYPKGKVFDEDCWSDEAYCRKNEDWYFVSKTLAEREAFAYAAKTGLDVVTICPSLVFGPLMQPTVNSSSKIILKYFTGDRETVENILRNMVDVRDVADALLLAYEKPEASGRYICSSHAIKVADMINILKTLYPSYPYPKNFVEDDDNSVYSSEKLQKLGWSFKPIEESLRDTVESYKAFGILN

SEQ ID NO: 5306 - DNA, 26 bp, Artificial sequence
  primer
atgactactgaaaaaaccgttgtttt

SEQ ID NO: 5307 - DNA, 27 bp, Artificial sequence
  primer
ttagcttttactttgaacttctagtaa

SEQ ID NO: 5308 - protein, 390 aa, Artificial sequence
  consensus sequence
  Variant (2)..(2): Xaa in position 2 is any amino acid
  Variant (7)..(7): Xaa in position 7 is any amino acid
  Variant (9)..(17): Xaa in position 9 to 17 is any amino acid
  Variant (20)..(21): Xaa in position 20 to 21 is any amino acid
  Variant (23)..(23): Xaa in position 23 is any amino acid
  Variant (24)..(24): Xaa in position 24 is any or no amino acid
  Variant (26)..(26): Xaa in position 26 is any amino acid
  Variant (28)..(29): Xaa in position 28 to 29 is any amino acid
  Variant (33)..(35): Xaa in position 33 to 35 is any amino acid
  Variant (36)..(44): Xaa in position 36 to 44 is any or no amino acid
  Variant (46)..(72): Xaa in position 46 to 72 is any amino acid
  Variant (73)..(88): Xaa in position 73 to 88 is any or no amino acid
  Variant (90)..(90): Xaa in position 90 is any amino acid
  Variant (92)..(92): Xaa in position 92 is any amino acid
  Variant (96)..(100): Xaa in position 96 to 100 is any amino acid
  Variant (101)..(121): Xaa in position 101 to 121 is any or no amino acid
  Variant (123)..(147): Xaa in position 123 to 147 is any amino acid
  Variant (149)..(150): Xaa in position 149 to 150 is any amino acid
  Variant (153)..(154): Xaa in position 153 to 154 is any amino acid
  Variant (156)..(164): Xaa in position 156 to 164 is any amino acid
  Variant (165)..(176): Xaa in position 165 to 176 is any or no amino acid
  Variant (180)..(180): Xaa in position 180 is any amino acid
  Variant (184)..(197): Xaa in position 184 to 197 is any amino acid
  Variant (198)..(211): Xaa in position 198 to 211 is any or no amino acid
  Variant (213)..(214): Xaa in position 213 to 214 is any amino acid
  Variant (216)..(224): Xaa in position 216 to 224 is any amino acid
  Variant (225)..(235): Xaa in position 225 to 235 is any or no amino acid
  Variant (237)..(239): Xaa in position 237 to 239 is any amino acid
  Variant (241)..(242): Xaa in position 241 to 242 is any amino acid
  Variant (245)..(246): Xaa in position 245 to 246 is any amino acid
  Variant (248)..(262): Xaa in position 248 to 262 is any amino acid
  Variant (263)..(269): Xaa in position 263 to 269 is any or no amino acid
  Variant (271)..(274): Xaa in position 271 to 274 is any amino acid
  Variant (277)..(282): Xaa in position 277 to 282 is any amino acid
  Variant (283)..(299): Xaa in position 283 to 299 is any or no amino acid
  Variant (301)..(301): Xaa in position 301 is any amino acid
  Variant (303)..(323): Xaa in position 303 to 323 is any amino acid
  Variant (324)..(335): Xaa in position 324 to 335 is any or no amino acid
  Variant (337)..(337): Xaa in position 337 is any amino acid
  Variant (341)..(341): Xaa in position 341 is any amino acid
  Variant (344)..(346): Xaa in position 344 to 346 is any amino acid
  Variant (347)..(347): Xaa in position 347 is any or no amino acid
  Variant (349)..(353): Xaa in position 349 to 353 is any amino acid
  Variant (354)..(355): Xaa in position 354 to 355 is any or no amino acid
  Variant (357)..(375): Xaa in position 357 to 375 is any amino acid
  Variant (376)..(389): Xaa in position 376 to 389 is any or no amino acid
VXVTGAXGXXXXXXXXXLLXXGXXYXVXXTVRXXXXXXXXXXXXLXXXXXXXXXXXXXXXXXXXXXXXXXXXXXXXXXXXXXXXXXXXVXHXASPXXXXXXXXXXXXXXXXXXXXXXXXXXPXXXXXXXXXXXXXXXXXXXXXXXXXAXXGTXXVXXXXXXXXXXXXXXXXXXXXXRVVXTSSXXXXXXXXXXXXXXXXXXXXXXXXXXXXEXXWXXXXXXXXXXXXXXXXXXXXYXXXKXXAEXXAXXXXXXXXXXXXXXXXXXXXXXPXXXXGPXXXXXXXXXXXXXXXXXXXXXXXNXSXXXXXXXXXXXXXXXXXXXXXXXXXXXXXXXXXVXDVAXAHXXXXEXXXXXXXRXXXXXXXXXXXXXXXXXXXXXXXXXXXXXXXXXP

SEQ ID NO: 5309 - protein, 19 aa, Artificial sequence
  protein pattern
  Variant (2)..(2): Xaa in position 2 is Phe, Cys or Leu
  Variant (3)..(3): Xaa in position 3 is Val or Leu
  Variant (4)..(4): Xaa in position 4 is Ser or Thr
  Variant (7)..(7): Xaa in position 7 is any amino acid
  Variant (9)..(9): Xaa in position 9 is Phe or Tyr
  Variant (10)..(10): Xaa in position 10 is Ile, Leu or Val
  Variant (11)..(11): Xaa in position 11 is Ala or Gly
  Variant (12)..(14): Xaa in position 12 to 14 is any amino acid
  Variant (15)..(15): Xaa in position 15 is Ala, Ile, Leu or Val
  Variant (16)..(17): Xaa in position 16 to 17 is any amino acid
VXXXGAXGXXXXXXXXXLL

SEQ ID NO: 5310 - protein, 12 aa, Artificial sequence
  protein pattern
  Variant (2)..(2): Xaa in position 2 is any amino acid
  Variant (3)..(4): Xaa in position 3 to 4 is any or no amino acid
  Variant (6)..(6): Xaa in position 6 is any amino acid
  Variant (7)..(7): Xaa in position 7 is Phe, Leu, Met or Val
  Variant (10)..(10): Xaa in position 10 is any amino acid
  Variant (11)..(11): Xaa in position 11 is any or no amino acid
YXXXKXXAEXXA

SEQ ID NO: 5311 - DNA, 930 bp, Saccharomyces cerevisiae
  CDS (1)..(930)
atggatagtaaggaagtactggtacatgttaagaatctagaaaagaacaaaagtaatgatgctgcagttctagaaatcttacatgtcttggataaagaattcgtccccactgaaaagttactgagagaaacaaaagttggtgtggaagtcaacaagtttaaaaaatccactaatgtagagatcagcaaactcgtgaagaaaatgattagctcttggaaagacgcaattaataaaaataagcgttccaggcaagcacagcagcatcatcaagatcatgcgccaggcaatgcagaggacaagacaactgtaggtgagtccgtgaatggtgttcaacagccggcctcctcccagtcagatgccatgaaacaagacaagtacgtcagcactaaaccaagaaatagtaagaacgatggtgtggatacagctatataccaccacaaattacgtgatcaggtactaaaagcactctacgacgttttggccaaggaaagtgagcatccacctcaatctattttgcatactgcaaaggccatagaaagtgaaatgaataaagttaacaactgtgacaccaacgaagccgcttacaaagccaggtatcgtataatttattcaaacgtcatatcaaagaataacccagatctcaaacataaaattgccaacggtgatataacacctgaattcttagctacatgcgatgccaaggatctggcaccagcgcccttaaagcaaaagatagaagaaattgccaagcaaaacttatacaacgcacagggtgccaccatagaaaggtcagtcaccgatagatttacatgtggtaaatgtaaagagaagaaggtatcttactatcaattgcaaacaagatctgcggatgaaccattgaccactttctgtacatgtgaagcatgtggtaacagatggaaattctcttag

SEQ ID NO: 5312 - protein, 309 aa, Saccharomyces cerevisiae
MDSKEVLVHVKNLEKNKSNDAAVLEILHVLDKEFVPTEKLLRETKVGVEVNKFKKSTNVEISKLVKKMISSWKDAINKNKRSRQAQQHHQDHAPGNAEDKTTVGESVNGVQQPASSQSDAMKQDKYVSTKPRNSKNDGVDTAIYHHKLRDQVLKALYDVLAKESEHPPQSILHTAKAIESEMNKVNNCDTNEAAYKARYRIIYSNVISKNNPDLKHKIANGDITPEFLATCDAKDLAPAPLKQKIEEIAKQNLYNAQGATIERSVTDRFTCGKCKEKKVSYYQLQTRSADEPLTTFCTCEACGNRWKFS

SEQ ID NO: 5313 - DNA, 1723 bp, Glycine max
  CDS (107)..(1213)
cttcccggtcctcacccacgcgtccgacttgccacaccaccgccgccgcaggagacaacaacaacaacaacacgttccattctcgaggagagagtggttgggttcgatggagaaggagttggtggaattgtacgaagcggcgaagaaggcggcggatgctgccatctccggcgacggcaaacatgaggaaagccgatgcatcgatgcgctcgagcagctcaagaagtttcccgttaattacaagattctcgtcaacacccaggtgggtaaacatcttaaagttttgacaaagcacccgaggctgaaaattaaggcctttgctattgacctaattgagatatggaaaggcataattatcaaggaaacaagcaaaaataaaaatgggggctctgatagtaaggttgagtcggctaatggggagaaatctaaagctgggaaaatgcaaaagagtccttcggtaaaggttgaaaaaggtgaaactgttaaggttgagaaaattgataggaatggtacaacaaagtcaagctcagaaaatatgaaaaaggtacaaaacgatgtcaagaatgagaaaactgatcgttctgcaagtgtcaaggtggaaaagatagccaaggaggaaaagccagtttctggagcaaagaaaatgtcatccagttctgccgctcccccaaaactaaaaactatgattaaatctaatgatgcaacacgagacaaaataagggaaattctccacgaggctttatccaaggttactggagaagctgatgaagatcttgtagatgtagtcaataattctgatcctatccgtgttgctgtgacagtggagtctgtattatttgaaaaatggggcccttctaatggggcacaaaaggtcaagtataggtccttaatgtttaaccttaaggattcaaacaaccctgatttccggagaaaagttctgcttggtgttattgagccagagcaactgatcaacatgagcacagcagaaatggctagtgagcaaaggaagcaggaatatcagaaaatcacagagaaagctttgtttgaatgtgagcgtggaggtccgccaaaagctacaaccgatcaatttaagtgtggccgatgtggtcaaagaaagaccacctattaccaaatgcagactcgcagtgctgatgaacctatgacaacctatgtcacttgtgttgtctgcaataaccgttggaagttctgttagtgcagttgtgattagtgagtctcactagagctgttgtcttctgttactgatttagggtatgaaggtgcgagtatcatggttccgaattgcaatcgtgccagaattttccatcagactgtttagatgtagaaatttttaggcagaaaaattgtactttttattctttcagttttaactcaagttttcgcattattgtagtttgctgtaactttacaagtgattgcaccaatgtttttctcaggttctactcatcagtaactaagtacttaacctaatggcatccaacctatacgattagttaacagaatggtcagttagagctaggttttattcataaacactaagtgcattgtacttaattttctttgtaagcttgcagcacactttacaatgtagtctcttcgtttcattttaattttgaaaacagcttagctttagttgcaatgcgttgcttgtaagctgcgaaccctttcaatgcatctgtagttcagtgaagaactcttacctttt

SEQ ID NO: 5314 - protein, 368 aa, Glycine max
MEKELVELYEAAKKAADAAISGDGKHEESRCIDALEQLKKFPVNYKILVNTQVGKHLKVLTKHPRLKIKAFAIDLIEIWKGIIIKETSKNKNGGSDSKVESANGEKSKAGKMQKSPSVKVEKGETVKVEKIDRNGTTKSSSENMKKVQNDVKNEKTDRSASVKVEKIAKEEKPVSGAKKMSSSSAAPPKLKTMIKSNDATRDKIREILHEALSKVTGEADEDLVDVVNNSDPIRVAVTVESVLFEKWGPSNGAQKVKYRSLMFNLKDSNNPDFRRKVLLGVIEPEQLINMSTAEMASEQRKQEYQKITEKALFECERGGPPKATTDQFKCGRCGQRKTTYYQMQTRSADEPMTTYVTCVVCNNRWKFC

SEQ ID NO: 5315 - DNA, 924 bp, Gibberella zeae PH-1
  CDS (1)..(924)
atgcccatgacggaacgtgaactcggccagcgcgttaaggcgctgactaaatgcgttgctgcgaatgagcctccagagaacgccatcaagctgctcgagacactaaagaaggatgcgtctcctaccgaagagatgctaagggcaacaagagctggtgtctttgtcggcaaacttcgttcaaatccgaacaaggagatcgcacgcgcggccgccgaacttgtgagcaagtggaagaagcttgtcgagcaagagaagagctcgaaactccaaaagtcaaaagtgggctcagggtcgccagccccagctcccgcatcggctcccgcatcgtctcccgcgcctcctccttcgtcctctggaaactccggagctaagtacaagggcgacattgagaagcgcaagtacgaaaccgacaacgtcaacgtcaagcgaaccgactcggctgtccgaaactcatgcatcggtcttatctacaacggcctagcgtaccgatcaacggcatccgagaacgaggtcgtcaacaaagccatcactgtcgaaaatgccgcctttgttaagttcaagggcgagacagccgactacaagaagaagatccgatcgcttttcaccaacctcaagaacaagtccaataaggaactcggaaagagcgtcttgtctggggagatctctccggaaaagtttgtcgtcatgtccgacgacgagctcaagagcgaggagcaacgtaagaaggaacttgagcttgagaaggagaacatgaagatggcccaggtgccccaggaacagaagagtatcagtgagagtctggaatgcggcaaatgcaagaagaagcaggtcagctatacacaagcgcaaacccgagctgctgatgaaccgatgactactttctgcgagtgcatggcttgcggaaaccgatggaagttctcttaa

SEQ ID NO: 5316 - protein, 307 aa, Gibberella zeae PH-1
MPMTERELGQRVKALTKCVAANEPPENAIKLLETLKKDASPTEEMLRATRAGVFVGKLRSNPNKEIARAAAELVSKWKKLVEQEKSSKLQKSKVGSGSPAPAPASAPASSPAPPPSSSGNSGAKYKGDIEKRKYETDNVNVKRTDSAVRNSCIGLIYNGLAYRSTASENEVVNKAITVENAAFVKFKGETADYKKKIRSLFTNLKNKSNKELGKSVLSGEISPEKFVVMSDDELKSEEQRKKELELEKENMKMAQVPQEQKSISESLECGKCKKKQVSYTQAQTRAADEPMTTFCECMACGNRWKFS

SEQ ID NO: 5317 - DNA, 921 bp, Candida glabrata CBS 138
  CDS (1)..(921)
atgatggacgccaaagatgtggttgtgcatgtccgcaacttagagaagtccaagggcaacgacgagtcggtgctggagatattgcggatattagagaaggaagtagtccctacggagaagctactcagagagacgaaagtcggtgtcgaggtgaacaagttcaagaagagcgagaatgctgagatatcgaagttggtgaagcgtatgattggtgcgtggaaggacgccatcaacaagcacaagaaggcaaagttacgacaacaacagccacctcagcagggtgtttctgcatctagcggaggtgccgctgatggtagcaataacgacggtgcgaagtccggcgatgagccacgcaagactgacaagttcgtcagcagcaaaatcagaaatacaaagaatgacggcgtggaccctaatgtgcataacaataagctgagagaccaagtgataagagcactctacgatgccttggccaaggacagcgaacatccaccaaagtctattctacagacaagtattgctatagaggaagaaatgcataagttgaacgatagtagcataaaggagaaagaatataaggacaaatatcgtgtgatctactccaacatcatctccagaaataaccctgatttaaaagttaagatagctaatggagatctttccccagagcaattggtcaacagcgatccaaaggatctggcccctgagcatttaaagaagaagatggaggagattaagaaacagaacttgttcaacgcccaaggtgccactatcgagaggtcggtgacagacagattcacttgtggtaagtgtaaagaaaagaaagtctcctactaccaactacaaacaagatctgcggatgaacctcttacaactttctgtacttgtgaggcctgcggtaacagatggaaattctcttga

SEQ ID NO: 5318 - protein, 306 aa, Candida glabrata CBS 138
MMDAKDVVVHVRNLEKSKGNDESVLEILRILEKEVVPTEKLLRETKVGVEVNKFKKSENAEISKLVKRMIGAWKDAINKHKKAKLRQQQPPQQGVSASSGGAADGSNNDGAKSGDEPRKTDKFVSSKIRNTKNDGVDPNVHNNKLRDQVIRALYDALAKDSEHPPKSILQTSIAIEEEMHKLNDSSIKEKEYKDKYRVIYSNIISRNNPDLKVKIANGDLSPEQLVNSDPKDLAPEHLKKKMEEIKKQNLFNAQGATIERSVTDRFTCGKCKEKKVSYYQLQTRSADEPLTTFCTCEACGNRWKFS

SEQ ID NO: 5319 - DNA, 879 bp, Kluyveromyces lactis NRRL Y-1140
  CDS (1)..(879)
atggaaaccaaggacgttttagaagccgtcaaaggattagagaagaacaaaaataataatgatgttgtgttcaagattctacagtcattagataaagatttgaaagatgttaatgagaagcttcttagagagacgaaagtaggggtcgtagtcaaccaatttaagaaatcttccaatccagacatcgtcaaattggtgaagaagatgattttatcctggaaagatgctgtggctcgtgaaaagaaaagcaaactaagcagcaattcctcatctacaagtaacaataatggtacaagcggtggagaagcagtaaagaaggagaaatatgtcagcaaagctccaagaaatgctaagaacgacggtgtgaaaacggatatatatggtgtcaagattagagatatggctattagggcattatatgatgcattggcaaaagaaagtgaacatcctccagtagctatcctagatacagtaatgagtattgagacagaaatggctaatctgttcaatcccgagtctgacgaaaagggatatcgtgacaaatacagaataatttactcaaatataatctccaagaacaatccagatttgaaacatagaattacgaatggagaagtatcagccaaacatttagtgactgctgatcctaaggacttggcaccggaacatttaaagaagaaaattgaggaaattgagaaacagaatttgtttaatgcacaaggtgcaactgtagaaagatcagtaacagatagattccaatgtggcaaatgtaaacaaagaaaagtatcatactaccaactacaaacaagatctgcggatgaacctcttactactttttgtacatgtgagaattgcggtaatagatggaagttctcgtag

SEQ ID NO: 5320 - protein, 292 aa, Kluyveromyces lactis NRRL Y-1140
METKDVLEAVKGLEKNKNNNDVVFKILQSLDKDLKDVNEKLLRETKVGVVVNQFKKSSNPDIVKLVKKMILSWKDAVAREKKSKLSSNSSSTSNNNGTSGGEAVKKEKYVSKAPRNAKNDGVKTDIYGVKIRDMAIRALYDALAKESEHPPVAILDTVMSIETEMANLFNPESDEKGYRDKYRIIYSNIISKNNPDLKHRITNGEVSAKHLVTADPKDLAPEHLKKKIEEIEKQNLFNAQGATVERSVTDRFQCGKCKQRKVSYYQLQTRSADEPLTTFCTCENCGNRWKFS

SEQ ID NO: 5321 - DNA, 873 bp, Debaryomyces hansenii CBS767
  CDS (1)..(873)
atggacgccaaagagattaagtccgctgtctctagtttagataaatctacagatgatgccaccattttgaagcttttaaatatcttaaacgatggagtagagcctacggaaaagttattgagagagactaaggttggggttgccgtgaacaaatttagaggaaacagcaacccagaagttagctcattggttaaaaagatgattagaaattggagggaagttgttcagaatgaaaaaaccaagaagaagactggttctgctacgcctgataaagattccaaaccagtgaataacaatacaaagcagagctctaccgaaagtaaatttcacagtgggccaagaaatccaaagactgacggaattaatactactctttatgataatacaacgagaaatgcctctgtaagtgcattgtatactgcattggctattgaacgtaatgactcgggtgaacatatattagcagttagccgtgatattgaaaatgaagttttcaaggcggaatacctgtctgtgaatgataattatagaaataaattaaggacatttacaatgaatcttagaaataagaaaaaccctgatttaagagaccgtttattaactaacaaaattaaaccatcaaattttattaaaatgacaccaaacgaaatggcaccggaatcattgaagaaagaaattgaaaagttacataaacaaaatcttttcgatgctcaaggtgctactgaaaagagggctgttacggatagatttacctgtggtaagtgtaaacataaaaaggtaagttattatcaaatgcaaactagatctgcggatgaaccgttaactaccttttgtacttgtgaaaattgtggtaacagatggaagttttcgtga

SEQ ID NO: 5322 - protein, 290 aa, Debaryomyces hansenii CBS767
MDAKEIKSAVSSLDKSTDDATILKLLNILNDGVEPTEKLLRETKVGVAVNKFRGNSNPEVSSLVKKMIRNWREVVQNEKTKKKTGSATPDKDSKPVNNNTKQSSTESKFHSGPRNPKTDGINTTLYDNTTRNASVSALYTALAIERNDSGEHILAVSRDIENEVFKAEYLSVNDNYRNKLRTFTMNLRNKKNPDLRDRLLTNKIKPSNFIKMTPNEMAPESLKKEIEKLHKQNLFDAQGATEKRAVTDRFTCGKCKHKKVSYYQMQTRSADEPLTTFCTCENCGNRWKFS

SEQ ID NO: 5323 - DNA, 888 bp, Yarrowia lipolytica CLIB122
  CDS (1)..(888)
atgggactcagtgttgcggaaatcaaaaagctgatggctgacctggaaaaggccagcggcgaggcggtatacgacattctgcaggtgttgcacaaggaggtggagcctacggagaagctgctgcgagagaccaagctgggtattgccgtcaacaagctgcgaacctccagcgacagccggatctcggacctggtcaagaagatgatcaagtcgtggaaggacacggtgacggcccagaagagagacgcgtccaagaaggtagagggcaagaaggagaccaaggaggagagccgaccggtcaagtccagctctgcgtcttctggtaacgccacttcgtatacgcctccttcgggccaacgaaccccggccaaggacggtgtgtctacagaaatctactcggacaaggtgcgaaaccggtgcatcgatgtaacctacactgcgctggctgtcggcatgactgcgcaccccaatgaggtgctcgcctgcgccaaggccattgagaatgaggtgtacaagatggagaatggcaccggcggcaactaccgccccaagatgcgatctctgtacatcaacctcaaggacccaaagaaccccggtctgcgaggcaacgtcatttcgggcaagatttcggccgaacgactgtgccgaatgtcgccccaggaaatggcgtccgacgagctcaagaaggagattgaggagatggagaagcagaacctgtttgctgctcgaggagccacggaacagagagccgtgacggaccgattcacatgcggcaagtgcaagcagaagaaggtcagttactaccagatgcagacgagatctgcagatgagccgttgaccacgttttgcacgtgcgagaactgtggtacgaggtggaaattctcctaa

SEQ ID NO: 5324 - protein, 295 aa, Yarrowia lipolytica CLIB122
MGLSVAEIKKLMADLEKASGEAVYDILQVLHKEVEPTEKLLRETKLGIAVNKLRTSSDSRISDLVKKMIKSWKDTVTAQKRDASKKVEGKKETKEESRPVKSSSASSGNATSYTPPSGQRTPAKDGVSTEIYSDKVRNRCIDVTYTALAVGMTAHPNEVLACAKAIENEVYKMENGTGGNYRPKMRSLYINLKDPKNPGLRGNVISGKISAERLCRMSPQEMASDELKKEIEEMEKQNLFAARGATEQRAVTDRFTCGKCKQKKVSYYQMQTRSADEPLTTFCTCENCGTRWKFS

SEQ ID NO: 5325 - DNA, 1161 bp, Aspergillus nidulans FGSC A4
  CDS (1)..(1161)
atggcactggacgcgaaagagatcgaattgaaagccaaagctctcacgaaggctgcaactcagaatgaaccacccgccaatatagtgtcgctgttgaaggaattacaacaaggcgtcaaggcctcggaagacttactgcggtctactcgcgttggtatcatagtcaacaaattcaagcaacacaaagcgccagaagtcgcacggttatcgagtgagattgtttccaagtggcggaacgaggtcaataagcagaaagcaagtggctcggcttctgctagtcagcgatcaagcgcgtcgccgcgcccccctcagaacggaactgcttcacctgccagcgcgactccttccgacaagatgtcgaagctagctgtgccgccagacaagcggacgtggaaggcggatgggattgatatcaatcagacgggtaaccgagcgcgcgataactgtatcggactcatgtatgatggactctgtctacactcagccgaaccgccgaaggccgttctatcaaaggccgcagcagtcgaagcggcggcatatgacgcctacggaccagaaacgaaagaaccctaccgtacgaagatccgcagtctattccagaatctcaagaacaagtccaacccaacgcttcgagttcgtgttttaagcaacgaggtcacccctgaacgattcgtgaaaatgacacatgaggagctccgatccgacgaacagcgcgagaaagatcgaaagattcaaaaggagaacatggataaggccatggtggcccaggcagagcgcagcattagtagagccgcggaggttatcacaaaaggcaggagagacgaccagcttgccccctttctgggccgcacattcaccggccgcgatcgggtagaagagtactttaccctgctcaacgagcacctgcgtatcgagagcatgcggttcgaggacgagaaggagtgggctgttgatcttgagacagggtttgtttgtttgaaggggcatgcgaggtttgtgagtaaagaaagcgaggaaggctgggatgaggtgtttatttaccggattgggctggttgaggatgaggaaataaaggaggtgaaagttcggaattatgaggtttgggcggacacgggggcggcttatttggctgcaaagggggagttgaaaagattgttttga

SEQ ID NO: 5326 - protein, 386 aa, Aspergillus nidulans FGSC A4
MALDAKEIELKAKALTKAATQNEPPANIVSLLKELQQGVKASEDLLRSTRVGIIVNKFKQHKAPEVARLSSEIVSKWRNEVNKQKASGSASASQRSSASPRPPQNGTASPASATPSDKMSKLAVPPDKRTWKADGIDINQTGNRARDNCIGLMYDGLCLHSAEPPKAVLSKAAAVEAAAYDAYGPETKEPYRTKIRSLFQNLKNKSNPTLRVRVLSNEVTPERFVKMTHEELRSDEQREKDRKIQKENMDKAMVAQAERSISRAAEVITKGRRDDQLAPFLGRTFTGRDRVEEYFTLLNEHLRIESMRFEDEKEWAVDLETGFVCLKGHARFVSKESEEGWDEVFIYRIGLVEDEEIKEVKVRNYEVWADTGAAYLAAKGELKRLF

SEQ ID NO: 5327 - DNA, 918 bp, Candida albicans SC5314
  CDS (1)..(918): transl_table=12
atggatacaaaggaaataagatctaccgtatctaatcttgaaaaagcagtagatgacaccaccattttaaagttgttgaatatcttgaatgatggggttaaaccatccgaaaaactcttgagagaaaccaaagtaggtgtagctgtcaacaaattcagaagtcacgacagtgccgaaatcaacggtttagttaaaaaaatgatcagaaattggagagatgccgtgcaagccgaaaagaacaacaaaaagaagttagcaatagcagctggaacaggaacaggaacaccttcaagctcagcaatttcgccatcatcatcgggttctggaagtacaacaccaaaaccatcagagtcaaccacaccatcggctgcccgtaaaggtccaagaaatccaaaaactgacggtgtaaatactcaattatacgaaaatgataccagaaatgcatcggttagtgctttatacacgtcgttagcagttgatcgtgacgattcaccaaaacacattttgagaatagctattgaaatcgaggctgaagtatacaagagcgaatacctgaaagtaagtgacagttatagaaataggttaagaagctttaccatgaatcttcgaaataagaaaaacccagaattaagagagagaatcttatcgaaacaaattttacctgctgcgttcatcaaaatgacccctaatgaaatggctcctgaggcattgaaaaaggaaattgaaaaattgcacaaacaaaacttgtttgatgctcaaggtgctactgaaaagagagcagtgaccgatagattcacttgtggcaagtgtaagcacaagaaggtcagttattatcaaatgcaaaccagatcagcggatgaacctttaactacattttgtacttgtgaaaattgtggcaatagatggaagttttcataa

SEQ ID NO: 5328 - protein, 305 aa, Candida albicans SC5314
MDTKEIRSTVSNLEKAVDDTTILKLLNILNDGVKPSEKLLRETKVGVAVNKFRSHDSAEINGLVKKMIRNWRDAVQAEKNNKKKLAIAAGTGTGTPSSSAISPSSSGSGSTTPKPSESTTPSAARKGPRNPKTDGVNTQLYENDTRNASVSALYTSLAVDRDDSPKHILRIAIEIEAEVYKSEYSKVSDSYRNRLRSFTMNLRNKKNPELRERILSKQILPAAFIKMTPNEMAPEALKKEIEKLHKQNLFDAQGATEKRAVTDRFTCGKCKHKKVSYYQMQTRSADEPLTTFCTCENCGNRWKFS

SEQ ID NO: 5329 - DNA, 948 bp, Ustilago maydis 521
  CDS (1)..(948)
atgtcctcgaaagatatgtcgctcgacgagctcaaggatctgcaaaagcagttatccaagctcgccacctcgtcagattcggaggccatcctctccattttttccaagctcaagtctgggctatcggcaccaacagaggatgttattcgtcaaagcaagatcggtgtggcggtcggaaaaatgcgttcgcactcggacaaaaaggtggcggaccaggcaaagtctttggttaaggattggaaggccatcgtagacaagcaaagggcacagtcgtctgcgaatagcagcaaagctccctcttccaccgcttcgcctgcaccgacaacatcgaaaccagatggcacaatcaacggcaacggcacagcatcggcatctccagcttcgacaccatcagcagcagccaaatccacgtcctccaccaagatcgactttgagatcctgaacgacaaggtgcgcaatgcgtgtctcaaactcctctaccagtcgctggaaatcggtaaggaatcacacgtctggaacgactctcagatctttgacgcggctgtggctgtggaagctgcgatcctctcgaatcagggcaaaggctcggtcaccgccgattaccgcaacaaagtgcgtagcctttcgctcaacattaaggacaagaacaacccagaccttcgcgttcgcgtcgtagaaggagatattgcagcagacaagctggtaaccatgaccaacgaagagttggcgagcgacaagagaaaacgagaaatcgaagagttgcagatgcaaaatctcttcaaggctaaaggtgctgccgcgcaggaggccgagaccgacgcattccagtgcggcaggtgcaagcagaggaagacaaggtactaccagatgcagacgcgatccgccgacgaaccgatgactacatttgtgacgtgtaccaactgcaaccacaagtggaagttctgttga

SEQ ID NO: 5330 - protein, 315 aa, Ustilago maydis 521
MSSKDMSLDELKDLQKQLSKLATSSDSEAILSIFSKLKSGLSAPTEDVIRQSKIGVAVGKMRSHSDKKVADQAKSLVKDWKAIVDKQRAQSSANSSKAPSSTASPAPTTSKPDGTINGNGTASASPASTPSAAAKSTSSTKIDFEILNDKVRNACLKLLYQSLEIGKESHVWNDSQIFDAAVAVEAAILSNQGKGSVTADYRNKVRSLSLNIKDKNNPDLRVRVVEGDIAADKLVTMTNEELASDKRKREIEELQMQNLFKAKGAAAQEAETDAFQCGRCKQRKTRYYQMQTRSADEPMTTFVTCTNCNHKWKFC

SEQ ID NO: 5331 - DNA, 915 bp, Aspergillus oryzae
  CDS (1)..(915)
atgcccttggaagcgaaggaaattgagctcaaggcgaaggccttgacgaaggccgccactcagaatgaaccagcagccaacattgtatccttgcttaaggagcttcaacaaggtgtgaaagcgacggaggatctgctgcgatccacccgtgtgggaatcatcgtcaacaagttcaaacagcacaagtcgcccgaggtctcccgcttgtccagtgaaatcgtgtccaggtggcggaatgaagtcaacaagcagaaggcgagtggatcgcccgcacccagccagcgttcaagcaactcgccgcgcccggcccagaacggaaccgcttcacctgccggtacgacgcctacggacaaggcttccaaattatcggttgccccggataaacgtacatggaaggcggatggtgtggatatcaaccagacgggaaataagattcgtgacagttgcattgggctgatgtatgatggactgtgtctgaactcgacagaagctccacgtaacgttctgtccaaggcatccgccgttgaggccgcagcatacaagtccttgggccccgagaccaaagagcagtaccgtaccaagatccgcagtttattccagaacctcaagaacaagtcgaatccatctctccgcatccgtgtcctcagcaacgacgtgacccccgatcagttcgtgcgcatgtcacacgacgagctacgctccgacgaacagcgcgagaaggacgcaaagatccagaaggagaacatggacaaggcaatggtcgcccaagcagagcgcagtatcagtaccagtctgcagtgcggcaagtgcggacaacgcaaagtcacatacaccgaggcccagacacgcagtgcagacgaaccgatgactttgttctgtacttgtctaaactgcggaaagtcctggaagcagtaa

SEQ ID NO: 5332 - protein, 304 aa, Aspergillus oryzae
MPLEAKEIELKAKALTKAATQNEPAANIVSLLKELQQGVKATEDLLRSTRVGIIVNKFKQHKSPEVSRLSSEIVSRWRNEVNKQKASGSPAPSQRSSNSPRPAQNGTASPAGTTPTDKASKLSVAPDKRTWKADGVDINQTGNKIRDSCIGLMYDGLCLNSTEAPRNVLSKASAVEAAAYKSLGPETKEQYRTKIRSLFQNLKNKSNPSLRIRVLSNDVTPDQFVRMSHDELRSDEQREKDAKIQKENMDKAMVAQAERSISTSLQCGKCGQRKVTYTEAQTRSADEPMTLFCTCLNCGKSWKQ

SEQ ID NO: 5333 - DNA, 882 bp, Schizosaccharomyces pombe
  CDS (1)..(882)
atggactctgctgatatccgatctgcgaaagcagctttggaaaaagctattcagggaaagaatatagagactataattaacattatgacacgtttaaaaaatgaagtagttgctaccgaagaattacttaaggaaacccggctgggattagtcgttggcaagctcagatctcatcccaatgagaaagttggtgagcaagctcgggaaattgtaaaaaaatggaaagccgatgttagtaaaggtcgtccattgaaaaccacaactacaacttcctccacgccttctaaacatgcggatgtaggttctcaagctcaaaaacaagttcaaaaacaaagcagcagtggtcagcgtacttttaaatctgataatgtgaacgtcaatgtgactgatgacaagattcgcaacaactgtattggattaatgtacaatgcattagtcatagattcggatgaatcttcttcattaataatagccaaagccaaagaaattgatgcgcaagtacttgctagagcagcaggtaaaactggttctgaatatcgaaacagaatgcggtccttgtatatgaatcttaaagataaaaataacccgaaacttagagcatcagtattacgaaatgaaattactccgcaaagactcagtaccatgacttctgccgaattggcttcagaagaccgtcgcaaggaagatgccaagctagaacaagaaaatttattccatgcgcaaggtgctaaaccccaaaaagctgttacagacctttttacttgtgggaagtgtaagcaaaaaaaagtttcttattaccaaatgcaaacaagatctgctgatgagcctatgacaacgttttgtgaatgtactgtttgcggaaatcgctggaaattttcttaa

SEQ ID NO: 5334 - protein, 293 aa, Schizosaccharomyces pombe
MDSADIRSAKAALEKAIQGKNIETIINIMTRLKNEVVATEELLKETRLGLVVGKLRSHPNEKVGEQAREIVKKWKADVSKGRPLKTTTTTSSTPSKHADVGSQAQKQVQKQSSSGQRTFKSDNVNVNVTDDKIRNNCIGLMYNALVIDSDESSSLIIAKAKEIDAQVLARAAGKTGSEYRNRMRSLYMNLKDKNNPKLRASVLRNEITPQRLSTMTSAELASEDRRKEDAKLEQENLFHAQGAKPQKAVTDLFTCGKCKQKKVSYYQMQTRSADEPMTTFCECTVCGNRWKFS

SEQ ID NO: 5335 - DNA, 1023 bp, Brassica napus
  CDS (1)..(1023)
atggaaagcgaattgatcgaattgttcgaggcggcgaagaaggcagccgatgcggcggcgatcgacggcgtaacctgcacaggtcaggaggtttctcgatctctcgacgcccttaaacagctcaagaagtttcccatcacatacgacatgctcgtcgcgactcaggtagggaagaagctgaggtctctttcaaaacatcccattgatgaaatcaaaaccgtagctaccgaccttcttgagatatggaagaaactcgtcattgaagagacgtccaagtctaagctggaaaggaaagatgctgacaagactccaaatccaacgcctgtgaaagtgcagaagcttcagagaggtgattcagctaagagcatcaaggtagaagagagaaaggaacgagacaacaaagtcaatgctggggcctcaaaggagaatcaatcaagtatgaaagctccagctaaggcaccatcaactaatggtgcaccaaagctgacttcgatggtcaaatgcaacgaccccgtgcgtgacaaaatccgtgagctgcttgtggacgcaatgtccaaggtccatgacgaatcagatgactacgatagagcgagagttgttggatgtgatccaatccgcgtcgctgtctccgtggagtctcacatgtttgagaagctgggacggtcaacgggagctcagaaggtgaagtacagatctataatgttcaacctgagggacagtaacaatccggatctgaggaggagggttctcacaggggaggtgtcgccggagaaacttattacattgtctggtgaagagatggcaagcgacaagaggaaacaggagactaatcagatcaaggagaagtttctgtttgattgtgagcgtggtcaggcgccgaaagcgagtactgatcagttcaagtgtgggaggtgtgggcagcgtaaatgtacttactatcagatgcagacgaggagtgctgatgagccgatgacgacttatgttacgtgtgttaactgtgacaatcactggaagttctgttga

SEQ ID NO: 5336 - protein, 340 aa, Brassica napus
MESELIELFEAAKKAADAAAIDGVTCTGQEVSRSLDALKQLKKFPITYDMLVATQVGKKLRSLSKHPIDEIKTVATDLLEIWKKLVIEETSKSKLERKDADKTPNPTPVKVQKLQRGDSAKSIKVEERKERDNKVNAGASKENQSSMKAPAKAPSTNGAPKLTSMVKCNDPVRDKIRELLVDAMSKVHDESDDYDRARVVGCDPIRVAVSVESHMFEKLGRSTGAQKVKYRSIMFNLRDSNNPDLRRRVLTGEVSPEKLITLSGEEMASDKRKQETNQIKEKFLFDCERGQAPKASTDQFKCGRCGQRKCTYYQMQTRSADEPMTTYVTCVNCDNHWKFC

SEQ ID NO: 5337 - DNA, 1107 bp, Zea mays
  CDS (1)..(1107)
atggacagggagcttctagagacgtttgacgcggccaagaaggcggccgacgaggcggcaggggacggcaactcgccggaggctggccgctgcctcgacgcgctgcggcggctgcgcgacattcgcgtcaacaccgacatcctcgtctcgacgcaggttggcaaacgccttcgaccccttactaagcatcctcactcaggcattcaagcagttgctgcagacctttttgggtactggaaaaaggttgtccttgaagagtcaggaaagaaaaatggcggctcagagaatgaaagatcaagtgactcttcaggaaaggttgagaaggtgaggcccgtgaagattgaaaagaactctgcatcagcaagcatgaagcttgagaaaagagatgtggatgttaggggtcagaagcctaacaatgtcaaagttgagaagactactagtaatggttccaaagctcaatctgtgaaggtggaaagggtatccaaagaagtcataaggactcctgactcgaagaggccagcatccgtccccaatggccacccaaagcttacatctcttgtcaaatgcaatgatcctacccgagataaaatccgggaactacttgctgaagcctttgtaagtgtttccagagagactagtgatgatgacagagacgaagtgaaaaacatcttggatgaagtcgaggcatgcgacccatacagggttgccgtgacagtagagtctgcactattcgagaggcttggaccttccactgggactcacagggcgaaatacaggtcaatcatgttcaacctgagggctgaaaacaataccgatttccggaggagggtcctcatcggtctagtggcgccggagaggcttccagacataccccctgatgagatggctagcgacgcaaggaagcaagagaacatgcagatcaaggagaaggctctgttcgactgcgagcgtggagcggcaccaaaggcgacgacggaccagttcaagtgtgccagatgtgggcagcggaagacgacttactaccagctgcagactcggagtgctgatgaaccgatgacgacgttcgtcacatgcgtgaactgcaacaatcactggaagttctgctga

SEQ ID NO: 5338 - protein, 368 aa, Zea mays
MDRELLETFDAAKKAADEAAGDGNSPEAGRCLDALRRLRDIRVNTDILVSTQVGKRLRPLTKHPHSGIQAVAADLFGYWKKVVLEESGKKNGGSENERSSDSSGKVEKVRPVKIEKNSASASMKLEKRDVDVRGQKPNNVKVEKTTSNGSKAQSVKVERVSKEVIRTPDSKRPASVPNGHPKLTSLVKCNDPTRDKIRELLAEAFVSVSRETSDDDRDEVKNILDEVEACDPYRVAVTVESALFERLGPSTGTHRAKYRSIMFNLRAENNTDFRRRVLIGLVAPERLPDIPPDEMASDARKQENMQIKEKALFDCERGAAPKATTDQFKCARCGQRKTTYYQLQTRSADEPMTTFVTCVNCNNHWKFC

SEQ ID NO: 5339 - DNA, 1107 bp, Zea mays
  CDS (1)..(1107)
atggagagggagctactggagacgttcgatgcggccaagaaggcggccgacgctacggcaggacagggcgactcgccggaggctggccgctgcctcgacgcgctgcaccggctgcgcgacatacgcgtcaacaccgacatcctcgtctccacgcaggttggcaaacgtcttcgacctcttactaagcaccctcactcgggcattcaggcagtcgcatcagacctttttgggtactggaaaaaggttgtccttgaagagacaggaaagaaaaatgggagctcagagaatgaaaaatcaagggactcttcagtaaaggttgagaaggtgaggcccatgaaggttgaaaagaattctgcatcagcaagcatgaaggttgagaaaagagatgtggatgataggggtcagaagcctgacaatgtcaaagttgagaagaccgctagtaatggttccagaactcaatctgtgaaggtagaaagggtatccaaagaagtcaacagaactcctgatgcaaagaagccagcacctgtccctaatggtcccccaaagcttacatctcttgtcaaatgcaatgatcctacccgagataaaatccgggaactccttgctgaagcctttgcaaaggttcccagagagactagtaatgatgaccgagatgaagtgagaaacatcctggatgaagttgatgcatgcgatccattcagagttgctgtgacagtagagtctgcactatttgagaggtttgggcgttccactggggcccacaaggcaaaatacaggtcaatcatgttcaacctgagggctgaaaacaacactgattttcggagaagggttctcattggtcaagtgaccccagagaggcttccagacatatcccctgatgagatggctagtgatgcaaggaagcaagagaatttgcagatcaaggagaaggctctgtttgactgtgagcggggagcagcaccaaaggcaacaacggatcagttcaaatgtggcagatgtggacagcggaagacaacttactatcagctgcagactcggagtgctgatgaaccgatgacgacattcgtcacatgtgtgaactgcaacaatcactggaagttctgctga

SEQ ID NO: 5340 - protein, 368 aa, Zea mays
MERELLETFDAAKKAADATAGQGDSPEAGRCLDALHRLRDIRVNTDILVSTQVGKRLRPLTKHPHSGIQAVASDLFGYWKKVVLEETGKKNGSSENEKSRDSSVKVEKVRPMKVEKNSASASMKVEKRDVDDRGQKPDNVKVEKTASNGSRTQSVKVERVSKEVNRTPDAKKPAPVPNGPPKLTSLVKCNDPTRDKIRELLAEAFAKVPRETSNDDRDEVRNILDEVDACDPFRVAVTVESALFERFGRSTGAHKAKYRSIMFNLRAENNTDFRRRVLIGQVTPERLPDISPDEMASDARKQENLQIKEKALFDCERGAAPKATTDQFKCGRCGQRKTTYYQLQTRSADEPMTTFVTCVNCNNHWKFC

SEQ ID NO: 5341 - DNA, 25 bp, Artificial sequence
  primer
atggatagtaaggaagtactggtac

SEQ ID NO: 5342 - DNA, 25 bp, Artificial sequence
  primer
ctaagagaatttccatctgttacca

SEQ ID NO: 5343 - protein, 412 aa, Artificial sequence
  consensus sequence
  Variant (2)..(34): Xaa in position 2 to 34 is any amino acid
  Variant (35)..(44): Xaa in position 35 to 44 is any or no amino acid
  Variant (46)..(47): Xaa in position 46 to 47 is any amino acid
  Variant (49)..(50): Xaa in position 49 to 50 is any amino acid
  Variant (52)..(75): Xaa in position 52 to 75 is any amino acid
  Variant (77)..(79): Xaa in position 77 to 79 is any amino acid
  Variant (81)..(134): Xaa in position 81 to 134 is any amino acid
  Variant (135)..(197): Xaa in position 135 to 197 is any or no amino acid
  Variant (199)..(208): Xaa in position 199 to 208 is any amino acid
  Variant (210)..(223): Xaa in position 210 to 223 is any amino acid
  Variant (224)..(239): Xaa in position 224 to 239 is any or no amino acid
  Variant (241)..(243): Xaa in position 241 to 243 is any amino acid
  Variant (245)..(260): Xaa in position 245 to 260 is any amino acid
  Variant (261)..(262): Xaa in position 261 to 262 is any or no amino acid
  Variant (264)..(264): Xaa in position 264 is any amino acid
  Variant (266)..(269): Xaa in position 266 to 269 is any amino acid
  Variant (271)..(275): Xaa in position 271 to 275 is any amino acid
  Variant (278)..(278): Xaa in position 278 is any amino acid
  Variant (280)..(289): Xaa in position 280 to 289 is any amino acid
  Variant (291)..(299): Xaa in position 291 to 299 is any amino acid
  Variant (301)..(301): Xaa in position 301 is any amino acid
  Variant (303)..(317): Xaa in position 303 to 317 is any amino acid
  Variant (319)..(330): Xaa in position 319 to 330 is any amino acid
  Variant (333)..(333): Xaa in position 333 is any amino acid
  Variant (335)..(335): Xaa in position 335 is any amino acid
  Variant (338)..(338): Xaa in position 338 is any amino acid
  Variant (340)..(342): Xaa in position 340 to 342 is any amino acid
  Variant (344)..(345): Xaa in position 344 to 345 is any amino acid
  Variant (346)..(351): Xaa in position 346 to 351 is any or no amino acid
  Variant (355)..(355): Xaa in position 355 is any amino acid
  Variant (364)..(364): Xaa in position 364 is any amino acid
  Variant (368)..(368): Xaa in position 368 is any amino acid
  Variant (369)..(392): Xaa in position 369 to 392 is any or no amino acid
  Variant (395)..(396): Xaa in position 395 to 396 is any amino acid
  Variant (397)..(405): Xaa in position 397 to 405 is any or no amino acid
  Variant (407)..(409): Xaa in position 407 to 409 is any amino acid
EXXXXXXXXXXXXXXXXXXXXXXXXXXXXXXXXXXXXXXXXXXXLXXTXXGXXXXXXXXXXXXXXXXXXXXXXXXWXXXVXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXRXXXXXXXXXXLXXXXXXXXXXXXXXXXXXXXXXXXXXXXXXAXXXEXXXXXXXXXXXXXXXXXXKXRXXXXNXXXXXNPXLXXXXXXXXXXPXXXXXXXXXEXAXXXXXXXXXXXXXXXLXXXXXXXXXXXXTDXFXCGXCXXXKXXXXXXXXYYQXQTRSADEPXTTFXXXXXXXXXXXXXXXXXXXXXXXXXTCXXXXXXXXXXXCXXXWKF

SEQ ID NO: 5344 - protein, 28 aa, Artificial sequence
  protein pattern
  Variant (4)..(4): Xaa in position 4 is Leu or Met
  Variant (13)..(13): Xaa in position 13 is Leu or Met
  Variant (16)..(16): Xaa in position 16 is any amino acid
  Variant (17)..(18): Xaa in position 17 to 18 is any or no amino acid
  Variant (20)..(20): Xaa in position 20 is any amino acid
  Variant (21)..(21): Xaa in position 21 is any or no amino acid
  Variant (23)..(23): Xaa in position 23 is Asp, Glu, Gly, Asn or Thr
  Variant (24)..(24): Xaa in position 24 is any amino acid
  Variant (25)..(25): Xaa in position 25 is His, Lys or Arg
YYQXQTRSADEPXTTXXXCXXCXXXWKF

SEQ ID NO: 5345 - protein, 58 aa, Artificial sequence
  protein pattern
  Variant (2)..(2): Xaa in position 2 is any amino acid
  Variant (3)..(4): Xaa in position 3 to 4 is any or no amino acid
  Variant (6)..(6): Xaa in position 6 is any amino acid
  Variant (7)..(7): Xaa in position 7 is Ile or Leu
  Variant (8)..(9): Xaa in position 8 to 9 is any amino acid
  Variant (11)..(11): Xaa in position 11 is Ile, Leu or Val
  Variant (12)..(12): Xaa in position 12 is any amino acid
  Variant (13)..(13): Xaa in position 13 is Ala, Asp, Asn or Ser
  Variant (14)..(15): Xaa in position 14 to 15 is any amino acid
  Variant (17)..(17): Xaa in position 17 is any amino acid
  Variant (18)..(18): Xaa in position 18 is Asp, Glu, Gly, Ser or Thr
  Variant (19)..(19): Xaa in position 19 is Phe or Leu
  Variant (20)..(22): Xaa in position 20 to 22 is any amino acid
  Variant (23)..(23): Xaa in position 23 is Ile or Val
  Variant (24)..(25): Xaa in position 24 to 25 is any amino acid
  Variant (26)..(26): Xaa in position 26 is Gly or Asn
  Variant (27)..(27): Xaa in position 27 is any amino acid
  Variant (28)..(28): Xaa in position 28 is Ile, Leu or Val
  Variant (29)..(29): Xaa in position 29 is Ala, Glu, Ser or Thr
  Variant (30)..(30): Xaa in position 30 is Ala or Pro
  Variant (31)..(31): Xaa in position 31 is Asp, Glu or Lys
  Variant (32)..(32): Xaa in position 32 is any amino acid
  Variant (33)..(33): Xaa in position 33 is Phe or Leu
  Variant (34)..(36): Xaa in position 34 to 36 is any amino acid
  Variant (37)..(37): Xaa in position 37 is Asp, Pro, Ser or Thr
  Variant (38)..(39): Xaa in position 38 to 39 is any amino acid
  Variant (40)..(40): Xaa in position 40 is Asp or Glu
  Variant (41)..(41): Xaa in position 41 is Leu or Met
  Variant (42)..(42): Xaa in position 42 is any amino acid
  Variant (43)..(43): Xaa in position 43 is Pro or Ser
  Variant (44)..(44): Xaa in position 44 is Ala, Asp or Glu
  Variant (45)..(46): Xaa in position 45 to 46 is any amino acid
  Variant (47)..(47): Xaa in position 47 is Lys or Arg
  Variant (48)..(48): Xaa in position 48 is any amino acid
  Variant (49)..(49): Xaa in position 49 is Glu or Lys
  Variant (50)..(52): Xaa in position 50 to 52 is any amino acid
  Variant (53)..(53): Xaa in position 53 is Ile, Leu or Met
  Variant (54)..(57): Xaa in position 54 to 57 is any amino acid
  Variant (58)..(58): Xaa in position 58 is Leu or Met
KXXXRXXXXNXXXXXNXXXXXXXXXXXXXXXXXXXXXXXXXXXXXXXXXXXXXXXXXX

SEQ ID NO: 5346 - DNA, 1722 bp, Saccharomyces cerevisiae
  CDS (1)..(1722)
atgccaataagatcaatcagctcagcttcacaaatgaacgtgttcggtaaaaaagaagaaaagcaagaaaaagtttactctctacaaaacggttttccgtactctcatcacccatacgcttctcaatactcaagaccagacggccctatcttactgcaagacttccatctgctggaaaatattgcaagtttcgatagagaaagagttccggagcgtgtagtccatgccaaaggtggtggttgtagactggagttcgaactaacagattctttgagtgatattacatacgccgctccataccagaatgtgggttacaaatgtcctggtcttgttcgtttttccaccgttggtggtgaaagtggtacaccagacactgcaagagacccaagaggtgtttcttttaaattctataccgagtgggggaaccatgactgggtcttcaacaatactcccgtcttcttcctcagagacgctattaagtttcccgtatttattcattcgcaaaagagagaccctcagtctcatctgaatcagtttcaggacactaccatatactgggattatctaacattgaatccggaatcaatccatcaaataacttacatgtttggtgatagaggtactcctgcttcgtgggctagtatgaacgcgtactctggtcattccttcatcatggtcaacaaagaaggtaaggacacatatgtgcaattccacgtcttgtcggatactggttttgaaaccttgactggagataaggctgctgaactgtcaggctcccaccctgattataatcaggcaaagctgttcactcaattgcaaaatggcgaaaagccaaaatttaactgttatgtgcaaacaatgacacccgaacaagcaactaagttcaggtattcggtaaatgacctaacgaaaatatggccacacaaggaattccctttgagaaaatttggtaccatcaccctaacggagaatgttgacaattatttccaagaaattgaacaagttgcattcagtccaacgaacacttgtatcccaggtattaagccttctaatgattccgttctacaagccagacttttctcctatccagacactcaacgtcatagattgggagccaactatcagcaattgcccgtcaacagaccaagaaacttgggatgtccatactccaaaggtgattcccaatacactgccgaacagtgtccatttaaagcagtgaacttccaaagggacggcccaatgagttactacaatttcggtcctgagccaaattatatttccagtttaccaaatcaaactctgaaattcaaaaatgaagacaacgacgaagtatctgataagttcaaagggatagttcttgacgaagtaacagaagtttctgtgagaaaacaggaacaagaccaaatcagaaacgagcatattgttgatgccaaaattaatcaatattactacgtttatggtattagtccactagacttcgaacagccaagagctctatatgaaaaggtatacaacgatgaacagaagaaattattcgttcataacgttgtttgccacgcttgtaagatcaaagatcctaaagtcaaaaagagagttacgcaatactttggtttgctaaacgaagatttgggtaaagtcattgcagaatgcttgggagttccttgggaacctgttgaccttgaaggttatgccaagacttggtccattgcaagtgccaattaa

SEQ ID NO: 5347 - protein, 573 aa, Saccharomyces cerevisiae
MPIRSISSASQMNVFGKKEEKQEKVYSLQNGFPYSHHPYASQYSRPDGPILLQDFHLLENIASFDRERVPERVVHAKGGGCRLEFELTDSLSDITYAAPYQNVGYKCPGLVRFSTVGGESGTPDTARDPRGVSFKFYTEWGNHDWVFNNTPVFFLRDAIKFPVFIHSQKRDPQSHLNQFQDTTIYWDYLTLNPESIHQITYMFGDRGTPASWASMNAYSGHSFIMVNKEGKDTYVQFHVLSDTGFETLTGDKAAELSGSHPDYNQAKLFTQLQNGEKPKFNCYVQTMTPEQATKFRYSVNDLTKIWPHKEFPLRKFGTITLTENVDNYFQEIEQVAFSPTNTCIPGIKPSNDSVLQARLFSYPDTQRHRLGANYQQLPVNRPRNLGCPYSKGDSQYTAEQCPFKAVNFQRDGPMSYYNFGPEPNYISSLPNQTLKFKNEDNDEVSDKFKGIVLDEVTEVSVRKQEQDQIRNEHIVDAKINQYYYVYGISPLDFEQPRALYEKVYNDEQKKLFVHNVVCHACKIKDPKVKKRVTQYFGLLNEDLGKVIAECLGVPWEPVDLEGYAKTWSIASAN

SEQ ID NO: 5348 - DNA, 1555 bp, Cryptococcus neoformans var. neoformans B-3501A
  CDS (1)..(1497)
atgactgagaaaacaccgacgtacaccctgtccgaaggatgccctatcgcggatgctacgaccgcccagcgtctgggcagttgccccgttaagggcctgatgttgatgcaggacacccagctcatcgagactctggcccacttcagtagggagcgcattcccgagcgtaccgtgcatgcttctgccgttggtgcatggggcgaatttgaagtaactcacgacaattccgacatcacttcggctgctttcctcaatgggattggcaaaaagtccaaggttcttatgcgtatctccactgtgggaccggaggctggcacagccgagactgttcgggatgtgaggggctggtcgatgaagatcttcactgaagagggcaaccaagactttgtcttcaacagcattccggtgttcttcatccgagacccaatcaaattcccctctgttaaccgatctcacaagcgtcatcccgcaaagcataccgccgactcttctatgttctgggactttcacaacaacaaccccgagggaactcatgccatcatgatgtattttagcaatcgagggctgccgtattcactaaggcaaatcaactcctacagtggtcacacttacaagctcaccaaatcggacggctcttttgtttatgtcaaactccacttcaaatccaatcaaggtgtcaagggcatgacgcaggccgaaggcgtacgcactgccggcgaagcacccgatttccacacgaccgatatgtgggatgctatcgagcggggcgactaccctacttggacgttgtatgctcaagtcatgaagcccgaagaggctgaaaactaccgctggaatatcttcgatatgaccaaggtttggccccacaaagacttccccctcagaccacttggtaaattgaccctaaaccgtaaccccgaaaactacttctcagacattgagcaggctgccttttcgccatcgacaatggtgccgggcgttgcgccctccggagatccaatgctgcaagctaggatgtttgcctaccccgatgccgctcgataccgcctcggtgtcaactaccagcaacttccgtgcaatcggcccgtcagtgaggtttatgcgccctaccagcgtgacggtgcgatgcgctacatgaccaattacggaggtgatcccaattatgtgcgatcttctctcaaggaagtcaacttcaagggtcaattgggcgcaaaaggccattccactgggggcaacgagaaacacaatgaatgggtcggtcgagttgcggcgtacacatccgaggtaacggatgaggattacgtccaagctcgcatgttctgggaggttcttggcaaagctggcgaccaagaggacttgatcaccaatgtctcgtgtcatctaagcaaggctatcccgtcggtgcagaaaggagctgtcgaaatcttcgccaaggtgaatgttgatttggccaagtccatcgaagaccgtttggctgagctcaacaaaggaaagtaaagggaaaaacatttgacaaggtaaaagccatgtgagaagcctgacaatgatacatatt

SEQ ID NO: 5349 - protein, 498 aa, Cryptococcus neoformans var. neoformans B-3501A
MTEKTPTYTLSEGCPIADATTAQRLGSCPVKGLMLMQDTQLIETLAHFSRERIPERTVHASAVGAWGEFEVTHDNSDITSAAFLNGIGKKSKVLMRISTVGPEAGTAETVRDVRGWSMKIFTEEGNQDFVFNSIPVFFIRDPIKFPSVNRSHKRHPAKHTADSSMFWDFHNNNPEGTHAIMMYFSNRGLPYSLRQINSYSGHTYKLTKSDGSFVYVKLHFKSNQGVKGMTQAEGVRTAGEAPDFHTTDMWDAIERGDYPTWTLYAQVMKPEEAENYRWNIFDMTKVWPHKDFPLRPLGKLTLNRNPENYFSDIEQAAFSPSTMVPGVAPSGDPMLQARMFAYPDAARYRLGVNYQQLPCNRPVSEVYAPYQRDGAMRYMTNYGGDPNYVRSSLKEVNFKGQLGAKGHSTGGNEKHNEWVGRVAAYTSEVTDEDYVQARMFWEVLGKAGDQEDLITNVSCHLSKAIPSVQKGAVEIFAKVNVDLAKSIEDRLAELNKGK

SEQ ID NO: 5350 - DNA, 1479 bp, Oryza sativa (japonica cultivar-group)
  CDS (1)..(1479)
atggatccctacaagcaccgcccgtcgagctcgttcaacggcccgctgtggagcaccaactccggcgcccccgtatggaacaacaacaactcgctcaccgtcggctcccgaggcccgatccttctggaggactaccacctggttgagaagctggccaacttcgacagggagcgtatcccggagcgcgtggtgcacgcccgcggcgccagcgccaagggcttcttcgaggtcacccacgacatcacccacctcacctgcgccgacttcctccgcgccccgggcgtccagaccccggtcatcgtccgcttctccaccgtcatccacgagcgcggcagcccggagaccctccgcgacccgcgtggcttcgccatcaagttctacacccgggagggcaactgggacctcgtcggcaacaacttccccgtcttcttcatccgcgacggcatgaagttcccggacatggtgcactcgctcaagcccaaccccaagtcgcacgtccaggagaactggcgcatcctcgacttcttctcccaccacccggagagcctccacatgttcaccttcctcttcgatgacatcggcatccccgccgactaccgccacatggacggctccggcgtcaacacctacacgctcgtcaaccgcgccggcaagtcgcactacgtcaagttccactggaagcccacctgcggcgtcaagtcgctgctcgacgacgaggccgtcaccgtcggcgggaccaaccacagccacgccacgcaggacctctacgactccatcgccgccggcaacttcccggagtggaagctgttcatccagaccatcgaccccgaccacgaggaccgcttcgacttcgacccgctcgacgtcaccaagacgtggcccgaggacatcgtcccgctgcagcccgtggggaggatggtgctcaaccgcaacatcgacaacttcttctcggagaacgagcagctggcgttctgccccgggatcatcgtgccggggatctactactccgacgacaagctgctgcagacgaggatcttctcctactccgacacgcagcgccaccgcctcggaccaaactacctgctgctcccgcccaacgcgcccaagtgcgcccaccacaacaaccactacgacggcttcatgaacttcatgcaccgcgacgaggaggtcgactacttcccatcccgctacgatcctgccaagcacgccccccgctaccccatcccctccgccaccctcaccggccgccgcgagaaggtggtgattgccaaggagaacaacttcaagcagccaggggagaggtaccgttcatgggatccggcaaggcaagaccggttcatcaagagatggatcgacgcactctctgaccctcgcctcacccacgagatcaggagcatctggctctcctactggtctcaggctgacaggtctctgggtcagaaactggcgagccgtctcagcgcgaagccgagcatgtaa

SEQ ID NO: 5351 - protein, 492 aa, Oryza sativa (japonica cultivar-group)
MDPYKHRPSSSFNGPLWSTNSGAPVWNNNNSLTVGSRGPILLEDYHLVEKLANFDRERIPERVVHARGASAKGFFEVTHDITHLTCADFLRAPGVQTPVIVRFSTVIHERGSPETLRDPRGFAIKFYTREGNWDLVGNNFPVFFIRDGMKFPDMVHSLKPNPKSHVQENWRILDFFSHHPESLHMFTFLFDDIGIPADYRHMDGSGVNTYTLVNRAGKSHYVKFHWKPTCGVKSLLDDEAVTVGGTNHSHATQDLYDSIAAGNFPEWKLFIQTIDPDHEDRFDFDPLDVTKTWPEDIVPLQPVGRMVLNRNIDNFFSENEQLAFCPGIIVPGIYYSDDKLLQTRIFSYSDTQRHRLGPNYLLLPPNAPKCAHHNNHYDGFMNFMHRDEEVDYFPSRYDPAKHAPRYPIPSATLTGRREKVVIAKENNFKQPGERYRSWDPARQDRFIKRWIDALSDPRLTHEIRSIWLSYWSQADRSLGQKLASRLSAKPSM

SEQ ID NO: 5352 - DNA, 1689 bp, Saccharomyces cerevisiae
  CDS (1)..(1689)
atgaacgtgttcggtaaaaaagaagaaaagcaagaaaaagtttactctctacaaaacggttttccgtactctcatcacccatacgcttctcaatactcaagaccagacggccctatcttactgcaagacttccatctgctggaaaatattgcaagtttcgatagagaaagagttccggagcgtgtagtccatgccaaaggtggtggttgtagactggagttcgaactaacagattctttgagtgatattacatacgccgctccataccagaatgtgggttacaaatgtcctggtcttgttcgtttttccaccgttggtggtgaaagtggtacaccagacactgcaagagacccaagaggtgtttcttttaaattctataccgagtgggggaaccatgactgggtcttcaacaatactcccgtcttcttcctcagagacgctattaagtttcccgtatttattcattcgcaaaagagagaccctcagtctcatctgaatcagtttcaggacactaccatatactgggattatctaacattgaatccggaatcaatccatcaaataacttacatgtttggtgatagaggtactcctgcttcgtgggctagtatgaacgcgtactctggtcattccttcatcatggtcaacaaagaaggtaaggacacatatgtgcaattccacgtcttgtcggatactggttttgaaaccttgactggagataaggctgctgaactgtcaggctcccaccctgattataatcaggcaaagctgttcactcaattgcaaaatggcgaaaagccaaaatttaactgttatgtgcaaacaatgacacccgaacaagcaactaagttcaggtattcggtaaatgacctaacgaaaatatggccacacaaggaattccctttgagaaaatttggtaccatcaccctaacggagaatgttgacaattatttccaagaaattgaacaagttgcattcagtccaacgaacacttgtatcccaggtattaagccttctaatgattccgttctacaagccagacttttctcctatccagacactcaacgtcatagattgggagccaactatcagcaattgcccgtcaacagaccaagaaacttgggatgtccatactccaaaggtgattcccaatacactgccgaacagtgtccatttaaagcagtgaacttccaaagggacggcccaatgagttactacaatttcggtcctgagccaaattatatttccagtttaccaaatcaaactctgaaattcaaaaatgaagacaacgacgaagtatctgataagttcaaagggatagttcttgacgaagtaacagaagtttctgtgagaaaacaggaacaagaccaaatcagaaacgagcatattgttgatgccaaaattaatcaatattactacgtttatggtattagtccactagacttcgaacagccaagagctctatatgaaaaggtatacaacgatgaacagaagaaattattcgttcataacgttgtttgccacgcttgtaagatcaaagatcctaaagtcaaaaagagagttacgcaatactttggtttgctaaacgaagatttgggtaaagtcattgcagaatgcttgggagttccttgggaacctgttgaccttgaaggttatgccaagacttggtccattgcaagtgccaattaa

SEQ ID NO: 5353 - protein, 562 aa, Saccharomyces cerevisiae
MNVFGKKEEKQEKVYSLQNGFPYSHHPYASQYSRPDGPILLQDFHLLENIASFDRERVPERVVHAKGGGCRLEFELTDSLSDITYAAPYQNVGYKCPGLVRFSTVGGESGTPDTARDPRGVSFKFYTEWGNHDWVFNNTPVFFLRDAIKFPVFIHSQKRDPQSHLNQFQDTTIYWDYLTLNPESIHQITYMFGDRGTPASWASMNAYSGHSFIMVNKEGKDTYVQFHVLSDTGFETLTGDKAAELSGSHPDYNQAKLFTQLQNGEKPKFNCYVQTMTPEQATKFRYSVNDLTKIWPHKEFPLRKFGTITLTENVDNYFQEIEQVAFSPTNTCIPGIKPSNDSVLQARLFSYPDTQRHRLGANYQQLPVNRPRNLGCPYSKGDSQYTAEQCPFKAVNFQRDGPMSYYNFGPEPNYISSLPNQTLKFKNEDNDEVSDKFKGIVLDEVTEVSVRKQEQDQIRNEHIVDAKINQYYYVYGISPLDFEQPRALYEKVYNDEQKKLFVHNVVCHACKIKDPKVKKRVTQYFGLLNEDLGKVIAECLGVPWEPVDLEGYAKTWSIASAN

SEQ ID NO: 5354 - DNA, 2136 bp, Bacillus halodurans C-125
  CDS (1)..(2136): transl_table=11
gtggacaaagaccaacaaggaaccgaatcatctgaaaataagaagaatgaacagctagaaccattcaaggtggatcacaaaaacacgaagctcacaacgaatcaaggggtgagggtatctgacacggacgattcccttaaagcaggggatcgaggccctaccttaatggaagacttccattttcgggaaaaaatgactcattttgatcatgaacggattcctgagcgtgtcgttcatgcgcgaggtttcggtgcccacggctactttcaagtgtatgagccaatgaccgaatatacgaaagcatcatttttacaggaccctaatgtaaagacaccggtgtttgtccgtttttctacagtggtcggttcgcgcgggtcagccgatacggttcgtgacgtaaggggatttgcgacgaagttttacacagaggacggaaactatgacctagtagcaaacaacatcccgatcttttttattcaggacgctattaagttcccagatgtggttcacgccttaaaacctgaaccgcacaatgaaatcccgcaagcttctgcagcgcacgacacgttctgggattttgtcgttagcaacacagaaaccgctcatatgattatgtggctcctttcagacagagcaatcccgcgcagctttcgaatgatggaagggtttggcgtcaacacgttccggttcgtgaacgaacaagggaaggcccgattcgtaaaattccattggaagccgaagctcggagttcattcgctcgtttgggatgaagcgcaaaagcttgccgggaaagatcctgacttccatcgtcgcgatttgtgggaagcgattaacatgggagaataccctgaatacgagttaggcgtgcaaatgattgaggaagaagatgagttttcgtttgatttcgatatccttgatccgacgaagttttggccagaggaaatggttccggtaaagcttatcgggaaaatgacattgaatcgaaatcaggacaatttcttcgccgaaaccgaacaagtcgcatttcatgcagggaatgtcgtcccagggattgatttcagcaatgacccgctcttacaaggtcggcttttctcttatcttgacacccaactgcttcgcttaagtggtccgaactttcacgaaatcccgatcaatcgaccaattgcccctgtcaacaacaaccagcgagatggattccatcggatgacgattgacaagggggctgttagctactcgccaaatacgcttcgcaataactcgcctgaaccagcatcggatcaagaacacggatacgttcattatatggaaaaggtcgaaggacaaaaaattcgcaggcgcagtgagagctttaacgatcatttcagccaagccactttgttttggaacagtttgtcgacagcggaaaaacaacacctgatcaaggcgttccattttgaagtcggaagtgtaaaggataaaaacctcaaacaacgtgttgttgagatgtttaatcaagtcgatggaaagttagcggcagagatcgcgaaaggaatcggtgtcaaccctccgaccacacctgggggaacgggagtaacagcgtcatctccagccgtcagtcaagaaaatacgatcaaactggcaagaacgcgaaaagtggccgttctaattgatcatggctttgctttcgacgaggtgtcacaagtggtcactgcgctacaatccgctggtctcggagtagatctcgtgagtaagcagttagggatgatttccagcgctgaaggggagcaactagaagcaaacaaaagcttcgccactaccggtgccatcatgtacgacgcactttacatcggcggtggtgcccaatccattagtagcctcaatttgtacagtgaatcgaaaacctttgttgatgaagcatttaaacatgcgaaaacaatcggagctacaaatgaaggcattgaactactaatagctgcacaagttcaaggaattacattcgcaggtcctgattcgaacgatcatgttgtgaacgacctagggattattacgattcaaacagataaagattttaaggcatttactgatgaaatgatccacgccattgcccagcaccgccattggatgcgggaatttaaggatggcaaattgtccggttaa

SEQ ID NO: 5355 - protein, 711 aa, Bacillus halodurans C-125
MDKDQQGTESSENKKNEQLEPFKVDHKNTKLTTNQGVRVSDTDDSLKAGDRGPTLMEDFHFREKMTHFDHERIPERVVHARGFGAHGYFQVYEPMTEYTKASFLQDPNVKTPVFVRFSTVVGSRGSADTVRDVRGFATKFYTEDGNYDLVANNIPIFFIQDAIKFPDVVHALKPEPHNEIPQASAAHDTFWDFVVSNTETAHMIMWLLSDRAIPRSFRMMEGFGVNTFRFVNEQGKARFVKFHWKPKLGVHSLVWDEAQKLAGKDPDFHRRDLWEAINMGEYPEYELGVQMIEEEDEFSFDFDILDPTKFWPEEMVPVKLIGKMTLNRNQDNFFAETEQVAFHAGNVVPGIDFSNDPLLQGRLFSYLDTQLLRLSGPNFHEIPINRPIAPVNNNQRDGFHRMTIDKGAVSYSPNTLRNNSPEPASDQEHGYVHYMEKVEGQKIRRRSESFNDHFSQATLFWNSLSTAEKQHLIKAFHFEVGSVKDKNLKQRVVEMFNQVDGKLAAEIAKGIGVNPPTTPGGTGVTASSPAVSQENTIKLARTRKVAVLIDHGFAFDEVSQVVTALQSAGLGVDLVSKQLGMISSAEGEQLEANKSFATTGAIMYDALYIGGGAQSISSLNLYSESKTFVDEAFKHAKTIGATNEGIELLIAAQVQGITFAGPDSNDHVVNDLGIITIQTDKDFKAFTDEMIHAIAQHRHWMREFKDGKLSG

SEQ ID NO: 5356 - DNA, 1515 bp, Neisseria meningitidis MC58
  CDS (1)..(1515): transl_table=11
atgactacctccaaatgccctgtaacccatctgaccatgaacaacggcgcgcctgttgccgacaatcaaaacagcctgaccgccggtcctcgcggccctctgctggcgcaggatttgtggctgaatgaaaaactcgccgacttcgtgcgcgaagtcatccccgaacgccgtatgcacgccaaaggttcgggcgcgttcggtacgtttaccgtaacgcacgacatcaccaaatacacccgcgccaaaatcttcagcgaagtcggcaaaaaaaccgagatgttcgcccgtttcaccaccgtggcaggcgaacgcggcgcagccgatgcagaacgcgacatccgcggttttgccttgaaattttataccgaagaaggcaactgggatgtggtcggcaacaacacgcccgtgttcttcctgcgcgacccgcgtaagttccccgacctgaacaaagccgtcaaacgcgacccgcgcaccaatatgcgctctgccacaaacaactgggacttctggacgctgctgcccgaagcactgcaccaagttaccatcgtgatgagcgaccgcggcatccccgccggctaccgccatatgcacggcttcggttcgcatacctacagcttctggaacgaagcaggcgagcgtttttgggtgaaattccatttccgcacccaacaaggcattaaaaacctgaccaacgaagaagccgccaaaatcatcgccgacgaccgcgaaagccatcagcgcgacttatacgaagccatcgaacgcggcgagtttccgaaatggacgatgtacatccaagtcatgcctgaagcagacgcggaaaaagtaccttatcatccgtttgacttgaccaaagtttggccgaaaaaagactatccgctgattgaagtgggcgaattcgagttgaaccgcaatcccgaaaacttcttcgccgatgtggaacaatccgccttcgcaccgagcaacctcgttcccggtgtcggcgccagcccagataaaatgctgcaagcgcgtttgttcaattacgccgacgcacaacgctaccgtttgggcgtaaacttccgccaaattcccgtcaatcgtccgcgttgccctgttcacagcaaccagcgcgacgggcaaggccgcgccgacggcaactacggcagcctgccgcactacgaacccaacagcttcggccaatggcagcaacaacccgacttcgccgaaccgcctttgaaaatcaacggcgacgcggcacactgggactaccgccaagacgatgacgactatttcagccaaccgcgcgccctgttcaacctgatgaacgacgcgcagaaacaggcattgttcggcaacaccgccgccgcaatgggcgacgcgcccgacttcatcaaataccgccatatccgcaactgctaccgttgcgacccggcatacggcgaaggcgtggccaaagcccttggactgactgtcgaagatgcccaagccgcccgcgcgaccgatcccgcactgggtcaggctggtttgctgtaa

SEQ ID NO: 5357 - protein, 504 aa, Neisseria meningitidis MC58
MTTSKCPVTHLTMNNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDVVGNNTPVFFLRDPRKFPDLNKAVKRDPRTNMRSATNNWDFWTLLPEALHQVTIVMSDRGIPAGYRHMHGFGSHTYSFWNEAGERFWVKFHFRTQQGIKNLTNEEAAKIIADDRESHQRDLYEAIERGEFPKWTMYIQVMPEADAEKVPYHPFDLTKVWPKKDYPLIEVGEFELNRNPENFFADVEQSAFAPSNLVPGVGASPDKMLQARLFNYADAQRYRLGVNFRQIPVNRPRCPVHSNQRDGQGRADGNYGSLPHYEPNSFGQWQQQPDFAEPPLKINGDAAHWDYRQDDDDYFSQPRALFNLMNDAQKQALFGNTAAAMGDAPDFIKYRHIRNCYRCDPAYGEGVAKALGLTVEDAQAARATDPALGQAGLL

SEQ ID NO: 5358 - DNA, 1425 bp, Campylobacter jejuni subsp. jejuni NCTC 11168
  CDS (1)..(1425): transl_table=11
atgaaaaaattgactaacgattttggaaacattatagctgataaccaaaattcattaagcgcaggcgcaaaaggacctttacttatgcaagattatcttttgcttgaaaaacttgctcatcaaaatagagaaagaattccagaaagaaccgttcatgctaagggaagtggagcttatggcgaaataaaaattacagcagacttaagtgcttataccaaagctaaaatttttcaaaaaggcgaagttactccattatttttacgcttttcaacagtagcaggtgaagcaggtgcagcagatgctgaacgcgatgtgagaggttttgctattaaattttacactaaagaaggaaactgggacttggtaggaaataacactccgacattcttcatccgcgatgcttataaattccctgatttcatccatactcaaaaaagagatccaagaactcatctaagaagtaataatgctgcttgggatttttggagtttatgtcctgaaagtttacatcaagtaaccattcttatgagcgatagaggaattcctgcaagttatcgtcatatgcatggatttggaagccatacttatagttttattaatgataaaaatgaaagattttgggtgaaattccattttaaaacccaacaagggattaaaaatcttaccaaccaagaagctgccgagcttatagcaaaagatagagaaagtcatcaaagagatctctataatgctatagaaaataaagattttccaaaatggaaagttcaagttcaaattcttgctgaaaaagatatagaaaaacttggatttaatccttttgatttaacaaaaatttggcctcatagttttgtacctttgatggatataggcgaaatgattctaaacaaaaatcctcaaaattattttaatgaagttgaacaagctgcctttagtccaagcaatatcgttcctggaattggctttagccctgataaaatgttgcaagctagaattttttcatatcctgatgcacaaagatatagaataggaactaattatcatcttttaccagtaaatcgtgcaaaaagcgaagtgaatacttacaatgtcgctggtgctatgaattttgatagttataaaaatgatgctgcttattatgaaccaaacagctatgataatagcccaaaagaagacaaaagctatcttgaacctgatttagtcttagaaggcgtagcacaaagatatgctccactagataatgacttttatactcaaccaagagctttatttaatcttatgaatgatgatcaaaaaactcaactttttcataatatcgccgcttctatggaaggagttgatgaaaaaattatcactagagctttaaaacattttgaaaaaatttcacctgattatgcaaaaggaattaaaaaagctttagaaaaataa

SEQ ID NO: 5359 - protein, 474 aa, Campylobacter jejuni subsp. jejuni NCTC 11168
MKKLTNDFGNIIADNQNSLSAGAKGPLLMQDYLLLEKLAHQNRERIPERTVHAKGSGAYGEIKITADLSAYTKAKIFQKGEVTPLFLRFSTVAGEAGAADAERDVRGFAIKFYTKEGNWDLVGNNTPTFFIRDAYKFPDFIHTQKRDPRTHLRSNNAAWDFWSLCPESLHQVTILMSDRGIPASYRHMHGFGSHTYSFINDKNERFWVKFHFKTQQGIKNLTNQEAAELIAKDRESHQRDLYNAIENKDFPKWKVQVQILAEKDIEKLGFNPFDLTKIWPHSFVPLMDIGEMILNKNPQNYFNEVEQAAFSPSNIVPGIGFSPDKMLQARIFSYPDAQRYRIGTNYHLLPVNRAKSEVNTYNVAGAMNFDSYKNDAAYYEPNSYDNSPKEDKSYLEPDLVLEGVAQRYAPLDNDFYTQPRALFNLMNDDQKTQLFHNIAASMEGVDEKIITRALKHFEKISPDYAKGIKKALEK

SEQ ID NO: 5360 - DNA, 1524 bp, Staphylococcus aureus subsp. aureus Mu50
  CDS (1)..(1524): transl_table=11
atgactatgtcacaacaagacaaaaagttaactggtgtttttgggcatccagtatcagaccgagaaaatagtatgacagcagggcctaggggacctcttttaatgcaagatatttactttttagagcaaatgtctcaatttgatagagaagtaataccagaacgtcgaatgcatgccaaaggttctggtgcatttgggacatttactgtaactaaagatataacaaaatatacgaatgctaaaatattctctgaaataggtaagcaaaccgaaatgtttgcccgtttctctactgtagcaggagaacgtggtgctgctgatgcggagcgtgacattcgaggatttgcgttaaagttctacactgaagaagggaactgggatttagtagggaataacacaccagtattcttctttagagatccaaagttatttgttagtttaaatcgtgcggtgaaacgagatcctagaacaaatatgagagatgcacaaaataactgggatttctggacgggtcttccagaagcattgcaccaagtaacgatcttaatgtcagatagagggattcctaaagatttacgtcatatgcatgggttcggttctcacacatactctatgtataatgattctggtgaacgtgtttgggttaaattccattttagaacgcaacaaggtattgaaaacttaactgatgaagaagctgctgaaattatagctacagatcgtgattcatctcaacgcgatttattcgaagccattgaaaaaggtgattatccaaaatggacaatgtatattcaagtaatgactgaggaacaagctaaaaaccataaagataatccatttgatttaacaaaagtatggtatcacgatgagtatcctctaattgaagttggagagtttgaattaaatagaaatccagataattactttatggatgttgaacaagctgcgtttgcaccaactaatattattccaggattagatttttctccagacaaaatgttgcaagggcgtttattctcatatggcgatgcgcaaagatatcgattaggagttaatcattggcagattcctgtaaaccaacctaaaggtgttggtattgaaaatatttgtccttttagtagagatggtcaaatgcgcgtagttgacaataaccaaggtggaggaacacattattatccaaataaccatggtaaatttgattctcaacctgaatataaaaagccaccattcccaactgatggatacggctatgaatataatcaacgtcaagatgatgataattattttgaacaaccaggtaaattgtttagattacaatcagaggacgctaaagaaagaatttttacaaatacagcaaatgcaatggaaggcgtaacggatgatgttaaacgacgtcatattcgtcattgttacaaagctgacccagaatatggtaaaggtgttgcaaaagcattaggtattgatataaattctattgatcttgaaactgaaaatgatgaaacatacgaaaactttgaaaaataa

SEQ ID NO: 5361 - protein, 507 aa, Staphylococcus aureus subsp. aureus Mu50
MTMSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEEAAEIIATDRDSSQRDLFEAIEKGDYPKWTMYIQVMTEEQAKNHKDNPFDLTKVWYHDEYPLIEVGEFELNRNPDNYFMDVEQAAFAPTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 5362 - DNA, 2142 bp, Agrobacterium tumefaciens str. C58
  CDS (1)..(2142): transl_table=11
atggccagaaaaccaaattccacctcgtccattaccgccaccatccatgaccagcagcttatccggggagcaggtggcgagctgcaccagattgccaccggcgacgaacccgttttgacgaccgctcaaggggctccagttgcagacgaccagaattcgcttcggatcggtcctcgcgggccgctcgtggtggatgacttccattttcgcgagaagatcttccatttcgatcacgagagaattcccgagcgcgtcgtccacgcccgcggatatggcgcgcacggctatttcgagacttatgattcccttgccacccataccaaggcggatttgtttcaacgggcaggggaaagaaccccggcctttgtgcggttctcgactgttgccggcaacaagggctcggccgatctcgcacgggatgtccgcggttttgccgtgaagctctataccaaggagggcaactgggatctcgtcggaaacaacatcccggtatttttcattcaggatgcgatcaagtttccggatctcgtccatgcggccaagcaggagcccgatcgcgcctttccacaagctcaaacggcacatgacaccttctgggatttcatcagtctcacgcccgaaagcatgaacatggtgatgtggatcatgtccgaccgcaccattccgcgttccttccgcttcatggaaggcttcggtgtgcacaccttccgcttcatcaatgcgaaggagcaatcaacctttgtgaagtttcactggaagccaaaacttgggttgcagtcggtggcgtggaacgaggcggtcaagatcaatggtgccgatcccgattttcaccggcgtgatctctggaccgcaatccagtcgggaaatttcccggaatgggagttgcaggtccagctcttcgatcaggatttcgccgacagcttcgatttcgacgttcttgatcctaccaagatcattcctgaagagatattggctccgaagcctgtcggccggctcgtgctcgaccgtatgccggacaatttcttcgccgagacggaacaggtggcgttcatgacacaaaacgtcccgccaggcatcgatttcagcaatgacccactgctgcagggtagaaatttttcctatctcgatacgcagttgaagcgtcttggcggtcccaacttcacgcatttgccgatcaatgcgccaaagtgtcctttcgcgcatttccagcaggacggtcacatggcgatgcgaaatccgacaggacgggccaattatcagccgaattcattcggggaaggccagcgggaatcgccgacgcgtggtttccagcatttcgcggctgaggagcagggggtcaaggcaaggttgcggccggaaagttttgccgatcactatagtcaagcacggcagttctacatcagccagacgccacccgaacaacgtcatatcgcatcggccctgactttcgaactcagcaaggtcgaaacggtggagattcgagagaggatggtttcacatcttcttaatatcgacgaaaccctcgctacgacggtggcgcagaagctcggccttcagacaatgccggagccggcgaatacggccattcctacccgtcaggatctggagccgtcgcccgcgctcagcatcgttgaacggggtcccaaacgcttcgaaggccgaaagcttggcattctcatcacggatggcgtggacgcaaaactgctgaaggggctgacccaggcagtaacagccgaaaaagccgtcttcgagttcatcgcgcccaaggtcgggggcgtaacggcgtcgaacggcacccttatcgaggcacatcacatgattgatggaggcccttcggtgcttttcgatgcggttgctctgctgacatcggaggcggccatcgctgagctgaccgaggaggcaactgcccgggatttcgttgcagacgcgttccagcactgcaaattcatcggatacgaccggtcagcgttgccgttgctggaaattgccggaattgccgacgccatggatgaaggcgtgctgcccttgcccggcgaggaagggcttgcggccttcgtggcagaacttgggaaattgcgtgtctgggctcgggaaccctcgctgaaactcggcaaggcatccgttccagtcaacaaggaataa

SEQ ID NO: 5363 - protein, 713 aa, Agrobacterium tumefaciens str. C58
MARKPNSTSSITATIHDQQLIRGAGGELHQIATGDEPVLTTAQGAPVADDQNSLRIGPRGPLVVDDFHFREKIFHFDHERIPERVVHARGYGAHGYFETYDSLATHTKADLFQRAGERTPAFVRFSTVAGNKGSADLARDVRGFAVKLYTKEGNWDLVGNNIPVFFIQDAIKFPDLVHAAKQEPDRAFPQAQTAHDTFWDFISLTPESMNMVMWIMSDRTIPRSFRFMEGFGVHTFRFINAKEQSTFVKFHWKPKLGLQSVAWNEAVKINGADPDFHRRDLWTAIQSGNFPEWELQVQLFDQDFADSFDFDVLDPTKIIPEEILAPKPVGRLVLDRMPDNFFAETEQVAFMTQNVPPGIDFSNDPLLQGRNFSYLDTQLKRLGGPNFTHLPINAPKCPFAHFQQDGHMAMRNPTGRANYQPNSFGEGQRESPTRGFQHFAAEEQGVKARLRPESFADHYSQARQFYISQTPPEQRHIASALTFELSKVETVEIRERMVSHLLNIDETLATTVAQKLGLQTMPEPANTAIPTRQDLEPSPALSIVERGPKRFEGRKLGILITDGVDAKLLKGLTQAVTAEKAVFEFIAPKVGGVTASNGTLIEAHHMIDGGPSVLFDAVALLTSEAAIAELTEEATARDFVADAFQHCKFIGYDRSALPLLEIAGIADAMDEGVLPLPGEEGLAAFVAELGKLRVWAREPSLKLGKASVPVNKE

SEQ ID NO: 5364 - DNA, 1521 bp, Streptomyces coelicolor A3(2)
  CDS (1)..(1521): transl_table=11
atgaccgacaccccgcccgccaccaccacggactccggcgcaccggcggagagcgacgaacactcgctcaccgcgggcccggcgggtccggtcctcctccaggacgcctacctcatcgagcagatggcgcagttcaaccgggagcgcatccccgagcgccagccgcacgccaagggcagcggcgccttcggccacttcgaggtgacgcacgacgtgagcgcctacaccaaggcggccgtcttccagccgggcacccggaccgacctggtcgcccgcttctccaccgtcgccggcgagcgcggcagcccggacacctggcgcgacccgcggggcttcgcggtgaagttctacaccagccagggcaactacgacatggtcggcaacaacacgccggtgttcttcgtcaaggacccgatgaagttccagcacttcatccggtcgcagaagcgccgggcggatagcaacctgcgcgaccacgacatgcagtgggacttctggacgctctcgccggaatccgcgcaccaggtcacctggctcatgggagaccgcggcatcccgcgcacctggcgccacatgaacggctacacctcccacacctacatgtggatcaacgcgtcgggcgagcgcttctgggtgaagtaccacttcaagaccgaccagggcatcgagtacttcacccagcacgaggccgaccagatggcggcggccgacacggactaccacatgcgggacctcttcgagcacatccgcgacggcgacttcccgagctggacgctgcacgtgcaggtcatgccgtacgaggaagccgcgggctaccggttcaacccgttcgacctgacgaaggtgtggccgcacggcgactaccccctcatcccggtcggccgcatgacgctggaacggaacccgacggacaaccacgccgagatcgagcaggcggccttccagcccaacaacctggtcccgggcatcggcccgagcccggaccgcatgctgctggcccggctcttctcgtacgccgacgcccaccgctaccggatcggcgcgaactaccagcagcttcccgtgaacgccccggtcgtcgacgtccgcacctactccaaggacggcgcgatggcgtaccggaagaccaccgatccggtctacgcgccgaactccaagggcggccccgccgccgacaccgagcacttcggcacgccgcccagctgggagacggacgggtccatcacgcgcacggcctacgtcagccacgccgaggacgacgactgggggcagccgggcaccctggtccgcgaggtgatggacgacgcggcccgggaccggctggtcgacaacgtggtggaccacctcctcaacgaggtgaccgaacccgtgctccagcgggccttcgcgtactggtcgaacatcgacaggaccatcggcgaccgcatcgccaagggggtgcgggcgaaggcgggcgagaaggacttcaaggccgccgagcagcgcaatccggcccggcaggccatgcaggacaaggcctga

SEQ ID NO: 5365 - protein, 506 aa, Streptomyces coelicolor A3(2)
MTDTPPATTTDSGAPAESDEHSLTAGPAGPVLLQDAYLIEQMAQFNRERIPERQPHAKGSGAFGHFEVTHDVSAYTKAAVFQPGTRTDLVARFSTVAGERGSPDTWRDPRGFAVKFYTSQGNYDMVGNNTPVFFVKDPMKFQHFIRSQKRRADSNLRDHDMQWDFWTLSPESAHQVTWLMGDRGIPRTWRHMNGYTSHTYMWINASGERFWVKYHFKTDQGIEYFTQHEADQMAAADTDYHMRDLFEHIRDGDFPSWTLHVQVMPYEEAAGYRFNPFDLTKVWPHGDYPLIPVGRMTLERNPTDNHAEIEQAAFQPNNLVPGIGPSPDRMLLARLFSYADAHRYRIGANYQQLPVNAPVVDVRTYSKDGAMAYRKTTDPVYAPNSKGGPAADTEHFGTPPSWETDGSITRTAYVSHAEDDDWGQPGTLVREVMDDAARDRLVDNVVDHLLNEVTEPVLQRAFAYWSNIDRTIGDRIAKGVRAKAGEKDFKAAEQRNPARQAMQDKA

SEQ ID NO: 5366 - DNA, 1464 bp, Oceanobacillus iheyensis HTE831
  CDS (1)..(1464): transl_table=11
ttgagtaataaaagaaacacattaacaactgcttctggagctccagtaggcgataaccaaaactcaattacagctggtcataacggacctacactactacaagattttcatttactagaaaagcttgctcattttaatagagaacgtatccctgagcgtgttgtacacgcaaaaggtgcaggtgcacatggatacttcgaagttacaaatgacgaaatatctaagtatacaaaagctgatttccttagtgaaaaaggtaaacgcacggatatgttcatccgcttctctacagttgctggtgagcaaggttcagcagatactgtacgtgaccctcgtggtttcgcggttaaattttatactgaagaaggaaactacgatttagttggtaacaatacacctatcttcttcattcgtgatgcgattaaattcccagattttattcacacacaaaaacgtaatccacaaactcatttaaaagataaagacatggtatgggatttctggtcattatctccagaatcattacaccaagttacgtatcttcatagtgaccgtggtcttccagctacattgcgtcacatgaacggatatggaagtcatacgttcaaatgggtgaatgcagaaggagaagcattctgggttaaatatcactttattagtgaacaaggaattaaaaacctagaccctgctctagcagataaaattgctggtgaaaacccagattaccatacagaagatctatttaatgcaatcgaagaaggcgatcaccctgcttggaaactatatgtacaaattatgccttacgaagatgcaaaaacgtacaaatgggatccatttgatgtaacaaaaatctggtctaaaaaagactaccctcgtattgaagttggacgcatggtattagatcgtaatccggagaactactttgcagaagtagaacaagctgcattctctcctggtcaattcgtacctggaattgaagcatctccagataaaatgcttcaaggtcgtttattcggttattctgatgcacatcgctaccgtctaggagcaaaccatcatagtattccagtaaatcgtcctaaaaacgaagtaaataattatcagcgtgatggctttatgagcgtagatggtaatggcggtaacaagccaaattatgaaccgaatagcgtaaatggccctacagaagatagtgaagctaaaatcaatccatttgaaatttatggtcaagcagatagtgtaacttacgatagtgatgatcactatactcaagcaggagatctttatcgacttatgtcagcagatgaaaaagatcgtctagttgaagcatttgtaggtcatatgactccagttactaaagatgaaattaaacttcgtcaaatcgagcatatctataaagcagacgctgaatggggagagcgcgtagctcaaggtcttgggttacaagttccagaaagcgtaaaataa

SEQ ID NO: 5367 - protein, 487 aa, Oceanobacillus iheyensis HTE831
MSNKRNTLTTASGAPVGDNQNSITAGHNGPTLLQDFHLLEKLAHFNRERIPERVVHAKGAGAHGYFEVTNDEISKYTKADFLSEKGKRTDMFIRFSTVAGEQGSADTVRDPRGFAVKFYTEEGNYDLVGNNTPIFFIRDAIKFPDFIHTQKRNPQTHLKDKDMVWDFWSLSPESLHQVTYLHSDRGLPATLRHMNGYGSHTFKWVNAEGEAFWVKYHFISEQGIKNLDPALADKIAGENPDYHTEDLFNAIEEGDHPAWKLYVQIMPYEDAKTYKWDPFDVTKIWSKKDYPRIEVGRMVLDRNPENYFAEVEQAAFSPGQFVPGIEASPDKMLQGRLFGYSDAHRYRLGANHHSIPVNRPKNEVNNYQRDGFMSVDGNGGNKPNYEPNSVNGPTEDSEAKINPFEIYGQADSVTYDSDDHYTQAGDLYRLMSADEKDRLVEAFVGHMTPVTKDEIKLRQIEHIYKADAEWGERVAQGLGLQVPESVK

SEQ ID NO: 5368 - DNA, 1440 bp, Pseudomonas putida KT2440
  CDS (1)..(1440): transl_table=11
atgagcaagattctcaccaccgctagcggtgcacctgtagccgacaaccagaactcccgctccgccggcccgcgcggtccgctgctgctcgacgacttccacctgatcgagaagctcgcccatttcaaccgcgagaacattcctgagcgccgcgtccatgccaaaggctcgggcgcctacggtacctttaccgttactcacgatatcaccggctataccagcgccaagctgttcgaagaggtcggtaaacaaaccgagactttcttacgcttctccaccgttggtggtgagcgcggttcggctgataccgagcgtgacccgcgcggcttcgcggtgaagttctacaccgaggaaggcaactgggacattgtcggtaacaacactccagtattcttcattcgcgacccacttaagttcccggactttatccacacccagaagcgccacccgcagtccaacctgaagaatgctcagatgatgtgggacttctggtcgcactctccagaagcgctgcatcaggtcaccatcctgttttccgatcgtggcattccggacggctaccgtcacatgcatggctttggcagccacacctacagcctgatcaatgcaaagggtgagcgcacttgggtcaagtggcacttcaagacccagcaaggcatcaagaacctcaccccggcagacgctgcacgcctggcaggtaccgacccggactacgctcagcgcgacctcttcgaggccatcgagcgtggcgactacccgcgctggactgtctgcattcaggtgatgagcgaagccgaggctgccagccgcgacgagaacccattcgacgtgaccaagacctggtcgcagaaggattatccactcatcgaggtgggtgtgctggagctcaaccgtaacccgctcaactattttgcggaggtcgagcaggccgcgttcgggccgagcaatatggtgcccggcgtcggtctttcgccggaccgcatgctgcaaggccgtgtattcgcctacgccgacgcgcaccgctatcgcgtggggaccaaccaccagcaattgccagtcaacgcgccacgctgcccggtgaacagctaccagcgtgatggctcgatggccaccggcagttacggtagtgcaccgaactacgagccaaacagctacagcgatgccccgaaacagtcgccacgtcatgctgagccagcattggccatgaatggttcggctgatcgctacgatcaccgcgaggataccgactacttcagccatgccggcgctttgttccgtttgatgaacgatgagcagaaggccctgctgatcagtaacatcgccggtaccatggcgggcgtcagcgaagatgtcattcagcgtcagctacagtacttcttcaaggcggatccggcttacggcgaagggattgcaaaggctttgggcatcaatctcgcctaa

SEQ ID NO: 5369 - protein, 479 aa, Pseudomonas putida KT2440
MSKILTTASGAPVADNQNSRSAGPRGPLLLDDFHLIEKLAHFNRENIPERRVHAKGSGAYGTFTVTHDITGYTSAKLFEEVGKQTETFLRFSTVGGERGSADTERDPRGFAVKFYTEEGNWDIVGNNTPVFFIRDPLKFPDFIHTQKRHPQSNLKNAQMMWDFWSHSPEALHQVTILFSDRGIPDGYRHMHGFGSHTYSLINAKGERTWVKWHFKTQQGIKNLTPADAARLAGTDPDYAQRDLFEAIERGDYPRWTVCIQVMSEAEAASRDENPFDVTKTWSQKDYPLIEVGVLELNRNPLNYFAEVEQAAFGPSNMVPGVGLSPDRMLQGRVFAYADAHRYRVGTNHQQLPVNAPRCPVNSYQRDGSMATGSYGSAPNYEPNSYSDAPKQSPRHAEPALAMNGSADRYDHREDTDYFSHAGALFRLMNDEQKALLISNIAGTMAGVSEDVIQRQLQYFFKADPAYGEGIAKALGINLA

SEQ ID NO: 5370 - DNA, 1467 bp, Bacteroides thetaiotaomicron VPI-5482
  CDS (1)..(1467): transl_table=11
atggaagaaaaaaaactaactgccgcgaacggtcgtcccattgccgacaatcagaattcgcaaaccgcaggtcaacgcggacctgtcatgttacaagatccatggcttattgaaaaactggctcattttgaccgtgaagtgattccggaaagacgtatgcacgccaaaggttcgggagctttcggtacatttaccgtcactcacgacattacgaagtacacccgtgcagctattttcagcgaagtcggaaagcaaactgagtgtttcgtccgtttctctaccgtagccggagagcgtggggcggcagatgccgaacgtgatatccgcggttttgccatgaaattctacaccgaagagggcaactgggatttagtcggaaacaacactcctgtctttttcttacgtgatccgcttaaatttccggatttgaatcatgccatcaagcgcgacccgaaaacgaacatgcgcagccctaacagcaactgggacttctggacacttctgcccgaagcgcttcatcaggtgacaatcactatgagccctcgcggcattccttactcctatcgccatatgcacggattcggaagccacacctatagttttatcaatgcggacaaccagcgtatctgggtgaaattccacctgcgcaccttgcagggaatcaaaaacctgacagatcaggaagcggaagcgatcatcgccaaagaccgcgaatctcatcaacgcgacctttttgaaagcatcgaaaagggagattacccgaaatggttattccagattcagttaatgacggaagaggaagcagaccattaccgcatcaacccgttcgacctgaccaaagtatggccgcacaaagacttcccgctacaagacgtcggaatccttgaactgaaccgtaatccggaaaactatttcgcagaagtagaacaagctgctttcaacccgatcaataccgtagacggcatcggattctcaccggacaagatgttacagggacgtctgttctcttacggcgatgcacagcgttatcgtctcggagtgaactccgaacagattccggtgaataaaccccgttgcccgttccatgcttaccaccgtgacggagccatgcgtgtagacggcaactacggtgcaaccaaaggctacgaacccaacagctacggagaatggaaagactctcctcacatgaaagaaccgcctctcaaagcatccggcaacggagagatatacaattataatgaacgcgaatacgatgatgattactacagccagccgggcgatctgttccgactgatgccggcagacgagcagcaacttctgtttgaaaacacggcacgtgctatgggagactccgaattattcatcaaacagcgtcacacccgcaactgctacaaagcagaccccgcatacggtgccggagtcgccaaagcattgggcattgatctgcaagaagcattgaaagaataa

SEQ ID NO: 5371 - protein, 488 aa, Bacteroides thetaiotaomicron VPI-5482
MEEKKLTAANGRPIADNQNSQTAGQRGPVMLQDPWLIEKLAHFDREVIPERRMHAKGSGAFGTFTVTHDITKYTRAAIFSEVGKQTECFVRFSTVAGERGAADAERDIRGFAMKFYTEEGNWDLVGNNTPVFFLRDPLKFPDLNHAIKRDPKTNMRSPNSNWDFWTLLPEALHQVTITMSPRGIPYSYRHMHGFGSHTYSFINADNQRIWVKFHLRTLQGIKNLTDQEAEAIIAKDRESHQRDLFESIEKGDYPKWLFQIQLMTEEEADHYRINPFDLTKVWPHKDFPLQDVGILELNRNPENYFAEVEQAAFNPINTVDGIGFSPDKMLQGRLFSYGDAQRYRLGVNSEQIPVNKPRCPFHAYHRDGAMRVDGNYGATKGYEPNSYGEWKDSPHMKEPPLKASGNGEIYNYNEREYDDDYYSQPGDLFRLMPADEQQLLFENTARAMGDSELFIKQRHTRNCYKADPAYGAGVAKALGIDLQEALKE

SEQ ID NO: 5372 - DNA, 1464 bp, Streptomyces avermitilis MA-4680
  CDS (1)..(1464): transl_table=11
gtgacccaggcaccccagaaggctccgtacaccacgaacaacgtcggaattccggtggagagcgacgaacactcgctcaccgtcggtcccgatggcccgatcctgctccaggaccactacctcatcgagaagatggcccagttcaaccgggagcgggtccccgagcgtgtggtgcacgccaagggcagtggcgcgtacggattcttcgaagtcaccaatgacgtcagccagttcaccaaggccgacctgttccagccgggcaagcgcaccgagatgctggcccgcttctccaccgtcgccggcgagcagggctcgcccgacacctggcgcgacccccgcggcttcgcgctgaagttctacaccgagcacggcaactacgacatggtgggcaacaacaccccggtcttcttcgtccgtgacacgatcaagttccaggacttcatccgctcgcagaagcgccacccggtcaccgggctgcgcagcaacgacatgcagtgggacttctggacgctctcccccgagtccgcacaccaggtgacctggctgatgggcgaccggggcatcccgaagacgtaccgccacatgaacggctacagctcccacacctatatgtggatcaatggcgccggtgagcggttctgggtgaagtaccacttcaagaccgaccagggcatcgacttcctcacccaggcggaggccgacgagctggccggttcggatgccgacaagcaccgccgggacctgttcgagtcgatcgagtccgggaacgcgccgacctggaccctgaaggtccagatcatgccgttcgaggacgcggcggactaccgcttcaacccgttcgacctgaccaaggtctggccgcacggcgactacccgctgatcgacgtcggccggatggtcctcaacaagaaccccgaggactacttcatccacatcgagcaggccgccttcgagccgtccaacctggtgccgggcatcggcccctcgccggacaagatgctgctcggccggctgttctcgtaccccgacacacaccggtaccggatcggcccgaactatgcgcagctgccgcccaaccggccgcacgccccggtgaactcgtacgccaaggacggcccgatgcggtacgtgccgtcgaacgcggcgaggccgtacgcgcccaactcctacggcggccccgcggccgactacgggcaattcggcgacccggcgagctgggagacggccggagagctggtccgcgaggcgaccaagccgcaccgcgaggacgacgactggggccagccgggcacgatggtgcgccaggtcctggacgacgcggcccgcgaccggctcgtgtcgaacgtcagcggccatctgaaggccgatgtctcgcgcccggtcctggaccgcgcggtgcagtactggcgcaacatcgacaaggagatcggcgaccggatcgccagcaacgtcaacggaggctga

SEQ ID NO: 5373 - protein, 487 aa, Streptomyces avermitilis MA-4680
MTQAPQKAPYTTNNVGIPVESDEHSLTVGPDGPILLQDHYLIEKMAQFNRERVPERVVHAKGSGAYGFFEVTNDVSQFTKADLFQPGKRTEMLARFSTVAGEQGSPDTWRDPRGFALKFYTEHGNYDMVGNNTPVFFVRDTIKFQDFIRSQKRHPVTGLRSNDMQWDFWTLSPESAHQVTWLMGDRGIPKTYRHMNGYSSHTYMWINGAGERFWVKYHFKTDQGIDFLTQAEADELAGSDADKHRRDLFESIESGNAPTWTLKVQIMPFEDAADYRFNPFDLTKVWPHGDYPLIDVGRMVLNKNPEDYFIHIEQAAFEPSNLVPGIGPSPDKMLLGRLFSYPDTHRYRIGPNYAQLPPNRPHAPVNSYAKDGPMRYVPSNAARPYAPNSYGGPAADYGQFGDPASWETAGELVREATKPHREDDDWGQPGTMVRQVLDDAARDRLVSNVSGHLKADVSRPVLDRAVQYWRNIDKEIGDRIASNVNGG

SEQ ID NO: 5374 - DNA, 1437 bp, Helicobacter hepaticus ATCC 51449
  CDS (1)..(1437): transl_table=11
atgtcaaagaaatttacgacagcaacaggcacaccattaggtgataatcaaaactcaattacagcaggcaaaaagggacctacacttttacaagatacttggcttttagaaaaacttgcacattttgatagagagagaatcccagagagagtggtgcacgctaaaggaagtgcagcatatggtgaattaacaattacaaatgatattactcaatacacaaaagcagaactttttaacaaagtgggcaaaaaaacaaaagcatttttgcgtttttctgtggtggcaggtgagcgaggagcagcagatgcagagcgtgatgtgcgtggttttgcactcaagctttatacaaatgaaggaaattgggatattgtaggtaataacacacctgtgttttttattaaagatgcgattaaattccctgattttattcatacacaaaaacgagaccccaaaacaaatatgaaaagccctacggcaatgtgggatttttggagtttgcacccagaatccttacatcaagtaacgattttaatgagcgataggggtattccacgaagttaccgagaaatgcacggatttggtagccacacatatagctttatcaatgccaaaaacgagcgcttttgggtgaaattccattttgtttgtttgcaaggtattcataaccttactaataaagaatcagaggcagttatcgccaaagatagagaatctcatcaaaaagatttgtttgaaaatattgaaaagggtaatttccctaaatggcgattctgtatccaagtaatgagcgaaaaagaggcggaaaactatcgttttaatccttttgatttaacaaaagtatggagtcataaagattatccgcttattgaagtggggattttagaactcaataagaatccagagaattattttgcagaagtagaacaagcagcttttaatcctgcaaatatcgtgcccggagtaggatatagccccgataaagtattgcaagggcggctttttagttatggagatacacaaagataccgcttaggcattaatcacactcaacttcctgtaaatgcacctattgtgcctgtgaataatacgcatcgtgatggttttatgcagcaaggtcagtttggcgatagacgcaattatgagccaagttattttaatgattatgttgaagataaaaacgcacttgaaccaccactttttgtgcaagagggtgatgtaatgtataaatatgaccatcgcgaatatgaagatgattattttgtgcaagcaggagatttgtatcgcttgatgactgcagagcaaaaagaagcattatgtcaaaatattaaagaatcaatggaaggtgtgccagatgaaattaaaaaacgtcagcttgagcactttaaaaaagcagataaagcgtatggcaagagagtggcagagcttttggggttataa

SEQ ID NO: 5375 - protein, 478 aa, Helicobacter hepaticus ATCC 51449
MSKKFTTATGTPLGDNQNSITAGKKGPTLLQDTWLLEKLAHFDRERIPERVVHAKGSAAYGELTITNDITQYTKAELFNKVGKKTKAFLRFSVVAGERGAADAERDVRGFALKLYTNEGNWDIVGNNTPVFFIKDAIKFPDFIHTQKRDPKTNMKSPTAMWDFWSLHPESLHQVTILMSDRGIPRSYREMHGFGSHTYSFINAKNERFWVKFHFVCLQGIHNLTNKESEAVIAKDRESHQKDLFENIEKGNFPKWRFCIQVMSEKEAENYRFNPFDLTKVWSHKDYPLIEVGILELNKNPENYFAEVEQAAFNPANIVPGVGYSPDKVLQGRLFSYGDTQRYRLGINHTQLPVNAPIVPVNNTHRDGFMQQGQFGDRRNYEPSYFNDYVEDKNALEPPLFVQEGDVMYKYDHREYEDDYFVQAGDLYRLMTAEQKEALCQNIKESMEGVPDEIKKRQLEHFKKADKAYGKRVAELLGL

SEQ ID NO: 5376 - DNA, 1440 bp, Bordetella bronchiseptica RB50
  CDS (1)..(1440): transl_table=11
atgaccaacaagaccctcactaccgccgccggtgcgccggttgccgacaacaacaacaccatgacggcggggccgcgcggccccgccctgctgcaggacgtctggttcctggagaaactggcccacttcgaccgtgaacgcattcccgagcgcgtggtgcacgccaaaggctcgggcgcctatggcaccttcacggtcacgcatgacatttcccgctacacgcgcgccaggatcttcgccgaagtcggcaagcagacgccgttgttcctgcgcttttcgaccgtggccggcgagcgcggcgcggccgacgccgaacgtgacgtgcgtggcttcgccatcaagttctataccgacgaaggcaactgggacctggtcggcaacaacacgcccgtgttcttcattcgcgatccgctcaagttccccgacttcatccatacccagaagcgcgaccccaagaccaacctgcgcaacgccaccgccgcctgggacttctggtcgctcaacccggaatcgctgcaccaggtcaccatcctgatgagcgatcgcggactgccgcagaactatcgccagcagcacggcttcggctcgcatacctacagcttcgtcaacgacgccggcgagcgtttctacgtcaagttccacttcaagtcgcagcaaggcatcgcctgttatacggacggcgaagccgccgagctggtcggccgcgatcgcgaaagcgcgcagcgcgacctgttccagaacatcgagcagggccagttcccgcgctggacgctcaaggtgcaggtaatgcccgaagccgaggccgccacctatcacatcaacccgttcgacctgaccaaggtgtggccgcatgccgactaccccttgatcgaagtgggcgtgctggaactgaacaagaaccccgagaactatttcgccgaagtcgaacaggccgcgttcacgccggccaatgtggtgccgggcatcggcttttcgcccgacaagatgctgcagggtcgcctgttctcgtacggcgacacccatcgctaccgcctgggcatcaaccaccatcagattcccgtcaatgcgccgcgctgcccgttccacagcttccatcgcgacgggatgggccgggtcgacggcaatggcggcgccacgctgaactacgaacccaacagtttcggcgaatggcgcgaagccaagcacgcagccgaaccgccgctggcgctggacggacaggccgccgaccgctggaaccatcgggtcgacgaggactactactcgcagccgggcgcgctgttccgtctcatgaacgacgaccagaaacagcagctgttcggcaacatcggccgccacatggccggcgtgcccgaggaaatccagcgccgccagctcgagcacttccgccgtgccgacccggcctatgccgcgggcgtggccaaggccctgggcctgaagtaa

SEQ ID NO: 5377 - protein, 479 aa, Bordetella bronchiseptica RB50
MTNKTLTTAAGAPVADNNNTMTAGPRGPALLQDVWFLEKLAHFDRERIPERVVHAKGSGAYGTFTVTHDISRYTRARIFAEVGKQTPLFLRFSTVAGERGAADAERDVRGFAIKFYTDEGNWDLVGNNTPVFFIRDPLKFPDFIHTQKRDPKTNLRNATAAWDFWSLNPESLHQVTILMSDRGLPQNYRQQHGFGSHTYSFVNDAGERFYVKFHFKSQQGIACYTDGEAAELVGRDRESAQRDLFQNIEQGQFPRWTLKVQVMPEAEAATYHINPFDLTKVWPHADYPLIEVGVLELNKNPENYFAEVEQAAFTPANVVPGIGFSPDKMLQGRLFSYGDTHRYRLGINHHQIPVNAPRCPFHSFHRDGMGRVDGNGGATLNYEPNSFGEWREAKHAAEPPLALDGQAADRWNHRVDEDYYSQPGALFRLMNDDQKQQLFGNIGRHMAGVPEEIQRRQLEHFRRADPAYAAGVAKALGLK

SEQ ID NO: 5378 - DNA, 1539 bp, Corynebacterium diphtheriae NCTC 13129
  CDS (1)..(1539): transl_table=11
gtgaccagcccagtcgatccaatcctgaacaagggcgagcgcaccgaagcagctcctcacaccacccgcgccggcgggcagcccgtcgccagcgaaaacatctccatcaccgcaggcccacaaggcgccaacgtactcaacgacctgcacctgatcgaaaaactcgcacactttaaccgcgagcgcgtcccagagcgcaatccacacgccaaaggtcacggcgcattcggcgaactccacatcaccgaagacgtatcccagtacaccaaggccaagctcttccaaaaaggcaccgtcacccccatggccgtgcgcttttctaccgtcgccggtgaaaaaggctccccagacacctggcgcgacgtccacggcttcgcactgcgcttttacacccaagacggcaactacgacatcgtaggaaacaacaccccaaccttcttcctacgcgacgccatgaagttccccgacttcatccactcccagaagcgcctcggctccagcggcctgcgcgatgctgacatgcaatgggacttctggacccgcaccccagaatccgcacaccaagtcacctacctcatgggcgaccgcggcacaccaaaaaccagccgccaccaggacggatttggctctcacacctaccagtggatcaacgaagacggccagccagtgtgggtgaagtaccactttaagacccgccagggctgggaaaccttcaccgacgcagaggcccaagaaatggccggcaagaacgccgactaccagcgcgaagacctctacaatgccatcgagcgcggcgacttccccatctgggacgtcaaagtccagatcatgccattcgacgaggccgaaacctaccgctggaaccccttcgacctgaccaagacctggtcccagaaggactacccgcttatcgacgtcggctacttcgtgctcaaccgcaacccacagaacttcttcgcccagatcgaacagctggccctcgacccagccaacctcgtcccaggcgttggactctccccagaccgcatgctcatggcccgtgccttcgcctacgcagacgcacaacgctaccgcattggcccgaactaccagcagctgcccatcaaccagccagtggtaccggtgaacacctaccagcacgaaggccccatggcctaccacttcaacccagctgacgcgccggtgcacacaccaaaccgctttggcaagggtgccggctacctcgacgacggtcaaacctcgtcctccggtgcgacctacggtcaggcgcaggatctctacgtcaacccagatccacacggcaccgacctgactcgcgcagcctatgtcaagcacgcagacgatgacgacttcatgcaagccggaatcctctaccgcgaggtctatgacgacgcagccaaggaacgcttcgtggacaacgtgaccaatgccatggcaggggtatccccagaaaccgaggagcgcgtctactggtactggacccaagtagacgaaaacctcggtgcgaaaatccgtgaggcattcgccgctaagaagtag

SEQ ID NO: 5379 - protein, 512 aa, Corynebacterium diphtheriae NCTC 13129
MTSPVDPILNKGERTEAAPHTTRAGGQPVASENISITAGPQGANVLNDLHLIEKLAHFNRERVPERNPHAKGHGAFGELHITEDVSQYTKAKLFQKGTVTPMAVRFSTVAGEKGSPDTWRDVHGFALRFYTQDGNYDIVGNNTPTFFLRDAMKFPDFIHSQKRLGSSGLRDADMQWDFWTRTPESAHQVTYLMGDRGTPKTSRHQDGFGSHTYQWINEDGQPVWVKYHFKTRQGWETFTDAEAQEMAGKNADYQREDLYNAIERGDFPIWDVKVQIMPFDEAETYRWNPFDLTKTWSQKDYPLIDVGYFVLNRNPQNFFAQIEQLALDPANLVPGVGLSPDRMLMARAFAYADAQRYRIGPNYQQLPINQPVVPVNTYQHEGPMAYHFNPADAPVHTPNRFGKGAGYLDDGQTSSSGATYGQAQDLYVNPDPHGTDLTRAAYVKHADDDDFMQAGILYREVYDDAAKERFVDNVTNAMAGVSPETEERVYWYWTQVDENLGAKIREAFAAKK

SEQ ID NO: 5380 - DNA, 1731 bp, Gibberella zeae PH-1
  CDS (1)..(1731)
atggctccatcagcagacacttcattctcggctcacgtagccagccagtttcagtcctacgaggaagatcgacagtcagcctccaaggaatcaacttatgctaccagcaacggcgtccctgtggctcacgcctacgaggcccaacgatgcggcgagaatgggcctcttcttctccaagactttcacctaattgatctcctttctcatttcgatcgagagcgtatccctgagcgagttgttcacgccaagggcagtggtgctcatggattctttgagtgtaccgaccctctcgatgatctgtgtcttgccgacatcttttccgccaagggaaagaaatgtcctgtttccatgagattttcgacagtcggaggagagtctggatcgcatgatatggccagagaccctcgtggattctctgtcaagatgcgaactgaggagggtaacttggattgggttttcaacaacactcccgtcttctttttgagagatcccgccaagtttcctcactttattcacactcaaaagcgcgatcccagtactcatctaactcatgctgatgattcattcgctttctgggactacctttctcagaaccccgagtcaattcatcaagtaatgatcttgatgggcgatcgtggtattcccaagggatacagaaagatgcacggttactctggacacactttcaagctcgtgaacaaagccggcgactgggtgtacacccaaatacacctcaagtccatgcaaggaaccgactttgttactcaggaggactcggccgattactcacccgacttctcccagaaggatctctacgaggctatccagaacggagactaccccaagtggactctcgaagtgcagactatgactcccaaggaagctgaggagttatgggagaaggagaagatcaatgtctttgatctcacccacgtctggcctcagaagcagttccctcgtcgcaaggttggagagtttactctcaatgagaacgctatcaactactttgccgaggttgagcagattgctttcaacccagctcacttacctcctggtattgagccttcagcagaccctgttcttcagtcacgcttgttctcttaccctgatacacaccgtcaccgcattggagtcaactaccaacaactccccgtcaatgccacacgtacaggatacaagtttggcaacttccagcgcgacggccagatggccttctacaaccagggtgcccgacctaactacctctcgtccattgatcctatcaagttccgtacccgaaccgtggatctcgacaagacacacggtcacttcacaggcgaagccatcacattcctcacagcaatccgccccgaggactttaatgctcctcgcgccttgtggaggaacgtatttgacgagccagctcgcgagcgtttcatcaacaatgttactggcaagatgaagctctgcaagcaggaggagcctctgaagcgacagattgccatcttccgcgaggtagaccctgagattgccgatagactcgaaaagtcaacaggcatcaagggatacgatggaattgctgatatgaagtttaatggaagccacaattgtatgaatggcgaaatgaagcttgcaaatgacattatcgcgaacaaggggaagagtgctactgcaaggaacggtgccccggcaaagggatgccactcaagactggagacgaatggacacttgaacggaacaaatggtaaatag

SEQ ID NO: 5381 - protein, 576 aa, Gibberella zeae PH-1
MAPSADTSFSAHVASQFQSYEEDRQSASKESTYATSNGVPVAHAYEAQRCGENGPLLLQDFHLIDLLSHFDRERIPERVVHAKGSGAHGFFECTDPLDDLCLADIFSAKGKKCPVSMRFSTVGGESGSHDMARDPRGFSVKMRTEEGNLDWVFNNTPVFFLRDPAKFPHFIHTQKRDPSTHLTHADDSFAFWDYLSQNPESIHQVMILMGDRGIPKGYRKMHGYSGHTFKLVNKAGDWVYTQIHLKSMQGTDFVTQEDSADYSPDFSQKDLYEAIQNGDYPKWTLEVQTMTPKEAEELWEKEKINVFDLTHVWPQKQFPRRKVGEFTLNENAINYFAEVEQIAFNPAHLPPGIEPSADPVLQSRLFSYPDTHRHRIGVNYQQLPVNATRTGYKFGNFQRDGQMAFYNQGARPNYLSSIDPIKFRTRTVDLDKTHGHFTGEAITFLTAIRPEDFNAPRALWRNVFDEPARERFINNVTGKMKLCKQEEPLKRQIAIFREVDPEIADRLEKSTGIKGYDGIADMKFNGSHNCMNGEMKLANDIIANKGKSATARNGAPAKGCHSRLETNGHLNGTNGK

SEQ ID NO: 5382 - DNA, 1524 bp, Candida glabrata CBS 138
  CDS (1)..(1524)
atgtccgctaatccaactaacacttccgatgttagaggtgacagagttgtcactaactctacaggttacccatacaatgacccatttgctactcaaagagttggtcaacacggcccattgttgatgcaagatgctaacttgatcgactccttggcccacttcaacagagagagaatcccagaaagaaaccctcacgcccacggttctggtgcctttggttactttgaagtcactgatgatattactgacatctgtggttctgccatgttctccgaaattggtaagagaaccagattcttgaccagattctccactgtcggtggtgaaaagggttctgcagacaccgccagagacccaagaggttttgctaccaagttctacactgaagaaggtaacttggactgggtttacaacaacactccaattttcttcatcagagacccatctaagttcccacatttcatccacacccaaaagagaaacccacaaactaacttgaaggacccaaacatgttctgggattacttgaccactccagaaaaccaagttgctgtccaccaattgatgatcctgttctccgacagaggtaccccagcttcttacagacacatgaacggttactccggtcacacttacaagtggtccaacaagaagggtgaatggcactatgtccaagttcacatcttgactgaccaaggtatcaaaaacttgaccaatgatgaagctgttgaaatcgctggtaagaacccagactactgtcaacaagacttgtacgaaaacatcgccaagggtaactacccatcctggactgtttacatccaaactatgaccgaagaacaagccaagaagttgccattctctgtcttcgacttgaccaaggtctggccacacaaggacttcccattgcgtagagtcggtaagatggtcatgaacgaaaacccattgaattactttgcttccatcgaacaagctgctttctccccagccaacactgttccataccaagaaccatctgctgacccagttctacaatctcgtttgtttgcttacgctgatgctcaccgttacagattgggtgctaacttccaccaaatccctgtcaactgcccatacgcctccaagttcttcaacccagttattagagacggtccaatgaacgttgatggtaacttcggtaacgaaccaaactactacgcttccaacaagcaataccaaattccaaaccaagacagaccaatccaacaacaccaagaagtctggaacggtccagctcaaccattccactgggctacttctccaggcgacatcgacttcgtccaagccagagacttgtacaaggtcttgggtaagcaaaaggaccaacaagagcacttggcttacaacatcggtactcacgttgctggtgctgacccagagatccaacaacgtgttatcgacatgttctctcgtgttgatgaaggtctaggtgctaacatcagaaaggagatcgaaaagaacgccagcgccccaactgctaagatctaa

SEQ ID NO: 5383 - protein, 507 aa, Candida glabrata CBS 138
MSANPTNTSDVRGDRVVTNSTGYPYNDPFATQRVGQHGPLLMQDANLIDSLAHFNRERIPERNPHAHGSGAFGYFEVTDDITDICGSAMFSEIGKRTRFLTRFSTVGGEKGSADTARDPRGFATKFYTEEGNLDWVYNNTPIFFIRDPSKFPHFIHTQKRNPQTNLKDPNMFWDYLTTPENQVAVHQLMILFSDRGTPASYRHMNGYSGHTYKWSNKKGEWHYVQVHILTDQGIKNLTNDEAVEIAGKNPDYCQQDLYENIAKGNYPSWTVYIQTMTEEQAKKLPFSVFDLTKVWPHKDFPLRRVGKMVMNENPLNYFASIEQAAFSPANTVPYQEPSADPVLQSRLFAYADAHRYRLGANFHQIPVNCPYASKFFNPVIRDGPMNVDGNFGNEPNYYASNKQYQIPNQDRPIQQHQEVWNGPAQPFHWATSPGDIDFVQARDLYKVLGKQKDQQEHLAYNIGTHVAGADPEIQQRVIDMFSRVDEGLGANIRKEIEKNASAPTAKI

SEQ ID NO: 5384 - DNA, 1536 bp, Kluyveromyces lactis NRRL Y-1140
  CDS (1)..(1536)
atgggccatcctactaatactgcggatgttaggaaagaccgtgtggtcacaaactctcaaggtgctccaattaatgaaccatttgctacgcaacgtgtaggacagcatggtcctttgttgttgcaggattttaaccttcttgattcgttagctcatttcaacagagaacggattccagaacgtaaccctcatgctcatggatcaggtgcgtttgggtacttagaaattacagatgatatcacggacgtgtgcggttcagcgatgttcgataccgtggggaagagaacgcgatgccttgttagatttagtactgttggtggtgagaagggttctgccgatacggcacgtgacccaagagggttcgctatcaagttctatagtgaagaagggaatgtcgactgggtcaacaacaacacgccagtcttcttcatcagagatccttctaagttcccacatttcattcatactcaaaagagaaacccagaaaccaatatgaaggatgctgacatgttttgggactttttgacgacagaggagaatcaagtcgcaattcatcaagtgatgatcttgttctccgatcgtggtactccagcttcttatcgtaacatgaacagttactcgggtcatacttacaaatggtctaacaagcaaggtgaatggcgctacgtgcaagtgcatttgaagacagatcaaggtattaagaacttgaacaacgaggaggcgactaagttggctggtgaaaaccctgactactgtcaaaaggatttgtttgaaaacatcgccaagggtaattacccatcttggaccctttacattcaaactatgaccgaagaagaggcagaaaaattgccattctctgtattcgatctaacaaaagtttggcctcataagcagttcccattgcgtcgtgtaggtaagatggttttgaatgaaaatccagaaaattacttcgctcaagtggaacaggctgcattctccccatcgcacaccgtcccataccaagaagcttctgctgaccctgtcttacaagcacgtttgttctcttatccagatgcccatcgttacagattaggccctaactattctcaaatccctgttaattgtccatatgcatcgaaggttttcaacccagctatcagagatggcccaatgaacgttaacggcaatttgggcaaagagccaaactatttgtctacttctaagaagtaccaattcattcaacaatcaaagccaattcaacaacatcaagaagtatggtctgggcctgcaatgcctgtacattgggcaacctcaccaggagacatcgatttcgttcaagccagagacttgtataacaaagtgttgagcaaacagccaggtcaacaaaaggcattggcccacaatgtcgcagtacacgtagcaagtgcatgccctgaaatccaagaccgtgtatttgccatgtttgcaagagtcgaccgtggtctatctgaaaacatcaaaaaggaagctctgagcttatccccaagaaaggctgctgcattgaatgcaaagttatag

SEQ ID NO: 5385 - protein, 511 aa, Kluyveromyces lactis NRRL Y-1140
MGHPTNTADVRKDRVVTNSQGAPINEPFATQRVGQHGPLLLQDFNLLDSLAHFNRERIPERNPHAHGSGAFGYLEITDDITDVCGSAMFDTVGKRTRCLVRFSTVGGEKGSADTARDPRGFAIKFYSEEGNVDWVNNNTPVFFIRDPSKFPHFIHTQKRNPETNMKDADMFWDFLTTEENQVAIHQVMILFSDRGTPASYRNMNSYSGHTYKWSNKQGEWRYVQVHLKTDQGIKNLNNEEATKLAGENPDYCQKDLFENIAKGNYPSWTLYIQTMTEEEAEKLPFSVFDLTKVWPHKQFPLRRVGKMVLNENPENYFAQVEQAAFSPSHTVPYQEASADPVLQARLFSYPDAHRYRLGPNYSQIPVNCPYASKVFNPAIRDGPMNVNGNLGKEPNYLSTSKKYQFIQQSKPIQQHQEVWSGPAMPVHWATSPGDIDFVQARDLYNKVLSKQPGQQKALAHNVAVHVASACPEIQDRVFAMFARVDRGLSENIKKEALSLSPRKAAALNAKL

SEQ ID NO: 5386 - DNA, 1653 bp, Kluyveromyces lactis NRRL Y-1140
  CDS (1)..(1653)
atgccttctgaatactcttcacctccagtttactccacttcaaatgggtttaaatactctcatcatccatacggtgcacaatactcgcgtccagatggtccacttttactacaggataaccatttgatagaatctctagctagattcgatagggaaagaattcccgaaagagttgtccatgccaaaggtggcggatgtcatatcgaatttgaactcactgattcgttatctgacatcacatatgcagcaccataccaatctcccggttacaagtgtcctggtatcataagatgcagtaccgttggcggtgaatcaggggctccagatacagccagagatccaagaggtttcagtttcaagttttacacgaaatgggggaaccatgactgggtgttcaacaatacaccggtgttcttcatcagagatgcaaacaagttccctcattttattcacactcaaaagagatccccaaggaatcatttgggacaggcttctgatacttccatgtattgggattatttgactcaaaatatcgagtccatccatcaaatcacgtatatgttcggtgatagaggcactccagcttcttggtctgacatgagtgcatattccggtcacacttataagtttatcaatgctgaaggtaagttgacttacgtgcaaattcatgtgttaccagagaatggattcaagactctttcattggaagaagccaataagttagctggtgaaaatcctgattataataaccaattgttgttcgaaaagctagaagccggtgaacgtccaaaatttaattgctatgttcagacgatgacccctgagcaagcagaaaatttcaggtattccattaacgatttgaccaagatttggccacataaggaattcccattgcgcaagttcggtaccattaccctaacccataacgtcgataactatttcgaagaaatcgagcaacttgctttctctccatcaaacacctgtattccaggtatcgagccatccaacgattctgtcttgcaatccagattattctcgtacccagacactcaacgtcacagacttggtaccaactttatgcagttaccagtcaatagacccgtgaatatgggtagagaagcttgtccatttgcaggtgcgaatttccaaagagatgggccaatgtgtatgttcaacttcaaggaccaaccaaactatatcgcttcttccggtaaaaaccttgttcagttcaacacattggatgacaacaatgccaagtcaacgcacgaaagatttactggtgttgtattagaagaggatgttgtcgctgaaataaagagacaagaagaaaaccgtgtagaacatgaacgtgttgttaacggtaagatcaacgaatattatattgtcaatggtgcatctccagtcgatttggaacaaccaagagctctatacgaaaaggtgtacaacgacaaggataagaagacattcgtcaaaaacgttgttgcacatgcttctaagatctccaatccggaaattaagactcgtgtgtctcaatacttcggtcttttgaatgaagatttgggtaaacagatcgctgaaggccttgaaatccaatgggagccagtttctttcgaaacatatgcccggagaatcagtatcgccagtgctttctaa

SEQ ID NO: 5387 - protein, 550 aa, Kluyveromyces lactis NRRL Y-1140
MPSEYSSPPVYSTSNGFKYSHHPYGAQYSRPDGPLLLQDNHLIESLARFDRERIPERVVHAKGGGCHIEFELTDSLSDITYAAPYQSPGYKCPGIIRCSTVGGESGAPDTARDPRGFSFKFYTKWGNHDWVFNNTPVFFIRDANKFPHFIHTQKRSPRNHLGQASDTSMYWDYLTQNIESIHQITYMFGDRGTPASWSDMSAYSGHTYKFINAEGKLTYVQIHVLPENGFKTLSLEEANKLAGENPDYNNQLLFEKLEAGERPKFNCYVQTMTPEQAENFRYSINDLTKIWPHKEFPLRKFGTITLTHNVDNYFEEIEQLAFSPSNTCIPGIEPSNDSVLQSRLFSYPDTQRHRLGTNFMQLPVNRPVNMGREACPFAGANFQRDGPMCMFNFKDQPNYIASSGKNLVQFNTLDDNNAKSTHERFTGVVLEEDVVAEIKRQEENRVEHERVVNGKINEYYIVNGASPVDLEQPRALYEKVYNDKDKKTFVKNVVAHASKISNPEIKTRVSQYFGLLNEDLGKQIAEGLEIQWEPVSFETYARRISIASAF

SEQ ID NO: 5388 - DNA, 1674 bp, Debaryomyces hansenii CBS767
  CDS (1)..(1674)
atggtttctgaatacattcaaaatacgaagaaagatccagcagtgtactcaacctccaatggagttccttatgccaatcatccatatggtgcccaaacggcaggccctggcgggccactattattgcaagattttaatttgatggacgacatttctcacttcgatcatgaaagaatcccagaaagagttgttcacgcaaaaggtggtggtgctcacggatatttcgaattgactgattcattgtctgatttaacttatgcccgtccattacaatccccaggctataaatgtcctgtatcagttagattctctacagttggaggtgaaaggggtacaccggacacaataagagatccaagggggttctcaattaaattgaaaactgacattggtaatatggattgggtttttaacaatacaccaatcttctttattagagacccgattaagttctccaaatttattcacacccaaaagagagatccatctacaaaccttaatcaattaactgatccataccatacttgggactactttattcagaatcctgaatgcttacatcaaataacttacatgtttggtaaaaggggtattccaaagagttgggccgaaatgcacggatattcgggtcatacatttaaactaattaacgataaagatgaaattacttatattcagatccattgtcttgctgatggaggttttgacggctttagtgacaaagaaggtaaagagttggctggttcatcacctgaatacaacactaaggatttatatgaaagaattgctgctggtaattatccatcatattcattttatgttcaaacgatgacacctaaacaagctgaagaatttcgttattctatcaatgatttaacaaaagtatggcctcacaaagaattcccattaagaaagtttggccgcatggttttagataagaatccggtaaattaccacgatgaaattgaacaaattgccttttcacctgctcatttagttcccggaattgagccttcaaatgatcctgttttacaatctaggttatactcttactctgatacacatcgtcatagattaggcgccaattaccaacagttaccggttaacaaaccaaggacatttgatagtaattctggatgtccatttttagcaggtaattttcaaagagaagggattgcatctattgataatcaaggatctagacctaattatttgagttcgttattacctattaattctgtctcgaacgatccaaagtcatacaagaatggattaccacctgttgaagaaaaaaagtatttaggtgttgttccgaaacgatctactgataaatatgaaattttacagaaagaacgtaatttgaaggcacatgaagaaaaaatttggctcaaatcgtatgactatatttctggatttagtgagctagatgttgaacagccaagagccctttataaaaatattattagtaagcaagataaaggggatttcatagaagctattgttggacatgcatcgaaaataagtgttcctcaaataaaagaaagagtacctcagttatggggtttgatagacggggatttaggaagtgaagttgctaaaggtttaggagtaagttacaagcatcttactgttgacgaatatatcgaagatcttggaatagctcctgctaactaa

SEQ ID NO: 5389 - protein, 557 aa, Debaryomyces hansenii CBS767
MVSEYIQNTKKDPAVYSTSNGVPYANHPYGAQTAGPGGPLLLQDFNLMDDISHFDHERIPERVVHAKGGGAHGYFELTDSLSDLTYARPLQSPGYKCPVSVRFSTVGGERGTPDTIRDPRGFSIKLKTDIGNMDWVFNNTPIFFIRDPIKFSKFIHTQKRDPSTNLNQLTDPYHTWDYFIQNPECLHQITYMFGKRGIPKSWAEMHGYSGHTFKLINDKDEITYIQIHCLADGGFDGFSDKEGKELAGSSPEYNTKDLYERIAAGNYPSYSFYVQTMTPKQAEEFRYSINDLTKVWPHKEFPLRKFGRMVLDKNPVNYHDEIEQIAFSPAHLVPGIEPSNDPVLQSRLYSYSDTHRHRLGANYQQLPVNKPRTFDSNSGCPFLAGNFQREGIASIDNQGSRPNYLSSLLPINSVSNDPKSYKNGLPPVEEKKYLGVVPKRSTDKYEILQKERNLKAHEEKIWLKSYDYISGFSELDVEQPRALYKNIISKQDKGDFIEAIVGHASKISVPQIKERVPQLWGLIDGDLGSEVAKGLGVSYKHLTVDEYIEDLGIAPAN

SEQ ID NO: 5390 - DNA, 1458 bp, Debaryomyces hansenii CBS767
  CDS (1)..(1458)
atggctcctgtttacactaactccaacggatgtccaatcccagaaccatttgctactcaaagagttggccaacatggtccattattattgcaagatttcaatcttattgattctttagcacacttcgacagagaaagaatcccagaaagagttgtgcacgccaagggatctggtgcttacggttactttgaagtgactgacgatattagtgatgtttgtagtgctgcatttttggatactattggtaaaaagaccaaggttttaaccagattctccaccgttggtggtgaatctggttctgctgacagtgctagagatccaagaggattttctactaagttgtataccgaggaaggtaacttggatttagtgtacaacaacaccccagttttcttcattagggacccatccaagttccctcacttcatccatacccaaaagagaaacccagaaactcacttgaaggacccaaccatgttctgggactacttgacttctaatcaagaatccatccaccaagttatgactcttttctccgaccgtggtactccagctagttacagagaaatgaacggttactctggtcacacttacaagtggtccaacaagaagggtgaatggtactacgtccaagtccacttcatctccgatcaaggtgtcaaaaccttgaccaacgaagaagcaggcgaattggcaggttccaatccagattttgctcaagaagacttgttcaaagaaattgccaagggtaatgcgccatcctggacttgttacatccaaaccatgactcaagaacaagctaagaaggcaccattctccgtcttcgacttaaccaaggtctggccacataaggattacccaatgagaagattcggtaaattagtcttgaacgaaaacccaaagaactactttgccgaaattgagcaagctgcatttgcacctgctcacaccgttccttacatggaagcttctgctgatccagtcttgcaatcaagattattctcttacgctgatacacacagacacagattaggtaccaattacacccaaattcctgttaactgtccaatcactggtcgtgttttcaatccacatatgagggatggtggtatgaatgttaacggtaacttaggatcacatccaaactatttagccacttccaaaccagttgaattcaagaattttagcatacaagaagaacaagaagtttgggaaggggctgcttgtccattccactggaaatgtactgacaaggattactcccaagctactgctttatacaatgttttagctaagtatccaaaccaacaaaagaacttagctcacaacgttgctgttcatgtttctggcgctgaaactcatatccaagacaaggtctttgatatgttcgcaaaggtccacccagaattatccgccaacattaagaaggaagctttacaactttctccaagaaagtaa

SEQ ID NO: 5391 - protein, 485 aa, Debaryomyces hansenii CBS767
MAPVYTNSNGCPIPEPFATQRVGQHGPLLLQDFNLIDSLAHFDRERIPERVVHAKGSGAYGYFEVTDDISDVCSAAFLDTIGKKTKVLTRFSTVGGESGSADSARDPRGFSTKLYTEEGNLDLVYNNTPVFFIRDPSKFPHFIHTQKRNPETHLKDPTMFWDYLTSNQESIHQVMTLFSDRGTPASYREMNGYSGHTYKWSNKKGEWYYVQVHFISDQGVKTLTNEEAGELAGSNPDFAQEDLFKEIAKGNAPSWTCYIQTMTQEQAKKAPFSVFDLTKVWPHKDYPMRRFGKLVLNENPKNYFAEIEQAAFAPAHTVPYMEASADPVLQSRLFSYADTHRHRLGTNYTQIPVNCPITGRVFNPHMRDGGMNVNGNLGSHPNYLATSKPVEFKNFSIQEEQEVWEGAACPFHWKCTDKDYSQATALYNVLAKYPNQQKNLAHNVAVHVSGAETHIQDKVFDMFAKVHPELSANIKKEALQLSPRK

SEQ ID NO: 5392 - DNA, 1599 bp, Yarrowia lipolytica CLIB122
  CDS (1)..(1599)
atgtccaaagaactctacgccaactccaaggacgacgctgtctactcctactcctttggagttccttacccccaccatccctactcatctcagcgggccggccctaccggccctctgctgctccaggacacctatctgattgacgctctggcccatttcgaccgagagcgaatccccgagcgagtcgtccatgccaacggaggaggagcccatggctactttgaggtgaccgatgacatctccgacatcacatacgccgagcccttccagaagattggctacaaatgccccaccaccgtgcgattttctaccgttggtggtgagcgaggctctcccgacactgctcgagacccccgaggtttcgctgtcaagcacaagaccgactggggtaactgggacatggttggtctcaactctcctgttttcttcattcgagatcctgtcaagttcatccatgtcaaccactctcagaagcgagacccccagaccaacctgactgccggagatgatgcctctaactactggaactatctggtccagaaccccgagtctctgcatcaggtggtgtacatgtttggagaccgaggtacccccaatggatggcgacacatgaactgcttctccactcatacttacaagatgatcaacaaggagggcaagctgacctacgtccagttccactacaagtccgaccagggagtcaagaacttcaccggacccgaggctgctgagatggctggaaagagcccggaccacgaccagaaggatctcttctttgccatcgataacggagactacccctcctggaccgtttcccttcagaccatgactcccgagcaggccgaggaatgggaatactccattctggatatgaccaagacctggccctatgacaagttccctctgcgaaaggtcggaaagctggtgctcaacaagaacgccgagaacttctttgaggagattgagcaggccgccttctctccctccaacctgatccacggtatcgaagcctctgatgatcctgttctccaggcccgactcttctcttaccccgatactgctcgacatcgactgggtcccaacttcaaccagctgcctgtcaaccaggcccgaaccttccaaaagggatctggctgcccattcatggccggaaacttccagcgagacggaaacatggccatccacaaccagggcaaccgacccaactacctgtcgacgatccgacccatccagtccgtgtccgtacccaacgaggacttcaagaacactcacgattactgcggagtggtcaccaaggagatggaggacgaatccttcaaggtccaggccgaggctgccaagaagcacaacgagaagatctgggagagctcgtcatacctgtacttgtctggtttccaggagagcgatgcagcccaaccccgagacctgtacgagagagtgtacgacgatgctgccaagcagcgaatgattgacaacgttgttgaccatgcctccaccatcaagcagcacggtctcaaggagcaggtcgccaagtactttggccgaatcagcgacgatcttggcaagaagatcgccgagggtcttggtgttccttactaa

SEQ ID NO: 5393 - protein, 532 aa, Yarrowia lipolytica CLIB122
MSKELYANSKDDAVYSYSFGVPYPHHPYSSQRAGPTGPLLLQDTYLIDALAHFDRERIPERVVHANGGGAHGYFEVTDDISDITYAEPFQKIGYKCPTTVRFSTVGGERGSPDTARDPRGFAVKHKTDWGNWDMVGLNSPVFFIRDPVKFIHVNHSQKRDPQTNLTAGDDASNYWNYLVQNPESLHQVVYMFGDRGTPNGWRHMNCFSTHTYKMINKEGKLTYVQFHYKSDQGVKNFTGPEAAEMAGKSPDHDQKDLFFAIDNGDYPSWTVSLQTMTPEQAEEWEYSILDMTKTWPYDKFPLRKVGKLVLNKNAENFFEEIEQAAFSPSNLIHGIEASDDPVLQARLFSYPDTARHRLGPNFNQLPVNQARTFQKGSGCPFMAGNFQRDGNMAIHNQGNRPNYLSTIRPIQSVSVPNEDFKNTHDYCGVVTKEMEDESFKVQAEAAKKHNEKIWESSSYLYLSGFQESDAAQPRDLYERVYDDAAKQRMIDNVVDHASTIKQHGLKEQVAKYFGRISDDLGKKIAEGLGVPY

SEQ ID NO: 5394 - DNA, 1599 bp, Yarrowia lipolytica CLIB122
  CDS (1)..(1599)
atgtccaaagaactctacgccaattccaaagacgacgccgtctactccacctccttcggagtccccttcccccaccacccctactctgctcagcgagctggtcctaccgggcctttgctgctccaggacacctatctaattgacgctctggcccatttcgaccgagagcgaattcccgagcgagttgtccatgcaaagggaggaggagcccacggctacttcgaggtcaccgatgatctgtctgacatcacctacgctgagcccttccagaaggccggctacaagtgtcccgtgacggtacgattctcaactgttggaggtgagcgaggctctgctgactcagctcgagacccccgaggcttctccatcaagcatcgaaccgactggggtaactgggacatggtggccaacaacacccccatcttcttcatccgagaccccatcaagttcccccacttcatccacacccagaagcgagatcctcagaccaacctgggtgctggaccggacgcttctcacttctggaactacctgacccagaaccccgagtctctccaccagatcacctacatgtttggagatcgaggcactcctgatggatggagacacatgaacggctactctggccacaccttcaagttcatcagcaaggagggtaagatcacctacactcagttccactacatcaccgaccagggtgtcaagaacctgtctgccgagaaggccggtgagcttgcaggtgccaaccctgattcctctcagcaggacctgtttgaggccatcgacaacggggattacccctcgtggacggtctacgtgcagaccatgactcccgagcaggccgaaaagttccggtactccattctggatcttaccaaggtttggtctcacaaggaattccctctgcgaaaggtcggcaagtttgtgctcaacaagaacgccgacaactactttgaggagattgagcaggtagcattctctccttccaacctgcccaacggtctggaggcctctgctgaccctgttctgcagtctcgactcttctcctaccccgatactcatcgacaccgactgggtcccaacttcaaccagttgcccgtcaaccagcctcgaaccttccagaaggggtctggatgtcccttcctggccggaaacttccagcgagacggaaacatggccatcaacaaccagggcaaccgacccaactacctgtcgaccatccgacccatccaatcggtttctgtgcctgacgaggacttcaagagtactcacaactacactggagtggtcaccaagaagatggaggacgagtccttgtctgtgcagaccgaggaggccaagaagcacgatgagaagatctgggagggcgcttcttacatctacgtgtctggaatccaggacattgatgcggagcagccccgagctctgtacgagaaggtatacgacgatgctgccaaggctcggttcattgagaacgtggttggtcatgcttcatcgatcaagcagcccggacttaaggagcaggttgccaagtactttggccagatcaacgacgatctcggacaaaaggtggctaagggtctgggtgtgagttattag

SEQ ID NO: 5395 - protein, 532 aa, Yarrowia lipolytica CLIB122
MSKELYANSKDDAVYSTSFGVPFPHHPYSAQRAGPTGPLLLQDTYLIDALAHFDRERIPERVVHAKGGGAHGYFEVTDDLSDITYAEPFQKAGYKCPVTVRFSTVGGERGSADSARDPRGFSIKHRTDWGNWDMVANNTPIFFIRDPIKFPHFIHTQKRDPQTNLGAGPDASHFWNYLTQNPESLHQITYMFGDRGTPDGWRHMNGYSGHTFKFISKEGKITYTQFHYITDQGVKNLSAEKAGELAGANPDSSQQDLFEAIDNGDYPSWTVYVQTMTPEQAEKFRYSILDLTKVWSHKEFPLRKVGKFVLNKNADNYFEEIEQVAFSPSNLPNGLEASADPVLQSRLFSYPDTHRHRLGPNFNQLPVNQPRTFQKGSGCPFLAGNFQRDGNMAINNQGNRPNYLSTIRPIQSVSVPDEDFKSTHNYTGVVTKKMEDESLSVQTEEAKKHDEKIWEGASYIYVSGIQDIDAEQPRALYEKVYDDAAKARFIENVVGHASSIKQPGLKEQVAKYFGQINDDLGQKVAKGLGVSY

SEQ ID NO: 5396 - DNA, 1479 bp, Yarrowia lipolytica CLIB122
  CDS (1)..(1479)
atgtctggaaaacgagtccccacttacaccaccactaacggtaaccccgtcaaggaccccctcgcctcccagcgaatcggcaagcacggacctctcctgctccaggactttgccctgatcgacctgctcgcccacttcgaccgagagcgaatccccgagcgagttgtccacgctaagggatccggtgcttacggagagttcgaggtcactgacgatatcaccgacctcaactgcgccgatttcttgtccaagatcggtaagaagaccaagaccttcactcgattctccaccgttggaggagagaagggatccgccgatgctgctcgagacccccgaggtttcgccaccaagttctacaccgacgagggaaacattgactgggtctacaacaacacccccgtctttttcatcagagacccctccaagttccccgttttcatccacactcagaagcgaaaccccgagaccaacctcaaggacgccactatgatgtgggactacattgccaacaaccaggagtgttgccaccagatcatggtcctcttctccgaccgaggtactcccgctaactaccgacagatgaacggttactccggccacacctacaagtggatcaagaaggatggctctttcaactacgtccagatccacatgaagaccgaccagggcatcaagaacctcaccaatgacgaggctgtcgctctctccggaaccaaccccgaccacgcccaggaagacctcttcaactccatcaagagtggctctttcccctcttggacttgttacgtccaggtctgcacccccgagcaggctgagaagctcaagtggtccgtctttgacctcaccaaggtctggcctcacgaccagttccctctcagacgattcggtaagctcactcttaacaagaacgtccagaactacttcgctgagaccgagcaggctgccttctctccctccaacaccgtccccggctgggagacctcggccgatcccgtcctgcagtctcgactcttctcttatcccgatactcagcgacaccgactcggtaccaacttcgcccagatccccgtcaactgtccctaccatgcccatactccttaccaccgagatggtcagatggctgttaacggcaactccggctctctgcccaactacccctcttctttcgagcccctgcagtaccgacaggacatcaacctgcatgagaagcacgagaagtgggttggtgaggccgtcgcctaccagtgggttgtcggcaccgacggtgttgacttccagcagcccgctgagctctggaaggttcttggaaagaccccagaccagcaggaacaccttgtttacaacatcgctgtctctctgtccggtgctcgacccgaggtccaggacaagacctttggcatgttcgacaaggtcgatgctcacttcggtaagctcgtccgagacgctactcttcagcgatctcctcgatccaagctttaa

SEQ ID NO: 5397 - protein, 492 aa, Yarrowia lipolytica CLIB122
MSGKRVPTYTTTNGNPVKDPLASQRIGKHGPLLLQDFALIDLLAHFDRERIPERVVHAKGSGAYGEFEVTDDITDLNCADFLSKIGKKTKTFTRFSTVGGEKGSADAARDPRGFATKFYTDEGNIDWVYNNTPVFFIRDPSKFPVFIHTQKRNPETNLKDATMMWDYIANNQECCHQIMVLFSDRGTPANYRQMNGYSGHTYKWIKKDGSFNYVQIHMKTDQGIKNLTNDEAVALSGTNPDHAQEDLFNSIKSGSFPSWTCYVQVCTPEQAEKLKWSVFDLTKVWPHDQFPLRRFGKLTLNKNVQNYFAETEQAAFSPSNTVPGWETSADPVLQSRLFSYPDTQRHRLGTNFAQIPVNCPYHAHTPYHRDGQMAVNGNSGSLPNYPSSFEPLQYRQDINLHEKHEKWVGEAVAYQWVVGTDGVDFQQPAELWKVLGKTPDQQEHLVYNIAVSLSGARPEVQDKTFGMFDKVDAHFGKLVRDATLQRSPRSKL

SEQ ID NO: 5398 - DNA, 1506 bp, Aspergillus nidulans FGSC A4
  CDS (1)..(1506)
atgggccaaaacgacgaccaaaagacgtaccgctacaatgaaagcccggtttataccacttccaatggctgtcctgtgatggacccgcaagcttcgcagcgagtagggcccaacggacctctcctcctgcaagacttcaaccttatcgaccttctcgcccactttgaccgtgagcgcattcccgagcgagtggtccatgccaagggtgcaggcgcctacggcgagttcgaagtcaccgacgacatcagcgatatcaccgtcatcgacatgctcaagggcgtcggcaagaagactaaaacctttgtccggttctcaaccgttggaggcgaaaagggctcccctgacagtgcccgcgaccctcgaggctttgcctgcaagttctatactgaggagggcaactgggactgggtcttcaacaacacccccgtcttcttcctccgtgaccctagcaaattccccatgttcatccacacccagaagcgtaatccacagacaaacctgaaagacgccaccatgttctgggactacctttccacccaccaggaggccgttcaccaggtcatgcacctcttttcagaccgcggcactccctactcctaccgtcacatgaacggctactccggtcacacctacaaatggatcaagcccgatggcactttcaactatgtccagctgcacctcaaaacagaccagggcaacaagacgttcacggacgccgaggccacgcgcctggccgccgagaaccctgactggcacactcaggacctcttcaatgccattgcccgcggcgaatacccctcatggacctgctatgttcagaccctgtcaccagagcaagccgagaagttccgctggaacattttcgacctgaccaaggtctggccgcaatccgaagttcccctccgccgcttcggccgcttcacccttaacaagaatcccgagaactacttcgccgaagttgagcaagccgccttctctccctcccaccttgtccccggcgtcgagccctccgccgatcccgtcctccaagcccgcctcttctcttacccggacacccaccgtcaccgcctcggcacgtcgaactatcaatccattcccgtcaactgccccctgcgcgcattcacgcccttccaccgcgacggcgcaatgagcgtgaatggcaaccatggcgcgaatcccaactacccatcgaccttccggccgctgcagtacaagcccgttaaggcgtcccaggagcacgagaagtgggctggctcggtagtaaccgagcagctgcctgttactgatgaggactttgttcaggccaatgggctctggaaagtccttggtcgccagccgggacagcaggagaattttgtgggtaatgttgcgggacacctctgcaatgctcaccctagggtccgccaggcgacatatggcatgttccgccgtgtgaatgctgaccttgggaagaggattgaaaaagccactgagaaaaaagctactgaggccagggctcgtttgtag

SEQ ID NO: 5399 - protein, 501 aa, Aspergillus nidulans FGSC A4
MGQNDDQKTYRYNESPVYTTSNGCPVMDPQASQRVGPNGPLLLQDFNLIDLLAHFDRERIPERVVHAKGAGAYGEFEVTDDISDITVIDMLKGVGKKTKTFVRFSTVGGEKGSPDSARDPRGFACKFYTEEGNWDWVFNNTPVFFLRDPSKFPMFIHTQKRNPQTNLKDATMFWDYLSTHQEAVHQVMHLFSDRGTPYSYRHMNGYSGHTYKWIKPDGTFNYVQLHLKTDQGNKTFTDAEATRLAAENPDWHTQDLFNAIARGEYPSWTCYVQTLSPEQAEKFRWNIFDLTKVWPQSEVPLRRFGRFTLNKNPENYFAEVEQAAFSPSHLVPGVEPSADPVLQARLFSYPDTHRHRLGTSNYQSIPVNCPLRAFTPFHRDGAMSVNGNHGANPNYPSTFRPLQYKPVKASQEHEKWAGSVVTEQLPVTDEDFVQANGLWKVLGRQPGQQENFVGNVAGHLCNAHPRVRQATYGMFRRVNADLGKRIEKATEKKATEARARL

SEQ ID NO: 5400 - DNA, 1458 bp, Candida albicans SC5314
  CDS (1)..(1458): transl_table=12
atggctccaacatttacgaattctaacggtcaaccaattccagaaccatttgccactcaaagagttggtcaacacggtccattgttgttacaagatttcaacttgattgattcattggcccatttcgatagagaaagaatcccagaaagagttgtccacgctaaaggttccggtgcttatggtgtttttgaagtcactgacgatatcactgatatttgtgctgccaaattcttggacactgttggtaagaaaactagaatcttcaccagattctctactgttggtggtgaattaggttctgctgatactgctagagatccaagaggttttgctaccaaattttacactgaagaaggtaacttggatttggtttacaacaacactccagtgtttttcattagagacccatctaaattcccacatttcatccacacccaaaagagaaacccagaaactcacttgaaggatgctaacatgttttgggattacttgactagcaatgaagaatccattcatcaagttatggttttattctccgacagaggtactccagcttcttacagagaaatgaatggttactctggtcacacttataaatggtccaacaaaaaaggtgaatggttttacgttcaagttcatttcatcagtgaccaaggtattaagactttgaccaacgaagaagctggtgctttagctggatctaacccagattacgcccaagaagatttgttcaagaacattgctgctggtaactacccatcatggactgcttacattcaaaccatgactgaagccgaagctaaagaagctgaattttctgtgtttgatttgaccaaagtttggccacacaagaaatacccattgagaagatttggtaagttcactttgaatgaaaacccaaagaactactttgctgaagttgaacaagctgctttctctccagcccacactgttccttacatggaaccatctgctgatccagtcttgcaatcaagattgttctcctatgctgatactcacagacacagattgggtaccaactatactcaaatcccagtgaactgtcctgtcaccggtgctgttttcaacccacatatgagagatggtgctatgactgttaatggtaacttgggtagccatccaaactacttggccagtgataagccagttgaattcaaacaattttctcttcaagaagaccaagaagtttggaatggtgctgccactccattccactggaaagccaccccagctgatttcaaacaagctcaagaattgtggaaagtgttgaagagatatccaaaccaacaagaacatttggcccacaacattgctgtacatgctgctggtgctgatgctgctatccaagacagagtgtttgcatactttggtaaagtctctcaagacttggctgatgctatcaaaaaggaagttttggaattatctccaagaaaataa

SEQ ID NO: 5401 - protein, 485 aa, Candida albicans SC5314
MAPTFTNSNGQPIPEPFATQRVGQHGPLLLQDFNLIDSLAHFDRERIPERVVHAKGSGAYGVFEVTDDITDICAAKFLDTVGKKTRIFTRFSTVGGELGSADTARDPRGFATKFYTEEGNLDLVYNNTPVFFIRDPSKFPHFIHTQKRNPETHLKDANMFWDYLTSNEESIHQVMVLFSDRGTPASYREMNGYSGHTYKWSNKKGEWFYVQVHFISDQGIKTLTNEEAGALAGSNPDYAQEDLFKNIAAGNYPSWTAYIQTMTEAEAKEAEFSVFDLTKVWPHKKYPLRRFGKFTLNENPKNYFAEVEQAAFSPAHTVPYMEPSADPVLQSRLFSYADTHRHRLGTNYTQIPVNCPVTGAVFNPHMRDGAMTVNGNLGSHPNYLASDKPVEFKQFSLQEDQEVWNGAATPFHWKATPADFKQAQELWKVLKRYPNQQEHLAHNIAVHAAGADAAIQDRVFAYFGKVSQDLADAIKKEVLELSPRK

SEQ ID NO: 5402 - DNA, 1521 bp, Acinetobacter sp. ADP1
  CDS (1)..(1521): transl_table=11
atgagtgacgataagttaaagtgtccagtcacccaccttacgactgatgcaggcgcgcctgttgtagacaatcagaacagtatgacggcaggtgcacgtggtccacttctgacccaagatctctggctcaatgagaaaatggctaattttgcacgtgaagttattccagaacgtcgtatgcatgccaaagggtcaggagcatttggtacttttacggtaacccacgatattacacagtattcccgtgccaaaatattcagtgaaattgggaaaaaaactgaaatgtttgcccgcttttcaacggtcgcaggtgaacgtggtgctgccgatgcagaacgtgatattcgcggttttgccctcaagttttataccgaagaaggtaactgggacatggtgggaaacaatacgcctgtgttctttatgcgtgatccacgtaagttcccagatcttaacaaagcagtaaaacgcgacccaaaaactaatttacgtagtgccacctataactgggatttctggacgctactgcctgaagcactgcatcaggtcacaattgtgatgtcagatcgtggtattccagatggatatcgccatatgcatggttttggtagccatacttatagcttcatcaatgccagcaatgagcgcttttgggtaaaattccatttccgcacccagcaaggtattaagaatttaactgatgctgaagctgaagcgattgttgccaaagaccgtgaaagtagccaaagcgatttgttcaatgcgattgaacaaggtaactatccaaaatggaccatgttcgttcaaatcatgccagaaactgatgcggaaaaagtaccctatcatccatttgacctcactaaagtctggccgcatggggattacccactgatcgaagtcggtgaatttgaactaaatcgtaatgctgaaaattattttcaggatgttgagcaagcgacatttgcaccaagtaatctagttccagggattagctactctccagaccgcatgttacaagcacgtttggtgaactatgccgatgcacaccgctatcgtgttggtgtaaatcacactcaaattccagtaaatgcgccgcgttgtccagtgcatagtaaccgccgtgacggacaaggccgtatggatggtaactatggtggtttaccacactacgaaccgaacagtttccatcaatggcaagaacagcctgagtttcgtgaaccgcctttaaaaattacgggcgatgcagatttctgggatttccgtcaagatgacagcgactattttagccagccccgtgctttgtttaatttgatgaatgatgagcaaaaacaggcattatttggtaatacggcacgtgcgatgggtgatgcgctcgacttcattaaatatcgccacatccgtaattgctacgcctgtgatcctgcctatggagaaggtgttgctcaggcactcggcatgacggttgcagatgctcaagcagcccgtgacagtgatcctgctaaaggtcatcctggtttcttataa

SEQ ID NO: 5403 - protein, 506 aa, Acinetobacter sp. ADP1
MSDDKLKCPVTHLTTDAGAPVVDNQNSMTAGARGPLLTQDLWLNEKMANFAREVIPERRMHAKGSGAFGTFTVTHDITQYSRAKIFSEIGKKTEMFARFSTVAGERGAADAERDIRGFALKFYTEEGNWDMVGNNTPVFFMRDPRKFPDLNKAVKRDPKTNLRSATYNWDFWTLLPEALHQVTIVMSDRGIPDGYRHMHGFGSHTYSFINASNERFWVKFHFRTQQGIKNLTDAEAEAIVAKDRESSQSDLFNAIEQGNYPKWTMFVQIMPETDAEKVPYHPFDLTKVWPHGDYPLIEVGEFELNRNAENYFQDVEQATFAPSNLVPGISYSPDRMLQARLVNYADAHRYRVGVNHTQIPVNAPRCPVHSNRRDGQGRMDGNYGGLPHYEPNSFHQWQEQPEFREPPLKITGDADFWDFRQDDSDYFSQPRALFNLMNDEQKQALFGNTARAMGDALDFIKYRHIRNCYACDPAYGEGVAQALGMTVADAQAARDSDPAKGHPGFL

SEQ ID NO: 5404 - DNA, 1458 bp, Bacillus licheniformis ATCC 14580
  CDS (1)..(1458): transl_table=11
atgacgacaaataaaaacaacctaacaaccagctggggcgctccagttggagacaaccaaaactcaatgacagctggttcacgcggaccgacgctgattcaggacgtccacttgctcgaaaagctcgcccacttcaatagagagcgtgtgcctgaacgggttgtgcatgcaaaaggcgccggtgcgcacggttattttgaagtcacaaatgacgtttccaaatatacaaaagccaaatttttatcagaagtcggaaaacgcacgccgttatttgtccgtttttcaactgttgccggcgaaaacggttcagccgattccgtccgcgacccgcgcggtttcgctgttaaattttatacagaggaagggaactatgatctcgttggaaacaatacacctgttttctttatccgcgatgcgattaaattccctgacttcattcatacacaaaagcgccatccggtcacacatttgaaaaacccggatgccgtatgggatttttggtcattgtctcctgaatccctgcaccaggtaaccatcctgatgtctgacaggggcatccctgcgacttaccggcacatgcacggcttcggctcccacacattcaaatgggtgaatgccgaaggagaaggcgtctggatcaaataccacttcaaaacagaacaaggcattaaaaacctgaccgaagaagtggggacaaagattgcaggtgaaaaccccgattatcacacacaggacttgtatgaggcgattgaaaaaggcgacttcccggcatggaagctgtacgttcaaataatgccgctggaggatgcggatacgtaccgttttgatccgttcgatgtgacaaaagtatggtcgcaaaaagattatccgctgattgaagtcggccgcatggttctaaaccggaatccggaaaactatttcgcagaggttgaacaagctacattctcccctggaacattggtgcccggcattgaaccgtctcccgacaaaatgcttcagggacgcctgttcgcatatgcggatgcacaccgctaccgcgtcggcgcaaaccataacagcctgccgatcaaccgtccgaaagcggaagttcataattatcaaagagacggacaaatgcgctttgattcaaacggcggcggctctgtctactatgagccgaacagcttcggaggccctcaggaaactccggaaaacaaaacaacggcttatccggtgtcaggttcggcggacagcacggcctacgaccataacgaccactatacacaggccggagatctttaccgcctcttgagcgaagaagagcggacccgccttgtcagcaatatcgtaggttcgatgaagcaggtgacaaaagacgaaattaagcttcgtcaaattcagcatttctataaagcagatccggagtacggcacacgagttgccgaaggattgggcttgtctgttccgcaggaagtttaa

SEQ ID NO: 5405 - protein, 485 aa, Bacillus licheniformis ATCC 14580
MTTNKNNLTTSWGAPVGDNQNSMTAGSRGPTLIQDVHLLEKLAHFNRERVPERVVHAKGAGAHGYFEVTNDVSKYTKAKFLSEVGKRTPLFVRFSTVAGENGSADSVRDPRGFAVKFYTEEGNYDLVGNNTPVFFIRDAIKFPDFIHTQKRHPVTHLKNPDAVWDFWSLSPESLHQVTILMSDRGIPATYRHMHGFGSHTFKWVNAEGEGVWIKYHFKTEQGIKNLTEEVGTKIAGENPDYHTQDLYEAIEKGDFPAWKLYVQIMPLEDADTYRFDPFDVTKVWSQKDYPLIEVGRMVLNRNPENYFAEVEQATFSPGTLVPGIEPSPDKMLQGRLFAYADAHRYRVGANHNSLPINRPKAEVHNYQRDGQMRFDSNGGGSVYYEPNSFGGPQETPENKTTAYPVSGSADSTAYDHNDHYTQAGDLYRLLSEEERTRLVSNIVGSMKQVTKDEIKLRQIQHFYKADPEYGTRVAEGLGLSVPQEV

SEQ ID NO: 5406 - DNA, 1425 bp, Campylobacter jejuni RM1221
  CDS (1)..(1425): transl_table=11
atgaaaaaattaactaacgattttggaaacattatagccgataaccaaaattcattaagtgcaggcgcaaaaggacctttgcttatgcaagattatcttttgcttgaaaaacttgctcatcaaaatagagaaagaattccagaaagaaccgttcatgccaagggaagtggggcttatggagaaataaaaatcaccgctgatttatctgcttatactaaggcaaaaatatttcaaaaaggagaaataactcctcttttcctacgcttttctactgttgcaggtgaagcaggtgcagcagatgctgagcgtgatgtgagaggttttgccattaaattttacaccaaagaaggaaactgggatttagtaggaaataatactccaactttttttatccgtgatgcgtataaatttcctgatttcattcatactcaaaaaagagatccaagaactcatctaagaagtaataatgctgcttgggatttttggagtttatgtcctgaaagtttacatcaagtaaccattcttatgagcgatagaggaattcctgcaagttatcgtcatatgcatggatttggaagccatacttatagttttattaatgataaaaatgaaagattttgggtgaaattccattttaaaacccaacaagggattaaaaatcttaccaaccaagaagctgccgagcttatagcaaaagatagagaaagtcatcaaagagatctctataatgctatagaaaataaagattttccaaaatggaaagttcaagttcaaattcttgctgaaaaagatatagaaaaacttggatttaatccttttgatttaacaaaaatttggcctcatagtcttgtgcctttgatggatataggcgaaatgattctaaacaaaaatcctcaaaattattttaatgaagttgaacaagctgcctttagtccaagcaatatcgttcctggaattggctttagccctgataaaatgttgcaagctagaattttttcatatcctgatgcacaaagatatagaataggaactaattatcatcttttaccagtaaatcgtgcaaaaagcgaagtgaatacttacaatgtcgctggtgctatgaattttgatagttataaaaatgatgctgcttattatgaaccaaacagctatgataatagcccaaaagaagacaaaagctatcttgaacctgatttagtcttagaaggcgtagcacaaagatatactccactagataatgacttttatactcaaccaagagctttatttaatcttatgaatgatgatcaaaaaactcaactttttcataatatcgccgcttctatggagggagttgatgaaaaaattatcactagagctttagaacattttgaaaaaatttcacctgattatgcaaaaggaattaaaaaagctttagaaaaataa

SEQ ID NO: 5407 - protein, 474 aa, Campylobacter jejuni RM1221
MKKLTNDFGNIIADNQNSLSAGAKGPLLMQDYLLLEKLAHQNRERIPERTVHAKGSGAYGEIKITADLSAYTKAKIFQKGEITPLFLRFSTVAGEAGAADAERDVRGFAIKFYTKEGNWDLVGNNTPTFFIRDAYKFPDFIHTQKRDPRTHLRSNNAAWDFWSLCPESLHQVTILMSDRGIPASYRHMHGFGSHTYSFINDKNERFWVKFHFKTQQGIKNLTNQEAAELIAKDRESHQRDLYNAIENKDFPKWKVQVQILAEKDIEKLGFNPFDLTKIWPHSLVPLMDIGEMILNKNPQNYFNEVEQAAFSPSNIVPGIGFSPDKMLQARIFSYPDAQRYRIGTNYHLLPVNRAKSEVNTYNVAGAMNFDSYKNDAAYYEPNSYDNSPKEDKSYLEPDLVLEGVAQRYTPLDNDFYTQPRALFNLMNDDQKTQLFHNIAASMEGVDEKIITRALEHFEKISPDYAKGIKKALEK

SEQ ID NO: 5408 - DNA, 1515 bp, Neisseria gonorrhoeae FA 1090
  CDS (1)..(1515): transl_table=11
atgactacctccaaatgccccgtaacccatctgaccatgaacaacggcgcgcccgttgccgacaatcaaaacagcctgaccgccggcccgcgcggccccctgctgacgcaagatttgtggctgaatgaaaaactcgccgacttcgtgcgcgaagtcatccccgaacgccgtatgcacgccaaaggttcgggcgcgttcggtacgtttaccgtaacacacgacatcaccaaatacacccgcgccaaaattttcagcgaagtcggcaaaaaaaccgagatgttcgcccgtttcaccaccgtggcaggcgagcgcggcgcagccgatgcggaacgcgacatccgcggttttgcgttgaaattctataccgaagaaggcaactgggatgtggtcggcaacaacacgcccgtgttcttcctgcgcgacccgcgcaaattccccgacctgaacaaagccgtcaaacgcgatccgcgcaccaatatgcgttccgccacaaacaactgggacttctggacgctgctgcccgaagccctgcaccaagttaccatcgtgatgagcgaccgcggtattcccgccagctaccgccatatgcacggcttcggttcgcatacctacagcttctggaacgaagcgggcgaacgtttttgggtgaaattccatttccgcagccagcaagggattaaaaacctgaccaacgaagaagctgcaaaaatcatcgccgacgaccgcgaaagccatcagcgcgacctgtacgaagccatcgagcgcggcgagttcccgaaatggacgatgtacatccaagtcatgcctgaagccgatgccgaaaaagtgccttatcatccgtttgacttgaccaaagtttggccgaaaaaagactatccgctgattgaagtgggcgaattcgagttgaaccgcaatcccgaaaacttcttcgccgatgtggaacaatccgccttcgcaccgagcaacctcgttcccggtatcggcgcgagcccggataaaatgttgcaagcccgtttgttcaattacgccgacgcgcaacgttaccgcttgggtgtgaacttccgccaaatccccgtcaatcgtccgcgttgccctgttcacagcaaccagcgcgacggacaaggccgcgccgacggcaactacggcagcctgccgcactacgaacccaacagcttcggccaatggcagcaacaacccgacttcgccgaaccgcctttgaaaatcaacggcgacgcggcacactgggactaccgccaagacgatgacgactacttcagccaaccgcgcgccttgttcaacctgatgaacgacgcgcagaaacaggctttgtttgacaacaccgccgcagccatgggcgatgcgcccgacttcatcaaataccgccatatccgcaactgctaccgttgcgacccggcatacggtgaaggcgtagccaaagccctcggactgaccgtcgaagacgcacaagccgtccgcgcgaccgatcccgcactgggtcaggccggtttgctgtaa

SEQ ID NO: 5409 - protein, 504 aa, Neisseria gonorrhoeae FA 1090
MTTSKCPVTHLTMNNGAPVADNQNSLTAGPRGPLLTQDLWLNEKLADFVREVIPERRMHAKGSGAFGTFTVTHDITKYTRAKIFSEVGKKTEMFARFTTVAGERGAADAERDIRGFALKFYTEEGNWDVVGNNTPVFFLRDPRKFPDLNKAVKRDPRTNMRSATNNWDFWTLLPEALHQVTIVMSDRGIPASYRHMHGFGSHTYSFWNEAGERFWVKFHFRSQQGIKNLTNEEAAKIIADDRESHQRDLYEAIERGEFPKWTMYIQVMPEADAEKVPYHPFDLTKVWPKKDYPLIEVGEFELNRNPENFFADVEQSAFAPSNLVPGIGASPDKMLQARLFNYADAQRYRLGVNFRQIPVNRPRCPVHSNQRDGQGRADGNYGSLPHYEPNSFGQWQQQPDFAEPPLKINGDAAHWDYRQDDDDYFSQPRALFNLMNDAQKQALFDNTAAAMGDAPDFIKYRHIRNCYRCDPAYGEGVAKALGLTVEDAQAVRATDPALGQAGLL

SEQ ID NO: 5410 - DNA, 1449 bp, Pseudomonas fluorescens Pf-5
  CDS (1)..(1449): transl_table=11
atgagccagaccaaaactcttactaccgcaagtggcgctcctgtcgctgataaccagaactctcgttccgccggcccccggggccctctgcttctcgacgattttcacctgatcgaaaagctcgcccatttcaaccgcgagaatattcccgagcgtcgcgtgcacgccaagggttcaggcgcctatggcactttcaccgtttctcgtgatatcaccgaatacaccagcgccaagttgtttgaggcggtaggcaagaagactccgaccttcctgcgtttttccacggtaggcggcgagcgtggttcggcagacaccgagcgggacccacgcggctttgccctcaagttctacaccgaagaaggcaactgggacatcgtaggcaacaacaccccggtgttcttcattcgcgacccgctgaagtttcccgactttatccacacccagaagcgcctgccccagagcaatctgaaaagtgcccagatgatgtgggatttctggtcccattcgcccgaggcgctgcaccaggtaaccattctgttttccgatcggggtattccggatggctaccgccacatgcatggctttggcagccacacctacagcctgatcaacgccaagggtgagcggcactgggtcaagtggcactacaagaccaagcagggcatcaagaacctggcgccggctgacgcagcgcgcctggccggtaccgatcctgattacgcccagcgcgacctgttcaatgcgatcgagcgcggtgagtttccgaaatggagcgtgtgcatccaggtcatgaccgaagctcaagccgccgcgcattacgagaaccccttcgatgtgaccaagacctggtcgcagaaagagttcccgttgatcgaagtgggtgagctggaactgaatcgcaacccgttgaattactttgcagaggtcgagcaggctgcattcggccctagcaacatggtacctggggtaggtctttcgccggaccgcatgctgcaaggccgggtattcgcatacgccgacgcgcatcgctaccgtgtgggtaccaaccaccaacagttgccggtgaacgctccattgagcccggtgaacagctaccagcgcgacggctccatggctttcggtagcaatggtggtgcggcgcctaactacgagcccaacagctatggcgatgcgccgaagcaggctccccgttatgccgagccggccctggcactcagcggtgctgcggaccgctacgatcatcgtgaagacgccgactactacagccacgctggtgcgttgttccgcctgatgaacgatgagcagaaggcattgctgatcaataacatcgtgggcgccatggctggagtggcggctgatgtggttgatcggcagttgcagcatttctacaaggccgacccggcttacggcgaaggcatcgccaaagctttgggcgtatcgctcaagtaa

SEQ ID NO: 5411 - protein, 482 aa, Pseudomonas fluorescens Pf-5
MSQTKTLTTASGAPVADNQNSRSAGPRGPLLLDDFHLIEKLAHFNRENIPERRVHAKGSGAYGTFTVSRDITEYTSAKLFEAVGKKTPTFLRFSTVGGERGSADTERDPRGFALKFYTEEGNWDIVGNNTPVFFIRDPLKFPDFIHTQKRLPQSNLKSAQMMWDFWSHSPEALHQVTILFSDRGIPDGYRHMHGFGSHTYSLINAKGERHWVKWHYKTKQGIKNLAPADAARLAGTDPDYAQRDLFNAIERGEFPKWSVCIQVMTEAQAAAHYENPFDVTKTWSQKEFPLIEVGELELNRNPLNYFAEVEQAAFGPSNMVPGVGLSPDRMLQGRVFAYADAHRYRVGTNHQQLPVNAPLSPVNSYQRDGSMAFGSNGGAAPNYEPNSYGDAPKQAPRYAEPALALSGAADRYDHREDADYYSHAGALFRLMNDEQKALLINNIVGAMAGVAADVVDRQLQHFYKADPAYGEGIAKALGVSLK

SEQ ID NO: 5412 - DNA, 1446 bp, Pseudomonas syringae pv. phaseolicola 1448A
  CDS (1)..(1446): transl_table=11
atgagtcagaagacccttacgaccgccagcggtgcaccagtcgccgacaatcagaattctcgctcggcaggcccgcgtggtcctttactgctcgatgatttccacctgatcgaaaagctcgctcatttcaaccgtgagaatattccggagcgtcgtgtccacgccaaaggatcgggtgctcatggaacgttcaccgttacccgtgatatcagccaatacagcagcgccaagctgttcgacacggtcggcaagcagaccccgatttttctgcgtttctccactgtaggtggtgagcgtggttcggcggatactgaacgtgatccgcgcggctttgcaatcaagttttacaccgaggaaggtaactggtacatcgtgggtaacaacacgccagtgttctttatccgtgaccctctgaaatttcctgacttcattcacacgcagaaacgtcttccgcaaaccaacctgaaaagcccgcaaatgatgtgggatttctggtcgcattcgcctgaagcgctgcaccaggtcactattctgttctcggaccgaggcattccggacggctatcgtcacatgcacggttttggtagccatacgtacagccttatcagcgcagcaggtgagcgtcattgggtgaagtggcactacaagacccggcagggcatcaagaacctcacgccagccgaggctgcgcgcattgcgggtactgatcccgattacgcccagcgcgatctgttcactgctatcgagaggggtgacttccccaagtggcaggtctgcattcagctgatgagcgaagcccaggctgcgaaccaccacgagaacccgttcgacgtgaccaagacctggtcgcagaaggaatatccgctgattgaagtaggtgaactggagcttaaccgtaacccgctcaactactttgccgaggttgagcaagcagcgtttggtcccagcaatatggtgcccggggttggcttgtcaccggaccgcatgctgcaagggcgggtgtttgcttacgccgatgcacatcgctatcgcgtaggtaccaatcaccagcaattgccgatcaatgcaccgagaaacccagtgcatagctaccagcgtgacgggtcgatggccttcggtaccaatggcggggcggctccgaactatgagccaaacagctattcggatgcgccgaaggaagatccgcgctacgcagaacctgcgctggctttgagtggtgccgcaggtcgtcatgatcatcgcgtggacggcgattactacagtcaggcgggcaagttgttcaacctgatgagcgatgatcaaaaagcgctgctgatcagtaacattgccggcgcgatggggggtgtttccagtgacatcgtgcagcgtcagttgcagcatttctacagggctgacccggcctacggggaaggcattgccaacgctctgggtataaaactgggctga

SEQ ID NO: 5413 - protein, 481 aa, Pseudomonas syringae pv. phaseolicola 1448A
MSQKTLTTASGAPVADNQNSRSAGPRGPLLLDDFHLIEKLAHFNRENIPERRVHAKGSGAHGTFTVTRDISQYSSAKLFDTVGKQTPIFLRFSTVGGERGSADTERDPRGFAIKFYTEEGNWYIVGNNTPVFFIRDPLKFPDFIHTQKRLPQTNLKSPQMMWDFWSHSPEALHQVTILFSDRGIPDGYRHMHGFGSHTYSLISAAGERHWVKWHYKTRQGIKNLTPAEAARIAGTDPDYAQRDLFTAIERGDFPKWQVCIQLMSEAQAANHHENPFDVTKTWSQKEYPLIEVGELELNRNPLNYFAEVEQAAFGPSNMVPGVGLSPDRMLQGRVFAYADAHRYRVGTNHQQLPINAPRNPVHSYQRDGSMAFGTNGGAAPNYEPNSYSDAPKEDPRYAEPALALSGAAGRHDHRVDGDYYSQAGKLFNLMSDDQKALLISNIAGAMGGVSSDIVQRQLQHFYRADPAYGEGIANALGIKLG

SEQ ID NO: 5414 - DNA, 1668 bp, Thermobifida fusca YX
  CDS (1)..(1668): transl_table=11
atgttgggaagaggtgggcgcctccctccggggaagtgtcgggttggccccgcacattggcccagccgactctcgtccgctgaggtgagccccaccacgcgggcactgtcgcgccacaccggaacttccgggccggcgccgtcccgatctctaccagccatatccacgatcaaggagaccgacttgaccgagaccaacgaggcactgtccactgcgagcaacgccacgggctccacgctcgactctggtgcgcctgcggctagcgaccgcaactcgctgagcgtgggcagcaacggcccgctgctgctgcacgacgtacggctcgttgagacgctcgcccacttcaaccgtgagcgggtccccgagcgcaacccgcacgccaagggcgccggtgccttcggtgtcttcgaaaccacggaggacgtctcccagtacaccaaggctgccctgttccagaagggtgcccgtaccgagatgctcgcccggttctccacggtcgctggtgagcagggctccccggacacctggcgggacgtgcgcggtttcgctctgaagttctacacctctgagggcaactacgacctggtcggcaacaacacgccgatcttcttcgtccgcgacccgatgaagttcccgcacttcatccgctcccagaagcggatgccggacacgggtctgcgcgacaacaacatgcagtgggacttctggaccctcaacccggagaccgcccaccaggtcacctacctcatgggtgaccgcggcctgccgcggacctggcgccacatgaacggctacggttcgcacacctacatgtggatcaacgccaagggcgagaagttctgggtcaagtaccacttcaaaaccgaccagggcatcgagaacatgaccaacgaggaagccgagcgtctcgccggtgtggacgccgacttccaccgtcgtgacctggtcgaggccatcgaacgcggggactacccgagctggaccctctacgtgcaggtcatgccgtacgaggacgccaagacctaccggttcaacccgttcgacctgaccaaggtctggccgcacagcgactacccgctcatcaaggtcggcaagatgaccttgaaccgcaacccggagaacttcttcgccgagatcgagcaggccgcgttcgcgccgtcgaacctggtcccgggtatcggcgtctccccggacaagatgctgctgggccgcgtcttcgcctacgcggacgcccaccgggcccggatcggcaccaactacttccagctgccggtgaacaagccgcgggtgaaggtcaactcctacaccttcgacgggcacatgacctacgagcactccggcaaggccccggtgtacgcgcccaactcctacggccgtccctggtctgaccagaccggcccggtcgaggacagctgggaggccgacggcgagctggtgcgcagcgcctacgagctgcacgctgaggacgacgacttctcgcaggccggcaccctggtccgcgaggtcttcgacgacgcccagcgggaccggctcgtggagacggtcgccgaccacctgtccaagggtgtcgtcgagccggtgctctcccgggccttccagtactggaagaacatcgacgagaccatcggcgagcggatcgagaagcggtaccacgagatcgctcggtga

SEQ ID NO: 5415 - protein, 555 aa, Thermobifida fusca YX
MLGRGGRLPPGKCRVGPAHWPSRLSSAEVSPTTRALSRHTGTSGPAPSRSLPAISTIKETDLTETNEALSTASNATGSTLDSGAPAASDRNSLSVGSNGPLLLHDVRLVETLAHFNRERVPERNPHAKGAGAFGVFETTEDVSQYTKAALFQKGARTEMLARFSTVAGEQGSPDTWRDVRGFALKFYTSEGNYDLVGNNTPIFFVRDPMKFPHFIRSQKRMPDTGLRDNNMQWDFWTLNPETAHQVTYLMGDRGLPRTWRHMNGYGSHTYMWINAKGEKFWVKYHFKTDQGIENMTNEEAERLAGVDADFHRRDLVEAIERGDYPSWTLYVQVMPYEDAKTYRFNPFDLTKVWPHSDYPLIKVGKMTLNRNPENFFAEIEQAAFAPSNLVPGIGVSPDKMLLGRVFAYADAHRARIGTNYFQLPVNKPRVKVNSYTFDGHMTYEHSGKAPVYAPNSYGRPWSDQTGPVEDSWEADGELVRSAYELHAEDDDFSQAGTLVREVFDDAQRDRLVETVADHLSKGVVEPVLSRAFQYWKNIDETIGERIEKRYHEIAR

SEQ ID NO: 5416 - DNA, 1515 bp, Methanococcoides burtonii DSM 6242
  CDS (1)..(1515): transl_table=11
atgagtgatgagaaaacttccagtttaactactgcttttggaattccagtcggtgatgatcagaatagcctcacggcaggagagcgtggaccagttctcatacaggacgttcacctattggagaaacttggtcattttaatcgtgaacgtatacctgagcgtgttgtgcatgctaaaggtgcaggggctggcggttattttgaagtgacagctgatgtgaccaaatatacaaaagccaaattcctttcagaaataggcaaacgcactgaggtctttgctcgcttttccactgtaggtggggaaaaaggttctgccgatgcagcaagggatccacgtggttttgctataaagttctacactgaagatggtaaccatgatctcacgggcaacaacacacctgtgttcttcattcgagaccctctgaagtttcctgatttcattcatacacagaagcgaaaccctgctacaaactgcaaagatccaaacatgttctgggactttctgtctctcactccggaatcaattcatcaggtcacgatccttttttcagacaggggtactcctgcaactttccgtaatatgaacggatattcaagtcatacttataagtggtataacgataagggcgaatacttctgggtgcagtatcattttaagactgatcagggtacaaagacccttacacgtgaggaagcagaaaaattaagtgggactgatccggatcatgctgttcgggatctctatgatgctatagaaaagggggattatccttcctggacccttgagatgcagataatgaccccggagcaggctgaagaatatcgctttgacattcttgatataaccaaggtctggccacatggtgatttccctaccatcaagatcggtaaaatggtgcttaataggaatccaaccaattattttgctgaagtggaacaatctgcttttagccctggtaatctggtaccgggtattgatatatctccagataagatgttacaggccagagttttctcatatcatgactctcatgttcatcgtttgggtcccaattatcatcagatccctgtgaatgctcctaaaaatgcacctgaaaccagctatcagcgtgatgggttcatgcgaattgatgccaatggaggaagtggaccaaattactggccaaacagttttggtggtcctgccccggaccctgatgctctgaagccaccattcgaagtttccggtaaagcagatcgtacgccttatgtccactccaatgatgactttgtgcaggcaggtaacctgtatcgtgacgtaatggatgatcaggctcgtgagaaccttgtgggtaatattatttcacatctctcgggtgcacaaaagcgtattcaactcagacagactgctctgttcttcaaagccgatcccgattacggagggcgtgtggctgatggattgggtttggatgtaaaagaaattgagcgtcttgccaatatgacccaaacggaacgtgtaaaagctacagaaaagtaa

SEQ ID NO: 5417 - protein, 504 aa, Methanococcoides burtonii DSM 6242
MSDEKTSSLTTAFGIPVGDDQNSLTAGERGPVLIQDVHLLEKLGHFNRERIPERVVHAKGAGAGGYFEVTADVTKYTKAKFLSEIGKRTEVFARFSTVGGEKGSADAARDPRGFAIKFYTEDGNHDLTGNNTPVFFIRDPLKFPDFIHTQKRNPATNCKDPNMFWDFLSLTPESIHQVTILFSDRGTPATFRNMNGYSSHTYKWYNDKGEYFWVQYHFKTDQGTKTLTREEAEKLSGTDPDHAVRDLYDAIEKGDYPSWTLEMQIMTPEQAEEYRFDILDITKVWPHGDFPTIKIGKMVLNRNPTNYFAEVEQSAFSPGNLVPGIDISPDKMLQARVFSYHDSHVHRLGPNYHQIPVNAPKNAPETSYQRDGFMRIDANGGSGPNYWPNSFGGPAPDPDALKPPFEVSGKADRTPYVHSNDDFVQAGNLYRDVMDDQARENLVGNIISHLSGAQKRIQLRQTALFFKADPDYGGRVADGLGLDVKEIERLANMTQTERVKATEK

SEQ ID NO: 5418 - DNA, 1470 bp, Rhodococcus sp. RHA1
  CDS (1)..(1470): transl_table=11
atgcctgaaacacagcgcgccaccaccaacaacttcggaattcccgtcgccagcgacaacgaatccctcacggcgggcacgcagggccctatcctgctgcacgaccactacctgatcgagaagctcgcccagttcaaccgggagcgtgtcccggagcgcgtcgtccacgccaagggtggcggtgcgttcggcgagctggtcgtcacccacgacgtgagccgctacacgaaggccacgctgttccagcccggcgtcaggaccgagtcactggtccgcttctccaccgtcgccggcgagcagggcagccccgacacctggcgtgacccgcgcggattcgccgtgaagttctacaccgaggacggcaactacgacctcgtcggcaacaacacgcccgtcttcttcatcaaggacccgatcaagttccccgacttcatccactcgcagaagcgactgccgggatccggtctgcgcgaccacaacatgcagtgggacttctggacgctgcggcccgagtccgcgcaccaggtgacctggctgatgggtgaccgcggaatcccgaagacgtggcgtcacatggacggtttcggctcgcacacgtaccagtgggtcaacgccgaaggcgaacggttctgggtcaagtaccacttcaagaccgatcagggcatcgagttcctcacgcaggacgaggccgacaccctcgcaggcaacgaccccgatcatcaccgcgccgacctgtacgacacgatcgcccgcggcgagttccccagctggacgctgaaggttcaggtcatgcccgtcgacgaggccgagggctaccggttcaacccgttcgacctcaccaaggtgtggtcgcagaaggactacccgctgatcgaggtcggcaagtggaccctcaaccgcaaccccgacaacttcttcgcgcagatcgagcaggcctcgttcgagccgtcgaatgtcgttccgggaatcggcttctcgcccgacaagatgctgctggggcgggtcttctcctacgcggacgcgcaccggtaccgcatcggcgccaactacgcgcagctgccggtcaacgcgccgaagaaccaggtcaactcgtactcgcaggacggtgcgatgcggtacgccaccaattcgcccgagacccccgtgtacgcgccgaactcctacggcggcccgcacgcagacgcgtcgctcgcgggcgacgagggacagtgggcgttcgacggcgagtccgtgcgagccggctacatcgagcacgccgaggacggcgatttcacgcaggcgggcacgctcgtccgtgaggtcctgagcgacgaggaacgcgaccgcctggtggacaacatcgtcggccacgcgctcggcggcgtcagcgaaccggttctgctgcgggtcttcgactactggaagagcgtcgaccccgacctgggcaagcgagtggaaatcggtgtccgggaagggcagagccagaactga

SEQ ID NO: 5419 - protein, 489 aa, Rhodococcus sp. RHA1
MPETQRATTNNFGIPVASDNESLTAGTQGPILLHDHYLIEKLAQFNRERVPERVVHAKGGGAFGELVVTHDVSRYTKATLFQPGVRTESLVRFSTVAGEQGSPDTWRDPRGFAVKFYTEDGNYDLVGNNTPVFFIKDPIKFPDFIHSQKRLPGSGLRDHNMQWDFWTLRPESAHQVTWLMGDRGIPKTWRHMDGFGSHTYQWVNAEGERFWVKYHFKTDQGIEFLTQDEADTLAGNDPDHHRADLYDTIARGEFPSWTLKVQVMPVDEAEGYRFNPFDLTKVWSQKDYPLIEVGKWTLNRNPDNFFAQIEQASFEPSNVVPGIGFSPDKMLLGRVFSYADAHRYRIGANYAQLPVNAPKNQVNSYSQDGAMRYATNSPETPVYAPNSYGGPHADASLAGDEGQWAFDGESVRAGYIEHAEDGDFTQAGTLVREVLSDEERDRLVDNIVGHALGGVSEPVLLRVFDYWKSVDPDLGKRVEIGVREGQSQN

SEQ ID NO: 5420 - DNA, 1518 bp, Rhodococcus sp. RHA1
  CDS (1)..(1518): transl_table=11
atggcagatcagaacttcacgaccgacgacgccggcatcccggtatcgagtgacgaacattcgctcaccgtcgggacggacgggcccatcctcctccaggatcattacctgatcgagaagatggcgcagttcaaccgcgaacgcgtcgcggagcggcaaccgcacgcgaagggaggcggggcgttcggacggttcgaagtcaccgaagacgtttccgcctacacgaaagccgacctcttccagcccggaaagaagacggatctgctgatcaggttctcgtccgtggccggcgagcgcggcagcccggacacctggcgcgacccacgcggattcgccctcaagttctacaccgaccagggcaactacgacatggtcggaaacaacacacccgtcttcttcatgcgcgacccgatgaagttccaggacttcatccgttcgcagaagcggcgtgccgacaacaacctccgcgaccacgacatgcagtgggacttctggacgttgtccccggagtcggcgcaccaggtcacgtggctcatgggcgaccgcggcatcccgcgcacctggcggcacatgaacgggtactccagccacacgtacatgtgggtgaacgccgcgggcgacaagttctgggtgaagtaccacttcaagaccgaccagggcatcgagttcttcacgcagcacgagggcgaccagatggcgtccatggacaccgattaccacacgcgggacctgtgggagcacatcgaaggcggcgagtacccgagctggaccttgaacatgcagatcatgccgttcgaggatgccgacgactaccggttcaacccgttcgacctcaccaaggtgtggccgcacggcgactacccgctgatccccgtcggcaggatgacactcgaccgcaaccccacggactaccactgcgagatcgagcaggccgcgttcgagcccagcaacctggtccccggcatcggcccgagcccggacaagatgctcatcggccggctgttctcctacccggacgcccaccgctaccgcatcggcgccaactacaaggagctgcccgtcaacaggccgcacgtacccgtccgctcgtactcgaaggacggcaacatgcggcaccacaaccccggggatccggtctacgtgccgaactccaagggcggcccgcatgccgacccgtcgcaggtcggggcgaccgccacctggtacagcgccggcgacatggtccgctctccgtacgcgctccacagggaggacgacgactggggtcaggccgggacgatggtccgtgaggtactcgacgacgccgcccgggaccgcctggtggacaacatcgtcgggcacctgctgaacggggtcaccgaaccggtcctggcgaaggcgttcgagtactggcgcaacgtcgacaagaccctcggcgatcgaatcgccgacggtgtcgggaagaaacagtcggagaccgaccccaaggcgggcgaacaggccaatgcggcgcgcagcagcgcgcaggcgaaggcctaa

SEQ ID NO: 5421 - protein, 505 aa, Rhodococcus sp. RHA1
MADQNFTTDDAGIPVSSDEHSLTVGTDGPILLQDHYLIEKMAQFNRERVAERQPHAKGGGAFGRFEVTEDVSAYTKADLFQPGKKTDLLIRFSSVAGERGSPDTWRDPRGFALKFYTDQGNYDMVGNNTPVFFMRDPMKFQDFIRSQKRRADNNLRDHDMQWDFWTLSPESAHQVTWLMGDRGIPRTWRHMNGYSSHTYMWVNAAGDKFWVKYHFKTDQGIEFFTQHEGDQMASMDTDYHTRDLWEHIEGGEYPSWTLNMQIMPFEDADDYRFNPFDLTKVWPHGDYPLIPVGRMTLDRNPTDYHCEIEQAAFEPSNLVPGIGPSPDKMLIGRLFSYPDAHRYRIGANYKELPVNRPHVPVRSYSKDGNMRHHNPGDPVYVPNSKGGPHADPSQVGATATWYSAGDMVRSPYALHREDDDWGQAGTMVREVLDDAARDRLVDNIVGHLLNGVTEPVLAKAFEYWRNVDKTLGDRIADGVGKKQSETDPKAGEQANAARSSAQAKA

SEQ ID NO: 5422 - DNA, 1521 bp, Rhodococcus sp. RHA1
  CDS (1)..(1521): transl_table=11
atggttgagaacaactacaccaccgatgatgcgggaattccggtaccgagcgacgagcgttcgctcaccgtcggcgcggacggtccgatcttgctgcacgacgcctacctcatcgaaaagatggctgctttcaatcgcgagcgtgtacccgagcggcagcctcatgccaaaggaggaggggcgttcggcacattcgaggtgacgggcgatgtcagtgcgtttaccttggcggacctgttccagcctggcaagaagacggagatgctcgcacggttctccacagtcgccggcgaacgtggcagtccggatacctggcgcgacccgcgcggttttgccctcaaattctataccgaacaaggcaatttcgacatggtcggcaacaacactccggtcttcttcatgcgggacccgatgaaattccaggatttcatccgttcgcagaagcggcgtgccgacaacaatctgcgcgatcatgatatgcagtgggatttttggacgctgtctccggagtccgcgcatcaggtgacgtggttgatgggtgaccgcggaattccgcgcacctggcggcacatgaacggctattccagccatacgtacatgtggatgaacgccgcgggcgagaagttctgggtgaagtaccacttcatcaccgatcagggaatcgagttcttcacgcaggacgagggcgatcagatggcctcgatcgacaccgactaccaccttcgtgacttgtgggagcacatcgaacaaggtgattatcccagctggacactcaagatgcagatcatgccgttcgaggatgcaaagacgtaccggttcaacccgttcgacctcaccaaggtctggccgcatgcggactatccactcgtcgaagtcggcaagatgacgctgaaccgcaatccgagcaactaccacaccgagatcgagcagggggcattcgagcccagcaacgccgtgcccggaaccgggccgagtccggacaagatgctgctcggccggtggttctcgtatcccgattcgcatcggcaccgcatcggcgccaactacaaggagctgccggtcaaccggccacacgcgaccaccgtgcggtcgtattcgaaggatggccacatgcgccacgagaatcccggagacccggtgtatgtacccaactccaagggcggcccgcatgcggatccagcggtggcgggcgaacccatcggctggtacagcgacggggacatggtgcggcaggcctacacacttcgccaggacgacgacgattggggtcaggcgggcacgatggtacgcgacgttctcgacgatgcggcccgcggacgcttggtcgacaacatcgtcgggcacctactcaacggcgtgagcgaacctgtcctggcgagagtgttcgagtattggcgcaatgtggacaaaggcctcggcgacaaagtcgcgcagggggtgcgcgccaaaaaggatgaactcgatcccaaggccgcgggacaagacaacccgtcgcgtcgatccgctcaagagaaggcctga

SEQ ID NO: 5423 - protein, 506 aa, Rhodococcus sp. RHA1
MVENNYTTDDAGIPVPSDERSLTVGADGPILLHDAYLIEKMAAFNRERVPERQPHAKGGGAFGTFEVTGDVSAFTLADLFQPGKKTEMLARFSTVAGERGSPDTWRDPRGFALKFYTEQGNFDMVGNNTPVFFMRDPMKFQDFIRSQKRRADNNLRDHDMQWDFWTLSPESAHQVTWLMGDRGIPRTWRHMNGYSSHTYMWMNAAGEKFWVKYHFITDQGIEFFTQDEGDQMASIDTDYHLRDLWEHIEQGDYPSWTLKMQIMPFEDAKTYRFNPFDLTKVWPHADYPLVEVGKMTLNRNPSNYHTEIEQGAFEPSNAVPGTGPSPDKMLLGRWFSYPDSHRHRIGANYKELPVNRPHATTVRSYSKDGHMRHENPGDPVYVPNSKGGPHADPAVAGEPIGWYSDGDMVRQAYTLRQDDDDWGQAGTMVRDVLDDAARGRLVDNIVGHLLNGVSEPVLARVFEYWRNVDKGLGDKVAQGVRAKKDELDPKAAGQDNPSRRSAQEKA

SEQ ID NO: 5424 - DNA, 1455 bp, Mycobacterium avium 104
  CDS (1)..(1455): transl_table=11
atggcggagaaccatacgaccacgaatgcgggtgcgccggcgcccagtgacgaactgtccttgacggtgggccccgacgggccgctcctgctgcaggattcctacctcgtcgagcagatggcggcgttcaatcgggaacgggtgcccgagcgtcagccgcacgccaagggcgccggggcatacgggcgcttcgaggtgacggccgatgtgagtgagtacaccaaggcggccttcctgcaaccgggtgcggtcaccgaggtgttcgcccgtttctcgtcgggcaacagcggcgagcgtggcagtgccgacacggcccgcgacaaccgcgggttttcggtgaagttttacaccaccgaaggcaacttcgacctcgtcggcagcgacgtcccggtcttcgcgatccgggatccgatgaagtttcccaacctgattcgcgccgggggccgccgcgcggacaacgacctgcacgaccacaacatggtgtgggatttctggacgagctgtcccgagactgcgcatctggtgacgctggtgatgggggaccggggcatccccaggacgtttcggcatatgaacggcttcggcctgcacgcgttcagttgggtcaattcggccggcgagatccattgggtgaagtaccacttcaagaccgaccagggcatccaatggttgccccaggaagagggtcggcggctggccggcacccatcccgactgctgcgtgcgcgacctgtacgaggccatcgcgcgcggggagtatccgagctggtcgctgcaggtgcagttgatgccgttcgccgacgcgaaaacctaccgcttcaacccctttgacgtgacgaaggtgtggccgcacgccgactacccacccatcgaggtcggcacgatgacgttggaccgcaacgtcaccgatcaccacgccgaggtcgagcaggccgccttcgcgccgagcaacctggtgcccggcaccgggctgagccccgacaggctgttgttgggccgcagtttcgcctaccccgatgcgcaccgtgcccgcatcggggtcaaccacgaccagctcccggtcaacgccgcccggtgtgcggtgcgctcgtacgccaaggacggccggatgcggattgtcaacaccgccgacccggtgtatgcgcccaactccgcgggcgggccgcacgccgatcccgcacgggccggcgaggtgcactgggccgccgacgggcagatgctgcgcgcggcgtacacgctgcgccgcgacgatgacgactggggccaggccggcaccctggtgcgccgggtgatggacgatgcgcaacgggaacgcctggtacacaacatcgttggtcacgtctcggcgggggtgaatgaacccgtcctgtcccgtgtcttcgcgtactggcgccacgtcgaccccgacatcggcaggaaggtcgaagaaggcgttcgcgccaatctcaacagctga

SEQ ID NO: 5425 - protein, 484 aa, Mycobacterium avium 104
MAENHTTTNAGAPAPSDELSLTVGPDGPLLLQDSYLVEQMAAFNRERVPERQPHAKGAGAYGRFEVTADVSEYTKAAFLQPGAVTEVFARFSSGNSGERGSADTARDNRGFSVKFYTTEGNFDLVGSDVPVFAIRDPMKFPNLIRAGGRRADNDLHDHNMVWDFWTSCPETAHLVTLVMGDRGIPRTFRHMNGFGLHAFSWVNSAGEIHWVKYHFKTDQGIQWLPQEEGRRLAGTHPDCCVRDLYEAIARGEYPSWSLQVQLMPFADAKTYRFNPFDVTKVWPHADYPPIEVGTMTLDRNVTDHHAEVEQAAFAPSNLVPGTGLSPDRLLLGRSFAYPDAHRARIGVNHDQLPVNAARCAVRSYAKDGRMRIVNTADPVYAPNSAGGPHADPARAGEVHWAADGQMLRAAYTLRRDDDDWGQAGTLVRRVMDDAQRERLVHNIVGHVSAGVNEPVLSRVFAYWRHVDPDIGRKVEEGVRANLNS

SEQ ID NO: 5426 - DNA, 1458 bp, Mycobacterium smegmatis str. MC2 155
  CDS (1)..(1458): transl_table=11
atgaccgagccgagggccacgaccaccgacgccggcgcgccggtgcccagcgacacgcactcgctcaccatcggtccggcggggccgatcctgctgcacgaccactatctgatcgagcagatggccaacttcaaccgcgagcgcatcccggagcggcaaccacacgccaaggggtcgggcgccttcggccacttcgaggtcaccggtgatgtgagccgctacaccagtgcggcggtgttccagccaggtgtgcggaccgacacgctcatccgcttctccacggtcgccggtgagcggggaagcccggacacctggcgtgatccgcggggtttcgcgctgcgtttctacaccagcgcaggcaatctcgacatcgtcggcaacaacacaccggtcttcttcatccgcgacggcctgaagttccagcacttcatccggtcccagaagcgccgcgccgacaccgggctgcgtgatcacgacatgcagtgggacttcttcacgctcacgcccgaatccgcacatcaggtggcgtggctgttcggcgaccgcggcatcccgcggacgtggcggcacatgaacgggtacggcagtcatacctacagctggatcaacgcagaaggtgagatccattgggtgaagtaccatttcatctccgaccagggcgtcgagaacctcacgcaggacgaggccgaccggctggcgggtgtggacgccgatttccaccagcgtgatctgcaccaggcgatcgctcgaggcgagtacccgagctggaccctggcggtccagatcatgccgttcgacgacgcgaagacctaccggatcaacccgttcgacctgaccaaggtgtggccgcacgccgactatccgctcgtgaccgtcggccggttggtgctggaccgcaatttcaccgaccaccacaccgagatcgagcaggccgcgttcgcgcccagcaaccaggttccgggcaccggtctgagcccggacaagatgctgcaggcccgtacgttcgcctacgccgatgccgcgcgtgcgcggatcggggtgaactacaagcagatcccggtcaacgcaccgcgatgccccgtgcacagttactccaaggacggggcgatgcgcgtcacgaacgtctcggatccggtgtacgccccgaactcctacggtggcccgcacgcggacccgaaccagacgaacgaggcgctgtggtacgccgacggggacatggtccgtaccgcctataccctgcgggccgaggacgacgacttcacgcaggccggtgacctcgtgcgccgcgtcatggacgacgccgagcgcgaccggttggtcggcaacgtcgcgggacacctgagcaacggggtctccgaacccgtgttgcagcgggtgttcgagtactggcgcaacatcgacaagttgacgggtgaccggatcgaggacgccgtacggaagcgccagggcgtcagatga

SEQ ID NO: 5427 - protein, 485 aa, Mycobacterium smegmatis str. MC2 155
MTEPRATTTDAGAPVPSDTHSLTIGPAGPILLHDHYLIEQMANFNRERIPERQPHAKGSGAFGHFEVTGDVSRYTSAAVFQPGVRTDTLIRFSTVAGERGSPDTWRDPRGFALRFYTSAGNLDIVGNNTPVFFIRDGLKFQHFIRSQKRRADTGLRDHDMQWDFFTLTPESAHQVAWLFGDRGIPRTWRHMNGYGSHTYSWINAEGEIHWVKYHFISDQGVENLTQDEADRLAGVDADFHQRDLHQAIARGEYPSWTLAVQIMPFDDAKTYRINPFDLTKVWPHADYPLVTVGRLVLDRNFTDHHTEIEQAAFAPSNQVPGTGLSPDKMLQARTFAYADAARARIGVNYKQIPVNAPRCPVHSYSKDGAMRVTNVSDPVYAPNSYGGPHADPNQTNEALWYADGDMVRTAYTLRAEDDDFTQAGDLVRRVMDDAERDRLVGNVAGHLSNGVSEPVLQRVFEYWRNIDKLTGDRIEDAVRKRQGVR

SEQ ID NO: 5428 - DNA, 2115 bp, Azoarcus sp. BH72
  CDS (1)..(2115): transl_table=11
atgggcaaacccgggaacgatgaagaagcacagggccgtgcgcggctgcacgacgaagaagtgggccgtggcccgggcggcgagacgcaccaggtggcgggcggcgaggtgccggtgctgaccacccagcaaggggtgccggtggccgacgaccagaactcgctgaaggccggtgcgcgcgggccgacgctgctggaagattttcacttccgcgagaaacttttccacttcgaccacgagcgcatccccgagcgcgtggtccatgcgcgcggctatggcgcgcacggctatttcgaaacctacgagtcgctttccgacctcacccgcgcggatctcttccagcgcgccggggaaaagacgcccgccttcgtgcgcttttccaccgtcgccggcaacaagggctccgccgacatggtgcgcgacgtgcgcggcttcgcggtgaagctctacacccgcgaaggcaactgggacatcgtcggcaacaacatcccggtgttcttcatccaggatgcgatcaagtttcccgacgtggtccatgcggtcaagcaggagccggaccgcgactttccgcaggcggcttccgcgcacgacaacttctgggacttcatctcgctgacaccggaatccatgcacatggtgatgtggatcatgtcggaccgcaccatcccgcgctccttccgcttcatggagggcttcggggtgcataccttccgcctggtcgatgccgagggcggctggcgcttcgtcaagttccactggaagcccaagcttggtctgcagtcggtggtgtggaacgaggcggtgaagatcaacggcgccgatcccgacttccaccgccgcgacctgtggaacgcggtgcagagcggcaactttccggaatgggagctgggcctgcaggtgttcgacgaggacttcgccaacagcttcgacttcgacctgctcgaccccaccaagatcatccccgaggaagtcctgccggtgcgcaaggtggggcggctggtgctggaccgcatggtggacaacttcttcgcggaaaccgagcaggtggcgttctgcacccagaacatcgtgcccggcatcgacttcagcgaagatccgctgctgcaggggcgcaacttctcctacctcgacacccagctgaagcggctcggcgggcccaacttcacccatctgccgatcaacgcgcccaagtgccccttccaccacttccagcaggacggccacatggccttcttcaatcccaaggggcgggccaactacgagccgaattcctggggcggggccgagggcgggccgcgcgaggcgccggacatcggcttcaagagcgcccgcaccgacatcgccggccccaagctgcgcatccgctccgataccttcgccgaccactacagccaggcgcgccagttctacatcagccagaccgaagtggagcagcgccatctcaccgacgcgctggtcttcgagctgagcaaggtcgaaacgccggtgatccgcgaacgcatggtgtcgcacctgctcaacatcgacgccgcgctcgccggcaaggtcgcggacggcatcggcctcacccagatgccgcaggccgcgacgccggcgcgtccgccgcgcaccgacctgccgccttcgcccgcgctcagcatcctgcagaacggtccgcagtcgttcgccgggcgcaagctcggcgtgctggtcaccgacggttgcgatgcagccctggtggccgcattgcgcagcgcggtggaggacgccggcggcatggtcgagctggtggcgccgcgcgtcggcggcgtcaccgcggacgacggccgcctgctgccggcccaccatcagctcgacggcgccccctcggtgctgttcgacgcggtggcggtgctgccctcggccgaaggcgtcgccgcgctggccgacaagccgcaggcgcgcgatttcgtcgccgatgcctatgcgcactacaagttcgtcgcctacgtgtcggcggcgcgcaagctgttcgacaaggccgggctgcccgcccagctggacggcggcttcgttgcgctggacaccggctcgccgcccagcgccttcctggccgcggcggcgccgctgcgcttctgggcccggccgggcgcctga

SEQ ID NO: 5429 - protein, 704 aa, Azoarcus sp. BH72
MGKPGNDEEAQGRARLHDEEVGRGPGGETHQVAGGEVPVLTTQQGVPVADDQNSLKAGARGPTLLEDFHFREKLFHFDHERIPERVVHARGYGAHGYFETYESLSDLTRADLFQRAGEKTPAFVRFSTVAGNKGSADMVRDVRGFAVKLYTREGNWDIVGNNIPVFFIQDAIKFPDVVHAVKQEPDRDFPQAASAHDNFWDFISLTPESMHMVMWIMSDRTIPRSFRFMEGFGVHTFRLVDAEGGWRFVKFHWKPKLGLQSVVWNEAVKINGADPDFHRRDLWNAVQSGNFPEWELGLQVFDEDFANSFDFDLLDPTKIIPEEVLPVRKVGRLVLDRMVDNFFAETEQVAFCTQNIVPGIDFSEDPLLQGRNFSYLDTQLKRLGGPNFTHLPINAPKCPFHHFQQDGHMAFFNPKGRANYEPNSWGGAEGGPREAPDIGFKSARTDIAGPKLRIRSDTFADHYSQARQFYISQTEVEQRHLTDALVFELSKVETPVIRERMVSHLLNIDAALAGKVADGIGLTQMPQAATPARPPRTDLPPSPALSILQNGPQSFAGRKLGVLVTDGCDAALVAALRSAVEDAGGMVELVAPRVGGVTADDGRLLPAHHQLDGAPSVLFDAVAVLPSAEGVAALADKPQARDFVADAYAHYKFVAYVSAARKLFDKAGLPAQLDGGFVALDTGSPPSAFLAAAAPLRFWARPGA

SEQ ID NO: 5430 - DNA, 1515 bp, Neisseria meningitidis FAM18
  CDS (1)..(1515): transl_table=11
atgactacctccaaatgccccgtaacccatctgaccatgaacaacggcgcgcctgttgccgacaatcaaaacagcctgaccgccggtcctcgcggccctctgctggcgcaggatttgtggctgaatgaaaaactcgccgacttcgtgcgcgaagtcatccccgaacgccgtatgcacgccaaaggttcgggcgcgttcggtacgtttaccgtaacgcacgacatcaccaaatacacccgcgccaaaatcttcagcgaagtcggcaaaaaaaccgagatgttcgcccgtttcaccaccgtggcaggcgaacgcggcgcagccgatgcggaacgcgacatccgcggctttgccttgaagttctataccgaagaaggcaactgggatgtggtcggcaacaacacgcccgtgttcttcctgcgcgacccgcgtaagttccccgacctgaacaaagccgtcaaacgcgacccgcgcaccaatatgcgctctgccacaaacaactgggacttctggacgctgctgcccgaagcactgcaccaagttaccatcgtgatgagcgaccgcggcatccccgccggctaccgccatatgcacggcttcggttcgcatacctacagcttctggaacgaagcaggcgagcgtttttgggtgaaattccatttccgcacccaacaaggcattaaaaacctgaccaacgaagaagccgccaaaatcatcgccgacgaccgcgaaagccatcagcgcgacttatacgaagccatcgaacgcggcgagtttccgaaatggacgatgtacatccaagtcatgcctgaagcagacgcggaaaaagtaccttatcatccgtttgacttgaccaaagtttggccgaaaaaagactatccgctgattgaagtgggcgaattcgagttgaaccgcaatcccgaaaacttcttcgccgatgtggaacaatccgccttcgcaccgagcaacctcgttcccggtatcggcgcgagcccagataaaatgttgcaagcccgtttgttcaattacgccgacgcgcaacgctaccgcttgggcgtgaacttccgccaaatccctgtcaaccgtccgcgttgccctgttcacagcaaccagcgcgacggacaaggacgcgccgacggcaactacggcagcctgccgcactacgaacccaatagcttcggccaatggcagcaacaacccgacttcgccgaaccgcctttgaaaatcaacggcgacgcggcgcactgggactaccgccaagacgatgacgactatttcagccaaccgcgcgccctgttcaacctgatgaacgacgcgcagaaacaggcattgttcggcaacaccgccgccgcaatgggcgacgcgcccgacttcatcaaataccgccatatccgcaactgctaccgttgcgatccggcatacggcgaaggcgtggcaaaagccctcggactgactgtcgaagacgcacaagccgcccgcgcgaccgaccccgcactcggccagcccggtttgctgtaa

SEQ ID NO: 5431 - protein, 504 aa, Neisseria meningitidis FAM18
MTTSKCPVTHLTMNNGAPVADNQNSLTAGPRGPLLAQDLWLNEKLADFVREVIPERRMHAKGSGAFGTFTVTHDITKYTRAKIFSEVGKKTEMFARFTTVAGERGAADAERDIRGFALKFYTEEGNWDVVGNNTPVFFLRDPRKFPDLNKAVKRDPRTNMRSATNNWDFWTLLPEALHQVTIVMSDRGIPAGYRHMHGFGSHTYSFWNEAGERFWVKFHFRTQQGIKNLTNEEAAKIIADDRESHQRDLYEAIERGEFPKWTMYIQVMPEADAEKVPYHPFDLTKVWPKKDYPLIEVGEFELNRNPENFFADVEQSAFAPSNLVPGIGASPDKMLQARLFNYADAQRYRLGVNFRQIPVNRPRCPVHSNQRDGQGRADGNYGSLPHYEPNSFGQWQQQPDFAEPPLKINGDAAHWDYRQDDDDYFSQPRALFNLMNDAQKQALFGNTAAAMGDAPDFIKYRHIRNCYRCDPAYGEGVAKALGLTVEDAQAARATDPALGQPGLL

SEQ ID NO: 5432 - DNA, 1494 bp, Nostoc punctiforme PCC 73102
  CDS (1)..(1494): transl_table=11
atgactgaaccccaaaacttgacaactgctgatggtattccagttagcgataaccagaactcactcactgctggagcgcgtggccctgtattaatccaggatttccaccttatagaaaagctggctcatttcaacagagaacgtattcctgaaagagttgttcacgctaaaggtgctgctgctcacggcactttgactattaccaatgacattacccgctacagtaaagccaaacttttttctgaaattggcaagaaaacggaacttatcttgcgtttttctacagttggcggagaaaaaggttcagcagatgccgagcgtgaccctagaggtttttccctcaagttttatactgaggagggtaactgggatcttgtaggtaacaatacccctattttcttcatccgcgaccctttgaagtttcctgattttatccatacccaaaagcgcaatccgcaaaccaattgcaaagaccagaatgcaaagtgggatttttggtcactcagtccagaatcgcttcaccaggtgacgatcctcttttcagaccggggaattcccaaaacccatcgacacatggacggttttggtagccacaccttcagtttaattaatgccgagggcgatcgcgtttggtgtaaatttcactttaagacgctgcaaggacatcaaaccttgacagaggaagaatccgctaagattaagggcgaagatcccgatcatgcgactcacgatttgtttgaagcgatcgctaaaaaagactatcctaagtggcggatgtgtattcaggtgatgaccgaggagcaagcggaaaaacatcctgacaatccttttgacttgaccaaagtttggaaacaaggcgaatatcctttaattgaagtcgggatattagagctaaatcgtaacccagagaattattttgccgaagttgagcaagccgcttttagccctagtgcagtggttcctggcgttagtttctctccagacaaaatgctgcaagctcgaattttttcttacccagatgctcaacggtatcgcttgggtggtaactatcagcaactacccgttaaccagcccaaatgtccagtgatgcattatcagcgagatggctttatggcatcggggaacaacggcggtagcgttcctaactatgaaccgaatagtgctgagggtacgcccaaagaaaatccagcttatgcagaaccacctagtcatttgggcgatgtcacagtcgatcgttacagtcatcgtgaaggaaacgacgattatactcaagcaggtaatttgtatcggttactaactcctgagcagcaggagcgtcttgctaaaaatattgtcggcagtctctctcaagcaagagaggacatccaaatgcgtcaactttgccacttcttccgggcagatgtttcttatggtcgtcgtgtagctgaaggattgggcattgcgatcgatccttcaatgttttctcatgatgctcaacctgtaggtaactggtag

SEQ ID NO: 5433 - protein, 497 aa, Nostoc punctiforme PCC 73102
MTEPQNLTTADGIPVSDNQNSLTAGARGPVLIQDFHLIEKLAHFNRERIPERVVHAKGAAAHGTLTITNDITRYSKAKLFSEIGKKTELILRFSTVGGEKGSADAERDPRGFSLKFYTEEGNWDLVGNNTPIFFIRDPLKFPDFIHTQKRNPQTNCKDQNAKWDFWSLSPESLHQVTILFSDRGIPKTHRHMDGFGSHTFSLINAEGDRVWCKFHFKTLQGHQTLTEEESAKIKGEDPDHATHDLFEAIAKKDYPKWRMCIQVMTEEQAEKHPDNPFDLTKVWKQGEYPLIEVGILELNRNPENYFAEVEQAAFSPSAVVPGVSFSPDKMLQARIFSYPDAQRYRLGGNYQQLPVNQPKCPVMHYQRDGFMASGNNGGSVPNYEPNSAEGTPKENPAYAEPPSHLGDVTVDRYSHREGNDDYTQAGNLYRLLTPEQQERLAKNIVGSLSQAREDIQMRQLCHFFRADVSYGRRVAEGLGIAIDPSMFSHDAQPVGNW

SEQ ID NO: 5434 - DNA, 1470 bp, Exiguobacterium sibiricum 255-15
  CDS (1)..(1470): transl_table=11
atgagtgaaaaacgattaaccacaaaccagggtgtcccgattggtgacaatcagaattcgcgtacggccggtcgtcgcggtccaacactgcttgaagactatcaactgattgagaaaatggcccatttcgaccgggaacgtgttcctgagcgtgttgtacacgcccgcggttttggtgcacacggcgtcttcacggtaaaaaattcgatgaagaaatatacaaaagcggcattccttcaaaacgaagggaccgaggttcctgtattcgcccgtttctcaaccgttattcacggtacacattctcctgaaacgttacgtgatccacgtggcttctcggttaagttctatacagaagaaggaaactgggatttcgtcggaaacaacttaccggtcttctttattcgcgattcgatgaagttcccggatatggtccactcgctgaaaccggatccacgcacgaatattcaagaccctgaccgctactgggacttcatgacattacgcccggaatctacaaatatgttgatgcacctctttacggatgagggaattccggcaagctaccgtaaaatgcgcggttcgtccgtccatgcttttaaatgggtgaacgctcacggcaatacggtttatgtcaagttacgttgggtgccaaaagtcggtgttcataacctgtcagcagatgaagcgacagagattcaaggaaaagactttaaccatgcatcaaacgacacgtatcaggcgattgaagacggagaattcccggagtgggatctgttcgtccaagttcttgatccggctgatgtcgacaacttcgacttcgatccactcgatgcaacaaaagattggtttgaagatgtcatcccgttccaacacgtcggaacgatggtattaaacaaaaacgtcgacaactactttgctgaaacggaatcggtcggctttaacccgggtgtactgatcccaggcatgttgccgtcagaagataaattgctccaagggcgtctcttctcgtattccgatacacagcgttaccgtatcggaacgaactatcaacagttgccgattaactgcccgttcgctcaggtcaacaactatcaacgtgacggtgcaatgccggtcggacaacaaacaagcccggtcaactacgaaccaaaccgttaccaggacgagccgaaacaaacgccggaatacacggaagaaaaccagccgttgtatgatgacattcacggtcgtcttgaaatcgaaaaaacaaataacttcggtcaagccggtgaagtgtaccgtcgtatgacagaagaagaacaaacggcactcctgaacaatttagtggatgacttaaaacaagtccgccatgaaaacactgtcttgcttgccatctgtaacttctaccgtgcggacgaatcgctcggcaagaaattatcagaagcgttacaagtcgatatccaaccgttcttgcaacagatgcaaaaataa

SEQ ID NO: 5435 - protein, 489 aa, Exiguobacterium sibiricum 255-15
MSEKRLTTNQGVPIGDNQNSRTAGRRGPTLLEDYQLIEKMAHFDRERVPERVVHARGFGAHGVFTVKNSMKKYTKAAFLQNEGTEVPVFARFSTVIHGTHSPETLRDPRGFSVKFYTEEGNWDFVGNNLPVFFIRDSMKFPDMVHSLKPDPRTNIQDPDRYWDFMTLRPESTNMLMHLFTDEGIPASYRKMRGSSVHAFKWVNAHGNTVYVKLRWVPKVGVHNLSADEATEIQGKDFNHASNDTYQAIEDGEFPEWDLFVQVLDPADVDNFDFDPLDATKDWFEDVIPFQHVGTMVLNKNVDNYFAETESVGFNPGVLIPGMLPSEDKLLQGRLFSYSDTQRYRIGTNYQQLPINCPFAQVNNYQRDGAMPVGQQTSPVNYEPNRYQDEPKQTPEYTEENQPLYDDIHGRLEIEKTNNFGQAGEVYRRMTEEEQTALLNNLVDDLKQVRHENTVLLAICNFYRADESLGKKLSEALQVDIQPFLQQMQK

SEQ ID NO: 5436 - DNA, 2142 bp, Croceibacter atlanticus HTCC2559
  CDS (1)..(2142): transl_table=11
atgagcgataaagaaaatttacagccagattcaaatagtaagacagaccaattatcatcttacacaaaagattctgaaggaaaaaacttaaccactaaccaaggtttaaaagttaacgataccaataattctttaaaagcaggagaacgcggttctacccttttagaggattttttattacgtgaaaaaataacaagttttgatcacgaaagaataccagagcgcatagtacacgcacgaggaagtgctgcacatggtcattttgaactctataaaagtattgagaaatataccaaagcaggcctttttacagatacctctaaaaaaacgcctgtatttgtaagattttcaacagttgcaggttctaagggatctccagatttggcaagagacgttcgtggttttgcagtaaagttttacacagaagaaggtacttgggatttggtaggtaataacatgcctattttctttatacaagatgctatgaagtttccagacttaatacattctgtaaagccagaaccaaataatgaaattccgcaggcagcttctgcacacgatacgttttatgattttgtgtctcacgcgcctgaaactttgcataaccatatttgggcaatgagtgatagagccataccaagaagttaccgaatgatggaaggttttggtatacatacattcagatttattaataaagaagggaaatctcactttgtaaagtttcattggaaacctgtactaggtgtacattctgtaacttgggaagaagcagttaaaattaatggtgtagatgccgattttcaccgtcgtgatctttgggaagctattgaagcaggacaatatccagaatgggaatttggtatacaagtagttcctgaggaagatgaacataaatatgattttgacttattagatcctaccaaattaattccagaagacatggttcctgttgagattgttggtaagatgacattaaacagaaaccctagtaatttctttgctgagacagagcaagttgcatttttacctggtcatattattcctggtctagatttcacgaatgacccattattacaaggtcgtttattttcttacagagacacacagctttcaaggttaggaagtcctaactttcatcaaataccaattaacagaccagtaacgccagcacacaacaaccaacgcgatggccatatgcaaactgaaattccgaaaggacaaactgcatatttccctaatactttaggtggtggttgtccgcatttagccaaaatggccgaaggtggttttacgtcttacgaagaacgtattgatgccaagaaagtaagaacacgaagtgaaagctttagtgaccatttctcacaaccagcattattttatagaagtttggaagaatgggaaaagaaacatgtagcaaacgcctactcttttgaacttggtaagtgtaaccaaaagcatattaaagaacgtatgctatggctaataaatcaaatagatgaagaccttgctaatactgtttcagagaacttaggcttatctattccagatgatattgaacagccaataaatcaatcaattggtgcagatgcagatgttgagaagtttcaaccttcagccaaaaaagtgtatctagaaaaagacaaatcattaagtcaagctcatacaaagtttgatagtatagcaacgagacaaattgctgtattagctgcaaatggcttttctatggatgactttaaaacatttacagatgctttagaagatgaaggtgctgtttgcaaaattattgctccgcatggtggtacaattaaatgtgaccaagatatggatcacgaggttgatgcagcaatatcgacaaccgaaagcgttctttttgatgctatttttgtacctggcggaaaagactctgttgataaactacttaaaactggtaaatattctaagtttataagtgaagcttttaaacattgtaaagctattgcagtttgcaatgaaggtgaagaattacttaaaaacagttatataaaatcttatgacgatgataaagctgtttttgtaaatggaaaacctaaaaactttattgatgctattgcccaacatagaaattgggaccgtatggaagcagcatcagatattccagtataa

SEQ ID NO: 5437 - protein, 713 aa, Croceibacter atlanticus HTCC2559
MSDKENLQPDSNSKTDQLSSYTKDSEGKNLTTNQGLKVNDTNNSLKAGERGSTLLEDFLLREKITSFDHERIPERIVHARGSAAHGHFELYKSIEKYTKAGLFTDTSKKTPVFVRFSTVAGSKGSPDLARDVRGFAVKFYTEEGTWDLVGNNMPIFFIQDAMKFPDLIHSVKPEPNNEIPQAASAHDTFYDFVSHAPETLHNHIWAMSDRAIPRSYRMMEGFGIHTFRFINKEGKSHFVKFHWKPVLGVHSVTWEEAVKINGVDADFHRRDLWEAIEAGQYPEWEFGIQVVPEEDEHKYDFDLLDPTKLIPEDMVPVEIVGKMTLNRNPSNFFAETEQVAFLPGHIIPGLDFTNDPLLQGRLFSYRDTQLSRLGSPNFHQIPINRPVTPAHNNQRDGHMQTEIPKGQTAYFPNTLGGGCPHLAKMAEGGFTSYEERIDAKKVRTRSESFSDHFSQPALFYRSLEEWEKKHVANAYSFELGKCNQKHIKERMLWLINQIDEDLANTVSENLGLSIPDDIEQPINQSIGADADVEKFQPSAKKVYLEKDKSLSQAHTKFDSIATRQIAVLAANGFSMDDFKTFTDALEDEGAVCKIIAPHGGTIKCDQDMDHEVDAAISTTESVLFDAIFVPGGKDSVDKLLKTGKYSKFISEAFKHCKAIAVCNEGEELLKNSYIKSYDDDKAVFVNGKPKNFIDAIAQHRNWDRMEAASDIPV

SEQ ID NO: 5438 - DNA, 1518 bp, Sulfitobacter sp. EE-36
  CDS (1)..(1518): transl_table=11
atgaccgacaagaagcaaacccctcccacaaccacagacgccggcattcgcgttcaaagcgatgaacattcgctgaccgttggccccgatggccccatcgtgctgaatgaccactatctgcttgaacagatggcgaattttaaccgtgaacgtattccagagcgccagccccacgccaaaggctcgggcgcatttggcaccttcgagacgacgcaagacgtgtcgaagtacacgatggcgaatatcttccagcccggcgcgaaatgcgatgtggtgatgcggttttcgaccgttgcaggcgaacgcggcagcccggatacatggcgcgacccgcgcggcttctcgatcaagatgtacaccgacgaaggcatctttgacatggtcggcaacaacaccccgatcttctttgtccgcgatccgatcaagttccagcagttcatccgcagccagaagcgccgtgcggataacaacatgcgcgaccacgatatgcagtgggatttctggacgctctcgcccgaaagcgcgcatcaggtgacctatcttatgggcgaccgtggcattccgaaaaactggcgcgagatgaacgggtattccagccacacctattcgctggtcaacgccgagggtgaaaagttctgggtcaagttccacttccacaccgatcagggcgacggcaatgcctaccttagccaggatgaagccgacaagctggccgggaccaacggcgactaccaccgcgccgatctgttcaacaacatccgcgacgggaactaccccagctggacgctcaagtggcagatcatgccttacgaggatgccaagacctatcgcatcaacccgtttgatctgaccaaggtctggccgcacgaggactacccgctgatcgaggtcggcaagctgaccctgaaccgcaaccccactgatttccatacagagatcgaacaggccgcgttcgagccaaacaatatggtgccgggcgtcggtctgtcgccagacaagatgctgttggcgcggggtttttcctacgctgacgcgcaccgcgcgcggctgggtgtcaactacaaacagattccggtcaataagcccgtctcgccgacccatagctattcgaaagacggcgcgggccggactgaaaaagtgtctgatccggtatatgcgcccaactcctacggtgggccctccgcgcagccgcatcagcatgaagcgggcctgtggtattccgatggcgacatggtgcgtcaggcctataccctgcgccccgatgacgatgattggagccaagccggcaagctcgtccgcgaggtgatggacgccgatgcccgcgcgcgtctggtatcgaacgtggtggggcacctgtgcgacggtgtcagcgaaaaggtgctcgtccgtgcctttgaatactggcgcaacatcgacaaagacaccggcgacaagatcgaggccggtgtgcgcgagaagctgggcggggaatccaaagcccccggcatggcctctgccctcagcatcggcggcaagtaa

SEQ ID NO: 5439 - protein, 505 aa, Sulfitobacter sp. EE-36
MTDKKQTPPTTTDAGIRVQSDEHSLTVGPDGPIVLNDHYLLEQMANFNRERIPERQPHAKGSGAFGTFETTQDVSKYTMANIFQPGAKCDVVMRFSTVAGERGSPDTWRDPRGFSIKMYTDEGIFDMVGNNTPIFFVRDPIKFQQFIRSQKRRADNNMRDHDMQWDFWTLSPESAHQVTYLMGDRGIPKNWREMNGYSSHTYSLVNAEGEKFWVKFHFHTDQGDGNAYLSQDEADKLAGTNGDYHRADLFNNIRDGNYPSWTLKWQIMPYEDAKTYRINPFDLTKVWPHEDYPLIEVGKLTLNRNPTDFHTEIEQAAFEPNNMVPGVGLSPDKMLLARGFSYADAHRARLGVNYKQIPVNKPVSPTHSYSKDGAGRTEKVSDPVYAPNSYGGPSAQPHQHEAGLWYSDGDMVRQAYTLRPDDDDWSQAGKLVREVMDADARARLVSNVVGHLCDGVSEKVLVRAFEYWRNIDKDTGDKIEAGVREKLGGESKAPGMASALSIGGK

SEQ ID NO: 5440 - DNA, 1533 bp, Alteromonadales bacterium TW-7
  CDS (1)..(1533): transl_table=11
atgaaaactcaaataaacacaacaaaaactaaattaactttaagcgcattagcccttgcagtggcattacctgcaagtgcggttaccactcttacaaaagacaacggcgcagctgttggcgataatcaaaactcaatgaccgccggtgagcgcggcagtgtattgcttgaagacgtacacctaattcaaaagctgcaacgttttgcacgcgagcgtatccctgaacgtgtagtgcatgcgcgaggaactggcgcacacggcgtgtttgtagcctcaaaagaactagacgatttaacaattgcggtgccatttgcagaagcaggtaaagaaacagacgtatttgttcgtttttcatcagtaattcactcaaaaggtagccctgaaacgctgcgtgatcctcgtggttttgctacaaaattttacacagaccaaggtaattgggatttagtaggtaacaacttacctgtgttctttatccgtgacgcgattaaattcccagatatggttcactcgttaaagccatctccggtagataatattcaagatcctaaccgcttatttgagtttttctcatacgagccgggctctactcacatgttaacgtgggtatacagcgactacggtacaccagcaagcttacgtaaaatggatggttggggcgtacatgcatataaaatgattaataaatcaggcgatgttaaatacgttaagtttcattgggtaagccaacaaggtatcgacaacctagatgctaaagaagtagccgaagtacaaggaaaagattttcaacacttaacacgcgacctgtacaccgaaattggtaaaggcaacttccctaagtgggacctatacattaaaacacttgacccatcgcagttagatgactttgattacaacccattagatgcaacaaaaatgtggttagacgttaaagaaacaaaagtgggtacaatgaccttaaaccgtatgccaactaacttctttcaatctacagaacaagttgcaatggcaccggcaaatgtaatcccgggtattgagccatctgaagacagactattgcaagggcgtgtgttttcatactcagatacacaaatgtaccgcttaggtgctaaccaccaacaattgccaattaaccgcgcaaaagttgatgtggttaactacaaccaagacggcgcaatgaactacggtaatacaacaagtaatgtgaactaccaaccaagtcacgaaaacgtagcagaaaacccaattgcacgtagaagcaacactgaacttaaaggttttgtacaacaagccgcgattaaaaagcagcaaaacttcgcacaagctggcgtactttaccgtggctttagtaagcaagagcgcactaacttagttaacaacttagctggcgatttaggcaaagtaaaagacagcaaagttatgcacaaaatgctcagccacttttacaaagccgacagcgagtacggtacacgtttaactaaagccgtaaatggcgatattaaaatggttaaacaactagccgctaaactttaa

SEQ ID NO: 5441 - protein, 510 aa, Alteromonadales bacterium TW-7
MKTQINTTKTKLTLSALALAVALPASAVTTLTKDNGAAVGDNQNSMTAGERGSVLLEDVHLIQKLQRFARERIPERVVHARGTGAHGVFVASKELDDLTIAVPFAEAGKETDVFVRFSSVIHSKGSPETLRDPRGFATKFYTDQGNWDLVGNNLPVFFIRDAIKFPDMVHSLKPSPVDNIQDPNRLFEFFSYEPGSTHMLTWVYSDYGTPASLRKMDGWGVHAYKMINKSGDVKYVKFHWVSQQGIDNLDAKEVAEVQGKDFQHLTRDLYTEIGKGNFPKWDLYIKTLDPSQLDDFDYNPLDATKMWLDVKETKVGTMTLNRMPTNFFQSTEQVAMAPANVIPGIEPSEDRLLQGRVFSYSDTQMYRLGANHQQLPINRAKVDVVNYNQDGAMNYGNTTSNVNYQPSHENVAENPIARRSNTELKGFVQQAAIKKQQNFAQAGVLYRGFSKQERTNLVNNLAGDLGKVKDSKVMHKMLSHFYKADSEYGTRLTKAVNGDIKMVKQLAAKL

SEQ ID NO: 5442 - DNA, 1440 bp, Pseudomonas putida GB-1
  CDS (1)..(1440): transl_table=11
atgagcaagattcttactaccgccagcggtgcgccagtagccgataaccagaactcccgctccgccggcccgcgtggcccattgttgctcgacgactttcacctgatcgagaaactcgcccacttcaaccgcgagaacattcctgagcgccgtgtgcacgccaagggctcgggcgcctatggcacctttactgttacccgcgacattaccggctataccagcgccaagctgtttgaacagatcggcaaacagaccgagaccttcctgcgcttctccactgtcggtggcgagcgtggctctgcggataccgagcgcgacccgcgtggtttcgcggtcaagttctacaccgaagaaggcaactgggacatcgttggcaacaacacgcccgtgttcttcattcgcgacccgctgaagttcccggactttatccacacccagaagcgccacccgcagtccaacctgaagaatgcccagatgatgtgggacttctggtcccactcccctgaggcgctgcaccaggtcaccatactgttttccgaccgtggtatcccggatggctatcgccacatgcacggcttcggcagccacacctacagcctgatcaatgccaagggtgagcgtacttgggtgaagtggcacttcaagacccaacaaggcatcaagaacctcgctccggcagaagcagcgcgcctggcgggtactgacccggactacgcccagcgcgacctgttcgaagcgatcgagcgtggcgactacccgcgttggacggtttgtatccaggtgatgagcgaagccgaggctgcgagtcgcgacgagaacccctttgacgtgaccaagacttggtcgcagagggactacccgctgatcgaggtgggcgtgctggagctcaaccgtaacccgctcaactacttcgcggaagtcgagcaagcagcgttcgggcccagcaatatggtgccaggggtcggcctgtcgccggaccggatgttgcagggccgtgtattcgcctacgccgacgcgcaccgttaccgcgtgggcaccaaccaccagcagttgccggtgaatgcgcctcgctgcccggttaatagctaccagcgcgacggttccatggccactggcagctacggcagtgcaccaaactacgagcccaatagccacgttgatgcgccgaagcagtcgccacgccatgccgagccagcgctggccttgaacggttcggcggaccgttacgatcaccgtgaggacaccgactacttcagccacgccggcgcgctgttccgcttgatgaacgctgagcagaaagccctgttgatcagcaacatcgccggtaccatggtgggtgtcagcgaggacgtgattcagcgtcagttgcagtacttcttcaaggccgatccggcctatggcgaagggattgccaaggcgttgggcgtccatctcgcctaa

SEQ ID NO: 5443 - protein, 479 aa, Pseudomonas putida GB-1
MSKILTTASGAPVADNQNSRSAGPRGPLLLDDFHLIEKLAHFNRENIPERRVHAKGSGAYGTFTVTRDITGYTSAKLFEQIGKQTETFLRFSTVGGERGSADTERDPRGFAVKFYTEEGNWDIVGNNTPVFFIRDPLKFPDFIHTQKRHPQSNLKNAQMMWDFWSHSPEALHQVTILFSDRGIPDGYRHMHGFGSHTYSLINAKGERTWVKWHFKTQQGIKNLAPAEAARLAGTDPDYAQRDLFEAIERGDYPRWTVCIQVMSEAEAASRDENPFDVTKTWSQRDYPLIEVGVLELNRNPLNYFAEVEQAAFGPSNMVPGVGLSPDRMLQGRVFAYADAHRYRVGTNHQQLPVNAPRCPVNSYQRDGSMATGSYGSAPNYEPNSHVDAPKQSPRHAEPALALNGSADRYDHREDTDYFSHAGALFRLMNAEQKALLISNIAGTMVGVSEDVIQRQLQYFFKADPAYGEGIAKALGVHLA

SEQ ID NO: 5444 - DNA, 1446 bp, Bacillus subtilis
  CDS (1)..(1446): transl_table=11
atgagttcaaataaattgacaaccagctggggcgctcctgtcggagataaccaaaactcaatgacggccggcgatcgcggtcctgctttaatacaagacgtccatctgcttgagaaattggcgcactttaacagagaacgcgttcccgagcgtgtcgttcacgcaaaaggcgcgggcgcacacggttattttgaagtcacaaatgacgttacaaaatatacgaaagccgcatttctgtcagaagtcggtaaacgcacgccgctcttcatccgtttctcaaccgttgcgggcgaactgggctctagtgacacagtgcgcgacccgcgcggatttgccgttaagttttatacagaagaaggaaactacgacatcgtcggaaacaatacacccgtgttcttcatccgcgatgccatcaagttccctgactttatccatacacaaaaaagagatccgagaacacatctgaaaaacccgacggccgtttgggatttctggtctctgtcaccggaatccctgcaccaggtaaccattctgatgtcagaccggggcattccggcgactcttcgccatatgcacggattcggaagccatacatttaaatggacaaatgataaaggcgaaggcgtctggatcaaatatcactttaaaacagagcaaggcgtgaaaaaccttgatgttaatacagccgcaaaaatcgcgggcgaaaatcccgattaccatacggaagatttgttcaatgcgattgaaaacggcgatttccccgcatggaaattatatgttcaaatcatgccgttagaagacgcaaacacatatcgctttgatccgtttgacgtcacaaaagtatggtctcaaaaagactatccgctcattgaagtcggccgcatggttctgaaccgcaatccggaaaattactttgcggaagtagaacaggcgacgttctctcccggcacattagtccccggcgtcgacgtctcacctgacaaaatgcttcaaggccggttgttcgcataccatgacgcgcatcgctaccgtgtcggcgcgaaccatcaggcgctgccgatcaaccgttcccgcaatgaagtgaaaaactatcagcgtgacggacaaatgcgttttgatgataacggcggccgctccgtctattacgagcctaacagtttcggcggcccgaaagagtcacctgaagataaacaggcggcatatcctgtatcaggtttcgctgacagtgtaagctataatcatcatgatcattacacacaagccggcgacctgtaccgcctgatgagtgaggaagagcgcgcgcgccttgttgccaatatcgtcagtgcgatgaaacctgtggaaaaagaagaaattaagctgcgccagatcggccacttctacaaagctgatcctgaatacggcagacgcgttgccgaaggactcggactgccatcaccaaaataa

SEQ ID NO: 5445 - protein, 481 aa, Bacillus subtilis
MSSNKLTTSWGAPVGDNQNSMTAGDRGPALIQDVHLLEKLAHFNRERVPERVVHAKGAGAHGYFEVTNDVTKYTKAAFLSEVGKRTPLFIRFSTVAGELGSSDTVRDPRGFAVKFYTEEGNYDIVGNNTPVFFIRDAIKFPDFIHTQKRDPRTHLKNPTAVWDFWSLSPESLHQVTILMSDRGIPATLRHMHGFGSHTFKWTNDKGEGVWIKYHFKTEQGVKNLDVNTAAKIAGENPDYHTEDLFNAIENGDFPAWKLYVQIMPLEDANTYRFDPFDVTKVWSQKDYPLIEVGRMVLNRNPENYFAEVEQATFSPGTLVPGVDVSPDKMLQGRLFAYHDAHRYRVGANHQALPINRSRNEVKNYQRDGQMRFDDNGGRSVYYEPNSFGGPKESPEDKQAAYPVSGFADSVSYNHHDHYTQAGDLYRLMSEEERARLVANIVSAMKPVEKEEIKLRQIGHFYKADPEYGRRVAEGLGLPSPK

SEQ ID NO: 5446 - DNA, 1660 bp, Corynebacterium equii
  CDS (107)..(1624): transl_table=11
cacagtccgttaccagctcacagaatcaagacgatgtgcccggatcgggtgggtcgatcacttcgaagacagccacagcccgtcagcgccaaggaggcttcgcacaatgacgtccattcagccacgtcccacgacgaacgacttcgggattcccgtcaacagcgacaacgaatccctcaccgccgggacgcagggacccattctcctgcacgaccactacctgatcgagaagctcgcgcacttcaaccgtgagcgggtgcccgagcgtgtcgtgcacgccaagggtggcggcgcattcggcgagctggtcatcaccggagacgtcagcaagtacacgaaggcgaagttccttcagccgggcaagaagacggagtcgctggtgcgcttctccaccgtcgccggcgagcagggcagccccgacacgtggcgcgacccgcgcggcttcgcgatgaagttctacaccgaggacggcaactacgacctcgtcggcaacaacacgccggtgttcttcatcaaggatccgatcaagttcccggacttcatccactcgcagaagcggctgcccgggtccggtctgcgcgaccacaacatgcagtgggatttctggacgctgtctcccgagtccgcacaccaggtgacatggctgatgggcgaccgcggtatccccaacacgtggcggcacatgaacgggtattcgagccacacgtacatgtgggtgaacgcgcagggcgagcggttctgggtgaagtaccacttcaagaccgaccagggcatcgagttcttcacgcaggacgagggcgaccagatggccgccatggacaccgactaccaccagcgggacctgtgggagcacatcgacggcggcgactaccccacctggacgctgaagatgcagatcatgccgtacgaggaggccaagacctaccggttcaatccgttcgatctcaccaaggtgtggccgcacgccgactacccgctgatcgacgtcggcaccatgaagctggaccgcaacccggccgactaccactgcgagatcgagcaggccgccttcgagccgagcagttcggtgccgggcaccgggccgagccccgacaagatgctgctcggtcgatggttctcctacccggacgcgcaccgctaccggatcggatccaattacaaggagttgccggtcaattcgccgcatgccgggccgcggaactcgtacaccaaggacgggcaacttcggcaccacaatccgggcgatccggtgtacgtaccgaactcgaagggcggcccgcacgccgacatctcggtgtccggcgagtcccccggctggtacaccgacggcgagatggtccaccaggcgtacacgctccgcaaggacgacgacgactggggtcaggccggcacgatggtgcgcgacgtcctcgacgacgcggcccgcgaacggctggtgtcgaacatcgtggggcacctgctcaacggagtcaccgagccggttctcgtgcgcgccttcgactattggcgcaacgtcgacaaagacctcggggagcgggtcgagaagggcgtccggaccgcgcagaacggaaacgcgtcgagtgatcggaacccggccagtcccgcagcggaggccaaggcttgatgtccgattgatcccgtatccgtgatagacagcttc

SEQ ID NO: 5447 - protein, 505 aa, Corynebacterium equii
MTSIQPRPTTNDFGIPVNSDNESLTAGTQGPILLHDHYLIEKLAHFNRERVPERVVHAKGGGAFGELVITGDVSKYTKAKFLQPGKKTESLVRFSTVAGEQGSPDTWRDPRGFAMKFYTEDGNYDLVGNNTPVFFIKDPIKFPDFIHSQKRLPGSGLRDHNMQWDFWTLSPESAHQVTWLMGDRGIPNTWRHMNGYSSHTYMWVNAQGERFWVKYHFKTDQGIEFFTQDEGDQMAAMDTDYHQRDLWEHIDGGDYPTWTLKMQIMPYEEAKTYRFNPFDLTKVWPHADYPLIDVGTMKLDRNPADYHCEIEQAAFEPSSSVPGTGPSPDKMLLGRWFSYPDAHRYRIGSNYKELPVNSPHAGPRNSYTKDGQLRHHNPGDPVYVPNSKGGPHADISVSGESPGWYTDGEMVHQAYTLRKDDDDWGQAGTMVRDVLDDAARERLVSNIVGHLLNGVTEPVLVRAFDYWRNVDKDLGERVEKGVRTAQNGNASSDRNPASPAAEAKA

SEQ ID NO: 5448 - DNA, 2500 bp, Candida dubliniensis
  CDS (1043)..(2500): transl_table=12
cgttagaacgcgtaatacgactcactatagggagatctagaaatgggtcattgcttaataatcataattttgggtgatagaaaaacatcagcaactacacacagaacgagaaaacagggctttaacatgcaaagcaactataatctgatatgcttgcccctaatgagttgattggtgttcacacacatacacactctgcaatgctttacaacagacataattagtttaaaaagaaatatacaacctcccccctgttaattagttaaatatgtggtgtgatgaattggagccggttccattggtgcacactatagctagatgaagtgaactggggtaattctaaaaaagaaaaaataaaaaaaaaaaaagacattgttgaaaattaaacgcgaaaatggaagggagtgattataccgtggaagtttatcatagttaattgtttttttttggggaagtcaaaccaaaaaaaaaaaaaaagttttagccaatgatcgagtacttataactaatacaaataatagctcttcacagtagtatttactaagaaacattttcagaaattgataccacaatgtagttgaagacacgtagtttccaattcagatatttatccctacatatatgtagccaatgatgtcattagaatcaaatcaagagtaagaactaggtgcttaataatcaaaatgaacaaaaatataaaaaaaaagatagtcctgtatataaccaagaagtctggatctttcaattgattgataatcccacatgaaaaaacaacgaccacagttaatgtattgtctttgttagtgaaagattaattagtaaaatttgtatccccgctaaattttttttattccatcaattcttatagattatataaataccccttgaaagttaccaataaaatttcaacaattacaaatttcttcttctcctctttatttttccctttttccttttttattgaaaatattatattcctttatcagttttgatttagatcttttttttttatttcctcacatatatatttaaattatttattatggctccaacattcacgaattctaacggtcaaccaattccagaaccatttgccactcaaagagttggtcaacacggtccattgttgttacaagactttaacttgattgattcattggctcattttgacagagaaagaatccctgaaagagttgtccacgctaaaggttcaggtgcttatggtgttttcgaagtcactgacgatatcactgatgtttgtgctgctaaatttttggatactgttggtaagaaaactagagttttcaccagattctccactgttggtggtgaattaggttctgctgataccgctagagacccaagaggttttgctaccaaattttacactgaagaaggtaacttggatttggtttacaacaacactccagtgtttttcatcagagatccatctaaattcccacatttcatccacacccaaaaaagaaatccagaaacccacttgaaagatgctaacatgttttgggattacttgactagcaatgaagaatccattcatcaagttatgattttgttctccgacagaggtactccagcttcttacagagaaatgaatggttactctggtcacacctacaaatggtccaacaaaaaaggtgaatggttttacgttcaagttcatttcatcagtgatcaaggtattaagactttgaccaatgaagaagcaggtgctttagctggatctaacccagattacgctcaagaagatttgttcaagaacattgctgctggtaactacccatcatggactgcttatatccaaaccatgactgaagccgaagctaaagaagctgacttttctgtgtttgatttgaccaaagtttggccacacaagaagtatccattgagaagatttggtaagtttactttgaatgaaaatccaaagaattactttgctgaagttgaacaagctgctttctctccagcccatactgttccatacatggaaccatctgctgatccagtcttgcaatcaagattgttctcttatgctgatacacacagacacagattgggtaccaactacactcaaatcccagtgaattgtcctgtcaccggtgctgttttcaacccacacatgagagacggtgctatgactgttaatggtaatttgggtagccatccaaactacttggctagtgacaagccagttgaatttaaacaattctctctccaagaagaccaagaagtttggaatggtgctgccactccattccactggaaagccaccccagctgatttcaaacaagctcaagaattatggaaagtgttgaagagatatccaaaccaacaagaacatttggcccataacattgctgttcatgctgctggtgctgatgctgcaatccaagacagagtgtttgcatactttggtaaagtctctcaagatttggctaatgctatcaagaaggaagttttggaattatctccaagaaaataa

SEQ ID NO: 5449 - protein, 485 aa, Candida dubliniensis
MAPTFTNSNGQPIPEPFATQRVGQHGPLLLQDFNLIDSLAHFDRERIPERVVHAKGSGAYGVFEVTDDITDVCAAKFLDTVGKKTRVFTRFSTVGGELGSADTARDPRGFATKFYTEEGNLDLVYNNTPVFFIRDPSKFPHFIHTQKRNPETHLKDANMFWDYLTSNEESIHQVMILFSDRGTPASYREMNGYSGHTYKWSNKKGEWFYVQVHFISDQGIKTLTNEEAGALAGSNPDYAQEDLFKNIAAGNYPSWTAYIQTMTEAEAKEADFSVFDLTKVWPHKKYPLRRFGKFTLNENPKNYFAEVEQAAFSPAHTVPYMEPSADPVLQSRLFSYADTHRHRLGTNYTQIPVNCPVTGAVFNPHMRDGAMTVNGNLGSHPNYLASDKPVEFKQFSLQEDQEVWNGAATPFHWKATPADFKQAQELWKVLKRYPNQQEHLAHNIAVHAAGADAAIQDRVFAYFGKVSQDLANAIKKEVLELSPRK

SEQ ID NO: 5450 - DNA, 1548 bp, Saccharomyces cerevisiae
  CDS (1)..(1548)
atgtcgaaattgggacaagaaaaaaatgaagtaaattactctgatgtaagagaggatagagttgtgacaaactccactggtaatccaatcaatgaaccatttgtcacccaacgtattggggaacatggccccttgcttttgcaagattataacttaattgattctttggctcatttcaacagggaaaatattcctcaaaggaatccacatgctcatggttctggtgccttcggctattttgaagtaaccgatgacattactgatatctgcgggtctgctatgtttagtaaaattgggaaaagaacgaaatgtctaacaagattttcgactgtgggtggtgataaaggtagtgccgacacggttcgtgatccaagggggtttgccaccaaactctacactgaagaaggtaatttagattgggtctacaataatacaccggtattctttatcagagacccttccaagttccctcactttatccacacacagaagagaaacccacaaaccaacctaagggatgctgacatgttttgggatttcctcaccactcctgaaaatcaggtggccattcatcaagtaatgatccttttttcagaccgtggtacccctgccaactaccgtagtatgcatggttattctggtcatacctataaatggtccaataaaaacggagattggcattatgtgcaagttcatatcaaaaccgatcaaggaataaagaatttgaccatagaagaggctaccaaaattgcgggatccaatccagattactgccagcaggatttatttgaggctattcagaatggaaactatccttcctggacagtttatattcaaacaatgaccgaacgcgatgccaaaaaattaccattttcagtctttgatttgactaaagtatggcctcaggggcaattccctttacggcgtgtgggtaagattgttttgaacgagaatccactgaacttcttcgcacaggtggaacaagctgccttcgcccccagtaccacggttccttaccaagaagcaagcgctgatccagtattacaggcccgtttgttttcatatgcggatgctcatagatacaggctaggtcctaacttccatcaaatacccgtaaactgtccatatgcatctaaatttttcaatcccgctatcagagatggaccgatgaatgttaacggcaacttcggctcagaacctacatatttggccaacgataaatcgtacacgtatatccaacaggacagacccattcaacaacaccaagaggtatggaatgggccagctatcccttatcattgggcaacatccccaggtgatgtagatttcgtgcaagcaagaaatctctaccgcgttttgggtaaacaacctggacagcaaaagaacttggcatataacatcggcattcatgtagaaggcgcctgtcctcaaatacagcagcgcgtttatgatatgtttgctcgtgttgataagggactatctgaggcaattaaaaaagtagctgaggcaaaacatgcttctgagctttcgagtaactccaaattttga

SEQ ID NO: 5451 - protein, 515 aa, Saccharomyces cerevisiae
MSKLGQEKNEVNYSDVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKLYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAEAKHASELSSNSKF

SEQ ID NO: 5452 - DNA, 2073 bp, Antonospora locustae
  CDS (1)..(2073)
atggaagacagcaagagcagtgaaaacaaaaacctggcagatactaagaaaacaccagaaacacaccagcaggcaggtggaaataccccagtgatgaccaccgcacaggggataccaatcgcagacggacagaactctctacatccgtcaccatgcggccctactctcctcgaggatttcatataccgcgagaagatatttcactttgaccatgaacgcgttcccgagcgtgtagtccatgcccgtggctttggagcacatgggtacctggaaattcttgagccaattccccagtacacgaaggcagacatttttcagcgtacaggaagaacaccagcttttgtacgcttctccacagcgctgggcagcaagggctctcctgacctagccagagacgtgaggggctttgcagttaagatatacacaagaaagggaaactgggacattgtgggaaacaacatacccgttttctttgtccaggaggcaatcaagtttcccgacataatccatgcaggcaaggaagagcccgatagcggctttccacaggcacaaacagcacatgacagcttctgggacttcattagcctcaaccccgagtctctgcacatcacaatgtgggcaatgtcggacagagggattccgcgttccttccgattcatggagggctttggtgtccacacatttcgccttgtcaacgcaaaaaacgagtacacgtttgtaaagttccactggaagcccagactagggctgcagtccgtgacatggagcgaggcacagcggctcaacggcgcagacccggactttcatcggcgtgatttgtggaatgcaatcaaaacgggaaactatcccgagtgggacctaggtctccagatatttagcgaggagactgcaaagacatttgactttgatgtcttagatgcgacaaagctcattccagaagaacttgtgcctgtgagaagagtcgggcgccttgtcttggaccgctgtgtcgacaacttctttgcagagacagaacaggttgcattttgcacagcgaacatcgtgcccggcatcgacttcaccgacgaccctctgttgcagggaagaaacttctcgtatctggacacacaactgagccgcctgggcagtccaaacttcacccagctgccaataaacgcacccaagtgtcctgtgcgtcactttcaacaggacgggcgcatggccttttacaacatcattgggcctgcaaactacgagcccaactctttgggagacaagggcggtccgcgagagtcgcccgaagaggggtttgtgtcgtacccagcaaaggccacggggccaaagatgcgcgtgcgcccaagcagcttttcagaccactacagccaggccacgctgttctacaacagtcagacagatattgaacagaggcacatacagagcgcgttcacatttgagctgagcaaggtcaccagcccggccatacagatgcgtgtcatttcgcatctgctaaacatcaacgaggaccttgcaaaaaacattgctcacaacctaggcgtgagggagctgccaaagccagcgcccatgttggtgcccaaaaaggagggaataaaggaatcccctgcactgagcataataaaaaacggccctgtgacatttaagggaagaaggcttgggctgcttgtctccgaaaatagcgatttctcgctgattgatggtatagacacgcggatgaaaatggaggaggcagagcttgtagtgattgccccaaagatccagggcctccgcactgaaagcagtgggtggagaaagccttcacagtgtcttcagagcacacttgctgcctggtacgacgcagttgcattgcttttatcaacagcggacttgaagaaaatggacgggcctgcactggtcagctttgtccaagatagctactacaactacaagttcattgccttttcaggtgacgtggctcctctaatggaaagacttggtattcagaaggacgatggcatggttgaaataagggacaactgcgactgggatacgtttattacaaagtgcaggaagcttcgctactggcaaagaaaaatttga

SEQ ID NO: 5453 - protein, 690 aa, Antonospora locustae
MEDSKSSENKNLADTKKTPETHQQAGGNTPVMTTAQGIPIADGQNSLHPSPCGPTLLEDFIYREKIFHFDHERVPERVVHARGFGAHGYLEILEPIPQYTKADIFQRTGRTPAFVRFSTALGSKGSPDLARDVRGFAVKIYTRKGNWDIVGNNIPVFFVQEAIKFPDIIHAGKEEPDSGFPQAQTAHDSFWDFISLNPESLHITMWAMSDRGIPRSFRFMEGFGVHTFRLVNAKNEYTFVKFHWKPRLGLQSVTWSEAQRLNGADPDFHRRDLWNAIKTGNYPEWDLGLQIFSEETAKTFDFDVLDATKLIPEELVPVRRVGRLVLDRCVDNFFAETEQVAFCTANIVPGIDFTDDPLLQGRNFSYLDTQLSRLGSPNFTQLPINAPKCPVRHFQQDGRMAFYNIIGPANYEPNSLGDKGGPRESPEEGFVSYPAKATGPKMRVRPSSFSDHYSQATLFYNSQTDIEQRHIQSAFTFELSKVTSPAIQMRVISHLLNINEDLAKNIAHNLGVRELPKPAPMLVPKKEGIKESPALSIIKNGPVTFKGRRLGLLVSENSDFSLIDGIDTRMKMEEAELVVIAPKIQGLRTESSGWRKPSQCLQSTLAAWYDAVALLLSTADLKKMDGPALVSFVQDSYYNYKFIAFSGDVAPLMERLGIQKDDGMVEIRDNCDWDTFITKCRKLRYWQRKI

SEQ ID NO: 5454 - DNA, 1458 bp, Porphyromonas gulae
  CDS (1)..(1458): transl_table=11
atggaaaagaacaaacttactacagctgcgggtgcccccgtagcagacaatcagaatgtggccactgcaggcaagcgtggtcctatgcttctgcaggatgtctggtttttggaaaagctggctcacttcgatcgtgaagtgatccccgaacgtcgtatgcatgccaaaggttcgggagctttcggcacatttactgtcactcatgacatcaccaagtacacgaaggcggctattttctccgaaatcggcaagcagaccgagctgtttgtacgcttctcgactgtggctggagagcgtggtgcggctgatgcggagcgggatatacgtggctttgctatcaagttttatactgaggaaggtaactgggacctcgtaggaaacaatacccccgtatttttcctgagagatcctctcaaattccccgacctgaaccacgtagtaaagcgtgacccacgcaccaatatgaggagtcctcaaaacaactgggacttttggacgcttttgcccgaagctctccaccaggtgactatcacgatgagcgaccgaggtatacctgccagctatcgtcacatgcacggctacggaagccatgcattctcgtttatcaacgccgaaggagtaagacattgggtgaaatttcatctccacactcaacaggggataaagaatctgacagatgcagaggcggaagcattgatcgggaaagatcgtgaaagtcatcagagagacttatttgaaagcattgagcgtggcgactatcctcgttggacgctcaaggtgcagatcatgacggaggaagaagccaaagctttgccgtataatcctttcgacttgacaaaggtgtggtcgcagaaagattttccccttatcgaagttggcgtaatggagctgaaccgcaatccggaaaactacttcgccgatgtggagcagtcggcattcaaccctgccaatgtggtgcccggcattagtttctcacctgacaggatgttgcaggggcgtctgttttcctatggcgatacgcaacgctatcgcctcggcgtgaatcatcaccaaatacctgtgaacaggagtcgttgtcctttcctgaatatgtatcacagggatggagccatgagggtagatggcaacttcggttcgcgtcttggctatgagcctaacagctatgggcactggcaagatcagaatgagtacaaagagccacccctcgaacttgatggtgctgcctatcaatgggatttcagggaagatgacagtgactattattctcagcctcgcaagctcttccatatcatgtcgccggatcagcagcaggtactattcgacaatacggctcgtgccatgggtgatatccccaaagagatcaagctgcgccatatagcgaattgctacaaggccgatccggactatggcaagggagtagcaaaggctttggggcttgacgtaaacgaagcactgtaa

SEQ ID NO: 5455 - protein, 485 aa, Porphyromonas gulae
MEKNKLTTAAGAPVADNQNVATAGKRGPMLLQDVWFLEKLAHFDREVIPERRMHAKGSGAFGTFTVTHDITKYTKAAIFSEIGKQTELFVRFSTVAGERGAADAERDIRGFAIKFYTEEGNWDLVGNNTPVFFLRDPLKFPDLNHVVKRDPRTNMRSPQNNWDFWTLLPEALHQVTITMSDRGIPASYRHMHGYGSHAFSFINAEGVRHWVKFHLHTQQGIKNLTDAEAEALIGKDRESHQRDLFESIERGDYPRWTLKVQIMTEEEAKALPYNPFDLTKVWSQKDFPLIEVGVMELNRNPENYFADVEQSAFNPANVVPGISFSPDRMLQGRLFSYGDTQRYRLGVNHHQIPVNRSRCPFLNMYHRDGAMRVDGNFGSRLGYEPNSYGHWQDQNEYKEPPLELDGAAYQWDFREDDSDYYSQPRKLFHIMSPDQQQVLFDNTARAMGDIPKEIKLRHIANCYKADPDYGKGVAKALGLDVNEAL

SEQ ID NO: 5456 - DNA, 2016 bp, Paracoccidioides brasiliensis
  CDS (157)..(1665)
cctcactgtcccttggactggttgtttggctgcaaatactcctatcaaatcccttatcttctccgtcgagaactcatcgtttcctactactactattgagttcgtatactctcttcgattgattttgttagatattcagtgtcacctaccgccatcatgggtgccgacgttgcgtccagtacttaccgttatactgaaactcccacctacaccacgtccaatggctgcccggtcatggaccctgagtcttcccagcgggtgggaatgaaaggccccctgctcctccaggatttccacctgattgaccttgcccatttcgatcgcgagcgaattcccgaacgagtggtccatgctaaaggtgcaggagcttacggtgaattcgaagtcttggatgatatcagcgacattacggtcattgatatgcttttgggtgtgggaaagaagacaaagtgtattacccgcttctccactgtgggtggagagaaggggtccgccgatagtgctcgcgatcctagagggttctccaccaaattttacaccgagcaaggaaattgggactgggtcttcaacaacaccccagtcttcttcttgcgtgatccatcaaagtttcctatcttcattcatacccagaagagaaacccacagaacaacctgaaggatgctactatgttctgggactacctctccacccatcaggagtccgccaacaggtcatgcatgcatctcttcagtgaccgtggcaccccgatactccctaccggcacatgtaacggtattctaggacaccacattacacagtggaccaagcctgacggaaccttcaactacgtccaaatccactgcaagaccgatcagggcaacaagacctttaacaacgaagaagccaccaagatggccgccgataatccagattggcataccgaagatctattcaaagccatcgagcgcggcgaatacccatcctggacgtgtacgttcaggtcctcagccccgagcaggctagaaatccgctggaatgtcttcgacctgaccaaagtctggcctcaggcggaggtgcccctccgccgcttcggccgcttcaccctctgcgagaacccgcagaactacttcgcggaaatcgaacaggccgccttctcaccctcccacatggtcccgggtgtcgaaccatccgccgaccctgtcctgcaatcccgcctcttctcctatccagacacccaccgccaccgcctgggcgtcaactaccagcagatccctgtcaactgtcctctgcgcgccttcaacccgtaccagcgtgacggtgccatggctatcaatggcaactacggcgccaaccccaactacccatccaccttccgcccgatggagttcaagcccgtcaaggcctgccaggagcacgagcagtgggctggcgccgccttgtcgaagcaaattcccgtcacggatgaggatttcgtccagcccaatggcctctggcaggttcttggacgccagccgggacaacaggagaatttcgttcacaatgtgtccgtccacctctgtggggcacaggagaaagtgcgcaaggccacctactgcatgttttcgcgcattaacgcggaccttggagcgcggattgagaaagccacggagaggttggttgcttctcagccacagtcgcatctgtgagtttgctggtggttataaccaaccagtagatttgcttttccggttagtgaaggggaaatatatgatggtaagagagttaagtgtgtgttacgtaggggaaagacattgatttatatgtagtctttggttcccccccccccctctttttttttttcgtagtgtctgcacccttgcaacgaattattcaatatcccgtaggtaaacccgaaatatctagaaatctaaatagctagatttagttttctacaatgttgaattttaacagagttaaatggtttcgtaccaaaaaaaaaaaaaaaaaaaaaaaaaaaaaaaaaaaaaaaaaaaaaaaaaaaaaaaaaaaaaaaaaaa

SEQ ID NO: 5457 - protein, 502 aa, Paracoccidioides brasiliensis
MGADVASSTYRYTETPTYTTSNGCPVMDPESSQRVGMKGPLLLQDFHLIDLAHFDRERIPERVVHAKGAGAYGEFEVLDDISDITVIDMLLGVGKKTKCITRFSTVGGEKGSADSARDPRGFSTKFYTEQGNWDWVFNNTPVFFLRDPSKFPIFIHTQKRNPQNNLKDATMFWDYLSTHQESANRSCMHLFSDRGTPILPTGTCNGILGHHITQWTKPDGTFNYVQIHCKTDQGNKTFNNEEATKMAADNPDWHTEDLFKAIERGEYPSWTCTFRSSAPSRLEIRWNVFDLTKVWPQAEVPLRRFGRFTLCENPQNYFAEIEQAAFSPSHMVPGVEPSADPVLQSRLFSYPDTHRHRLGVNYQQIPVNCPLRAFNPYQRDGAMAINGNYGANPNYPSTFRPMEFKPVKACQEHEQWAGAALSKQIPVTDEDFVQPNGLWQVLGRQPGQQENFVHNVSVHLCGAQEKVRKATYCMFSRINADLGARIEKATERLVASQPQSHL

SEQ ID NO: 5458 - DNA, 1827 bp, Bacillus subtilis
  CDS (169)..(1620): transl_table=11
ctccaaaaattattaagtgtcataaaaagctgttacaacaagttttttcaacattttcgatactagatatcgattaatagagataactattttataataattataaaataatattgacttttacttagagatgatattatgttcttataaattccaagaggtgataatatgagttcaaataaactgacaactagctggggcgctccggttggagataatcaaaactcaatgactgccggttctcgcggaccaactttaattcaagatgtacatttactcgaaaaattggcccatttcaaccgagaacgtgttcctgaacgtgttgttcacgccaaaggagcaggcgcacacggatattttgaagtgacaaacgacgtaacaaaatacacgaaagccgctttcctttctgaagtcggcaaacgcacaccgttgttcatccgtttctcaacagttgccggtgaacttggctctgctgacacagttcgcgacccgcgcggatttgctgttaaattttatactgaagaaggaaactacgacatcgtcggcaacaatacgcctgtattctttatccgcgatgcgattaagttccctgatttcatccatacacaaaaaagagatccaaaaacacacctgaaaaacccaacggctgtatgggatttctggtcactttcaccagagtcacttcaccaagtgacaatcctgatgtctgaccgcggaattcctgcaacacttcgccacatgcacggcttcggaagccatacattcaaatggacaaatgccgaaggcgaaggcgtatggattaaatatcattttaaaacagaacaaggcgtgaaaaaccttgatgtcaatacggcagcaaaaattgccggtgaaaaccctgattaccatacagaagaccttttcaatgcaatcgaaaacggtgattatcctgcatggaaactatatgtgcaaatcatgcctttagaagatgcaaaaacgtaccgtttcgatccgtttgatgtcacaaaagtttggtctcaaaaagactacccgttaatcgaggtcggacgcatggttctagacagaaatccggaaaactactttgcagaggtagaacaagcgacattttcacctggaacactcgtgcctggtattgatgtttcaccggataaaatgcttcaaggccgactgtttgcttatcatgatgcacaccgctaccgtgtcggtgcaaaccatcaagcgctgccaatcaaccgcgcacgcaacaaagtaaacaattatcagcgtgatggacaaatgcgttttgacgataacggcggcggatctgtgtattacgagcctaacagcttcggcggtccaaaagagtcacctgaggataagcaagcagcatatccggtacaaggcatcgctgacagcgtaagctacgatcacaacgatcactacactcaagccggtgatctgtatcgtttaatgagtgaagatgaacgtacccgccttgttgaaaatatcgttaatgctatgaagccggtagaaaaagaagaaatcaagctgcgccaaatcgagcacttctacaaagcggatcctgaatacggaaaacgcgtggcagaaggccttggattgccgattaaaaaagattcttaatgtagaaatgcaaaaaacgctgtaatcagcgttttttttatatttagttacacattgcgtatgcttctcatcaatcttcatataaatttcttccatgagctccgcgttgtttataatctctcgtttgtttttttcaatcagcagctcaagcggcaaaatctgattcccgtagtttttcgcttcctgaatcgttttctccccttttct

SEQ ID NO: 5459 - protein, 483 aa, Bacillus subtilis
MSSNKLTTSWGAPVGDNQNSMTAGSRGPTLIQDVHLLEKLAHFNRERVPERVVHAKGAGAHGYFEVTNDVTKYTKAAFLSEVGKRTPLFIRFSTVAGELGSADTVRDPRGFAVKFYTEEGNYDIVGNNTPVFFIRDAIKFPDFIHTQKRDPKTHLKNPTAVWDFWSLSPESLHQVTILMSDRGIPATLRHMHGFGSHTFKWTNAEGEGVWIKYHFKTEQGVKNLDVNTAAKIAGENPDYHTEDLFNAIENGDYPAWKLYVQIMPLEDAKTYRFDPFDVTKVWSQKDYPLIEVGRMVLDRNPENYFAEVEQATFSPGTLVPGIDVSPDKMLQGRLFAYHDAHRYRVGANHQALPINRARNKVNNYQRDGQMRFDDNGGGSVYYEPNSFGGPKESPEDKQAAYPVQGIADSVSYDHNDHYTQAGDLYRLMSEDERTRLVENIVNAMKPVEKEEIKLRQIEHFYKADPEYGKRVAEGLGLPIKKDS

SEQ ID NO: 5460 - DNA, 1512 bp, Methanobrevibacter arboriphilus
  CDS (1)..(1512): transl_table=11
atgtcaaataaaaaaaaattcacaacaaataaaggaattcctgtacctaatgatcaggcatccattaccacaggtaaaggatcaaattatacaatgttaggagattctcatttaactgagaaacttgcgcatttcggtagagaaagaataccggaaagagtcgttcatgcgaaaggaactggggcttatggatattttgaagttacaaatgacctttcaaaatatactagagctaaatttctttcagaagttggtaaaaaaactgaggtttttataagattctctaccgttgggggagaaagaggttctgctgatgcaaaaagagatcctcgtggaactgctatgaaatattatactgaagaaggaaattatgatcttgttggaaataatactcctattttctttattagagatgcaataaagttcccagattttatccacactcaaaagagaaaccctaaaaataatctatctgatgctgatatgttttgggattttatgtccttaacacctgaatcaatacatcaagcaacatttttatttactgatagaggaactccacaaaattaccgacatatggatttatttggaagtcattcttttatgtggtataatgaaaaaaatgaatatgtatgggtaaaatatcattttaaaacagctcagggaatacaaaacttaacaaatgatgaagcaattaaaatgtgtggtgaaaatccagaccatgccacagaagatctatttaatgctattgaagaaggaaattatccagaatggaatgtctatgttcaaataatgactcccgaagaagcagaaaaatatgaatttgatccatttgatgtaacaaaagtttggttccatggagattatccattaatccctctaggaaaattagttttaaataaaaatccagaaaatttctttgctgaagttgaacaggttgcattcgcaccttcaaattttgttccaggaattggaccttcaccagacaggcttttgcaaggaaggttattttcttatgaagacactcaaagacatagactaggtccaaatcatcaccaaattccaataaatagggcaaaaaatgctgaagtaaacacctatcaaagagacggaccgatgacagtcacagataatggaggaagtgggcctaattactatccaaattcatttgatgggccagaagtagatgaaacagttactccaccaactatagaattgaaagcggaaattaatagacacccaaggccagttgaagatgttgactttttccaaacaggcgaactttggagaagagttttaagtgatgaggataaggatcatctagtatataatatagttgcacacttaggaaatgcccaagaaagaattcaatatagacaatgtgctcttttctacaaagcagaaccagaatatggaacacgtgtagctgagggaattggacttgatatatccaaagttaaaaatctttctgaaatgactcaagaagaaagagttgaagccacaaaaaaatga

SEQ ID NO: 5461 - protein, 503 aa, Methanobrevibacter arboriphilus
MSNKKKFTTNKGIPVPNDQASITTGKGSNYTMLGDSHLTEKLAHFGRERIPERVVHAKGTGAYGYFEVTNDLSKYTRAKFLSEVGKKTEVFIRFSTVGGERGSADAKRDPRGTAMKYYTEEGNYDLVGNNTPIFFIRDAIKFPDFIHTQKRNPKNNLSDADMFWDFMSLTPESIHQATFLFTDRGTPQNYRHMDLFGSHSFMWYNEKNEYVWVKYHFKTAQGIQNLTNDEAIKMCGENPDHATEDLFNAIEEGNYPEWNVYVQIMTPEEAEKYEFDPFDVTKVWFHGDYPLIPLGKLVLNKNPENFFAEVEQVAFAPSNFVPGIGPSPDRLLQGRLFSYEDTQRHRLGPNHHQIPINRAKNAEVNTYQRDGPMTVTDNGGSGPNYYPNSFDGPEVDETVTPPTIELKAEINRHPRPVEDVDFFQTGELWRRVLSDEDKDHLVYNIVAHLGNAQERIQYRQCALFYKAEPEYGTRVAEGIGLDISKVKNLSEMTQEERVEATKK

SEQ ID NO: 5462 - DNA, 2014 bp, Ajellomyces capsulata
  CDS (127)..(1638)
ctcgagtgtcatcttacctccccgcccttcccactgctaaggggcaacaacccaccgttgtgactactaggtcgatctactttcttggtgccatctcccagccagccagactctcaaatcgccatcatgggtgccgatgataccttcaactcgtaccgatacaaggatactccaacttacactgactccaatggctgtccggttatggaccccgagtcctcccagcgcgttggagaaaatggacccctgctccttcaggatttccatctgatcgatctcctcgcgcattttgaccgcgagcggatccctgaaagagtcgtccatgcaaagggtgcaggagcgtacggtgaattcgaagtgctggacgacatcagcgatatcaccaccattaacatgctgaagggcgtgggaaaaaagacaaagcttgttacccgtttctccactgttggtggggagaagggatccgccgacagcgctcgtgacccgaggggtttctctaccaaattctacactgaggagggcaactgggactgggtcttcaacaacacgccagtcttcttcttgcgtgatccctcaaagttcccgctcttcatccatacccagaagaggaacccccagaccaacctcaaggatgccaccatgttttgggactatctgtccacccatcaggaagcaatccaccaagttatgcatctcttcagtgatcgtggtaccccgtactcttaccgccacatgaatggctactccggacacactttcaagtggctcacgccggacgggggtttcaactacgttcagatccatctcaagactgaccaaggcagcaagactttgaccaacgaggaggccactaaacttgccgctgagaatccagattggcacaccgaggacctcttccgggccattgagcgcggcgaatatccatcctggacctgttacgtccaggtcctcagtcctcaacaggccgagaaattccgctggaacattttcgatttgaccaaggtctggccccattcggaggtccctctccgccgcttcggtcgccttgttctgaacaagaacccacaaaactacttcgctgagatggaacaagctgccttctcgccctcacacctggtccccggcgtcgagccctccgcagacccagtcctgcaatcccgcctcttctcctacccagacacccatcgccaccgccttggcgtcaactaccagcagatccccgtcaactgcccgctgcgcgcctttaacccgtaccagcgcgacggtgcgatggccgtcaacggcaactacggcgccaaccccaactacccatccaccttccgccggatgaattacatgcccgtcaaagccagccaggagcacgagaagtggaccggtgctgtcctcgcgaaacagctccccgtcaccgatgaggatttcgtgcaagccaatggcctctggcaggttctgggtcgccaacctggccagcaagcgaactttgtcaagaatgtggccggccacttgtgcaatgctgagcagaaagtgcgcaaggcggcgtatggcatgttcatccgcgtcaataaggacttgggaagttccattgagtcgtcaacagaagctttggtggcgtcgcaggcgcagtcgcagccgcgcctgtagccgcgttgagaacgttttatgtcgttcggttggatattggggttgacaagtttgaatattgaacgtcggttatgatggttgaattgacttttatgttatttttttcatttttacccttttattttccttttattttcttttcaccattctaggtacttggcaggatatgaatgaatttaaacatccttggataacgacataagaggataggccgcaagactagttatgcaggacaactctggtgttttctttcggggccctagatattcactatagttttggtacttatatcagaacatacttggaggatccgtggctatcgtgacccattttccattccagggccaaaattttccaaacaaattatttttctatt

SEQ ID NO: 5463 - protein, 503 aa, Ajellomyces capsulata
MGADDTFNSYRYKDTPTYTDSNGCPVMDPESSQRVGENGPLLLQDFHLIDLLAHFDRERIPERVVHAKGAGAYGEFEVLDDISDITTINMLKGVGKKTKLVTRFSTVGGEKGSADSARDPRGFSTKFYTEEGNWDWVFNNTPVFFLRDPSKFPLFIHTQKRNPQTNLKDATMFWDYLSTHQEAIHQVMHLFSDRGTPYSYRHMNGYSGHTFKWLTPDGGFNYVQIHLKTDQGSKTLTNEEATKLAAENPDWHTEDLFRAIERGEYPSWTCYVQVLSPQQAEKFRWNIFDLTKVWPHSEVPLRRFGRLVLNKNPQNYFAEMEQAAFSPSHLVPGVEPSADPVLQSRLFSYPDTHRHRLGVNYQQIPVNCPLRAFNPYQRDGAMAVNGNYGANPNYPSTFRRMNYMPVKASQEHEKWTGAVLAKQLPVTDEDFVQANGLWQVLGRQPGQQANFVKNVAGHLCNAEQKVRKAAYGMFIRVNKDLGSSIESSTEALVASQAQSQPRL

SEQ ID NO: 5464 - DNA, 2537 bp, Ajellomyces capsulata
  CDS (65)..(2314)
attcacaaaagctccagtttcaactttgaaaaagaaccagagaatatttttttcatcgcccccaatgactagcaaggttgaagaagggctccagagggtcaaggagctggtggaaaatatgcagccaggagagcaaaaggtcgcagacctcgcccgcgatactacagacgtcaacggatgcctccccttcaccactgaccatggagtcaaagttagcaatacggacttttggcttcgacttgcatccgaaaatcaaaccggcccattgcttttggaggatcagattgctcgtgaaaagatccatcgatttgaccatgaaagaatcccagaacgtgttgtccatgcacgaggaacaggtgcttttgggcacttcaagctcttcgagagcgcggcagacgtgacgtccgctggtgttctaactgacacgtcccgaactactccggtgttcgttcggttttccaccgtccagggcagcaaaggcagtttcgatacagtccgtgatgtcagaggtttcgctaccaaattctatacggaagaaggcaactgggatcttgttggcaataacattcctgtattcttcattcaagatgctgtgaaattcccagattttgttcatgctgtgaagccggaacctcataacgaagttccccagggacaaacagcacataacaacttctgggactttgtatatatgcatcctgaggcgacgcatatgttcatgtgggctatgtcggacagggctattccgcgatcatatcggatgatgcaaggatttggtgttaatacttttgttttggtgaataaacaagggaaaagacatttcgttaagtttcactggatgccggaacttggggttcattcgctggtccccgatgaatcattcaaacttggtggccaggacccagacttccaccgtaaagatctaatggaggcaatcgacaataaggtgtacccgaaatggaagtttggaattcaggttcttcctgaagaaaaagagcacgattttgattttgatatacttgatccaactaagatatggccagagagcctaatacctgttcggtatattggagagatggagctcaaccgcaacgtcgatgagtttttcccacagacagaacaggttgccttctgtaccgcccacattgttcctggaattgaattctccggcgatcctctgctccagggacgcaatttctcctattttgacactcaaattacccgccttggcgtcaactgggaggagctcccgatcaatcgtcctgtgtgccctgttatgaatcacaacagggatggtgcaatgcgccataagataacccaaggaaccgtaaactattggccgaaccgtttcgaggcttgcccacccacgaagcccgaggatgggggttttgtcacttaccctcaaaaggtagagcagagtatcaaagcgaggatgcttagtagcaagttccgcgagcatatcaaccaagcgcaattattctataactctctctccgaatacgaaaagctccatgtcaataatgctttttgctttgagttggatcactgcgatgaccccattgtctacaatagacttgtgtctcggatttctgaaatcgaccatgccctcgcccaagccgttgcagtgaaagtcggcgcaccgaccccaccaaggcctgggagagacaacccaggtcaaacaaccattaacctaagccaaaaatacatcaacgaccgtcagctgtcctctcccacaattaaaggtcggaggatcgccatattgattggggatggttacgattccgtcgcctttggcacggtcatagccgcggtgagcgccatgggcgcgctacccttcataatcggcacgaagcggcaacccatctttgccgacgacgaagacaggaatcactccaagggtgtgactccaaaccacaactataccagccaacgctccacttgtttcgacgctactttcatccctggtggctcacatatcaaggaattgagccagctgggccttatccagcactgggttgccgagcagttcggacactgcaaggcaattggcgctacaggagaggccatcaatctaatcgtgcaggctctgagcaacctgcctgatttggaggtcgcatccgcctcgtcagggcatccagtcgattggtacggcgttgtcacgtcgagtaagctgcatgagccccatagtttgaccgaagggatcaagctgtttcccgaggcgagtgacttcttgggcaagctcttttatcagatctcccagcatcggaattatgagcgggagatggctgggttgacggacaaggttccattttaaatggcaacatggcatcggtgtgagtcgctaggaagcaagtgaaagttaatagtcaggccccaaaaacaactatacatactgtaaacactaggtttaatttttggcttatatgttcttctggcaacaatgaattggtttgttgctgttgccatttctaacaagttgtcacaactaatatatatccaatcgaatccatgaaaatggcattcttgttcacatattc

SEQ ID NO: 5465 - protein, 749 aa, Ajellomyces capsulata
MTSKVEEGLQRVKELVENMQPGEQKVADLARDTTDVNGCLPFTTDHGVKVSNTDFWLRLASENQTGPLLLEDQIAREKIHRFDHERIPERVVHARGTGAFGHFKLFESAADVTSAGVLTDTSRTTPVFVRFSTVQGSKGSFDTVRDVRGFATKFYTEEGNWDLVGNNIPVFFIQDAVKFPDFVHAVKPEPHNEVPQGQTAHNNFWDFVYMHPEATHMFMWAMSDRAIPRSYRMMQGFGVNTFVLVNKQGKRHFVKFHWMPELGVHSLVPDESFKLGGQDPDFHRKDLMEAIDNKVYPKWKFGIQVLPEEKEHDFDFDILDPTKIWPESLIPVRYIGEMELNRNVDEFFPQTEQVAFCTAHIVPGIEFSGDPLLQGRNFSYFDTQITRLGVNWEELPINRPVCPVMNHNRDGAMRHKITQGTVNYWPNRFEACPPTKPEDGGFVTYPQKVEQSIKARMLSSKFREHINQAQLFYNSLSEYEKLHVNNAFCFELDHCDDPIVYNRLVSRISEIDHALAQAVAVKVGAPTPPRPGRDNPGQTTINLSQKYINDRQLSSPTIKGRRIAILIGDGYDSVAFGTVIAAVSAMGALPFIIGTKRQPIFADDEDRNHSKGVTPNHNYTSQRSTCFDATFIPGGSHIKELSQLGLIQHWVAEQFGHCKAIGATGEAINLIVQALSNLPDLEVASASSGHPVDWYGVVTSSKLHEPHSLTEGIKLFPEASDFLGKLFYQISQHRNYEREMAGLTDKVPF

SEQ ID NO: 5466 - DNA, 1479 bp, Arabidopsis thaliana
  CDS (1)..(1479)
atggatccatacagggttcgtccttcaagcgctcatgattcccctttcttcactacaaactcgggtgctcctgtctggaacaacaactcttctttgactgtcggaactcgaggtccaatccttctggaggactatcatctgcttgagaaactcgctaactttgacagggagcggattcctgagagggttgttcatgccaggggagccagtgctaagggtttctttgaagtcactcatgacattacccaacttacttctgctgattttcttcgaggacctggtgttcagactcctgttatcgttcgtttctcaactgtcatccatgagcgtggcagtcccgagactctcagagatccccgtggttttgctgttaagttttacaccagagaggggaactttgatcttgttgggaacaacttccctgtattcttcgtccgtgatggaatgaaattccctgacatggtccatgcattgaaaccgaatcccaagtctcacattcaggagaactggaggatactggacttcttctcccaccacccagagagtttgcacatgttttcatttctctttgatgatctcggtatcccacaggactacaggcacatggaaggcgctggggtcaacacttacatgctaatcaacaaagctggaaaagctcactatgtgaaattccactggaagccgacttgtgggatcaaatgcctgtcggatgaggaagctatcagagttggaggagccaatcacagccatgccaccaaagatctctatgactcgatcgcagccgggaactatccgcagtggaatctcttcgttcaggtgatggatcctgcccatgaagacaaatttgacttcgatccgcttgatgtcacaaagatctggcctgaagatatcttgcctttacaacctgttggtcgcttggtcttgaacaaaaacatcgacaacttctttaatgagaacgaacagattgcattctgtcctgctcttgtggttccaggcatccactattcagatgataagctactccagacccggatcttctcctacgctgatagtcagagacaccgtcttggaccaaactatctgcaactacctgttaatgcccctaaatgtgctcaccacaacaatcaccatgatggttttatgaacttcatgcacagggatgaggaggtcaattacttcccttcaaggttggatccggttcgccatgccgaaaaataccctacaactcctattgtctgctctggaaatcgtgagaagtgcttcatcgggaaggagaacaacttcaagcaaccaggggagagataccggtcctgggattcagacaggcaagaacgattcgtgaagcgttttgttgaagcgctttcggagcctcgtgtcacgcacgaaatccgcagcatttggatctcttactggtctcaggcagacaaatctctgggacagaaactagcaactcgtcttaacgtgaggccaaacttctga

SEQ ID NO: 5467 - protein, 492 aa, Arabidopsis thaliana
MDPYRVRPSSAHDSPFFTTNSGAPVWNNNSSLTVGTRGPILLEDYHLLEKLANFDRERIPERVVHARGASAKGFFEVTHDITQLTSADFLRGPGVQTPVIVRFSTVIHERGSPETLRDPRGFAVKFYTREGNFDLVGNNFPVFFVRDGMKFPDMVHALKPNPKSHIQENWRILDFFSHHPESLHMFSFLFDDLGIPQDYRHMEGAGVNTYMLINKAGKAHYVKFHWKPTCGIKCLSDEEAIRVGGANHSHATKDLYDSIAAGNYPQWNLFVQVMDPAHEDKFDFDPLDVTKIWPEDILPLQPVGRLVLNKNIDNFFNENEQIAFCPALVVPGIHYSDDKLLQTRIFSYADSQRHRLGPNYLQLPVNAPKCAHHNNHHDGFMNFMHRDEEVNYFPSRLDPVRHAEKYPTTPIVCSGNREKCFIGKENNFKQPGERYRSWDSDRQERFVKRFVEALSEPRVTHEIRSIWISYWSQADKSLGQKLATRLNVRPNF

SEQ ID NO: 5468 - DNA, 1804 bp, Solanum lycopersicum
  CDS (33)..(1511)
ctctcttcaattcttctttcatttccatcaccatggatccctctaagtatcgcccatcaagcgcatacgacacccctttcttgacaacaaatgctggtggtcctgtgtacaacaatgtttcttccttgactgttggacctagagggcctgttctgcttgaggattactatctaattgagaagctcgcgacatttgatcgcgagaagatacctgaacgtgttgttcatgctagaggtgctagtgctaagggattctttgaagttactcatgacatttctcatcttacttgtgctgattttctccgagctcctggcgctcaaacgcctgttatttgtcgattctctactgttgtccatgaacgtggaagccccgagtctatcagggacattcgtggttttgctgtcaagttctacaccagagagggtaactttgatcttgttggaaacaatgtccccgtgttctttaatcgtgatgctaagtcgttccctgacacgattcgtgcattgaaaccaaatccaaagtcacacattcaggagaactggaggatacttgatttcttctcgttccttcctgagagtttgcatacattcgccttcttctacgatgatgtttgtctcccaacggattacagacacatggaaggttttggcgttcacgcgtatcaattgattaacaaagaggggaaagcacattatgtgaagttccactggaagccaacttgtggtgtgaaatgtatgtctgaggaagaagctattagagtcggtggtactaatcatagccacgcgaccaaggatctttacgattcaattgctgctggaaactatcctgagtggaagctttttatccaaacaatggaccccgaggatgtagacaagttcgattttgatcctctggatgtaaccaagacatggcctgaggatctcttgccgttgatcccagttggtcgattggtgttgaacaggaacattgataacttcttcgcagagaatgaacaactcgcgtttaaccctggacatattgtccctggtatttactattccgaggataagcttctccagactaggatattcgcgtatgctgatactcagagacaccgtattggaccaaactatatgcagctcccagttaatgctcccaagtgtggtcatcacaacaatcatcgcgatggtgctatgaacatgacacatcgcgatgaagaggtggattatttgccctcgaggtttgatccttgtcgtcctgctgagcagtacccgattccttcttgtgtcttgaatggaaggcgtacaaattgtgtcattccgaaagaaaacaacttcaaacaggcaggggagaggtacagatcatgggaacctgacaggcaagacagatacatcaacaaatgggttgagtctttatccgatccacgagtcactcatgagattcgcagcatatggatatcatacttgtctcaggctgacaagtcctgtggtcagaaggtcgcttctcgtctcactgtgaagcctacaatgtgaaaaatcaatgaaaatagttgaaatggtttcaagctgcaaatgttgaaggactaatgcaaaaaaacgtccgcgttgtgctataaactgtacttctttttcaatcgtaatgttgtattttgtatcgaatttcgatgtcttgtgtttttactataatgatgttggaacctgaataagttcacagttgtatgttcaatgtttcactttctaaagttatgtaattatgttgagttcttgttcactttggtgcttgaagaacacactctcaatttcaataatatcactttcatttcagt

SEQ ID NO: 5469 - protein, 492 aa, Solanum lycopersicum
MDPSKYRPSSAYDTPFLTTNAGGPVYNNVSSLTVGPRGPVLLEDYYLIEKLATFDREKIPERVVHARGASAKGFFEVTHDISHLTCADFLRAPGAQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPTDYRHMEGFGVHAYQLINKEGKAHYVKFHWKPTCGVKCMSEEEAIRVGGTNHSHATKDLYDSIAAGNYPEWKLFIQTMDPEDVDKFDFDPLDVTKTWPEDLLPLIPVGRLVLNRNIDNFFAENEQLAFNPGHIVPGIYYSEDKLLQTRIFAYADTQRHRIGPNYMQLPVNAPKCGHHNNHRDGAMNMTHRDEEVDYLPSRFDPCRPAEQYPIPSCVLNGRRTNCVIPKENNFKQAGERYRSWEPDRQDRYINKWVESLSDPRVTHEIRSIWISYLSQADKSCGQKVASRLTVKPTM

SEQ ID NO: 5470 - DNA, 1733 bp, Glycine max
  CDS (53)..(1531)
atcgtgatttagcatttaccacaccaaaatcaatctgcggagtcagaaagccatggatccctacaagaatcggccatcaagcgccttcaattctcccttctggactacaaattccggtgctcccatctggaacaataactcatcgctgactgttggatctagaggtccaattctgctggaggattaccatctggtggagaagcttgcaaactttgacagggaacggatccccgaacgtgttgtccacgctcgtggagctagcgcaaagggtttctttgaagtcacgcatgacatttctcacctcacatgtgccgatttccttcgagcccctggagttcagacccccctcatcgtccgtttctccactgttatccacgagcgtggcagccccgaaaccctcagggatcccagaggttttgctgtcaaattctacaccagagagggtaacttcgaccttgtgggaaacaacttccctgtcttcttcgtccgcgatggcctcaagtttcctgacatggttcatgccctcaaacccaaccccaagtcccacatccaggagaattggaggatcctcgatttcttctcccaccatcccgaaagccttcacatgttctccttcttattcgacgacgttggtatccctcaagattacaggcatatggatggcttcggtgtcaacacctacacccttatcaacaaggccggcaaagcactctatgtcaaatttcattggaagaccacctctggcgaaaagtctcttttggacgacgaggccatcagggttggaggatccaaccacagtcatgccacccaggacctttacgattcaattgctgctggaaactatcctgagtggaaactctacatccaaacattggatcccgaaaacgaagacaggcttgactttgacccccttgatgttactaagacctggcccgaggacgttttgcccctccagcctgttggccgcatggtcttgaataagaacattgataacttctttgccgagaatgaacaacttgcattttgccctgccattattgtacctggtgtatactactccgatgataaattgcttcaaactcgcgtattctcctatgctgatacccagagacacagacttggaccaaattatctgcagcttcctgctaatgcccctaagtgtgcccatcacaacaatcaccatgatggtttcatgaatttcatgcacagggatgaagaggtcaattacttcccttcaaggtatgatcctgtccgtcatgcggaaaaggtccccgttcctcctcgtatcctaggtgggaagcgtgaaaagtgcatgattgagaaggagaacaacttcaagcaacctggggagagataccgatcctggccctctgacaggcaagaaaggtttgtccgccgatgggttgatgctttgtctgacccacgtgtcacccatgaaatccgtagcatctggatatcatactggtctcaggctgatcgttctcttggacaaaagatagcatctcacctgaacttgaagccaagtatctaagattggtggtggaaaccctagcttctaagagatgcagatgtaggaacaagtgagaagtttgtggcacagtattaatttgaaaggactggtccttttattacagtattgctatattgtatattgcttatttcatgaactcaacttcttgacttgtccacttaatactatatgtccattgtgataaaaaaaaaaaaaaaaaaaa

SEQ ID NO: 5471 - protein, 492 aa, Glycine max
MDPYKNRPSSAFNSPFWTTNSGAPIWNNNSSLTVGSRGPILLEDYHLVEKLANFDRERIPERVVHARGASAKGFFEVTHDISHLTCADFLRAPGVQTPLIVRFSTVIHERGSPETLRDPRGFAVKFYTREGNFDLVGNNFPVFFVRDGLKFPDMVHALKPNPKSHIQENWRILDFFSHHPESLHMFSFLFDDVGIPQDYRHMDGFGVNTYTLINKAGKALYVKFHWKTTSGEKSLLDDEAIRVGGSNHSHATQDLYDSIAAGNYPEWKLYIQTLDPENEDRLDFDPLDVTKTWPEDVLPLQPVGRMVLNKNIDNFFAENEQLAFCPAIIVPGVYYSDDKLLQTRVFSYADTQRHRLGPNYLQLPANAPKCAHHNNHHDGFMNFMHRDEEVNYFPSRYDPVRHAEKVPVPPRILGGKREKCMIEKENNFKQPGERYRSWPSDRQERFVRRWVDALSDPRVTHEIRSIWISYWSQADRSLGQKIASHLNLKPSI

SEQ ID NO: 5472 - DNA, 1756 bp, Hordeum vulgare
  CDS (59)..(1543)
cgcgagcgacactccccacccccagcttagctacgctacttcactcactcgaggaaggatggatccctgcaagttccggccgtcgagcagcttcgacaccaagacgacgacgacgaacgccgggcagccggtgtggaacgacaacgaggcgctcacggtggggccgcgcggcccgatcctgctggaggactatcacctgctggagaagatcgcccacttcgcgcgggagcgcatcccggagcgcgtcgtgcacgcgcggggcgcctccgccaagggcttcttcgagtgcacccacgacgtcaccggcctcacctgcgccgacttcctccgcgcgcccggggcgcgcacgccggtcatcgtccgcttctccaccgtgatccacgagcgcggctcgccggagaccatccgtgacccgcgcgggttcgccgtcaagttttacacgcgcgagggcaactgggacctgctcggcaacaacttccccgtcttcttcatccgcgacggcatcaagttccccgacgtcatccacgccttcaagcccaacccaaagtcccacgtgcaggagtactggcgcgtcttcgacttcctctcccaccacccggagagcctccacaccttcttcttcctcttcgacgacgtcggcatccccaccgactaccgccacatggacggcttcggcgtcaacacctacaccttcgtctcccgcgccggcaagtcccactacgtcaagttccactggcgccccacctgcggcgtcagctgcctcatggacgacgaggcaaccctcgttggcggcaagaaccacagccacgccacgcaggacctctacgactccatcgacgccggcaacttccccgagtggaagctcttcgtgcaggtcatcgaccccgacgaagaggaccgcttcgacttcgacccgctcgacgacaccaagacatggccagaggacctcgtccccctccagcccgtgggccgcctcgtgctcgaccgcaacgtcgacaacttcttcaacgagaacgagcagctcgcgttcggccccggcctcgtcgtgcccgggatctactactccgacgacaagatgctgcagtgcagggtgttcgcatacgccgacacgcagcgctaccgcctggggccaaactacctgatgctccccgtcaacgcgcccaagtgcggcttcaagaacaaccactacgacggcgccatgaacttcatgcaccgcgatgaggaggtggactactacccgtctcgccacgcgccgctccggcatgccgagccggccagcttccccgtgccgacgaggcccgtggttggaaagagggagaagacgaggatcaagaaggagaacgacttcgtgcagcccggggagaggtaccgcagctgggcgcccgaccgccaggacaggttcgtgcgccgcttctccgacgcgctcgcgcaccccaaggtcagccacgagctgcgtgtcatctggatcgacttcctctccaagtgtgacaagtcgtgcgggatgaaggtggcgaaccgcctcaacgtgaagccaagcatgtgatggatggatctgccatggatgatggatggaccattctgtgtaaactttgtgctatatcatgaaccagccagcaataagggaccatgcatgccagctactgtggatcatgtggtcgaatagataccatgctactaataagttaccatcttttgttacagtaaactgcatgtactctagcttaaactaaagtgggtgcttcgagcttaaaaaaaa

SEQ ID NO: 5473 - protein, 494 aa, Hordeum vulgare
MDPCKFRPSSSFDTKTTTTNAGQPVWNDNEALTVGPRGPILLEDYHLLEKIAHFARERIPERVVHARGASAKGFFECTHDVTGLTCADFLRAPGARTPVIVRFSTVIHERGSPETIRDPRGFAVKFYTREGNWDLLGNNFPVFFIRDGIKFPDVIHAFKPNPKSHVQEYWRVFDFLSHHPESLHTFFFLFDDVGIPTDYRHMDGFGVNTYTFVSRAGKSHYVKFHWRPTCGVSCLMDDEATLVGGKNHSHATQDLYDSIDAGNFPEWKLFVQVIDPDEEDRFDFDPLDDTKTWPEDLVPLQPVGRLVLDRNVDNFFNENEQLAFGPGLVVPGIYYSDDKMLQCRVFAYADTQRYRLGPNYLMLPVNAPKCGFKNNHYDGAMNFMHRDEEVDYYPSRHAPLRHAEPASFPVPTRPVVGKREKTRIKKENDFVQPGERYRSWAPDRQDRFVRRFSDALAHPKVSHELRVIWIDFLSKCDKSCGMKVANRLNVKPSM

SEQ ID NO: 5474 - DNA, 1877 bp, Oryza sativa
  CDS (194)..(1672)
aggggaggccggcaagaagcatactagcacgctacgaaaccccccttctcttcgtccccaaattgcactacaaaaaaggccgcccctttcttctctcctcgtccttatcaccaccaatccgatcctcttctcttctcttctcttcttccccacatccagttcgattctcatctctcccacaacaaatcacgccatggatccctacaagcatcggccgtccagcgggagcaattccaccttctggaccaccaactccggcgcccccgtctggaacaacaactccgccctcaccgtcggagagcgaggccctatcctccttgaggactatcatctgattgaaaagcttgcacagtttgacagggagcgtatccctgaacgtgtcgttcatgcaaggggagccagtgccaagggattttttgaggttactcatgatatttctcacctcacatgtgctgattttctccgtgctcctggtgttcagaccccagttattgttcggttctccacagtcgtgcatgagcgtggaagccctgagacattgagggatccacgtggttttgctgtcaagttttacactagagagggtaattttgatcttgttgggaacaatatgcctgtcttttttatccgagatgggatgaaattccctgacatggtccatgctttcaagccaagtccaaagaccaatatgcaggagaactggagaatagttgatttcttttcacaccacccagagagcctgcacatgttctccttcctctttgacgatgtaggcatcccactcaactacaggcacatggagggttttggtgtcaacacctacaccctaatcaataaggatggaaagcctcaccttgtcaaattccactggaagcctacctgtggtgtcaaatgcctgttggatgatgaagctgtgactgttggcggcacctgccacagccatgccacgaaggacttgactgattctattgcagcagggaattacccagagtggaagctttacatccagactattgatcctgatcatgaggacagatttgacttcgatcctcttgatgtcaccaagacatggccagaggatatcatccccctgcagccagttggacggatggtcctgaacaaaaacattgataacttctttgcagaaaatgaacagcttgctttctgcccagcgataattgtccctggaatccattactctgatgataagctgctccagacaagaattttctcctatgctgatacccaaaggcaccgtcttggcccaaactatttgatgcttcctgtgaatgcaccaaaatgtgcataccacaacaaccaccacgatggctccatgaatttcatgcacagggatgaagaggttaactacttcccttcaaggtttgatgctgcacgtcatgctgagaaggtccctattcctcctcgtgttctaacaggctgtcgggaaaagtgtgtcattgacaaggagaacaatttccaacaggctggtgagagataccggtcatttgaccctgccaggcaagatcgttttctccagcggtgggttgatgctctctcagatcctcgtattacacatgaactccgtggcatctggatctcctactggtcgcagtgtgatgcgtcccttgggcagaagctggcttcacgtctcaacctgaaaccaaacatgtagatcggccaggaggaatccagtggtggtgctatgttggacagtcaaacatgaactgtaatgtgtcgaccagccgtagtcgtgaataaaatgtgatacggtgatatgtatactggtgacgcaagttgtgaaactgtatctggaatcctgaaaatatgccttgctgtgtcttgggaaagagataataaagactgatacagtgggtgct

SEQ ID NO: 5475 - protein, 492 aa, Oryza sativa
MDPYKHRPSSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFSFLFDDVGIPLNYRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQCDASLGQKLASRLNLKPNM

SEQ ID NO: 5476 - DNA, 2087 bp, Bacteroides fragilis
  CDS (348)..(1808): transl_table=11
ttcatcacagagaaacacaaaatttccggtaagtttacctattatttccactctccatcccccttgtggtaaatcacattggggctatttctttcccaaacggctaatttaccggatgaattcggataaaagatcaaattcttttcaaaaaaacatttatagaacctattatattcaagtaatatcaatatctttgatagaaatagatattacctatttatggattgaaattatctatttgacaggtaaatgatttagctctacatttgtcgggtaataacacggaagaagggctgtaaaagactccacatcattgaaagctttgtttccgataaaatcaaaattatatggaaaataaaaaactcacagcagctaatggtcgtcctatcgccgacaaccaaaacagccagacagcaggacctcgcgggcctattatgttacaagacccatggttgattgaaaaacttgctcatttcgaccgtgaagttatccctgaacgccgtatgcatgccaaaggctccggagcttacggtacatttaccgtcacacatgatatcaccaagtacacacgagcagctattttcagtcaagtaggcaagcaaacagaatgttttgtacgtttctccactgtagcaggagaacgcggagctgctgatgcagaacgcgatatccggggatttgccatgaagttttatacagaagaaggaaactgggatttggtaggtaacaatactcccgtcttcttcttacgcgacccgctaaaatttcctgatttaaatcatgctgtaaaacgcgatccacgcaacaacatgcgtagcgctaacaataattgggatttctggaccctgttacccgaggctcttcatcaggtaactatcactatgagtccgcgtggcattccggcttcctatcgccacatgcacggattcggcagccatacttacagtttcttaaacgcagaaaacaaacgaatttgggttaagtttcatctaaagactatgcagggcattaaaaacctgactgatcaggaagctgaagcaatcatcgccaaagatcgtgaatcgcatcaacgtgacctatacgaaagtatcgaacggggtgatttcccaaaatggaagttccagattcagttgatgactgaagaagaagcagataactatcgtatcaatccgttcgaccttaccaaggtttggccacacaaagatttcccattgcaagatgtaggtattcttgaattgaaccgtaatccggaaaactattttgcagaagtagaacaatcggctttcaatccgatgaatattgttgaaggtatcggcttctctcccgacaagatgttgcaaggacgattattttcttatggtgatgcacaacgctaccgattgggtgtaaactcagagcagataccggtaaacaagccacgttgtccgttccacgccttccatcgtgacggagcaatgcgagtggacggaaactatggttcagccaaaggttatgaaccgaatagttatggcgaatggcaagactcgcctgagaaaaaagaaccgcctttaaaagttcacggagatgtattcaactataacgaacgtgaatatgatgacgattactacagtcagccgggtgatttgttccgactgatgcctgcggatgaacaacaattattgtttgaaaataccgcacgcgccatgggtgacgcagaattgttcatcaaacaacggcatgtacgcaactgctacaaagctgatccggcttatggcacaggagtagctcaagcattaggtattgatctggaagaagccttgaaagaataatctaacttcttcgatatgcgcctcaaatgtgattctgttacatttgaggcgcatttatataaagaaagaacacaatctcactataatttatccttatcacaacgccttccacaatttctgaaaatcactatatttaccatagcacaccaatacgtcatccggacgtatcttggcatcctccggcaattcgtttacaaccttgtgctccaccaaagaaatgcccaggcaattcttgatcgtattggaacgcttcaatccgatcaacttcaaattgaattc

SEQ ID NO: 5477 - protein, 486 aa, Bacteroides fragilis
MENKKLTAANGRPIADNQNSQTAGPRGPIMLQDPWLIEKLAHFDREVIPERRMHAKGSGAYGTFTVTHDITKYTRAAIFSQVGKQTECFVRFSTVAGERGAADAERDIRGFAMKFYTEEGNWDLVGNNTPVFFLRDPLKFPDLNHAVKRDPRNNMRSANNNWDFWTLLPEALHQVTITMSPRGIPASYRHMHGFGSHTYSFLNAENKRIWVKFHLKTMQGIKNLTDQEAEAIIAKDRESHQRDLYESIERGDFPKWKFQIQLMTEEEADNYRINPFDLTKVWPHKDFPLQDVGILELNRNPENYFAEVEQSAFNPMNIVEGIGFSPDKMLQGRLFSYGDAQRYRLGVNSEQIPVNKPRCPFHAFHRDGAMRVDGNYGSAKGYEPNSYGEWQDSPEKKEPPLKVHGDVFNYNEREYDDDYYSQPGDLFRLMPADEQQLLFENTARAMGDAELFIKQRHVRNCYKADPAYGTGVAQALGIDLEEALKE

SEQ ID NO: 5478 - DNA, 1849 bp, Bacillus subtilis
  CDS (201)..(1652): transl_table=11
tgtttcgcaaatagagaaggaaaaattatttctccaaaaattattaagtgtcataaaaagctgttacaacaaggtttttcaacaatttcgatactatatatcgattaatagagataactattttataataattataaaataatattgactttttacttagagatgatattatgttcttataaattccaagaggtgataacatgagttcaaataaactgacaactagctggggcgctccggttggagataatcaaaactcaatgactgccggttctcgcggaccaactttaattcaagatgtacatttactcgaaaaattggcccatttcaaccgagaacgtgttcctgaacgtgttgttcacgccaaaggagcaggcgcacacggatattttgaagtgacaaacgacgtaacaaaatacacgaaagccgctttcctttctgaagtcggcaaacgcacaccgttgttcatccgtttctcaacagttgccggtgaacttggctctgctgacacagttcgcgacccgcgcggatttgctgttaaattttatactgaagaaggaaactacgacatcgtcggcaacaatacgcctgtattctttatccgcgatgcgattaagttccctgatttcatccatacacaaaaaagagatccaaaaacacacctgaaaaaccctacggctgtatgggatttctggtcactttcaccagagtcactgcaccaagtgacaatcctgatgtctgaccgcggaattcctgcgacacttcgccacatgcacggcttcggaagccatacattcaaatggacaaatgccgaaggcgaaggcgtatggattaaatatcactttaaaacagaacaaggcgtgaaaaaccttgatgtcaatacggcagcaaaaattgccggtgaaaaccctgattaccatacagaagaccttttcaacgcaatcgaaaacggtgattatcctgcatggaaactatatgtgcaaatcatgcctttagaagatgcaaatacgtaccgtttcgatccgtttgatgtcacaaaagtttggtctcaaaaagactacccgttaatcgaggtcggacgcatggttctagacagaaatccggaaaactactttgcagaggtagaacaagcgacattttcacctggaaccctcgtgcctggtattgatgtttcaccggataaaatgcttcaaggtcgactttttgcttatcatgatgcacaccgctaccgtgtcggtgcaaaccatcaagcgctgccaatcaaccgcgcacgcaacaaagtaaacaattatcagcgtgatgggcaaatgcgttttggtgataacggcggcggatctgtgtattacgagcctaacagcttcggcggtccaaaagagtcacctgaggataagcaagcagcatatccggtacaaggtatcgctgacagcgtaagctacgatcactacgatcactacactcaagccggcgatctgtatcgtttaatgagtgaagatgaacgtacccgccttgttgaaaatatcgttaatgccatgaagccggtagaaaaagaagaaatcaagctgcgccaaatcgagcacttctacaaagcggatcctgaatacggaaaacgcgtggcagaaggccttggattgccgattaaaaaagattcttaatggagaaatgcaaaaacccgttgtagtcagcgggtttttttatatttagttacacattgcgtatgcttctcatcaatcttcatataaatttcttccatgagttccgcgctgtttataatctctcgtttgtttttttcaatcagcagctcaagcggcaaaatctgattcccgtaggtttttcgcttcctgaatcgttt

SEQ ID NO: 5479 - protein, 483 aa, Bacillus subtilis
MSSNKLTTSWGAPVGDNQNSMTAGSRGPTLIQDVHLLEKLAHFNRERVPERVVHAKGAGAHGYFEVTNDVTKYTKAAFLSEVGKRTPLFIRFSTVAGELGSADTVRDPRGFAVKFYTEEGNYDIVGNNTPVFFIRDAIKFPDFIHTQKRDPKTHLKNPTAVWDFWSLSPESLHQVTILMSDRGIPATLRHMHGFGSHTFKWTNAEGEGVWIKYHFKTEQGVKNLDVNTAAKIAGENPDYHTEDLFNAIENGDYPAWKLYVQIMPLEDANTYRFDPFDVTKVWSQKDYPLIEVGRMVLDRNPENYFAEVEQATFSPGTLVPGIDVSPDKMLQGRLFAYHDAHRYRVGANHQALPINRARNKVNNYQRDGQMRFGDNGGGSVYYEPNSFGGPKESPEDKQAAYPVQGIADSVSYDHYDHYTQAGDLYRLMSEDERTRLVENIVNAMKPVEKEEIKLRQIEHFYKADPEYGKRVAEGLGLPIKKDS

SEQ ID NO: 5480 - DNA, 1449 bp, Bordetella bronchiseptica
  CDS (1)..(1449): transl_table=11
atgaacgcaatgaccaacaagaccctcactaccgccgccggtgcgccggttgccgacaacaacaacaccatgacggcggggccgcgcggccccgccctgctgcaggacgtctggttcctggagaaactggcccacttcgaccgtgaacgcattcccgagcgcgtggtgcacgccaaaggctcgggcgcctatggcaccttcacggtcacgcatgacatttcccgctacacgcgcgccaggatcttcgccgaagtcggcaagcagacgccgttgttcctgcgcttttcgaccgtggccggcgagcgcggcgcggccgacgccgaacgtgacgtgcgtggcttcgccatcaagttctataccgacgaaggcaactgggacctggtcggcaacaacacgcccgtgttcttcattcgcgatccgctcaagttccccgacttcatccatacccagaagcgcgaccccaagaccaacctgcgcaacgccaccgccgcctgggacttctggtcgctcaacccggaatcgctgcaccaggtcaccatcctgatgagcgatcgcggactgccgcagaactatcgccagcagcacggcttcggctcgcatacctacagcttcgtcaacgacgccggcgagcgtttctacgtcaagttccacttcaagtcgcagcaaggcatcgcctgttatacggacggcgaagccgccgagctggtcggccgcgatcgcgaaagcgcgcagcgcgacctgttccagaacatcgagcagggccagttcccgcgctggacgctcaaggtgcaggtaatgcccgaagccgaggccgccacctatcacatcaacccgttcgacctgaccaaggtgtggccgcatgccgactaccccttgatcgaagtgggcgtgctggaactgaacaagaaccccgagaactatttcgccgaagtcgaacaggccgcgttcacgccggccaatgtggtgccgggcatcggcttttcgcccgacaagatgctgcagggtcgcctgttctcgtacggcgacacccatcgctaccgcctgggcatcaaccaccatcagattcccgtcaatgcgccgcgctgcccgttccacagcttccatcgcgacgggatgggccgggtcgacggcaatggcggcgccacgctgaactacgaacccaacagtttcggcgaatggcgcgaagccaagcacgcagccgaaccgccgctggcgctggacggacaggccgccgaccgctggaaccatcgggtcgacgaggactactactcgcagccgggcgcgctgttccgtctcatgaacgacgaccagaaacagcagctgttcggcaacatcggccgccacatggccggcgtgcccgaggaaatccagcgccgccagctcgagcacttccgccgtgccgacccggcctatgccgcgggcgtggccaaggccctgggcctgaagtaa

SEQ ID NO: 5481 - protein, 482 aa, Bordetella bronchiseptica
MNAMTNKTLTTAAGAPVADNNNTMTAGPRGPALLQDVWFLEKLAHFDRERIPERVVHAKGSGAYGTFTVTHDISRYTRARIFAEVGKQTPLFLRFSTVAGERGAADAERDVRGFAIKFYTDEGNWDLVGNNTPVFFIRDPLKFPDFIHTQKRDPKTNLRNATAAWDFWSLNPESLHQVTILMSDRGLPQNYRQQHGFGSHTYSFVNDAGERFYVKFHFKSQQGIACYTDGEAAELVGRDRESAQRDLFQNIEQGQFPRWTLKVQVMPEAEAATYHINPFDLTKVWPHADYPLIEVGVLELNKNPENYFAEVEQAAFTPANVVPGIGFSPDKMLQGRLFSYGDTHRYRLGINHHQIPVNAPRCPFHSFHRDGMGRVDGNGGATLNYEPNSFGEWREAKHAAEPPLALDGQAADRWNHRVDEDYYSQPGALFRLMNDDQKQQLFGNIGRHMAGVPEEIQRRQLEHFRRADPAYAAGVAKALGLK

SEQ ID NO: 5482 - DNA, 1869 bp, Botrytis cinerea
  CDS (58)..(1497)
cccaattgacaactaccattcatcacacataaatctgctcgagtaaattcaaacaacatggctcaaaccaatggcgtattgcaagaaccggccatcacaacgatgaacggtgctcccgttctaaagccagcatctacccaaagaattggcaatcagctcagagccactcttctacttcaagatatcaatctcttggaattgatccaacacatcacccatgagcgaattcctgagcgtgtcgtccatgccagaggtactagcgctcacggatactttgaggtcaccgatgacatatcagatgtcacatctgcggcttttctaaaccgggtcggaaaacaaaccgatatattttgtcggttctccaccgtagctggtcgagcagaatctgccgaaacggttcgggatactcgtggttttgcttttaaaatgtttaccgaggaaggtaacttagattggttgttccttagcactcctgtcttcccaattcgagatggagctaaattcccatctttcactcatgctactaagaagaatccacgaagtggcttacctgatcacaaggcattctgggactacttcactcacaaccaagaggggattcacttcctgatgttcctcttcagtgatcgagctacaccagtcgatttccaacatgccgatattttcagtatcaacacctacaagttcaccaaatcagacggttcattcacatatgtgaagatccatctcaagaccaaccaaggagtgaagaacttcacacaagatgaggctaatcaaaaggctggtgttgatccagacttccaaacccgtagtctttacgaggatatcgaaaatcaaaagtacccaacgtgggacgtttttgcacagatcattgaccctgtcaaggccgagaattatcacatcaatatcttcgacgcaaccaagacattcccattttccgagttccctcttcgcaagttcggtaaaattacactcaacaggaatgtggataatttcttcgctgagcaagagcaaagtgcttttagtccaacaaatctcgttcctggttgggctctaactccagatcctatcattcaaactcgtgctcttgcctacgcagatactcaaagatatcgtctcggagccaacttcgtccaattacctgtcaatgctccatacaaaaagccctttactcccctcattagggatggagctgcaactgtcaacggcaacttaggtggtaccccaaattacttcccatcatctttttacaatgttggagcagcgacacaatatgcacaacctgacgaagaacaattccaaggaacagttgtcaactttgagagtgaagtcgtcgatgcagactacgtgcagccaagaatcttctgggaaaagacactagctgaagagccaggtcaacaggataatcttatcagcaatgttgcgggtcatctaagcgcagtcactggagataaaggacttggaagttcgacaagcggtctatgcaatgttcggtaaagttaacgccgatcttggcaagcgtatcgagacttcgacagaaactttgatcaagcaaaacgagacaggaacgttggccaaaaatctgaacaacatcaagatcagcaaacaaaatggagtgaagaacgggatactaaatggcaacagccataacagtggtatgttcgctcacaagaattggaactggagatatctgttttgttgtatttgtaatgtattgcgggaagttggaatgagtcaagtccgttttctgaataaaacggtgtatgtagtgataagtgcggggatgtattttcctgaatcgtgtgaaagagaagagatagaagaagacgcggataattttaatttattttggaaaaaaaaaaaaaaaaa

SEQ ID NO: 5483 - protein, 479 aa, Botrytis cinerea
MAQTNGVLQEPAITTMNGAPVLKPASTQRIGNQLRATLLLQDINLLELIQHITHERIPERVVHARGTSAHGYFEVTDDISDVTSAAFLNRVGKQTDIFCRFSTVAGRAESAETVRDTRGFAFKMFTEEGNLDWLFLSTPVFPIRDGAKFPSFTHATKKNPRSGLPDHKAFWDYFTHNQEGIHFLMFLFSDRATPVDFQHADIFSINTYKFTKSDGSFTYVKIHLKTNQGVKNFTQDEANQKAGVDPDFQTRSLYEDIENQKYPTWDVFAQIIDPVKAENYHINIFDATKTFPFSEFPLRKFGKITLNRNVDNFFAEQEQSAFSPTNLVPGWALTPDPIIQTRALAYADTQRYRLGANFVQLPVNAPYKKPFTPLIRDGAATVNGNLGGTPNYFPSSFYNVGAATQYAQPDEEQFQGTVVNFESEVVDADYVQPRIFWEKTLAEEPGQQDNLISNVAGHLSAVTGDKGLGSSTSGLCNVR

SEQ ID NO: 5484 - DNA, 2751 bp, Candida boidinii
  CDS (1145)..(2659)
actagtcttaaggtttccatagcctgcaacaagattcacaaagttagaaacaaattcgacaaggttttcaaaattgcatttaaatctgtgtatgtatttgtaatgtggtgatattcagccagagtctatagatcggatggccaatcgtaagcgccgacatattataaatacgcctatgattactcagacttgtgcgtagattagatctttttctggtggagtcttacaattactaatattttggcacagagtcgtttctagaccgccaaataaaaatcacacatcgattcatctttgtggggttattgcttcttaatctgtgtgtactacccatcactaatcagtaaattaacttaaaccatgatttcttgggagggttgttgttgatcttcttcggtaattctactggcgaccgtctatatgctgttctggaaccacaaatttccgccttggtggttgtcacaatctctaacgtagtaagagccggctttttttatgctgggggagggggaatcatagacaggaacagatgcggttggtgaccagatgtggttggtgacccagcgggaaggctatataggatggggaatcgtggccatggcaggtggccttggaaaagcctggcaaaggcccgaaggtgcgtcgttccccatggcgagcaccgaccttcccagatccaccgccgctgattctcatatgcgcttgcgtcccaaaagggaatgcgaattggataatggacaatcccctctttgaataaatcatgcatgatttaaagctaccgctattgttttactatgtcattgttctctggatatttttatcatgatggtagtgagcaaactacatagttaagagtatcagaaagcaattgataacagtgtataatataaaatatgcacttgaagttttcaattgagttttattattattgcttccctgaccattggctgaataatttccctttgaaattatatataccctcttgttccccattttattaatacccattgctattgctattttatatatatatatagaaataattttttatttatttattcttcctattttttgtttctctttataatattatttgtttcactgtgtaatcaaattattttaagataataaattatattcaaatatgtctaatcctccaacttatacaacttctcaaggttgtccagtcagtgacgccttttccacccaacgtatctctggtacaaagatttcaatcaagactccagttggtccattattattacaagatttcaagtttcttgattctttagctcactttgatagagagcgtatcccagaaagagttgtccatgccaaaggtgctggtgcttatggtgtctttgaagttactgaagatatttcagatatttgttcagctaaattcttagatactgttggtaaaaagaccaaaattttcactagattctctactgttggtggtgaaaagggttcatccgattctgctagagatccaagaggttttgctactaaattctataccgaagaaggtaacttagatttagtttataacaatactccaattttctttattagagatccaactaaattcccacattttattcatactcaaaagagaaatccagctactaattgtaaagatgctaatatgttctgggattacttaactaacaatccagaatctttacatcaaattatgtacttattctcaaatagaggtactccaacttcttacagaaagatgaatggttattcaggtcatagttataaatggtacaatgctaaaggtgaatgggtttcgtcagttcatttcatctctaaccaaggtgttcacaatatgactgatgaagaagctggtgatttaagtggtaaagacccagatttccaaactatggatttatacaaggccattgaacaaggtgattacccatcatgggaatgttatgttcaaactatgactttagaagaagccaagaaacaaccattctcagtttacgatttaactaaagtttggccacataaagatttcccattaagacattttggtaaatttacattaaatgaaaatgcccaaaattattttgctgaagttgaacaagctgctttctctccatctcacactgttccaggtatggaaccatcaaatgatccagttttacaatccagattattctcttacccagatactcaccgtcacagattaggtgttaattactcccaaattccagttaactgcccaatgagagctgttttcgctccacaaattagagatggttcaatgatggttaacggtaacttaggtggtactccaaattatgccggtgcttacaactgcccggttcaatatcaagctccaattaaagcatctagtaagactccagaagaacaatacgaaggcgaaactttaagttatgactggactgaagtcaatgaatacgatttctaccaaccaggtagattctgggaagttttaggtaagactaaaggtgaacaagaagctttagttcataatgttgctaatcacgtttctggtgctgatgaatttatccaagaccgtgtctttgcttatttctcaaaagccaacccagttatcggtgatttaattagaaaagaagttttaaagaagagtccaagaggtgcttctaagaataaattttaaattatttaatactttttttattttattcttttaattcttgcgtttttacttgtttcttttatttcataattatcatttatattttacgtttc

SEQ ID NO: 5485 - protein, 504 aa, Candida boidinii
MSNPPTYTTSQGCPVSDAFSTQRISGTKISIKTPVGPLLLQDFKFLDSLAHFDRERIPERVVHAKGAGAYGVFEVTEDISDICSAKFLDTVGKKTKIFTRFSTVGGEKGSSDSARDPRGFATKFYTEEGNLDLVYNNTPIFFIRDPTKFPHFIHTQKRNPATNCKDANMFWDYLTNNPESLHQIMYLFSNRGTPTSYRKMNGYSGHSYKWYNAKGEWVSSVHFISNQGVHNMTDEEAGDLSGKDPDFQTMDLYKAIEQGDYPSWECYVQTMTLEEAKKQPFSVYDLTKVWPHKDFPLRHFGKFTLNENAQNYFAEVEQAAFSPSHTVPGMEPSNDPVLQSRLFSYPDTHRHRLGVNYSQIPVNCPMRAVFAPQIRDGSMMVNGNLGGTPNYAGAYNCPVQYQAPIKASSKTPEEQYEGETLSYDWTEVNEYDFYQPGRFWEVLGKTKGEQEALVHNVANHVSGADEFIQDRVFAYFSKANPVIGDLIRKEVLKKSPRGASKNKF

SEQ ID NO: 5486 - DNA, 2632 bp, Candida tropicalis
  CDS (651)..(2108): transl_table=12
ggatcctctgtccacgggctctgggggccgatggcaactagtggtggtgagttttgtgtgagggtggcacgtgagcgagaagaatcaaccgaggaacaaacaccagcaggcgtctccccagaattttgtgtggcagtggggagcaattagccaatggatggcaagtaaaaagtaatcccaccagagaggagaagattaacaatggagggattaaacgttgtctgtttccctcctggagtgtgaacaacgcgggtctagtattagagcagccagcccagcccagcacaacccaacccaacccaactcattattaatcaagagtagaagactagatggttcaatggatgaaggttagttggttacgcgttaacgttgtgcgcactcacaattctggaactctgccatgattataataccacatgaaaaattatgtgcgaactcttaactctcaccttaacttatcatggaaaaaaaacatgctaacctccgcccccccccccccgcttatttctccccaagtcctttgcactataaatacccctgtgcttttccctctgtctggcatttcccactttccatcaaataatatccaattgattactaaaacaatcaataccaccatcaccacacccccacactaattattcaatatggctcctaccttcacaaactcaaacggtcaacctatccctgaacctttcgccactcaaagagttggtcaacacggtcctttgttgttgcaagacttcaacttgattgactccttggcccacttcgacagagaaagaatcccagaaagagtcgttcacgctaagggttcaggtgcttacggtgtctttgaagtcaccgatgacatcaccgacgtttgtgccgcaaagttcttggacactgtcggtaaaaagaccagaattttcactagattttccaccgtcggtggtgaactgggttccgctgacaccgccagagacccaagaggttttgctaccaagttttacaccgaagaaggtaacttggacttggtttacaacaacacccctgtctttttcattagagacccttccaagttccctcacttcatccacacccaaaagagaaacccggaaactcacttgaaggacgccaacatgttctgggactacttgaccaccaacgaagaatccgtccaccaagttatggttttgttctccgacagaggtaccccagcttcctacagagaaatgaatggttactctggccacacctacaagtggtccaacaacaagggtgaatggttctacgtccaggtccatttcatcagtgaccaaggtatcaagaccttgaccaacgaagaagctggctccttggctggttccaacccagactatgctcaagaagatttgttcaaaaacattgctgctggtaactacccatcctggacctgttacatccaaaccatgactgaagctcaagctaaagaagctgaattctccgtctttgacttgaccaaggtctggccacacggaaagtacccaatgagaagatttggtaagtttactttgaacgaaaacccaaagaactactttgccgaagttgaacaagctgctttctccccagcccacaccgttccacacatggaaccatctgctgacccagtcttgcaatccagattgttctcttatgctgatactcacagacacagattgggtaccaactacacccaaatcccagtcaactgcccagtcactggtgctgttttcaacccacacatgagagacggtgccatgaatgtcaatggtaacttgggcaaccatccaaactacttggcctctgacaaaccaattgaattcaagcaattctccctccaagaagaccaagaagtctggcacggtgctgctactccattccactggaaggctaccccagctgatttcaagcaagccactgaattgtggaaggtgttgaagaaatatccaaaccaacaagaacacttggcccacaatgttgctgtccatgcctctgctgccgatgctccaatccaagacagagtcattgcttactttaccaaggtccacccagacttgggagacctcatcaagaaggaaatcttggaattgtctccaagaaagtaaagaagattctgatttgatattggagtgctaaaggtcttagttatgtttgtttcttttcttttttcttattaatatttatagctgttgtaatgcgttttacagtaaattgaatggttatatttgatatatctgacagtggaagtgtagaagcaatggtggtggttgtggttattaaatgctacccgttgttcgggatgaaattctcattcattggcgcgcaaagcaaaaataacagaagatgggcgaggagttaaaaaaaaaaaaaaaagatttagctcaaaaataaaaaaaaaatttttctcacttactcacagtactggaaaatattgaaaaccatcatcatcatcaccaacaacaacaacaacaacaacaaccaaaaccgcagccatcatagcaccacgatacctataacataacccacacagctatccatctgtaccagtcactaacaaaacaacagagacagagagagaaggaaagagaaagagaaagacatcttggaatttacaaatcatgacagcgtc

SEQ ID NO: 5487 - protein, 485 aa, Candida tropicalis
MAPTFTNSNGQPIPEPFATQRVGQHGPLLLQDFNLIDSLAHFDRERIPERVVHAKGSGAYGVFEVTDDITDVCAAKFLDTVGKKTRIFTRFSTVGGELGSADTARDPRGFATKFYTEEGNLDLVYNNTPVFFIRDPSKFPHFIHTQKRNPETHLKDANMFWDYLTTNEESVHQVMVLFSDRGTPASYREMNGYSGHTYKWSNNKGEWFYVQVHFISDQGIKTLTNEEAGSLAGSNPDYAQEDLFKNIAAGNYPSWTCYIQTMTEAQAKEAEFSVFDLTKVWPHGKYPMRRFGKFTLNENPKNYFAEVEQAAFSPAHTVPHMEPSADPVLQSRLFSYADTHRHRLGTNYTQIPVNCPVTGAVFNPHMRDGAMNVNGNLGNHPNYLASDKPIEFKQFSLQEDQEVWHGAATPFHWKATPADFKQATELWKVLKKYPNQQEHLAHNVAVHASAADAPIQDRVIAYFTKVHPDLGDLIKKEILELSPRK

SEQ ID NO: 5488 - DNA, 1788 bp, Lactobacillus sakei
  CDS (191)..(1627): transl_table=11
gcgtgtctaaataccactaacccgaaaaagaactgccgataacctcggcagttcttttttagtaacttgttgagcaagctctttcatttgacggttgcctgttgaaggtcctatagtgactaggtaagttgcgcacaatctttttcagtgtgttcctagtttttaaactattcttaggaggtcaaatattatgacaaatcaactaacgactaacgaggggcaaccgtgggcggacaatcaacattcgcaaactgccggccaacgcggccccgtcttaatccaagattatcaattactcgaaaaactcgcccactttaaccgcgaacgcatccctgaacgggtggtgcatgccaaaggcgctggcgctaaaggctatttcaaggttaccaaggacatgagcgcatataccaaagccgctgttttcagtggcgtcggcaaaaaaacaccgcttatcactcgtttttctcaagtcgctggtgaagccggctatcccgatacataccgcgatgtccgcggtttcgccgttaaattctatacggaagaaggcaattacgatattgtcggcaataacacgccggtcttcttcgtcaatgatccactaaaattccccgatttcatccactctcaaaaacgtgatccccggacacatgcccgtagccaagatatgcaatgggatttctggtccctgtcacccgaatctgtccaccaagtcacgattctcatgagtgatcgcgggattcctgctagttaccggatgatgcacggctttggtagccacaccttcaaatgggttaacgcacaaggtgaacaattctgggttaaataccatttcaagacgaaccaaggtattcacaatctcagcaacgaactcgccgatgaactcgctggtaaggatactgattaccttcaaaatgatttattcgacgcaattgaaaccggcgattatccaagttggacggttgccgtccaactcgtcccttatgaagatggcttgaattatccccaagatatttttgatgttactaaagttatttcacaaaaggattatccattaatcgaaatcggtcaaatggtcctcgatgaaaatccaacgaataacttcgaagatatccaagaactggccttctcaccggctaacttagtccctgggattgaagcatcacccgacaaattacttcaaggtcgactatttggctataaggatgctgaacgttaccggcttggtgccaactacgagcaactccctgtcaaccgaccaaaagtccccgttcataattacgaacgtgacggtgcgatggcccaaaatcaagcaactggcgttaactacgaacccaacagtcaagatggacccactgaagtcccagcagctaagattcatggcgatcaactctctggtacaactggcaacttctctgccgatcccgattattactcagcagctggcaaactttaccggttattatcagccgatgaacaaacccgcttaatcgaaaatattcgcatgaatcttggtcaagtgactaaaccagaaattcaaattcgcgaagttaaacaattttaccaagctgatccagaatatggtcggcgcgtcgcaaccagcgttaaacttagatttagctcagtttgaataatcactaacacgaaaaaataggtggccccagtttgggacacctattttttattcgttatcttttttccctgtctcttgttttgccgccactcttttttcggttaataatcagaaacgttcatcttgattttcgtaacgttaagccagtcattttatgc

SEQ ID NO: 5489 - protein, 478 aa, Lactobacillus sakei
MTNQLTTNEGQPWADNQHSQTAGQRGPVLIQDYQLLEKLAHFNRERIPERVVHAKGAGAKGYFKVTKDMSAYTKAAVFSGVGKKTPLITRFSQVAGEAGYPDTYRDVRGFAVKFYTEEGNYDIVGNNTPVFFVNDPLKFPDFIHSQKRDPRTHARSQDMQWDFWSLSPESVHQVTILMSDRGIPASYRMMHGFGSHTFKWVNAQGEQFWVKYHFKTNQGIHNLSNELADELAGKDTDYLQNDLFDAIETGDYPSWTVAVQLVPYEDGLNYPQDIFDVTKVISQKDYPLIEIGQMVLDENPTNNFEDIQELAFSPANLVPGIEASPDKLLQGRLFGYKDAERYRLGANYEQLPVNRPKVPVHNYERDGAMAQNQATGVNYEPNSQDGPTEVPAAKIHGDQLSGTTGNFSADPDYYSAAGKLYRLLSADEQTRLIENIRMNLGQVTKPEIQIREVKQFYQADPEYGRRVATSVKLRFSSV

SEQ ID NO: 5490 - DNA, 1846 bp, Methanosarcina barkeri
  CDS (236)..(1753): transl_table=11
gatcagataaatcactaggataaggaattcttttattttgttctaatgttggcgaataatatggttacatgtagcatttaattttaaacagtctttttaacttggaagtctctccaaatgaaatctatttataaaaattaaacctcataactacataattttttggatatttaataacgatgtaggtttgattatatttgtcaaacgttcaattggagtagaggagtaaaatataatgggtgaaaagaattcttccaaggttctcaccactggttttggaataccggtgggggatgatcagaacagccttacagccggaaatagaggaccggttcttatgcaggatgttcatctgcttgataaacttagccatttcgaccatgaacgtatcccagagcgtgtagtacatgccaaaggtgcaggtgctggaggttactttgaagtcactgcagacgtgaccaaatataccaaagctaaatttctgtctgaaatcggtaaacgtactgaagtttttgtccgtttttccacagttggaggagagaagggatcggctgattccgctcgtgatccacgtggttttgccgtgaagttctacacagaagatggtaactacgatcttgtaggcaataatacccctgtgttttttattcgcgaccctttaaagtttcctgattttatccacacacaaaaacgtaacccagctacaaactgtaaagatccagatatgttctgggacttcctttccctgacacctgagtcaattcatcaggtcactattctcttctcagaccgcggtactcctgctacctatagaaacatgaatggttattctagccacacctataagtggtataatgaaaagggtgaatatttctgggtgcagtatcattttaagactgaccaggggataaagaacctgacccttgaagaagcagaaaaaatcggtggatcggatcccgaccacgcgacaagagacctgtatgaggctatcaagaaaggtgattatccctcctggactcttgaaatgcaaataatgactccggagcaggcagaagattaccggtttgacatcagggatataaccaaagtatggccccatggtgatttccctaccatgaaaataggcaagttggtgttgaatcgaaatccaacaaattatttcgctgaagtagaacaagcagcttttagtcctgcaaatcttgtgccaggcatcggtatttcacctgataaaatgctgcagggtagggttttttcttatcacgatactcatatccaccgtcttggtccaaattataatctaatacctgttaatgcaccaaagtactcacctgaaaatagttatcagcgtgatggattcatgcgtgttgatgctaacgggggcagtggacccaactattggccaaacagttttggaggaccttctcccgactctgtttatctggaacctccatttggagtatcaggactagcagctcgcacactctatacacatccaaatgatgactttgtacaggctggaaatttgtaccgtgacgttatgactgactacgatcgtgaaaaccttgtaggaaatatcgtatctcatctctctgccgcacagaagcgtatacagcttaggcagacagcattgttctttaaagctgatcgtgactatggaagccgtgtcgctaagggtcttgagcttgatattaaggaagttgagcgcctagctaatatgaccaatgaagagcgagcccgagcaactgagagataatattcctttaagacagtcaaaggctaaatcccacgctctttagacgtgggatatagccgtcaactatattcatttattttgatattatttact

SEQ ID NO: 5491 - protein, 505 aa, Methanosarcina barkeri
MGEKNSSKVLTTGFGIPVGDDQNSLTAGNRGPVLMQDVHLLDKLSHFDHERIPERVVHAKGAGAGGYFEVTADVTKYTKAKFLSEIGKRTEVFVRFSTVGGEKGSADSARDPRGFAVKFYTEDGNYDLVGNNTPVFFIRDPLKFPDFIHTQKRNPATNCKDPDMFWDFLSLTPESIHQVTILFSDRGTPATYRNMNGYSSHTYKWYNEKGEYFWVQYHFKTDQGIKNLTLEEAEKIGGSDPDHATRDLYEAIKKGDYPSWTLEMQIMTPEQAEDYRFDIRDITKVWPHGDFPTMKIGKLVLNRNPTNYFAEVEQAAFSPANLVPGIGISPDKMLQGRVFSYHDTHIHRLGPNYNLIPVNAPKYSPENSYQRDGFMRVDANGGSGPNYWPNSFGGPSPDSVYLEPPFGVSGLAARTLYTHPNDDFVQAGNLYRDVMTDYDRENLVGNIVSHLSAAQKRIQLRQTALFFKADRDYGSRVAKGLELDIKEVERLANMTNEERARATER

SEQ ID NO: 5492 - DNA, 1518 bp, Micrococcus luteus
  CDS (3)..(1514): transl_table=11
ccatggagcaccagaagacgacgccgcacgcgaccggctcgacccgccagaacggcgccccggccgtcagcgaccgccagtccctgaccgtgggcagcgagggtcccatcgtcctgcacgacacccacctgctggagacccaccagcacttcaaccgcatgaacatcccggagcgccgcccgcacgccaagggctcgggcgcgttcggcgagttcgaggtgaccgaggacgtgtcgaagtacaccaaggccctcgtgttccagccgggcacgaagaccgagaccctcctgcgcttctccaccgtggccggcgagctcggctccccggacacctggcgcgacgtgcgcggcttcgcgctgcgcttctacaccgaggagggcaactacgacctcgtcggcaacaacaccccgatcttcttcctgcgcgaccccatgaagttcacccacttcatccgctcgcagaagcgcctgccggactccggcctgcgcgatgccaccatgcagtgggacttctggaccaacaaccccgagtcggcgcaccaggtgacctacctgatgggcccgcgcggcctgccccgcacctggcgtgagatgaacggctacggctcccacacctacctgtgggtcaacgcccagggtgagaagcactgggtgaagtaccacttcatctcccagcagggcgtgcacaacctctcgaacgacgaggccaccaagatcgccggcgagaacgccgacttccaccgccaggacctgttcgagtccatcgccaagggcgaccaccccaagtgggacctctacatccaggcgatcccctacgaggagggcaagacctaccggttcaaccccttcgacctgacgaagacgatctcccagaaggactacccgcgcatcaaggtcggcacgctgaccctgaaccgcaacccggagaaccacttcgcgcagatcgagtccgccgcgttcagcccgagcaacaccgtgccgggcatcggcctgtccccggaccgcatgctcctgggccgcgccttcgcgtaccacgacgcgcagctgtaccgcgtgggcgcccacgtgaaccagctgccggtgaaccgtcccaagaacgcggtgcacaactacgccttcgagggccagatgtggtacgaccacaccggcgaccgctccacctacgtgccgaactccaacggcgactcctggtcggacgagaccggcccggtggacgacggctgggaggccgacggcaccctgacccgtgaggcccaggcgctgcgcgcggacgacgacgacttcggccaggccggcaccctcgtccgcgaggtcttctcggaccaggagcgtgacgacttcgtggagaccgtggccggcgcgctgaagggtgtccgccaggacgtccaggcccgcgccttcgagtactggaagaacgtggacgccacgatcggccagcgcatcgaggacgaggtcaagcgccacgagggcgacggcatcccgggcgtcgaggccggcggcgaggcccgcatgtgaattc

SEQ ID NO: 5493 - protein, 503 aa, Micrococcus luteus
MEHQKTTPHATGSTRQNGAPAVSDRQSLTVGSEGPIVLHDTHLLETHQHFNRMNIPERRPHAKGSGAFGEFEVTEDVSKYTKALVFQPGTKTETLLRFSTVAGELGSPDTWRDVRGFALRFYTEEGNYDLVGNNTPIFFLRDPMKFTHFIRSQKRLPDSGLRDATMQWDFWTNNPESAHQVTYLMGPRGLPRTWREMNGYGSHTYLWVNAQGEKHWVKYHFISQQGVHNLSNDEATKIAGENADFHRQDLFESIAKGDHPKWDLYIQAIPYEEGKTYRFNPFDLTKTISQKDYPRIKVGTLTLNRNPENHFAQIESAAFSPSNTVPGIGLSPDRMLLGRAFAYHDAQLYRVGAHVNQLPVNRPKNAVHNYAFEGQMWYDHTGDRSTYVPNSNGDSWSDETGPVDDGWEADGTLTREAQALRADDDDFGQAGTLVREVFSDQERDDFVETVAGALKGVRQDVQARAFEYWKNVDATIGQRIEDEVKRHEGDGIPGVEAGGEARM

SEQ ID NO: 5494 - DNA, 1845 bp, Onchocerca volvulus endobacterium
  CDS (174)..(1622): transl_table=11
cgaatacacgttcatcccgtgcagcaacttttgatgtccgttcggatgtatcgttagttaatttctatcggtgggtatgatttaataaatttgatggtgtcatcttcctggtcaataatcgctccaagcccgattagccggcagttccaagactgacctgaggaagattgagcatgagccagaataaaacccttactaccgccagcgggccacctgtcgcggataaccagaattcccgttccgccggcccacgcggcccgctgctgctcgacgactttcacctgatcgagaagctcgctcacttcaaccgtgaaaacattcctgagcgtcgtgtacacgccaaaggctcgggcgcttacggtaccttcaccgtcactcaagacatcacgcagtacaccagcgccaagctgttcgattctgtgggcaagcaaactccgactttcctgcgcttctccacggtgggtggcgagcgtggttcggctgatactgagcgcgacccgcgtggtttcgcgttgaagttctacaccgaagaaggcaactgggacatcgttggtaacaacaccccggtgttcttcatccgcgacccgctgaagtttcccgactttatccacacccaaaagcgcctgccgcaaagcaacctgaaaagtgcacagatgatgtgggacttctggtcgcactcccctgaggcgctgcaccaggtcaccatcctgttttcggaccgtggcatcccggacggctaccgtcacatgcacggcttcggcagtcacacctacagcttgattaacgccaaaggcgagcgtcactgggtgaagtggcactacaagaccaagcaaggtatcaagaacctggcgccggctgacgctgcacgcctggcgggtaccgaccctgattacgctcagcgcgatctgttcggtgctattgagcgtggtgacttcccgaaatggcgcgtgtgcattcagatcatgactgaggcccaggccaacgctcactacgaaaacccgttcgacgtgaccaagacctggtcgcagaaagagttcccgctgatcgaagtgggtgagctggaactgaaccgcaacccgctgaactacttcgctgaagttgaacaggcggctttcggtccaagcaacatggtcccgggtgttggcctgtcgccagaccgcatgctgcaagggcgcgtgttcgcttacgccgatgcccatcgctatcgcgtaggtaccaatcaccagcaactgccggtgaatgcgccacgcagcccagtcaacagctaccagcgtgatggttcgatggcattcggctccaatggtggtgcggcccccaattacgagccaaacagctacgccgatgcgccgaagcaggctcctcagtatgccgagccagccttggccctgagcggtgcggctgatcgttacgatcaccgcgaagataccgactactacagccatgccggtgcgctgttccgcctgatgaacgatgagcagaaagccctgctgatcaacaatatcgccggcgcaatggcgggtgtttccagcgacgtggtgcagcgccagttgcagtacttcttcaaggccgacccggcttatggagaagggatcgcatctgcactgggtgtatcgcttaactgactctaaacgataagcagaaccgccctcatttgggcgtttttgcgttatttaagctacttttcaccggaaatcttcacttttctgccgttggtcccgtgacctccgggtcatcatggttcaaactacagactttcaagcagggagatgtagggcgatgcaaggtcaccccgacgtaatcgattacctcaacgcgttgctgacgggcgaactggcagctcgtgac

SEQ ID NO: 5495 - protein, 482 aa, Onchocerca volvulus endobacterium
MSQNKTLTTASGPPVADNQNSRSAGPRGPLLLDDFHLIEKLAHFNRENIPERRVHAKGSGAYGTFTVTQDITQYTSAKLFDSVGKQTPTFLRFSTVGGERGSADTERDPRGFALKFYTEEGNWDIVGNNTPVFFIRDPLKFPDFIHTQKRLPQSNLKSAQMMWDFWSHSPEALHQVTILFSDRGIPDGYRHMHGFGSHTYSLINAKGERHWVKWHYKTKQGIKNLAPADAARLAGTDPDYAQRDLFGAIERGDFPKWRVCIQIMTEAQANAHYENPFDVTKTWSQKEFPLIEVGELELNRNPLNYFAEVEQAAFGPSNMVPGVGLSPDRMLQGRVFAYADAHRYRVGTNHQQLPVNAPRSPVNSYQRDGSMAFGSNGGAAPNYEPNSYADAPKQAPQYAEPALALSGAADRYDHREDTDYYSHAGALFRLMNDEQKALLINNIAGAMAGVSSDVVQRQLQYFFKADPAYGEGIASALGVSLN

SEQ ID NO: 5496 - DNA, 2620 bp, Pichia angusta
  CDS (645)..(2168)
gtcgacggtgtaaacagcctgcagctcgctgggcttgagcgtcgggtcgggctggagcgagctctgtgcaatgcgggcctgttttgccgagcaaaatgggatccagtacgatctagacggtcagacaacaacaatgacgactacttacagtttgtgagagaacaccataagaaaaagattgttgcacagcccgctttgagaaggaaataaccgtagcctatatcagtcactcctcgcaccgcaacgattctgaaatgattgcgatttcctaatccagccttacaaattcaagcaacccaattggccccacaaacgcagcaagtccaaaaaatgtgctcgacaagtttgtggattttgctgtaccgcggcgggtgaacgatgcaaagtgctgtttcttgaagacaattggtcatcagcattcagcattcagcatggatctcgtgatcggagagcaactgtagagtgactcttattaattatgcaaccaagtccagaaactctcctcagatatgtcagcaattttgaaactagtaaaataatagtctatgcatgcaggcgggggcaacagtactaattgaagcctaagcaaaaatatataaaggctcccggccgcaccccaacttggctaatcactgttgaacaaaatgtcaaacccccctgttttcactacttcgcaaggttgtcccgtgtcggatcccttcaccacccaacggatccctctggattccacgggctacaagtatgcccctccaattggtccattgctcttgcaggacttcaagctcattgacacactctcccactttgacagagaaagaattccagagagagtggtgcacgccaagggtgccggagcttacggtgtgtttgaagtgaccgacgacattaccgatgtttgcagtgccaagttcctcgacactgttggtaagaagacaagaattttcaccagattctccactgtgggtggagaaaaaggttctgcagacacagccagggacccaaggggatttgctaccaaattctacacagaagacggaaacttggaccttgtgtacaacaacacgccgatcttcttcatcagggacccaattaagttcccccactttattcacacgcagaagagaaacccggccaccaacttgaaggacccaaacatgttctgggactacctgacggccaatgacgagtctttgcaccaagtcatgtatttattctccaacagaggtacgcctgcctcgtacagaaccatgaacggctactctggccacacctacaaatggtacaattccaagggcgagtgggtgtatgtgcaggtccacttcattgccaaccaaggcgtgcacaatctgctcgacgaggaagctggaaggctggctggagaagatccagaccactccaccagagacttgtgggaagcaattgagaaaggagattatccatcgtgggagtgctacatccagaccatgacccttgagcagtccaagaagctgccattctctgtgtttgacttgaccaaggtctggccacacaaggacttcccgctgagacactttggcagattcactcttaatgagaatcctaagaattactatgctgaaacggagcagattgccttctctccttcgcacaccgttcctggaatggagccttcgaacgaccctgtcttgcaatcgagactgttttcgtacccagacacgcacagacacagacttggacctaactaccaccagatccctgtcaactgtccactgaaatcgggctcgttcaatcctatcaacagagacggtcctatgtgtgttgatggcaacttgggaggcacgccgaactacgcaaacgcttacaactgtcctattcagtacgctgtgagccctaaggcatctggcaataagccagacgaaaagtatactggagaagtggtcccataccactgggagcacactgattatgactacttccagccaaagatgttctggaaggttcttggcaggacgccaggcgaacaggagtcccttgtcaagaacgttgcaaaccatgtttctgctgctgacgagttcatccaggaccgtgtttacgaatacttctcgaaggccgagcctattattggagatctgatcagaaagaaggttcaggagctcaaaagaaaggcttcttctccatccaaaatataatcatcgataagtatttattgaatcagtgttcgtatactatattttttttcattatctgcctgatttttttttccctgattatagcttcctgatctggcagtcctgtccgccgtatcatccttcctaaaacagcacgagatatcggtatattataagaagcgtatttttccaatcattatctttatttttcatcgttcatggcttgtggatgttccggtaacaagaggacgcagaccgtcaccgtccagcgtccgcagaatctcgtttctgaaaagtcgtcgaagccatcgacctgctgtggcggcaaggaggaaaccaggtgcaagtgcggatctgcttgcaagtgtccaagttgtaacaccaccaagtaagtatcaacttattcatcatgctaactcccagactgtgaagagcttgtccggatgtgctcaaatcatacagaagaagagatc

SEQ ID NO: 5497 - protein, 507 aa, Pichia angusta
MSNPPVFTTSQGCPVSDPFTTQRIPLDSTGYKYAPPIGPLLLQDFKLIDTLSHFDRERIPERVVHAKGAGAYGVFEVTDDITDVCSAKFLDTVGKKTRIFTRFSTVGGEKGSADTARDPRGFATKFYTEDGNLDLVYNNTPIFFIRDPIKFPHFIHTQKRNPATNLKDPNMFWDYLTANDESLHQVMYLFSNRGTPASYRTMNGYSGHTYKWYNSKGEWVYVQVHFIANQGVHNLLDEEAGRLAGEDPDHSTRDLWEAIEKGDYPSWECYIQTMTLEQSKKLPFSVFDLTKVWPHKDFPLRHFGRFTLNENPKNYYAETEQIAFSPSHTVPGMEPSNDPVLQSRLFSYPDTHRHRLGPNYHQIPVNCPLKSGSFNPINRDGPMCVDGNLGGTPNYANAYNCPIQYAVSPKASGNKPDEKYTGEVVPYHWEHTDYDYFQPKMFWKVLGRTPGEQESLVKNVANHVSAADEFIQDRVYEYFSKAEPIIGDLIRKKVQELKRKASSPSKI

SEQ ID NO: 5498 - DNA, 1799 bp, Pseudomonas putida
  CDS (231)..(1670): transl_table=11
taaagttggagtggttgatttttcggttgggcggtgctgtagaagctgctggagtaagaacttctgtctggtaacaaaaaaccgggtctagtgcccggttttttgttgctgatggtattgttaatttctattgatgtaagtcagttaatgaatttgtccctatagccttgctcgtcaatactctctccatagccgattagccggcgcttcaagaccgataaggagagcccatgagcaagattctcaccaccgccagcggtgcacctgtagccgacaaccagaactcccgctccgccggcccacgcggcccgctgctgctcgacgacttccacctgatcgagaagctcgcccatttcaaccgtgagaacatccccgagcgccgggtacacgcgaagggttcgggcgcctatggcacttttaccgtaacccgcgacatcaccggttacaccagcgccaaactgttcgagcaggttggcaagcagaccgagacatttctgcgcttctctaccgtgggtggcgaacgtggttctgcggacacagagcgagaccctcgcggatttgccgttaagttctacaccgaggaaggtaactgggacatcgtgggtaacaacacgccagtgttcttcattcgtgatccgctcaagttcccggactttatccacacccagaaacggcacccgcagtccaacctgaaaaacgcccaaatattttgggattcctggtcgcactcgcccgaggcgctgcaccaagtcaccatcctgttctctgatcgtggcattccggacggctaccgccacatgcacggctttggcagccacacctacagcctgatcaatgcccagggtgagcgcacttgggtcaaatggcacttcaagacccagcagggcatcaagaaccttgctccggcagatgccgcacgtttggcaggtactgacccggactacgcccagcgcgacctgttcgaagccattgagcgaggtgattacccacgctggactgtctgcatccaggtgatgagcgaagccgaagccgcgagccgcgacgagaacccgttcgacgtgaccaaaacctggtcacaaaaggactacccgttgatcgaagtgggcgtgcttgagcttaaccgtaacccgctcaattacttcgccgaagtcgagcaggctgccttcgggccaagcaacatggtgccgggggtcggcctgtcgccagaccgcatgctccagggtcgcgtattcgcctacgcggacgcacaccgctaccgtgtgggtaccaaccaccaacagttgccggtgaatgcgccacgctgcccggtcaacagctaccagcgcgacggctccatggccactggcagctatggcagtgcgccgaactacgaacccaacagctacgccgcggcaccgaagcagtcgccacgtcacgcagagcccgcattggccctgaatggttcggccgaccgttacgatcaccgcgaggacgctgactactacagccacgccggcgcgctgttccgcctgatgagtgatgagcagaaggccctgctgatcagcaacatcgctggaaccatggcgggtgtcagcgaaaacgtcatccaacggcagttgcagtacttcttcaaggccgacccagcctacggagaaggcatcgccaagggcctgggcatcaatctcgcctaagtcgaagtgataagaagaacccgccttcatttgggcggtttttcaatgaatatcactactgtttaaccgattttttgcttcttattgcgcgtttttcagtgaccgcaggcaaaagctggttcacactat

SEQ ID NO: 5499 - protein, 479 aa, Pseudomonas putida
MSKILTTASGAPVADNQNSRSAGPRGPLLLDDFHLIEKLAHFNRENIPERRVHAKGSGAYGTFTVTRDITGYTSAKLFEQVGKQTETFLRFSTVGGERGSADTERDPRGFAVKFYTEEGNWDIVGNNTPVFFIRDPLKFPDFIHTQKRHPQSNLKNAQIFWDSWSHSPEALHQVTILFSDRGIPDGYRHMHGFGSHTYSLINAQGERTWVKWHFKTQQGIKNLAPADAARLAGTDPDYAQRDLFEAIERGDYPRWTVCIQVMSEAEAASRDENPFDVTKTWSQKDYPLIEVGVLELNRNPLNYFAEVEQAAFGPSNMVPGVGLSPDRMLQGRVFAYADAHRYRVGTNHQQLPVNAPRCPVNSYQRDGSMATGSYGSAPNYEPNSYAAAPKQSPRHAEPALALNGSADRYDHREDADYYSHAGALFRLMSDEQKALLISNIAGTMAGVSENVIQRQLQYFFKADPAYGEGIAKGLGINLA

SEQ ID NO: 5500 - DNA, 1539 bp, Schizosaccharomyces pombe
  CDS (1)..(1539)
atgaactcgaaagactcaaataccgtccctgtttacaccaccaacaccggttgtcccatttttaaccctatggctgcggctcgtgtgggtaagggaggtcctgtcttacttcaagattcccatttaatcgacgtctttcaacactttgatcgcgagcgtattcctgaacgtgtcgtccatgcaaagggttccggtgcttttggtgaattcgaatgcaccgacgacattaccaagtataccaaacataccatgttttctaaggttggtaagaaaacccctatggttgctcgtttctccaccgtcggtggtgaaaggggtactcctgatactgctcgtgatcctcgtgggttcgcattaaagttctacaccgatgaaggtattttcgatatggttggaaacaatacccctgtcttcttccttcgtgatcccgctaaattccctctcttcatccatactcagaagcgtaaccctcaaaatgatatgaaggatgctactatgttttgggattacctttctcaaaacgcagagtccatccatcaagttatgattcttttctctgacttgggtggtaccccttatagctaccgtttcatggatggcttttccagtcatacctacaaatttgttaatgataagggtgaattctactattgcaaatggcatttcattactaatcaaggaaccaagggtttaacaaatgaagaagccgctgcattggatggatccaatcccgaccatgctcgtcaagatcttttcgaagctattgaacgtggtgattaccccagttggacgctttacgttcaagttatgacccctcaggaggctgaaaaatatcgctacaacattttcgatcttactaaggtctggcctcataaggacgtaccaatgcaaagggttggacgctttaccttgaatcagaatcctaccaatttctttgcagatatcgagcaggctgggttctctccttctcatatggttcctggtattgaagtctcagcggatcctgttttgcaagtacgtacattttcctatcctgatacccaccgccatcgtttgggtgctaatttcgagcaaattcccgtcaattctcctaagtgtcctgtctttaactattctcgtgacggccctatgaatgtcaatggaaaccaaggaaattggccaaactatccatcctcaatccgaccacttgctaaagttcaatatgagcctgacgaaggtcacgaaaagtgggtaggtcaagttacttaccatatggacgaaattaccgacgttgattttgagcaacctagagcgttttggcaaaatgttttgggcaagaaacctggacagcaagataactttgttaagaacgttgccggtcacttgtctggtgctatatctcctgtacgtgaacgccaatacggtgtatttactcgtgttgattcagagcttggtcgccgtattcgtgaggctactgaagctgaagtgaagaagatggaagaaaaagcccccaagccaattaacaagggcgaaccccatatgttccaaggaagctcataa

SEQ ID NO: 5501 - protein, 512 aa, Schizosaccharomyces pombe
MNSKDSNTVPVYTTNTGCPIFNPMAAARVGKGGPVLLQDSHLIDVFQHFDRERIPERVVHAKGSGAFGEFECTDDITKYTKHTMFSKVGKKTPMVARFSTVGGERGTPDTARDPRGFALKFYTDEGIFDMVGNNTPVFFLRDPAKFPLFIHTQKRNPQNDMKDATMFWDYLSQNAESIHQVMILFSDLGGTPYSYRFMDGFSSHTYKFVNDKGEFYYCKWHFITNQGTKGLTNEEAAALDGSNPDHARQDLFEAIERGDYPSWTLYVQVMTPQEAEKYRYNIFDLTKVWPHKDVPMQRVGRFTLNQNPTNFFADIEQAGFSPSHMVPGIEVSADPVLQVRTFSYPDTHRHRLGANFEQIPVNSPKCPVFNYSRDGPMNVNGNQGNWPNYPSSIRPLAKVQYEPDEGHEKWVGQVTYHMDEITDVDFEQPRAFWQNVLGKKPGQQDNFVKNVAGHLSGAISPVRERQYGVFTRVDSELGRRIREATEAEVKKMEEKAPKPINKGEPHMFQGSS

SEQ ID NO: 5502 - DNA, 1691 bp, Solanum melongena
  CDS (20)..(1498)
ctcatcaatttccatcactatggatctctctaagtatcgcccttcaagcgcatacgacacccctttcttgacaacaaatgctgggggtcctgtgtacaacaatgtatcttccttgactgttggacctagagggcctgttctgcttgaggattatcatttaatagagaagcttgcgacttttgatcgcgagaggatacctgagcgtgttgttcatgctcgaggtgctagtgccaagggattctttgaagtcactcatgatgtttctcatcttacttgtgctgatttcctccgagctcctggcgttcaaacgcctgttatttgtcgcttctctactgttgttcatgaacgtggaagccccgagtctatcagggatattcgcggttttgctgtcaaattttacaccagagaggggaactttgatctggttggaaacaacgtccctgtcttctttaatcgcgatgcaaagtcattccctgacacgattcgtgcattgaaaccaaatccaaagtcacacattcaggaaaactggaggatccttgatttcttctctttccttccggagagtttgcatacgtttgcctttttctatgacgatgtttgtctaccgataaattacagacacatggaaggatttggggttcatgcttatcaattgatcaacaaagctgggaaagcacattatgtgaagtttcactggaagccaacttgtggtgtcaaaagcatgacggaggaagaagctattagagtcggaggtactaatcatagccacgcgaccaaggatctctacgattcaattgctgctggaaactatccagagtggaaactttttatccaaattatggaccctgaggatgtagacaaattcgactttgatcctctcgatgtaaccaagacatggcctgaggatatcttgcctttgatgccagttggtcgattggtgttgaatagaaacattgataacttctttgctgagaatgagcagctcgcgtttaaccctggtcatatcgtccctggtgtttactattcggaggataagcttcttcagactaggatatttgcatatgctgatactcagagacaccgtattgggccaaactatatgcagctcccagttaatgctcccaagtgtgctcatcacaacaatcatcgcgatggtgccatgaacttcatgcatcgcgatgaagaggtggattatttgccctcaaggtttgatccttgtcgtcctgctgagcagtacccaattccttcttgtgtcttgacaggaaggcgcgagaagtgtgtcattccgaaggagaacaacttcaaacaggcaggggagagataccgaacctgggaacctgacaggcaagatagatacatcaacaaatgggttgagtctttatccgatccacgagtcactcatgagattcgcagtatatggatatcatacttgtctcaggctgacaagtcctgtggtcagaaggtcgcttctcgtctactggtcaagcctacaatgtgaagaagatgaagaaaatagttggaaatgttgaaggactaatacaagaaaaacgtccgcgctgtgctgtaaactgtactatgtttttaatgtgtatttgtatccatcttcgatgtcttgtgtttttactacgatgatgttggaacctgaataagtttggagttgtatgttcaagtactctaccttgttttaaaaa

SEQ ID NO: 5503 - protein, 492 aa, Solanum melongena
MDLSKYRPSSAYDTPFLTTNAGGPVYNNVSSLTVGPRGPVLLEDYHLIEKLATFDRERIPERVVHARGASAKGFFEVTHDVSHLTCADFLRAPGVQTPVICRFSTVVHERGSPESIRDIRGFAVKFYTREGNFDLVGNNVPVFFNRDAKSFPDTIRALKPNPKSHIQENWRILDFFSFLPESLHTFAFFYDDVCLPINYRHMEGFGVHAYQLINKAGKAHYVKFHWKPTCGVKSMTEEEAIRVGGTNHSHATKDLYDSIAAGNYPEWKLFIQIMDPEDVDKFDFDPLDVTKTWPEDILPLMPVGRLVLNRNIDNFFAENEQLAFNPGHIVPGVYYSEDKLLQTRIFAYADTQRHRIGPNYMQLPVNAPKCAHHNNHRDGAMNFMHRDEEVDYLPSRFDPCRPAEQYPIPSCVLTGRREKCVIPKENNFKQAGERYRTWEPDRQDRYINKWVESLSDPRVTHEIRSIWISYLSQADKSCGQKVASRLLVKPTM

SEQ ID NO: 5504 - DNA, 1518 bp, Staphylococcus aureus
  CDS (1)..(1518): transl_table=11
atgtcacgacaagataaaaagttaactggtgtttttgggcatccagtatcagatcgagaaaatagtatgacagcagggcctaggggacctcttttaatgcaagatatttacttcttagagcaaatgtctcaatttgatagagaagtaatacctgagcgtcgtatgcatgccaaaggttctggtgcatttgggacatttactgtaactaaagatataacaaaatatacgaatgctaaaatattctctgaaataggtaagcaaaccgaaatgtttgcccgtttctctactgtagcaggagaacgtggtgctgctgatgcggagcgtgacattcgaggatttgcgttaaagttctacactgaagaaggaaactgggatttagtagggaataacacaccagtattcttctttagagatccaaagttatttgttagtttaaatcgtgcggtgaaacgagatcctagaacaaatatgagagatgcacaaaataactgggatttctggacggggcttccagaagcattgcaccaagtaacgatcttaatgtcagatagagggattcctaaagatttgcgtcacatgcatgggttcggttcacacacatactctatgtataatgattctggtgaacgtgtttgggttaaattccattttagaacgcaacaaggtattgaaaacttaactgatgaagtagctgctgaaattatagcaacagatcgcgattcatctcaacgcgatttattcgaagccattgaaaaaggtgattatccaaaatggacaatgtatattcaagtaatgactgaggaacaagctaaaaaccataaagataatccatttgatttaacaaaagtatggtatcacgatgagtatcctctaattgaagttggagagtttgaattaaatagaaatccagataattactttatggatgttgaacaagctgcgtttgcaccaactaatattattccaggattagatttttctccagacaaaatgctgcaagggcgtttattctcatatggcgatgcgcaaagatatcgattaggagttaatcattggcagattcctgtaaaccaacctaaaggtgttggtattgaaaatatttgtccttttagtagagatggtcaaatgcgcgtagttgacaataaccaaggtggaggaacacattattatccaaataaccatggtaaatttgattctcaacctgaatataaaaagccaccattcccaactgatggatacggctatgaatataatcaacgtcaagatgatgataattattttgaacaaccaggtaaattgtttagattacaatcagaggacgctaaagaaagaatttttacaaatacagcaaatgcaatggaaggcgtaacggatgatgttaaacgacgtcatattcgtcattgttacaaagctgacccagaatatggtaaaggtgttgcaaaagcattaggtattgatataaattctattgatcttgaaactgaaaatgatgaaacatacgaaaactttgaaaaataa

SEQ ID NO: 5505 - protein, 505 aa, Staphylococcus aureus
MSRQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEVAAEIIATDRDSSQRDLFEAIEKGDYPKWTMYIQVMTEEQAKNHKDNPFDLTKVWYHDEYPLIEVGEFELNRNPDNYFMDVEQAAFAPTNIIPGLDFSPDKMLQGRLFSYGDAQRYRLGVNHWQIPVNQPKGVGIENICPFSRDGQMRVVDNNQGGGTHYYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 5506 - DNA, 1756 bp, Staphylococcus aureus
  CDS (166)..(1683): transl_table=11
aagctttttaagtgtactattcaataactatttagtactgtaaagcggaaaaattaaaattttctgattttttaatcatcttgagcatgtttaattgtaattttgatggggttaaattataatatgtattaaattataattattataaattgtggagggatgactatgtcacaacaagacaaaaagttaactggtgtttttgggcatccagtatcagaccgagaaaatagtatgacagcagggcctaggggacctcttttaatgcaagatatttactttttagagcaaatgtctcaatttgatagagaagtaataccagaacgtcgaatgcatgccaaaggttctggtgcatttgggacatttactgtaactaaagatataacaaaatatacgaatgctaaaatattctctgaaataggtaagcaaaccgaaatgtttgcccgtttctctactgtagcaggagaacgtggtgctgctgatgcggagcgtgacattcgaggatttgcgttaaagttctacactgaagaagggaactgggatttagtagggaataacacaccagtattcttctttagagatccaaagttatttgttagtttaaatcgtgcggtgaaacgagatcctagaacaaatatgagagatgcacaaaataactgggatttctggacgggtcttccagaagcattgcaccaagtaacgatcttaatgtcagatagagggattcctaaagatttacgtcatatgcatgggttcggttctcacacatactctatgtataatgattctggtgaacgtgtttgggttaaattccattttagaacgcaacaaggtattgaaaacttaactgatgaagaagctgctgaaattatagctacagatcgtgattcatctcaacgcgatttattcgaagccattgaaaaaggtgattatccaaaatggacaatgtatattcaagtaatgactgaggaacaagctaaaaaccataaagataatccatttgatttaacaaaagtatggtatcacgatgagtatcctctaattgaagttggagagtttgaattaaatagaaatccagataattactttacggatgttgaacaagctgcgtttgcaccaactaatattattccaggattagatttttctccagacaaaatgctgcaagggcgtttattctcatatggcgatgcgcaaagatatcgattaggagttaatcattggcagattcctgtaaaccaacctaaaggtgttggtattgaaaatatttgtccttttagtagagatggtcaaatgcgcgtagttgacaataaccaaggtggaggaacacaccattatccaaataaccatggtaaatttgattctcaacctgaatataaaaagccaccattcccaactgatggatacggctatgaatataatcaacgtcaagatgatgataattattttgaacaaccaggtaaattgtttagattacaatcagaggacgctaaagaaagaatttttacaaatacagcaaatgcaatggaaggcgtaacggatgatgttaaacgacgtcatattcgtcattgttacaaagctgacccagaatatggtaaaggtgttgcaaaagcattaggtattgatataaattctattgatcttgaaactgaaaatgatgaaacatacgaaaactttgaaaaataaatttgatatgtagtttctatattgcgtagttgagcagtttatgatatcataataaatcgtaaagattcctaac

SEQ ID NO: 5507 - protein, 505 aa, Staphylococcus aureus
MSQQDKKLTGVFGHPVSDRENSMTAGPRGPLLMQDIYFLEQMSQFDREVIPERRMHAKGSGAFGTFTVTKDITKYTNAKIFSEIGKQTEMFARFSTVAGERGAADAERDIRGFALKFYTEEGNWDLVGNNTPVFFFRDPKLFVSLNRAVKRDPRTNMRDAQNNWDFWTGLPEALHQVTILMSDRGIPKDLRHMHGFGSHTYSMYNDSGERVWVKFHFRTQQGIENLTDEEAAEIIATDRDSSQRDLFEAIEKGDYPKWTMYIQVMTEEQAKNHKDNPFDLTKVWYHDEYPLIEVGEFELNRNPDNYFTDVEQAAFAPTNIIPGLDFSPDKMLQGRLFSYGDAQRYRLGVNHWQIPVNQPKGVGIENICPFSRDGQMRVVDNNQGGGTHHYPNNHGKFDSQPEYKKPPFPTDGYGYEYNQRQDDDNYFEQPGKLFRLQSEDAKERIFTNTANAMEGVTDDVKRRHIRHCYKADPEYGKGVAKALGIDINSIDLETENDETYENFEK

SEQ ID NO: 5508 - DNA, 1527 bp, Vibrio vulnificus
  CDS (1)..(1527): transl_table=11
atgcatatgtcaaaaagctttttattaatttcgatgggtttggcgagtatttcggtacacgctcaaacgcttactcgtgacaatggtgcacccgttggtgacaaccagaattcgataaccgcaggggaaaacggcagcgtattgctgcaagacgttcacctgatccaaaaacttcagcgttttgccagagaacgtattcctgagcgcgtagtgcatgctcgcggtacaggtgcgcatggtgaattcgtcgtatctggtgatttcagtgatttaactctttcttctccttttgctcaatcaggaaaagtaaccccagtgtttgtacgtttttctactgtgattcattccaaaggttcaccagaaactctgcgtgatccgcgtggatttgcgacaaaattttataccgaccaaggcaactgggatcttgttggcaacaacctacccgtcttttttattcgtgactcgatcaagttccctgacatggtgcattcattaaaaccgtctccggtcaccaatcttcaagatccgaatcgtttttttgattttttcagtagccaaccaagcgcaaccaatatgctgacttgggtttacaccaatttaggcaccccagcgagctaccgcacgatggatggctttggtgtgcacgcgtacaaatggatcaaccgaaaaggcgaagtgaactacgttaagtttcactggaagagccaacaaggtgtgaagagtttacgcccggcggaagtgaccaaagtgcaaggggaagatttcaatcacctgactaacgatctctatacgcagattaacgcggggaactttccgaagtgggatctttacgtcaaagtgctttctccaaaagcgttatcaaaactcgattacaacggtctagacgccaccaaggtttggttggatgtgcctgagaaaaaggttggcaccatgacgctcaatcgtgtacccgataatttctttttagagacagaacaatctgcctttgcgccatccaatattattcctggtattgaaccttcagaagatcgcctgcttcaaggtcgcttgtttgcttatgccgatacgcagttgtatcgccttggtgccaacttgttccagttgcccgtcaacagcccgaaaagcccagtggccaatcacaaccaagatggcccaagcaacaactctactggtttaggaaatgtcgatagcttagacgtgaattacgagcctagccgtttggttaatctgaccgtggataaacaagcgagagcagtagaaacgccactttctggccatgttcaacagcaggcaatccgcaatccgcgagatttcttccaagccggcgtgctttaccgcagcttgagcgaacaagacaaggcggacttaattcacaacctgtctggcgatttaaacaaggtaaacgatgccgaagtcaaagccatcatggtgagctacttctaccgtgcagacaaagagtatggcactcgtctagccaaagcgactgacgtcaatttaaaacaagtcactaaactggcgtcgatgtaa

SEQ ID NO: 5509 - protein, 508 aa, Vibrio vulnificus
MHMSKSFLLISMGLASISVHAQTLTRDNGAPVGDNQNSITAGENGSVLLQDVHLIQKLQRFARERIPERVVHARGTGAHGEFVVSGDFSDLTLSSPFAQSGKVTPVFVRFSTVIHSKGSPETLRDPRGFATKFYTDQGNWDLVGNNLPVFFIRDSIKFPDMVHSLKPSPVTNLQDPNRFFDFFSSQPSATNMLTWVYTNLGTPASYRTMDGFGVHAYKWINRKGEVNYVKFHWKSQQGVKSLRPAEVTKVQGEDFNHLTNDLYTQINAGNFPKWDLYVKVLSPKALSKLDYNGLDATKVWLDVPEKKVGTMTLNRVPDNFFLETEQSAFAPSNIIPGIEPSEDRLLQGRLFAYADTQLYRLGANLFQLPVNSPKSPVANHNQDGPSNNSTGLGNVDSLDVNYEPSRLVNLTVDKQARAVETPLSGHVQQQAIRNPRDFFQAGVLYRSLSEQDKADLIHNLSGDLNKVNDAEVKAIMVSYFYRADKEYGTRLAKATDVNLKQVTKLASM

SEQ ID NO: 5510 - DNA, 1527 bp, Vibrio vulnificus
  CDS (1)..(1527): transl_table=11
atgcatatgtcaaaaagctttttattaatttcgatgggtttggcgagtatttcggtacacgctcaaacgcttactcgtgacaatggtgcacccgttggtgacaaccagaattcgataaccgcaggggaaaacggcagcgtattgctgcaagacgttcacctgatccaaaaacttcagcgttttgccagagaacgtattcctgagcgcgtagtgcatgctcgcggtacaggtgcgcatggtgaattcgtcgcatctggtgatttcagtgatttaactctttcttctccttttgctcaatcaggaaaagtaacccctgtgtttgtacgtttttctactgtgattcattccaaaggttcaccagaaactctgcgtgatccgcgtggatttgcgacaaaattttataccgaccaaggcaactgggatcttgttggcaacaacctacccgtcttttttattcgtgactcgatcaagttccctgacatggtgcattcattaaaaccgtctccggtcaccaatcttcaagatccgaatcgtttttttgattttttcagtagccaaccaagcgcaaccaatatgctgacttgggtttacaccaatttaggcaccccagcgagctaccgcacgatggatggctttggtgtgcacgcgtacaaatggatcaaccaaaaaggcgaagtgaactacgttaagtttcactggaagagccaacaaggtgtgaagagtttacgcccggcggaagtgaccaaagtgcaaggggaagatttcaatcacctgactaacgatctctatacgcagattaacgcggggaactttccgaagtgggatctttacgtcaaagtactgtctccaaaagcgttatcaaaactcgattacaacggtctagacgccaccaaggtttggttggatgtgcctgagaaaaaggttggcaccatgacgctcaatcgtgtacccgataatttctttttagagacagaacaatctgcctttgcgccatccaatattattcctggtattgaaccttcggaagatcgtctgcttcaaggccgcttgtttgcttatgccgatacgcagttgtatcgccttggtgccaacttgttccagttgcccgtcaatagtccgaaaagcccagtggccaatcacaaccaagatggcccaagcaacaactctactggtttaggaaatgtggatagcttagacgtgaattacgagccaagccgtttggttaatctgaccgtggataaacaagcgagagcagtagaaacgccactttctggccatgttcaacagcaggcaatccgcaatccgcgagatttcttccaagccggcgtgctttaccgcagcttgagcgaacaagacaaggcggacttaattcacaacctgtctggcgatttaaacaaggtaaacgatgccgaagtcaaagccatcatggtgagctacttctaccgtgcagacaaagagtatggcactcgtctagccaaagcgactgacgtcaatttaaaacaagtcactaaactggcgtcgatgtaa

SEQ ID NO: 5511 - protein, 508 aa, Vibrio vulnificus
MHMSKSFLLISMGLASISVHAQTLTRDNGAPVGDNQNSITAGENGSVLLQDVHLIQKLQRFARERIPERVVHARGTGAHGEFVASGDFSDLTLSSPFAQSGKVTPVFVRFSTVIHSKGSPETLRDPRGFATKFYTDQGNWDLVGNNLPVFFIRDSIKFPDMVHSLKPSPVTNLQDPNRFFDFFSSQPSATNMLTWVYTNLGTPASYRTMDGFGVHAYKWINQKGEVNYVKFHWKSQQGVKSLRPAEVTKVQGEDFNHLTNDLYTQINAGNFPKWDLYVKVLSPKALSKLDYNGLDATKVWLDVPEKKVGTMTLNRVPDNFFLETEQSAFAPSNIIPGIEPSEDRLLQGRLFAYADTQLYRLGANLFQLPVNSPKSPVANHNQDGPSNNSTGLGNVDSLDVNYEPSRLVNLTVDKQARAVETPLSGHVQQQAIRNPRDFFQAGVLYRSLSEQDKADLIHNLSGDLNKVNDAEVKAIMVSYFYRADKEYGTRLAKATDVNLKQVTKLASM

SEQ ID NO: 5512 - DNA, 2048 bp, Saccharomyces cerevisiae
  CDS (501)..(2048)
gggaagaactaagagatgttatggctcggagagttttgaaaagcgaaatagattcgctgcaagtttgtgaagaaaccatcgacaagaattacaaggttattcctgatgaaaagctgctaactaatattttaaagagaaagttgacagaggaagaaaaaagctctgtcaaacgtccttgcgtgaagaagtgagcggttgttctaaccactatttaaagccgcaattagtaatgcaaaaagttggccggaattagccgcgcaagttggtggggtcccttaatccgaaaaaggacggctttaacaaatataaactccgaaaatccccacagtgacagaattggagaaacaaccagttttgatatcgccatacatataaagagatgtagaaagcattcttcactgtaatgtccaaatcgtacatttgaatttcttgtaggtttatttaaaaggtaagttaaataaatataatagtacttacaaataaatttggaaccctagaagatgtcgaaattgggacaagaaaaaaatgaagtaaattactctgatgtaagagaggatagagttgtgacaaactccactggtaatccaatcaatgaaccatttgtcacccaacgtattggggaacatggccctttgcttttgcaagattataacttaattgattctttggctcatttcaacagggaaaatattcctcaaaggaatccacatgctcatggttctggtgccttcggctattttgaagtaaccgatgacattactgatatctgcgggtctgctatgtttagtaaaattgggaaaagaacgaaatgtctaacaagattttcgactgtgggtggtgataaaggtagtgccgacacggttcgtgatccaagggggtttgccaccaaattctacactgaagaaggtaatttagattgggtctacaataatacaccggtattctttatcagagacccttccaagttccctcactttatccacacacagaagagaaacccacaaaccaacctaagggatgctgacatgttttgggatttcctcaccactcctgaaaatcaggtggccattcatcaagtaatgatccttttttcagaccgtggtacccctgccaactaccgtagtatgcatggttattctggtcatacctataaatggtccaataaaaacggagattggcattatgtgcaagttcatatcaaaaccgatcaaggaataaagaatttgaccatagaagaggctaccaaaattgcgggatccaatccagattactgccagcaggatttatttgaggctattcagaatggaaactatccttcctggacagtttatattcaaacaatgaccgaacgcgatgccaaaaaattaccattttcagtctttgatttgactaaagtatggcctcaggggcaattccctttacggcgtgtgggtaagattgttttgaacgagaatccactgaacttcttcgcacaggtggaacaagctgccttcgcccccagtaccacggttccttaccaagaagcaagcgctgatccagtattacaggcccgtttgttttcatatgcggatgctcatagatacaggctaggtcctaacttccatcaaatacccgtaaactgtccatatgcatctaaatttttcaatcccgctatcagagatggaccgatgaatgttaacggcaacttcggctcagaacctacatatttggccaacgataaatcgtacacgtatatccaacaggacagacccattcaacaacaccaagaggtatggaatgggccagctatcccttatcattgggcaacatccccaggtgatgtagatttcgtgcaagcaagaaatctctaccgcgttttgggtaaacaacctggacagcaaaagaacttggcatataacatcggcattcatgtagaaggcgcctgtcctcaaatacagcagcgcgtttatgatatgtttgctcgtgttgataagggactatctgaggcaattaaaaaagtagctgaggcaaaacatgcttctgagctttcgagtaactccaaattttga

SEQ ID NO: 5513 - protein, 515 aa, Saccharomyces cerevisiae
MSKLGQEKNEVNYSDVREDRVVTNSTGNPINEPFVTQRIGEHGPLLLQDYNLIDSLAHFNRENIPQRNPHAHGSGAFGYFEVTDDITDICGSAMFSKIGKRTKCLTRFSTVGGDKGSADTVRDPRGFATKFYTEEGNLDWVYNNTPVFFIRDPSKFPHFIHTQKRNPQTNLRDADMFWDFLTTPENQVAIHQVMILFSDRGTPANYRSMHGYSGHTYKWSNKNGDWHYVQVHIKTDQGIKNLTIEEATKIAGSNPDYCQQDLFEAIQNGNYPSWTVYIQTMTERDAKKLPFSVFDLTKVWPQGQFPLRRVGKIVLNENPLNFFAQVEQAAFAPSTTVPYQEASADPVLQARLFSYADAHRYRLGPNFHQIPVNCPYASKFFNPAIRDGPMNVNGNFGSEPTYLANDKSYTYIQQDRPIQQHQEVWNGPAIPYHWATSPGDVDFVQARNLYRVLGKQPGQQKNLAYNIGIHVEGACPQIQQRVYDMFARVDKGLSEAIKKVAEAKHASELSSNSKF

SEQ ID NO: 5514 - DNA, 2458 bp, Bacillus subtilis
  CDS (201)..(2261): transl_table=11
gatatgacctcccctattcaacagcttttttggtaagcgcttccatcctttctttctgtgaagaaggcttatttcaaatgtgtatgaccgcatatttatatgtagaccaaaaatcctaatgagcggattagcagtttatatgaagaacgccacgggtaaatgtgctgtagaatgtttcgttttaaaaagggggagcagacatgagtgatgaccaaaacaaacgtgtaaatgaacactcaaaggacgagcagcttgagcagtacaggaccgataacagcgggaagaaaatgacgacaaaccaaggcttgcgagtgtcagaggatgagcactcgttaaaagccggggttcgcggcccgacgctgatggaggattttcatttccgggagaaaatgacgcactttgaccatgagaggattccggagcgcgttgtgcatgcgcgcggatttggcgtgcatggcttttttcaggtttacgaaccaatgacggaatacacacgggccaaatttcttcaggacccttcggtgaagacaccggtatttgtccgtttttctacggttgcgggttctaaaggctccgcagacacggtgcgggatgccagaggctttgcgacaaaattttatactgaagaaggaaactatgaccttgtgggaaataacattccggtgtttttcattcaggacgcaatcaaatttccggatttggttcacgcgtttaagcctgagccacacaatgaaatgcctcaggctgcgactgctcacgatacattttgggattttgtcgccaataaccctgagtctgcccacatggtgatgtggacgatgtctgacagaggcatcccgcgcagctacagaatgatggaaggcttcggcgttcacacgttccgttttgtcaatgaacaaggaaaggcacgtttcgtgaaatttcactggaagccggtgctcggcgtgcattctctcgtatgggatgaagcgcaaaaaattgccgggaaagatccagatttccaccgccgtgacctgtgggaaacaattgaaaacggcggcaaggttgaatacgagctcggcgtgcagatgattgatgaggaagatgaattcaagtttgattttgatattcttgacccaactaagctgtggccggaagagcttgtgccggtgaagatcattggaaaaatgacgctgaaccgcaatcaggataatgtgtttgcggaaacagaacaagtcgcattccacccgggaaatgtcgtgccgggcatcgattttaccaatgacccgctattgcaggggcggcttttcccttatacggatacacagctcatccgtcttggcggcccgaacttccatgagattccgattaaccggccggtctgtccattccataacaaccaatacgacggctatcaccggatgacgatcaataagggacctgtcgcttatcataaaaactcactgcaaaacaatgatccgtcgcctgcgacagctgaagaaggcggctacgtccactatcaggaaaaagtcgagggcaaaaaaatccgccagcgaagcgacagcttcaacgattattactcacaggcgaagcttttctggaacagcatgtctcctgtggagaaacagcacatcatttctgctttctgcttcgaggtcgggaaggttaaaagcaaagacgtacagcggcaggtcgttgatgtcttcagcaatgtcgatgcagatttagcagaagaaatcgccaaaggagtaggcgtggcggcgcccgcaaagcgtaaagcatctaaagaaaatcttacttcgcctgcgttaagccaagcccgtacagtgaaaaccgcctcaacaaggaaagtcgctgtactcgccggaaacggatttcatgaaaaagagctgcaaacagtactggaagccttaaagcaagaaggaatcacagtggatatcatcagtcaaaatctggggtatatgacaagcggcagcggacagcagcttgaggccagcggcacgttcctgacggttgattctgttctgtatgatgccgtctatgccgcaggaggactggagttaaaagacaacaaacaagcgatggcgtttatcagagaagcttacaatcactacaaggcgatcggtgcggcaaatgaaggaattgaccttcttcaatcctctgtcgggacaacagaggggctaggcatcgtaacggctaaagatgaacctgactacaccgctttcagcaaggcatttatcgatgcggttgctgctcatcgccattgggatagacgaatttgatcggctcctgtatctttaaggaagatacttttcataaggagcatgacaaatgaaccgaaaacagctcactgaagcttacgaacgcgatgaaaatatgatgattttggtgtttgcccagtggtgcgtgaaccatgatcttgatccgatggagctgtacgccaaagcgtatccgcagcaaaagctgaatgaaagcttga

SEQ ID NO: 5515 - protein, 686 aa, Bacillus subtilis
MSDDQNKRVNEHSKDEQLEQYRTDNSGKKMTTNQGLRVSEDEHSLKAGVRGPTLMEDFHFREKMTHFDHERIPERVVHARGFGVHGFFQVYEPMTEYTRAKFLQDPSVKTPVFVRFSTVAGSKGSADTVRDARGFATKFYTEEGNYDLVGNNIPVFFIQDAIKFPDLVHAFKPEPHNEMPQAATAHDTFWDFVANNPESAHMVMWTMSDRGIPRSYRMMEGFGVHTFRFVNEQGKARFVKFHWKPVLGVHSLVWDEAQKIAGKDPDFHRRDLWETIENGGKVEYELGVQMIDEEDEFKFDFDILDPTKLWPEELVPVKIIGKMTLNRNQDNVFAETEQVAFHPGNVVPGIDFTNDPLLQGRLFPYTDTQLIRLGGPNFHEIPINRPVCPFHNNQYDGYHRMTINKGPVAYHKNSLQNNDPSPATAEEGGYVHYQEKVEGKKIRQRSDSFNDYYSQAKLFWNSMSPVEKQHIISAFCFEVGKVKSKDVQRQVVDVFSNVDADLAEEIAKGVGVAAPAKRKASKENLTSPALSQARTVKTASTRKVAVLAGNGFHEKELQTVLEALKQEGITVDIISQNLGYMTSGSGQQLEASGTFLTVDSVLYDAVYAAGGLELKDNKQAMAFIREAYNHYKAIGAANEGIDLLQSSVGTTEGLGIVTAKDEPDYTAFSKAFIDAVAAHRHWDRRI

SEQ ID NO: 5516 - DNA, 2118 bp, Rhizobium meliloti
  CDS (1)..(2118): transl_table=11
atggccaagaaaccctctgcgccgaacaatacgaaaccggccaccattcatgaccagaaagcgacacgcggcaacggtggagaacttcaccagatcgccgaaggcgacacgcccgtcctgacgaccgcccagggcggccccgtcgccgacgaccagaacagcctgcgcgccggcgaacgcggccctacgctcatcgaggatttccacttccgcgagaagatcttccacttcgatcacgagcgcattcccgagcgtgtcgtgcacgcccgcggctacggggtgcatggcttcttcgagacctacgaatcgcttgcagcctacacccgggcggatctgttccagcgcccgggcgagcgaacccccgccttcgtgcgtttctcgacggtcgccggaagcaagggctccttcgacctcgcccgcgacgttcgcggtttcgcggtcaagatctacaccaaggagggcaattgggacctcgtcggcaacaacatcccggtcttcttcatccaggacgcaatcaagtttcccgacgtcatacattcggtaaagcccgaaccggaccgggagtttccccaggcgcagtccgcccacgacaatttctgggacttcatcagcctgacgccggaaagcatgcacatgatcatgtgggtcatgtcggaccgggcgatcccgcgctccttccggttcatggaaggcttcggcgtccatacgtttcgtttcgtcaatgccaaggacgagtccactttcgtcaaattccattggaagccgaagctcgggctgcagtcggtcgtgtggaacgaggccgtgaagatcaacggtgccgatcctgacttccaccggcgcgacatgtggcaagccatccagtccggcaacttcccggaatgggacctgcatgtgcagcttttcgatcaggacttcgccgacaagttcgatttcgacattctcgatccgaccaagatcatcccggaggaagtgctgccgacgaagcctgtgggccggctggtgctcgatcgcatgccggagaatttcttcgccgaaaccgagcaggtcgccttcatgacgcagaacgtgccgccgggcatcgacttcagcgacgatccattgctgcaggggcgcaacttctcctatctggacacgcagctgaagcggctcggcagcccgaacttcacccatctgccgatcaacgcgccgaaatgtcccttccagcactttcagcaggacggccacatggccatgcgcaaccccgtcgggcgcgtgaactaccagcccaattcctggggcgagggcccgcgcgagtcgcccatgaaaggcttccgccattttccttccgaggagcaggggcccaagctgcgcatccgcgccgagagctttgccgaccattacagccaggcccggcagttcttcatcagccagacgccgcccgagcagcgccacatcgccgacgccctgaccttcgaattgagcaaggtggagacgccggtgatccgcgagcggatggtcgcgcatcttctcaacatcgatgaaaccttggggaaaaaggtcggccacgccctcggcctggagacgatgccgaagccggcggatgcggccgttgccacccgccaggacctcgacccgtcgccggccctcagcatcatccagcgtgggccgaagcgtttcgagggccgcaagctcgggatattggcgacggacggcgcggacggcgcgcttctcgacgccttgatagcggcggtcgagaaggagaaggcggccttcgagctgatcgcgccgaaagtcggcggcttcaccgcctccgacggaaaacgcatcgccgcccaccagatgctcgacggcggcccgtcggtactttacgacgcggtggtcctgcttccttccgcagaggccgtcacggatctgatcgacgtcgccaccgcgcgcgatttcgtggccgacgccttcgcccattgcaaatatatcggctatgccggcgccgccgttccccttctcgaaagggccggcattgcggaactgctcgatgagggaacgatcgaactcaccgacgctgcgagtgcggcagccttcctcacggagatcggtaaactgcgcgtctggggaagagaaccctcggtcaagctgaaatag

SEQ ID NO: 5517 - protein, 705 aa, Rhizobium meliloti
MAKKPSAPNNTKPATIHDQKATRGNGGELHQIAEGDTPVLTTAQGGPVADDQNSLRAGERGPTLIEDFHFREKIFHFDHERIPERVVHARGYGVHGFFETYESLAAYTRADLFQRPGERTPAFVRFSTVAGSKGSFDLARDVRGFAVKIYTKEGNWDLVGNNIPVFFIQDAIKFPDVIHSVKPEPDREFPQAQSAHDNFWDFISLTPESMHMIMWVMSDRAIPRSFRFMEGFGVHTFRFVNAKDESTFVKFHWKPKLGLQSVVWNEAVKINGADPDFHRRDMWQAIQSGNFPEWDLHVQLFDQDFADKFDFDILDPTKIIPEEVLPTKPVGRLVLDRMPENFFAETEQVAFMTQNVPPGIDFSDDPLLQGRNFSYLDTQLKRLGSPNFTHLPINAPKCPFQHFQQDGHMAMRNPVGRVNYQPNSWGEGPRESPMKGFRHFPSEEQGPKLRIRAESFADHYSQARQFFISQTPPEQRHIADALTFELSKVETPVIRERMVAHLLNIDETLGKKVGHALGLETMPKPADAAVATRQDLDPSPALSIIQRGPKRFEGRKLGILATDGADGALLDALIAAVEKEKAAFELIAPKVGGFTASDGKRIAAHQMLDGGPSVLYDAVVLLPSAEAVTDLIDVATARDFVADAFAHCKYIGYAGAAVPLLERAGIAELLDEGTIELTDAASAAAFLTEIGKLRVWGREPSVKLK

SEQ ID NO: 5518 - DNA, 1479 bp, Oryza sativa
  CDS (1)..(1479)
atggatccttgcaagttccggccgtcgagctcgttcgacacgaagacgacgacgacgaacgcgggagctccggtgtggaacgacaacgaggcgctgacagtggggcccagggggccgatcctcctcgaggactaccacctgatcgagaaggtggcgcacttcgcccgggagcgcatcccggagcgcgtggtccacgcccgcggcgcctccgccaagggcttcttcgagtgcacccacgacgtcaccgacatcacctgcgccgacttcctccggtccccgggcgcccagacccccgtcatcgtccgcttctccaccgtcatccacgagcgcggcagcccggagacgatccgcgacccgcgcgggttcgccgtcaagttctacacccgcgagggcaactgggacctcctcggcaacaacttccccgtcttcttcatccgcgacggcatcaagttccccgacgtcatccacgccttcaagcccaacccgcgctcccatgtccaggagtactggagggtcttcgacttcttgtcccaccaccccgagagcctccacaccttcttcttcctcttcgacgacgtcggcatccccaccgattaccgccacatggacggcttcggcgtcaacacctacaccttcgtcacccgcgacgccaaggccaggtacgtcaagttccactggaagcccacctgcggcgtcagctgcttgatggacgacgaggccacgctcgtcggcggcaagaaccacagccacgccacccaggacctctacgactccatcgccgccggcaacttccccgagtggaagctgttcgtccaggtgatcgacccggaggaggaggagaggttcgacttcgacccgctggatgacaccaagacatggccggaggacgaggtgccgctccggcccgtggggcgcctcgttctcaaccgcaacgtcgacaacttcttcaacgagaacgagcagctggcgttcgggccggggctggtggtgccggggatctactactccgacgacaagatgctgcagtgcagggtgttcgcgtacgccgacacgcagcgctacaggctggggccaaactacctgatgctgccggtgaacgcgcccaagtgcgcccaccacaacaaccactacgacggcgccatgaacttcatgcaccgggacgaggaggtggactactacccatcgcgccacgcgccgctccgccacgcgccgccgacgcccatcacgccgcgccccgtggtggggaggaggcagaaggcgacgatacacaagcagaacgacttcaagcagcccggggagaggtacaggtcgtgggcgccggatagacaggagaggttcatccgccgcttcgccggcgagctcgcgcaccccaaggtctcccctgagctccgcgccatctgggtcaactacctctcccagtgtgatgagtcgttgggggtgaagattgcgaataggctcaacgtgaagccaagcatgtga

SEQ ID NO: 5519 - protein, 492 aa, Oryza sativa
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIRRFAGELAHPKVSPELRAIWVNYLSQCDESLGVKIANRLNVKPSM

SEQ ID NO: 5520 - DNA, 1467 bp, Oryza sativa
  CDS (1)..(1467)
atggatccttgcaagttccggccgtcgagctcgttcgacacgaagacgacgacgacgaacgcgggagctccggtgtggaacgacaacgaggcgctgacagtggggcccagggggccgatcctcctcgaggactaccacctgatcgagaaggtggcgcacttcgcccgggagcgcatcccggagcgcgtggtccacgcccgcggcgcctccgccaagggcttcttcgagtgcacccacgacgtcaccgacatcacctgcgccgacttcctccggtccccgggcgcccagacccccgtcatcgtccgcttctccaccgtcatccacgagcgcggcagcccggagacgatccgcgacccgcgcgggttcgccgtcaagttctacacccgcgagggcaactgggacctcctcggcaacaacttccccgtcttcttcatccgcgacggcatcaagttccccgacgtcatccacgccttcaagcccaacccgcgctcccatgtccaggagtactggagggtcttcgacttcttgtcccaccaccccgagagcctccacaccttcttcttcctcttcgacgacgtcggcatccccaccgattaccgccacatggacggcttcggcgtcaacacctacaccttcgtcacccgcgacgccaaggccaggtacgtcaagttccactggaagcccacctgcggcgtcagctgcttgatggacgacgaggccacgctcgtcggcggcaagaaccacagccacgccacccaggacctctacgactccatcgccgccggcaacttccccgagtggaagctgttcgtccaggtgatcgacccggaggaggaggagaggttcgacttcgacccgctggatgacaccaagacatggccggaggacgaggtgccgctccggcccgtggggcgcctcgttctcaaccgcaacgtcgacaacttcttcaacgagaacgagcagctggcgttcgggccggggctggtggtgccggggatctactactccgacgacaagatgctgcagtgcagggtgttcgcgtacgccgacacgcagcgctacaggctggggccaaactacctgatgctgccggtgaacgcgcccaagtgcgcccaccacaacaaccactacgacggcgccatgaacttcatgcaccgggacgaggaggtggactactacccatcgcgccacgcgccgctccgccacgcgccgccgacgcccatcacgccgcgccccgtggtggggaggaggcagaaggcgacgatacacaagcagaacgacttcaagcagcccggggagaggtacaggtcgtgggcgccggatagacaggagaggttcatccgccgcttcgccggcgagctcgcgcaccccaaggtctcccctgagctccgcgccatctgggtcaactacctctcccaggtaattcataccagcaatttagtattacctccatttttgtttttatga

SEQ ID NO: 5521 - protein, 488 aa, Oryza sativa
MDPCKFRPSSSFDTKTTTTNAGAPVWNDNEALTVGPRGPILLEDYHLIEKVAHFARERIPERVVHARGASAKGFFECTHDVTDITCADFLRSPGAQTPVIVRFSTVIHERGSPETIRDPRGFAVKFYTREGNWDLLGNNFPVFFIRDGIKFPDVIHAFKPNPRSHVQEYWRVFDFLSHHPESLHTFFFLFDDVGIPTDYRHMDGFGVNTYTFVTRDAKARYVKFHWKPTCGVSCLMDDEATLVGGKNHSHATQDLYDSIAAGNFPEWKLFVQVIDPEEEERFDFDPLDDTKTWPEDEVPLRPVGRLVLNRNVDNFFNENEQLAFGPGLVVPGIYYSDDKMLQCRVFAYADTQRYRLGPNYLMLPVNAPKCAHHNNHYDGAMNFMHRDEEVDYYPSRHAPLRHAPPTPITPRPVVGRRQKATIHKQNDFKQPGERYRSWAPDRQERFIRRFAGELAHPKVSPELRAIWVNYLSQVIHTSNLVLPPFLFL

SEQ ID NO: 5522 - DNA, 1428 bp, Oryza sativa
  CDS (1)..(1428)
atggatccctacaagcatcggccgtccagcgggagcaattccaccttctggaccaccaactccggcgcccccgtctggaacaacaactccgccctcaccgtcggagagcgaggccctatcctccttgaggactatcatctgattgaaaagcttgcacagtttgacagggagcgtatccctgaacgtgtcgttcatgcaaggggagccagtgccaagggattttttgaggttactcatgatatttctcacctcacatgtgctgattttctccgtgctcctggtgttcagaccccagttattgttcggttctccacagtcgtgcatgagcgtggaagccctgagacattgagggatccacgtggttttgctgtcaagttttacactagagagggtaattttgatcttgttgggaacaatatgcctgtcttttttatccgagatgggatgaaattccctgacatggtccatgctttcaagccaagtccaaagaccaatatgcaggagaactggagaatagttgatttcttttcacaccacccagagagcctgcacatgttctccttcctctttgacgatgtaggcatcccactcaactacaggcacatggagggttttggtgtcaacacctacaccctaatcaataaggatggaaagcctcaccttgtcaaattccactggaagcctacctgtggtgtcaaatgcctgttggatgatgaagctgtgactgttggcggcacctgccacagccatgccacgaaggacttgactgattctattgcagcagggaattacccagagtggaagctttacatccagactattgatcctgatcatgaggacagatttgacttcgatcctcttgatgtcaccaagacatggccagaggatatcatccccctgcagccagttggacggatggtcctgaacaaaaacattgataacttctttgcagaaaatgaacagcttgctttctgcccagcgataattgtccctggaatccattactctgatgataagctgctccagacaagaattttctcctatgctgatacccaaaggcaccgtcttggcccaaactatttgatgcttcctgtgaatgcaccaaaatgtgcataccacaacaaccaccacgatggctccatgaatttcatgcacagggatgaagaggttaactacttcccttcaaggtttgatgctgcacgtcatgctgagaaggtccctattcctcctcgtgttctaacaggctgtcgggaaaagtgtgtcattgacaaggagaacaatttccaacaggctggtgagagataccggtcatttgaccctgccaggcaagatcgttttctccagcggtgggttgatgctctctcagatcctcgtattacacatgaactccgtggcatctggatctcctactggtcgcaggtaacataa

SEQ ID NO: 5523 - protein, 475 aa, Oryza sativa
MDPYKHRPSSGSNSTFWTTNSGAPVWNNNSALTVGERGPILLEDYHLIEKLAQFDRERIPERVVHARGASAKGFFEVTHDISHLTCADFLRAPGVQTPVIVRFSTVVHERGSPETLRDPRGFAVKFYTREGNFDLVGNNMPVFFIRDGMKFPDMVHAFKPSPKTNMQENWRIVDFFSHHPESLHMFSFLFDDVGIPLNYRHMEGFGVNTYTLINKDGKPHLVKFHWKPTCGVKCLLDDEAVTVGGTCHSHATKDLTDSIAAGNYPEWKLYIQTIDPDHEDRFDFDPLDVTKTWPEDIIPLQPVGRMVLNKNIDNFFAENEQLAFCPAIIVPGIHYSDDKLLQTRIFSYADTQRHRLGPNYLMLPVNAPKCAYHNNHHDGSMNFMHRDEEVNYFPSRFDAARHAEKVPIPPRVLTGCREKCVIDKENNFQQAGERYRSFDPARQDRFLQRWVDALSDPRITHELRGIWISYWSQVT

SEQ ID NO: 5524 - DNA, 1479 bp, Glycine max
  CDS (1)..(1479)
atggatccctacaagaatcggccatcaagcgccttcaattctcccttctggactacaaattccggtgctcccatctggaacaataactcatcgctgactgttggatctagaggtccaattctgctggaggattaccatctggtggagaagcttgcaaactttgacagggaacggatccccgaacgtgttgtccacgctcgtggagctagcgcaaagggtttctttgaagtcacgcatgacatttctcacctcacatgtgccgatttccttcgagcccctggagttcagacccccctcatcgtccgtttctccactgttatccacgagcgtggcagccccgaaaccctcagggatcccagaggttttgctgtcaaattctacaccagagagggtaacttcgaccttgtgggaaacaacttccctgtcttcttcgtccgcgatggcctcaagtttcctgacatggttcatgccctcaaacccaaccccaagtcccacatccaggagaattggaggatcctcgatttcttctcccaccatcccgaaagccttcacatgttctccttcttattcgatgacgttggtatccctcaagattacaggcatatggatggctttggtgtcaacacttacacccttatcaacaaggctggcaaagccgtctatgtcaaatttcattggaagaccacctctggcgaaaagtctcttttggacgacgaggccatcagggttggaggatcgaaccacagtcatgccacccaagacctttacgattcaattgctgctggaaactatcctgagtggaaactctacatccaaacattggatcccgaaaacgaagacaggcttgactttgacccccttgatgtaactaagacctggcctgaggacgttttgcccctccagcctgttggccgcatggtcttgaataagaacattgataacttctttgccgagaacgaacaacttgcattttgccctgcaattattgtacctggtgtatactactccgacgataaattgcttcagactcgcatattctcctatgctgatacccaaagacacagacttgggccaaattatctgcagcttcctgctaattcccccaagtgtgcccatcacaacaatcaccatgatggtttcatgaatttcatgcacagggatgaagaggtcaattacttcccttcaaggtatgatcctgtccgtcatgcggaaaaggtccccgttcctcctcgtatcctaggtgggaagcgtgaaaagtgcatgattgagaaggagaacaacttcaagcaacctggggagagataccgatcctggccctctgacaggcaagaaaggtttgtccgccgatgggttgatgctttgtctgacccacgtgtcacccatgaaatccgtagcatctggatatcatactggtctcaggctgatcgttctcttggacaaaagatagcatctcacctgaacttgaagccaagtatctaa

SEQ ID NO: 5525 - protein, 492 aa, Glycine max
MDPYKNRPSSAFNSPFWTTNSGAPIWNNNSSLTVGSRGPILLEDYHLVEKLANFDRERIPERVVHARGASAKGFFEVTHDISHLTCADFLRAPGVQTPLIVRFSTVIHERGSPETLRDPRGFAVKFYTREGNFDLVGNNFPVFFVRDGLKFPDMVHALKPNPKSHIQENWRILDFFSHHPESLHMFSFLFDDVGIPQDYRHMDGFGVNTYTLINKAGKAVYVKFHWKTTSGEKSLLDDEAIRVGGSNHSHATQDLYDSIAAGNYPEWKLYIQTLDPENEDRLDFDPLDVTKTWPEDVLPLQPVGRMVLNKNIDNFFAENEQLAFCPAIIVPGVYYSDDKLLQTRIFSYADTQRHRLGPNYLQLPANSPKCAHHNNHHDGFMNFMHRDEEVNYFPSRYDPVRHAEKVPVPPRILGGKREKCMIEKENNFKQPGERYRSWPSDRQERFVRRWVDALSDPRVTHEIRSIWISYWSQADRSLGQKIASHLNLKPSI

SEQ ID NO: 5526 - DNA, 25 bp, Artificial sequence
  primer
atgccaataagatcaatcagctcag

SEQ ID NO: 5527 - DNA, 25 bp, Artificial sequence
  primer
ttaattggcacttgcaatggaccaa

SEQ ID NO: 5528 - protein, 507 aa, Artificial sequence
  consensus sequence
  Variant (2)..(4): Xaa in position 2 to 4 is any amino acid
  Variant (6)..(6): Xaa in position 6 is any amino acid
  Variant (8)..(17): Xaa in position 8 to 17 is any amino acid
  Variant (18)..(18): Xaa in position 18 is any or no amino acid
  Variant (20)..(21): Xaa in position 20 to 21 is any amino acid
  Variant (22)..(31): Xaa in position 22 to 31 is any or no amino acid
  Variant (34)..(34): Xaa in position 34 is any amino acid
  Variant (36)..(37): Xaa in position 36 to 37 is any amino acid
  Variant (39)..(40): Xaa in position 39 to 40 is any amino acid
  Variant (42)..(46): Xaa in position 42 to 46 is any amino acid
  Variant (47)..(47): Xaa in position 47 is any or no amino acid
  Variant (49)..(49): Xaa in position 49 is any amino acid
  Variant (52)..(52): Xaa in position 52 is any amino acid
  Variant (57)..(58): Xaa in position 57 to 58 is any amino acid
  Variant (61)..(61): Xaa in position 61 is any amino acid
  Variant (63)..(63): Xaa in position 63 is any amino acid
  Variant (66)..(66): Xaa in position 66 is any amino acid
  Variant (68)..(68): Xaa in position 68 is any amino acid
  Variant (70)..(71): Xaa in position 70 to 71 is any amino acid
  Variant (73)..(73): Xaa in position 73 is any amino acid
  Variant (74)..(74): Xaa in position 74 is any or no amino acid
  Variant (76)..(79): Xaa in position 76 to 79 is any amino acid
  Variant (81)..(81): Xaa in position 81 is any amino acid
  Variant (83)..(87): Xaa in position 83 to 87 is any amino acid
  Variant (88)..(88): Xaa in position 88 is any or no amino acid
  Variant (90)..(90): Xaa in position 90 is any amino acid
  Variant (91)..(91): Xaa in position 91 is any or no amino acid
  Variant (93)..(96): Xaa in position 93 to 96 is any amino acid
  Variant (101)..(101): Xaa in position 101 is any amino acid
  Variant (103)..(103): Xaa in position 103 is any amino acid
  Variant (106)..(106): Xaa in position 106 is any amino acid
  Variant (108)..(109): Xaa in position 108 to 109 is any amino acid
  Variant (111)..(112): Xaa in position 111 to 112 is any amino acid
  Variant (115)..(115): Xaa in position 115 is any amino acid
  Variant (120)..(120): Xaa in position 120 is any amino acid
  Variant (125)..(126): Xaa in position 125 to 126 is any amino acid
  Variant (129)..(129): Xaa in position 129 is any amino acid
  Variant (131)..(131): Xaa in position 131 is any amino acid
  Variant (133)..(133): Xaa in position 133 is any amino acid
  Variant (136)..(136): Xaa in position 136 is any amino acid
  Variant (141)..(141): Xaa in position 141 is any amino acid
  Variant (144)..(145): Xaa in position 144 to 145 is any amino acid
  Variant (149)..(154): Xaa in position 149 to 154 is any amino acid
  Variant (156)..(157): Xaa in position 156 to 157 is any amino acid
  Variant (159)..(168): Xaa in position 159 to 168 is any amino acid
  Variant (169)..(172): Xaa in position 169 to 172 is any or no amino acid
  Variant (175)..(179): Xaa in position 175 to 179 is any amino acid
  Variant (180)..(181): Xaa in position 180 to 181 is any or no amino acid
  Variant (184)..(185): Xaa in position 184 to 185 is any amino acid
  Variant (187)..(193): Xaa in position 187 to 193 is any amino acid
  Variant (194)..(194): Xaa in position 194 is any or no amino acid
  Variant (198)..(198): Xaa in position 198 is any amino acid
  Variant (199)..(199): Xaa in position 199 is any or no amino acid
  Variant (201)..(203): Xaa in position 201 to 203 is any amino acid
  Variant (205)..(205): Xaa in position 205 is any amino acid
  Variant (206)..(206): Xaa in position 206 is any or no amino acid
  Variant (208)..(208): Xaa in position 208 is any amino acid
  Variant (210)..(212): Xaa in position 210 to 212 is any amino acid
  Variant (213)..(213): Xaa in position 213 is any or no amino acid
  Variant (216)..(219): Xaa in position 216 to 219 is any amino acid
  Variant (221)..(222): Xaa in position 221 to 222 is any amino acid
  Variant (224)..(227): Xaa in position 224 to 227 is any amino acid
  Variant (229)..(229): Xaa in position 229 is any amino acid
  Variant (230)..(230): Xaa in position 230 is any or no amino acid
  Variant (232)..(236): Xaa in position 232 to 236 is any amino acid
  Variant (238)..(244): Xaa in position 238 to 244 is any amino acid
  Variant (245)..(246): Xaa in position 245 to 246 is any or no amino acid
  Variant (249)..(258): Xaa in position 249 to 258 is any amino acid
  Variant (259)..(261): Xaa in position 259 to 261 is any or no amino acid
  Variant (264)..(266): Xaa in position 264 to 266 is any amino acid
  Variant (268)..(269): Xaa in position 268 to 269 is any amino acid
  Variant (271)..(272): Xaa in position 271 to 272 is any amino acid
  Variant (274)..(274): Xaa in position 274 is any amino acid
  Variant (276)..(279): Xaa in position 276 to 279 is any amino acid
  Variant (281)..(294): Xaa in position 281 to 294 is any amino acid
  Variant (295)..(299): Xaa in position 295 to 299 is any or no amino acid
  Variant (301)..(301): Xaa in position 301 is any amino acid
  Variant (304)..(304): Xaa in position 304 is any amino acid
  Variant (306)..(308): Xaa in position 306 to 308 is any amino acid
  Variant (309)..(310): Xaa in position 309 to 310 is any or no amino acid
  Variant (312)..(315): Xaa in position 312 to 315 is any amino acid
  Variant (317)..(319): Xaa in position 317 to 319 is any amino acid
  Variant (321)..(322): Xaa in position 321 to 322 is any amino acid
  Variant (324)..(325): Xaa in position 324 to 325 is any amino acid
  Variant (327)..(327): Xaa in position 327 is any amino acid
  Variant (329)..(331): Xaa in position 329 to 331 is any amino acid
  Variant (334)..(334): Xaa in position 334 is any amino acid
  Variant (337)..(337): Xaa in position 337 is any amino acid
  Variant (339)..(341): Xaa in position 339 to 341 is any amino acid
  Variant (342)..(342): Xaa in position 342 is any or no amino acid
  Variant (346)..(348): Xaa in position 346 to 348 is any amino acid
  Variant (350)..(350): Xaa in position 350 is any amino acid
  Variant (352)..(353): Xaa in position 352 to 353 is any amino acid
  Variant (356)..(356): Xaa in position 356 is any amino acid
  Variant (358)..(358): Xaa in position 358 is any amino acid
  Variant (360)..(360): Xaa in position 360 is any amino acid
  Variant (362)..(362): Xaa in position 362 is any amino acid
  Variant (364)..(365): Xaa in position 364 to 365 is any amino acid
  Variant (367)..(367): Xaa in position 367 is any amino acid
  Variant (369)..(369): Xaa in position 369 is any amino acid
  Variant (371)..(371): Xaa in position 371 is any amino acid
  Variant (372)..(372): Xaa in position 372 is any or no amino acid
  Variant (374)..(377): Xaa in position 374 to 377 is any amino acid
  Variant (379)..(379): Xaa in position 379 is any amino acid
  Variant (381)..(381): Xaa in position 381 is any amino acid
  Variant (383)..(391): Xaa in position 383 to 391 is any amino acid
  Variant (392)..(410): Xaa in position 392 to 410 is any or no amino acid
  Variant (413)..(413): Xaa in position 413 is any amino acid
  Variant (415)..(423): Xaa in position 415 to 423 is any amino acid
  Variant (424)..(429): Xaa in position 424 to 429 is any or no amino acid
  Variant (431)..(466): Xaa in position 431 to 466 is any amino acid
  Variant (467)..(506): Xaa in position 467 to 506 is any or no amino acid
TXXXGXPXXXXXXXXXXXGXXXXXXXXXXXXGPXLXXDXXLXXXXXXFXREXIPERXXHAXGXGAXGXFXXTXXDXXXXTXAXXXXXXGXXTXXXXRFSTXVXGEXGXXDXXRDXRGFAXKFYTXXGNXDXVXNNXPVFFXRDXXKFPXXXXXXKXXPXXXXXXXXXXXXXXWDXXXXXXXPEXXHXXXXXXXXDRGXXPXXXRXXMXGXXXXHTXXXXNXXGXXXXVXXHXXXXXGXXXXXXXXXEAXXXXXXXXXXXXXDLXXXIXXGXXPXWXXXXQXXXXXXXXXXXXXXXXXXXDXTKXWXXXXXPXXXXGXXXLXXNXXNXFXXXEQXAFXPXXXXVPGXXXSXDXXLQXRXFXYXDXXRXRXGXXNXXXXPXNXPXXXXXXXXXXXXXXXXXXXXXXXXXXXXDGXMXXXXXXXXXXXXXXXYXXXXXXXXXXXXXXXXXXXXXXXXXXXXXXXXXXXXXXXXXXXXXXXXXXXXXXXXXXXXXXXXXXXXXXXXXXXXQ

SEQ ID NO: 5529 - protein, 57 aa, Artificial sequence
  protein pattern
  Variant (2)..(2): Xaa in position 2 is Ser or Thr
  Variant (4)..(5): Xaa in position 4 to 5 is any amino acid
  Variant (6)..(6): Xaa in position 6 is Asp, Glu, Gly, Asn or Ser
  Variant (7)..(8): Xaa in position 7 to 8 is any amino acid
  Variant (9)..(9): Xaa in position 9 is Ala, Ser or Thr
  Variant (10)..(10): Xaa in position 10 is any amino acid
  Variant (11)..(11): Xaa in position 11 is Asp or Glu
  Variant (12)..(13): Xaa in position 12 to 13 is any amino acid
  Variant (16)..(16): Xaa in position 16 is Ala, Ile, Pro or Val
  Variant (17)..(17): Xaa in position 17 is His or Arg
  Variant (19)..(19): Xaa in position 19 is any amino acid
  Variant (20)..(20): Xaa in position 20 is Ala or Ser
  Variant (21)..(21): Xaa in position 21 is any amino acid
  Variant (22)..(22): Xaa in position 22 is Lys or Arg
  Variant (23)..(24): Xaa in position 23 to 24 is any amino acid
  Variant (25)..(25): Xaa in position 25 is Ser or Thr
  Variant (26)..(27): Xaa in position 26 to 27 is any amino acid
  Variant (30)..(30): Xaa in position 30 is any amino acid
  Variant (32)..(32): Xaa in position 32 is any amino acid
  Variant (34)..(34): Xaa in position 34 is any amino acid
  Variant (37)..(37): Xaa in position 37 is any amino acid
  Variant (39)..(39): Xaa in position 39 is any amino acid
  Variant (42)..(43): Xaa in position 42 to 43 is any amino acid
  Variant (45)..(45): Xaa in position 45 is any amino acid
  Variant (46)..(46): Xaa in position 46 is any or no amino acid
  Variant (48)..(48): Xaa in position 48 is any or no amino acid
  Variant (50)..(53): Xaa in position 50 to 53 is any amino acid
  Variant (54)..(54): Xaa in position 54 is His, Lys or Arg
  Variant (55)..(55): Xaa in position 55 is Ala, Ser, Thr or Val
  Variant (56)..(56): Xaa in position 56 is any amino acid
SXVXXXXXXXXXXRDXXGXXXXXXXXXGNXDXVXNNXPXFFXXDXXKXFXXXXXXXK

SEQ ID NO: 5530 - protein, 29 aa, Artificial sequence
  protein pattern
  Variant (2)..(3): Xaa in position 2 to 3 is any amino acid
  Variant (4)..(7): Xaa in position 4 to 7 is any or no amino acid
  Variant (9)..(9): Xaa in position 9 is Ala, Asp, Gly, Asn or Val
  Variant (12)..(12): Xaa in position 12 is any amino acid
  Variant (13)..(13): Xaa in position 13 is Ile or Val
  Variant (17)..(18): Xaa in position 17 to 18 is any amino acid
  Variant (21)..(21): Xaa in position 21 is any amino acid
  Variant (23)..(23): Xaa in position 23 is any amino acid
  Variant (24)..(24): Xaa in position 24 is Ala, Gly or Ser
  Variant (25)..(25): Xaa in position 25 is Ala or Cys
  Variant (26)..(26): Xaa in position 26 is any amino acid
  Variant (27)..(27): Xaa in position 27 is Gly, Ile or Leu
  Variant (28)..(28): Xaa in position 28 is any amino acid
  Variant (29)..(29): Xaa in position 29 is Phe or Leu
LXXXXXXFXREXXPERXXHAXGXXXXXXX

SEQ ID NO: 5531 - protein, 24 aa, Artificial sequence
  protein pattern
  Variant (2)..(2): Xaa in position 2 is any amino acid
  Variant (4)..(4): Xaa in position 4 is any amino acid
  Variant (5)..(5): Xaa in position 5 is Leu, Met or Val
  Variant (7)..(7): Xaa in position 7 is any amino acid
  Variant (8)..(8): Xaa in position 8 is Ala, Cys, Gly, Ser, Thr or Val
  Variant (10)..(10): Xaa in position 10 is any amino acid
  Variant (12)..(12): Xaa in position 12 is Ala, Gly, Asn or Ser
  Variant (14)..(14): Xaa in position 14 is any amino acid
  Variant (16)..(16): Xaa in position 16 is Ala, Ser or Thr
  Variant (17)..(17): Xaa in position 17 is any amino acid
  Variant (19)..(19): Xaa in position 19 is any amino acid
  Variant (21)..(21): Xaa in position 21 is Ile, Leu or Val
  Variant (23)..(23): Xaa in position 23 is any amino acid
SXDXXLXXRXFXYXDXXRXRXGXN

SEQ ID NO: 5532 - protein, 29 aa, Artificial sequence
  protein pattern
  Variant (2)..(2): Xaa in position 2 is Leu, Met or Val
  Variant (3)..(4): Xaa in position 3 to 4 is any amino acid
  Variant (5)..(5): Xaa in position 5 is Phe, Ile, Leu or Val
  Variant (7)..(9): Xaa in position 7 to 9 is any amino acid
  Variant (10)..(10): Xaa in position 10 is Leu or Met
  Variant (11)..(12): Xaa in position 11 to 12 is any amino acid
  Variant (14)..(15): Xaa in position 14 to 15 is any amino acid
  Variant (16)..(16): Xaa in position 16 is Asp or Asn
  Variant (17)..(17): Xaa in position 17 is any amino acid
  Variant (18)..(18): Xaa in position 18 is Phe, His or Tyr
  Variant (19)..(21): Xaa in position 19 to 21 is any amino acid
  Variant (24)..(24): Xaa in position 24 is any or no amino acid
  Variant (26)..(26): Xaa in position 26 is any or no amino acid
  Variant (28)..(28): Xaa in position 28 is any amino acid
PXXXXGXXXXXXNXXXXXXXXEQXAXFXP

SEQ ID NO: 5533 - DNA, 129 bp, Saccharomyces cerevisiae
  CDS (1)..(129)
atggaattggtgtccctatgtaatacaattacgattatttctcattcggttttatatgtttcattatcctattacattatcaatccttgcacttcagcttcctctaacttcgatgacagcttctcataa

SEQ ID NO: 5534 - protein, 42 aa, Saccharomyces cerevisiae
MELVSLCNTITIISHSVLYVSLSYYIINPCTSASSNFDDSFS

SEQ ID NO: 5535 - DNA, 381 bp, Saccharomyces cerevisiae
  CDS (1)..(381)
atggataatttgataattgctgggattttattgttgatcaaggctatgatattctgtatagttaatatactagaagttctcctcgaggatataggaatcctcaaatccctatttttacataatgctattacgattatttcttcttccgtcttatattttttattgtcctattacatcatcaatcctcgcatttcagcttccattatatttgatgactgtttctcaatctttatgttatcttcttacaccgtatgtgatgatatactaataacacggatacttaataaacagatgatgttacagtttcatccaatacgaacgattatcaaattattgcaacatttcccagtgaaatcgtcaccaaatgctcatacagcgtga

SEQ ID NO: 5536 - protein, 126 aa, Saccharomyces cerevisiae
MDNLIIAGILLLIKAMIFCIVNILEVLLEDIGILKSLFLHNAITIISSSVLYFLLSYYIINPRISASIIFDDCFSIFMLSSYTVCDDILITRILNKQMMLQFHPIRTIIKLLQHFPVKSSPNAHTA

SEQ ID NO: 5537 - DNA, 354 bp, Saccharomyces cerevisiae
  CDS (1)..(354)
atgctgaatgtgcgccagtactatcgaaccatagaaacccatatattccccaatattaataattctactgagaaatgggtgaattttgaaataattgttgggattccatcgttgataaaggctataatattaggtatacagaatgtactagaagttctcctcgatgatataggaatccccataatggaatctatatttctatgtaccaatattacgattattcctcattccatttcatatgtttcattatcctattacattatcgatccttgcatttcagcttcctctaacttcggtgacagcttctataataacttatgtcactatctaacaccgtatatgataatatattga

SEQ ID NO: 5538 - protein, 117 aa, Saccharomyces cerevisiae
MLNVRQYYRTIETHIFPNINNSTEKWVNFEIIVGIPSLIKAIILGIQNVLEVLLDDIGIPIMESIFLCTNITIIPHSISYVSLSYYIIDPCISASSNFGDSFYNNLCHYLTPYMIIY

SEQ ID NO: 5539 - DNA, 198 bp, Saccharomyces cerevisiae
  CDS (1)..(198)
atgaaggctataatattaggtatacagaatatactagaagttctcctcgaggatataggaatcctcaaaatggaatctatatttctacatactaatattacgattattcctcattccgttttatatgtttcattatcctattacattatcaatccttgcacttcagcttcctctaacctcgatgacagcttctcataa

SEQ ID NO: 5540 - protein, 65 aa, Saccharomyces cerevisiae
MKAIILGIQNILEVLLEDIGILKMESIFLHTNITIIPHSVLYVSLSYYIINPCTSASSNLDDSFS

SEQ ID NO: 5541 - DNA, 255 bp, Saccharomyces cerevisiae
  CDS (1)..(255)
atgtactcacatgagaatcacgtgaattttcagatagttgttgggattccattattgataaaggcagtaatattatgtatacagaatatactagaagttctcctcgaggatataggaatcctcaaaatggaatctatatttctacatactaatattacgattattcctcattccgttttatatgtttcattatcctattacattatcaatccttgcacttcagcttcgtctaacttcgatgacagcttctcataa

SEQ ID NO: 5542 - protein, 84 aa, Saccharomyces cerevisiae
MYSHENHVNFQIVVGIPLLIKAVILCIQNILEVLLEDIGILKMESIFLHTNITIIPHSVLYVSLSYYIINPCTSASSNFDDSFS

SEQ ID NO: 5543 - DNA, 177 bp, Saccharomyces cerevisiae
  CDS (1)..(177)
atggaatctatatttctacatgctaatattacgatcattcctcattcagttttatatgtttcattatcctattacattatcaatccttgcgtttcagtttccactaatttagatgactatttctcatcatttgtgtcatcttctaacaccgtatatgataatatactagtaacataa

SEQ ID NO: 5544 - protein, 58 aa, Saccharomyces cerevisiae
MESIFLHANITIIPHSVLYVSLSYYIINPCVSVSTNLDDYFSSFVSSSNTVYDNILVT

SEQ ID NO: 5545 - DNA, 129 bp, Saccharomyces cerevisiae
  CDS (1)..(129)
atggaatctatatttctacatactaatattacgattattcctcattccgttttatatgtttcattatcctattacattatcaatccttgcacttcagcttcctctaacttcgatgacagcttctcataa

SEQ ID NO: 5546 - protein, 42 aa, Saccharomyces cerevisiae
MESIFLHTNITIIPHSVLYVSLSYYIINPCTSASSNFDDSFS

SEQ ID NO: 5547 - DNA, 26 bp, Artificial sequence
  primer
atggaattggtgtccctatgtaatac

SEQ ID NO: 5548 - DNA, 26 bp, Artificial sequence
  primer
ttatgagaagctgtcatcgaagttag

SEQ ID NO: 5549 - protein, 42 aa, Artificial sequence
  consensus sequence
  Variant (4)..(4): Xaa in position 4 is any amino acid
  Variant (7)..(9): Xaa in position 7 to 9 is any amino acid
  Variant (14)..(14): Xaa in position 14 is any amino acid
  Variant (31)..(31): Xaa in position 31 is any amino acid
  Variant (35)..(35): Xaa in position 35 is any amino acid
  Variant (37)..(37): Xaa in position 37 is any amino acid
  Variant (40)..(40): Xaa in position 40 is any amino acid
MESXFLXXXITIIXHSVLYVSLSYYIINPCXSASXNXDDXFS

SEQ ID NO: 5550 - protein, 43 aa, Artificial sequence
  protein pattern
  Variant (3)..(4): Xaa in position 3 to 4 is any or no amino acid
  Variant (6)..(7): Xaa in position 6 to 7 is any or no amino acid
  Variant (9)..(9): Xaa in position 9 is any amino acid
  Variant (10)..(10): Xaa in position 10 is Ala, Asn or Thr
  Variant (11)..(11): Xaa in position 11 is Asn or Thr
  Variant (16)..(16): Xaa in position 16 is Pro or Ser
  Variant (19)..(19): Xaa in position 19 is Ile or Val
  Variant (20)..(20): Xaa in position 20 is any amino acid
  Variant (30)..(30): Xaa in position 30 is Asp or Asn
  Variant (33)..(33): Xaa in position 33 is any amino acid
  Variant (35)..(35): Xaa in position 35 is Ala or Val
  Variant (37)..(37): Xaa in position 37 is Ser or Thr
  Variant (39)..(39): Xaa in position 39 is Phe or Leu
  Variant (40)..(40): Xaa in position 40 is Asp or Gly
  Variant (42)..(42): Xaa in position 42 is any amino acid
MEXXSXXLXXXITIIXHSXXYVSLSYYIIXPCXSXSXNXXDXF

SEQ ID NO: 5551 - DNA, 1233 bp, Saccharomyces cerevisiae
  CDS (1)..(1233)
atgttttccatattcaattcaccatgtgtttttgaacagctgccatcttttagtcagcccctacattcgcgttattttgattgcagttctccagtgagctattatccagaatgtaaaaggaggaaagcaataaaagctaacctaagagctccaaaaaaaagcgatgcaaattgttcagaacctttgaggtatgcacttgctgaaacaccaaatggttatacattaagcttgtctaagcggattccatatgaacttttttcaaagtacgttaatgagaaattaggtgagctaaaggagaaccattacagaccaacttaccatgttgtccaagatttttttggaaaccagtattatgttgaagatgaagcggatgaagatgctctattgagatctgcattgaaagatctggattttagagccataggaaagaaaattgctaaggatcttttccaagactacgaaatagaattgaatcatagaggtgatgaattgagcatattgagtaagaaggataaaatctttaaggaattctctctagaccaagtgtttgaagatgtttttgttattggctgtggagttgaaaacatagatgatggctcgagagaaaaatatgcacttttaaagattggtttagttaagcatgaggaagaaatttccgaaggtggcatcaacgaaccaaagatgccaataattgaatccaaaatagacgagtctcacgatgatgttaacatgtctgaatctttgaaggaggaagaagcggagaaagcgaaagaaccactaaccaaagaagaccaaataaaaaaatggatagaggaagaaagattgatgcaggaggaaagcagaaaatcagaacaggaaaaagctgccaaggaagatgaagaaaggcaaaagaaagagaaggaagccagattgaaggcaaggaaagaatctttgataaataagcaaaaaaccaagaggtcccagcaaaaaaaattgcaaaattccaaatcattgcctatctctgagattgaggccagcaataaaaataataatagcaattctggttcagcagaaagtgataatgaaagtataaacagtgattctgatacgactttggatttctctgtgtctggtaatacactaaaaaaacacgcttcacccctattagaagacgttgaggatgaggaagttgacagatacaacgagtccctaagcagatctcccaagggaaactctattattgaggagatataa

SEQ ID NO: 5552 - protein, 410 aa, Saccharomyces cerevisiae
MFSIFNSPCVFEQLPSFSQPLHSRYFDCSSPVSYYPECKRRKAIKANLRAPKKSDANCSEPLRYALAETPNGYTLSLSKRIPYELFSKYVNEKLGELKENHYRPTYHVVQDFFGNQYYVEDEADEDALLRSALKDLDFRAIGKKIAKDLFQDYEIELNHRGDELSILSKKDKIFKEFSLDQVFEDVFVIGCGVENIDDGSREKYALLKIGLVKHEEEISEGGINEPKMPIIESKIDESHDDVNMSESLKEEEAEKAKEPLTKEDQIKKWIEEERLMQEESRKSEQEKAAKEDEERQKKEKEARLKARKESLINKQKTKRSQQKKLQNSKSLPISEIEASNKNNNSNSGSAESDNESINSDSDTTLDFSVSGNTLKKHASPLLEDVEDEEVDRYNESLSRSPKGNSIIEEI

SEQ ID NO: 5553 - DNA, 1032 bp, Candida glabrata CBS 138
  CDS (1)..(1032)
atgctagatatttttaacggtccatgtatggctacattgccttccatttacaataacgatgccgctttcccacatgacatatttagtgccatgcctattttctctgacatgatggtcgacgctcctcacggtaagagacgctgctacaagaactacaataagactggcggtaatgagcacactcagaaacatgcttcaagagctagaagccacaagaagcagcactcaatgaactacaagattgagaagctaggtaacggtaactacgagttgcaactctccaagaaaattggacacaatgttgtcgctaaggccatcaatgaccaagtttctgttctcgctgagaaatactacgtccctagctatagtgtggtcagggacatcttcggtagacagtactacgttgaagaggaaactgacgaagaggaattaagacaaaaagttatgtctcaaattgatatcggtgatatcaagagaaagattgctcgccagcagttcaatgactacgagtttgaactgaatcacagaggtgatgaagttattatgttcagtaaatcagataaaattgagaaggaatttaattttggtgagaatctcgaagacatcagaatgaaatactgtactattaacaacaagaacaccgaggctgtgctttgtgttgaattaatagcatctgaaggacataatataaataattcggtcttcgctcaaccagtaaatcatgccaatgaagtatttccagatccaagatcagatctatctcaccagagctccgaggaagaaaatgaagaagatgaagcatatatctctaccgatgatgagctcaatactaacacagacggtaacacgtccgattcttctgatgttgtgtctgacgccgtatctgacagcgacagcagtgcatactatggtgagtctgtcacaaaagtatactccccaatactcgaaaatgtggaggatgaagagatagacaggtatagaaagtcatttgaacactctccaagcggatatgctatcattgaggatttgtaa

SEQ ID NO: 5554 - protein, 343 aa, Candida glabrata CBS 138
MLDIFNGPCMATLPSIYNNDAAFPHDIFSAMPIFSDMMVDAPHGKRRCYKNYNKTGGNEHTQKHASRARSHKKQHSMNYKIEKLGNGNYELQLSKKIGHNVVAKAINDQVSVLAEKYYVPSYSVVRDIFGRQYYVEEETDEEELRQKVMSQIDIGDIKRKIARQQFNDYEFELNHRGDEVIMFSKSDKIEKEFNFGENLEDIRMKYCTINNKNTEAVLCVELIASEGHNINNSVFAQPVNHANEVFPDPRSDLSHQSSEEENEEDEAYISTDDELNTNTDGNTSDSSDVVSDAVSDSDSSAYYGESVTKVYSPILENVEDEEIDRYRKSFEHSPSGYAIIEDL

SEQ ID NO: 5555 - DNA, 1029 bp, Kluyveromyces lactis NRRL Y-1140
  CDS (1)..(1029)
atgcttgcctgtacacttccagagatttcaccattcatgtttactcagaactgtccatacaaaaagagaagaacaactcatcagaagccaactgtaaggtaccaagtgcagcatttgccaaacgagatcattgttgatctgaagaagactgctcctaaggaaactattgaacaccatattttatctcatgttaggaatttccaagataccattcctagatataagttagtcaccgactggctcggtaaccaatattatgttgaaaacgacatcaaccaagaaacaattttcaacgaagtactaagatctattaattggacccagtttggtatcaacatgtgcaagaagctattccgtgactatgacattcaattgaaacatgacgggaaagagctcagagtaacaagcaaaatggatggtattgatcagatcttcgaattgaatgaggaagtggatgacgttgaaattatgggactacagttatccgatgacttgcatgatgctgttttgaaattacgtttgatcaagaaagaaatgcaggaagaaaaagtgaagagtgtacaatgtgaacacaaagaaagtgtgcacaagaaagaaccatctgaatttgaaactaaaaaaccttcccaagtcacagagagtaaagaaatcctcaaaaggaaaaaccgccattatcatcaccaccactctaaaaacgagcccagaaataagacaaagagcaactccagaaaggtcaaaaaagttgaaaaagaattacccacttcggatgacgacaacacacagctagaagcatcgaagcctaaagcctttaagatcgacgtcctctttgactctagtgattctgaaaagtcagagaataatgtcaactccagtaacaactacgacaatggagtttctccacccagaagaaactccgcctcaagtgttaactcagtagtattggaagaagttgaagacgaagaggtaagaagatggcaaaaatcgttgacgcaaacaccttctggtcactccgttttagaggatgtgtag

SEQ ID NO: 5556 - protein, 342 aa, Kluyveromyces lactis NRRL Y-1140
MLACTLPEISPFMFTQNCPYKKRRTTHQKPTVRYQVQHLPNEIIVDLKKTAPKETIEHHILSHVRNFQDTIPRYKLVTDWLGNQYYVENDINQETIFNEVLRSINWTQFGINMCKKLFRDYDIQLKHDGKELRVTSKMDGIDQIFELNEEVDDVEIMGLQLSDDLHDAVLKLRLIKKEMQEEKVKSVQCEHKESVHKKEPSEFETKKPSQVTESKEILKRKNRHYHHHHSKNEPRNKTKSNSRKVKKVEKELPTSDDDNTQLEASKPKAFKIDVLFDSSDSEKSENNVNSSNNYDNGVSPPRRNSASSVNSVVLEEVEDEEVRRWQKSLTQTPSGHSVLEDV

SEQ ID NO: 5557 - DNA, 26 bp, Artificial sequence
  primer
atgttttccatattcaattcaccatg

SEQ ID NO: 5558 - DNA, 27 bp, Artificial sequence
  primer
ttatatctcctcaataatagagtttcc

SEQ ID NO: 5559 - DNA, 2316 bp, Saccharomyces cerevisiae
  CDS (1)..(2316)
atgtctgtgcgaaacctcaccaataatcgtcattccaacagcgaaaatagtgtttccggaagcgaaaactccttttattcctcgaatgagcaatcaagacaaagctcatcattagaacctgcagatggtcagaacgttagggtgagcggtaatcctttccttggaagtgaagaatttgacgaagattataattcacccagtggagacgatgagcggcgtggggcaaatgaatattccagttcttcatccataaattataataacgatcctaacagcgatacttctcttctggctaatgaaaagaactcacccgagagaaatggtcaaagaatgtcagactataagggctattatgctaagactaacctaacttctgctaataacttaaacaatcataataacaataattataagaacattataagcagtagtaacgataatagttttgcatcacatttacagccgccggacagaaacttaccgtctcatccttcttcaaataatatgagtagcttttctaacaacagcttaattaagtctccaccaccttttgacagatatccgctagtaggaacgaggcatatttcagcggctcaatctcagtcgcagaaccttataaatgaaaagaaaagagcgaatatgactggctcatcttcttctgctcacgactcttcattatcatccaccaacttatacatgggcgaacaggatttttcgccctttggcggttatccagcttccttctttccgttaacgttggacgaaaaggaagacgatgactacattcataatccaaatgtcgaggaagaagcaaagttagatagaaggaggttcgttgacgacttcaaacacatggatagaagatctttcttggggcttctgggtattctatttttatttatggctggtatatttattttcattgtattacctgcaattacattttccggggtagtttatcatcatgaacatgttcatgcggcaaattcagcaggatcgtcgtcttctaatactacatccaagtcattgactgaatatcaatatcctcaacttgcggctataaggacaactttagttgatccagacacacctgacagtgcgaagacaagagtagcgaaagatggatctaaatggcagctggtgttttccgatgaatttaatgctgaaggtaggaccttttacgatggcgatgaccagttttggacagctcctgacatccactacgacgctacgaaagatcttgaatggtactcaccagatgccgttacaactacaaatggtaccttgacgttgagaatggatgcattcagaaaccatgacctttattacagatctggtatggtacagagctggaacaaactctgctttacagaaggtgcgttagaagtttccgcgaacctccctaattatggtcgagttacaggattatggcctggtatgtggaccatggggaacttgggcagaccaggttatttggcgagtactcaaggtgtttggccttattcatatgaagcatgtgacgctggtataacaccaaaccaaagttccccagatggtatttcttacttgccgggacaaaagttgagtgtttgtacttgtgataatgaggatcatccaaatcagggagttggaagaggcgcaccggaaatagatattttagaaggtgaagctgatacaattttgggtgttggtgttgcgtcacaatctctacaaattgctccatttgatatatggtacatgcccgattatgacttcatcgaagtttataatttcaccacaacaactatgaatacttacgctggtgggccttttcaacaagctgtctcagcaatatccactttaaatgtaacatggtatgaatttggggaggaagcaggttattttcaaaagtatgccattgaatatctcaatgatgacgacaacggatatattcgttggtttgtgggagagaaccctactttcacactatatgctacttctttacatcctagtggtaatattgactggaggagaataagtaaggagccaatgtcagcgattttaaacttaggtatttccaacaactgggcctatatcgactggcaatatatatttttcccggtgacaatgtcaatagattacgtccgattataccagccgaagggttctacgtccattacttgtgatcctgaggactacccgacatatgattatatccaaagccatctaaatgcatattataacgccaatttaactgattgggaacaggctggatatactttcccaaaaaatattctaacaggaggttgtagtagttcaaaattctcattatcctga

SEQ ID NO: 5560 - protein, 771 aa, Saccharomyces cerevisiae
MSVRNLTNNRHSNSENSVSGSENSFYSSNEQSRQSSSLEPADGQNVRVSGNPFLGSEEFDEDYNSPSGDDERRGANEYSSSSSINYNNDPNSDTSLLANEKNSPERNGQRMSDYKGYYAKTNLTSANNLNNHNNNNYKNIISSSNDNSFASHLQPPDRNLPSHPSSNNMSSFSNNSLIKSPPPFDRYPLVGTRHISAAQSQSQNLINEKKRANMTGSSSSAHDSSLSSTNLYMGEQDFSPFGGYPASFFPLTLDEKEDDDYIHNPNVEEEAKLDRRRFVDDFKHMDRRSFLGLLGILFLFMAGIFIFIVLPAITFSGVVYHHEHVHAANSAGSSSSNTTSKSLTEYQYPQLAAIRTTLVDPDTPDSAKTRVAKDGSKWQLVFSDEFNAEGRTFYDGDDQFWTAPDIHYDATKDLEWYSPDAVTTTNGTLTLRMDAFRNHDLYYRSGMVQSWNKLCFTEGALEVSANLPNYGRVTGLWPGMWTMGNLGRPGYLASTQGVWPYSYEACDAGITPNQSSPDGISYLPGQKLSVCTCDNEDHPNQGVGRGAPEIDILEGEADTILGVGVASQSLQIAPFDIWYMPDYDFIEVYNFTTTTMNTYAGGPFQQAVSAISTLNVTWYEFGEEAGYFQKYAIEYLNDDDNGYIRWFVGENPTFTLYATSLHPSGNIDWRRISKEPMSAILNLGISNNWAYIDWQYIFFPVTMSIDYVRLYQPKGSTSITCDPEDYPTYDYIQSHLNAYYNANLTDWEQAGYTFPKNILTGGCSSSKFSLS

SEQ ID NO: 5561 - DNA, 2082 bp, Candida glabrata CBS 138
  CDS (1)..(2082)
atgactgttagaaatttgacaggacgtgattaccgttcctccaggtcttcttcatttgataacaacacgggcaatccgtttctggcgagtgaagaagagaacgatgacgatagaagttcttcctctttcatccattacgacagggatgcgtctcgacaagcggcgctagagggccttgacggtcagcgccatgtgtccgattacaaaggttactactctaagaataacactgctcaaaacttgaatacgggcaatggcaacactcccaacctggacaacagcaagagatacttttcacagacgtctctgaacactggtcttacaagaaatgacatcttgtcccctcctgaatttgatagatatccattggttggttcgagagttgcctcctctacccagttacaccagcaggcatactcatcttctccggtgcctcgcatggcttcatcgcctgataactctggatcctctttttcctctactaacaataatactttcttaggtgaacaggatttctctccctttggtggctatcctgcttcatctttcccactactgatggaagaaaaagaagatgacgattacttacataacccagaccctgaagaggaggctagactggacagaaagagattttccaacgacttcaagtacatggataagagatccgccggtggtcttgcgggtgttcttttcctattcatcgggctgggatgtttgttcatcctactgccagcattaacctacacaggtgtcactgaacacgctaagccagtggtacaagaaatcttgtccgcttaccagtatccacaattgtcagcaataagaactaagctggtggacccagacacacctcaatcagctctgtcaagacaggcaagagatggttcatactggaagctggtattctcagatgaatttaatgcagagggaagaacattttatgacggtgaagaccaattctggaccgctcctgatatccactacgatgccactaaggatttggaatggtattcccctgatgcatcaactacacgcaacggtactctacaactaagaatggatgctttcaaaaaccacaacttatactacagatctggtatgttacaaagttggaacaaactatgttttacacaaggtgccatcgaagtctcagctaatttgcctaactacggtcgtgtatctggtctatggcctggtctatggactatgggtaacctgggtagacctggttacttaggttctactgatggtgtttggccatattcgtattcttcttgtgatgcaggtatcacaccaaaccaaagttcgccggatggtatctcgtacttaccgggccaaagattaagtgtctgtacttgtgatggtgaggaacatccaaaccaaggtaccggtagaggtgctcctgaaatcgatattcttgaaggtgctaccgatacagtcttaggtgtaggtacagcatcccaatcctaccaagttgcaccatttgatatctggtatattccagactatgacttcattgagattcacaatttcactacaaccactatgaatacttattgtggtggtccattccaacaggctatttctgctgtgaccactttaaacacttcatggtatcagtatggtgaaggatctggatattaccagaaatttgcaattgaattcttgaacgacgatgaggatggatatatccaatggtatgtcggtgacaaggccacttggactttaatgaacacagctttacacgccaatggtaacattgataatagacacgtcagtaaagagcctatgtccatcattttgaacttaggtatctccaataactgggcttacattgattggcaaatgatctacttcccggtaaccatgtctattgactatgtcagaatatatcaaccaaacaacagtgttagtgttacctgtgatcctcctgattatccaacatacgattacatcaaggatcacccaattgtctacaacgacgctaatgttaccaagtggaatctggctggctactccacaccaaagaatatattgactggtaactgtaagagctcaaagttcaagctgtcctcttag

SEQ ID NO: 5562 - protein, 693 aa, Candida glabrata CBS 138
MTVRNLTGRDYRSSRSSSFDNNTGNPFLASEEENDDDRSSSSFIHYDRDASRQAALEGLDGQRHVSDYKGYYSKNNTAQNLNTGNGNTPNLDNSKRYFSQTSLNTGLTRNDILSPPEFDRYPLVGSRVASSTQLHQQAYSSSPVPRMASSPDNSGSSFSSTNNNTFLGEQDFSPFGGYPASSFPLLMEEKEDDDYLHNPDPEEEARLDRKRFSNDFKYMDKRSAGGLAGVLFLFIGLGCLFILLPALTYTGVTEHAKPVVQEILSAYQYPQLSAIRTKLVDPDTPQSALSRQARDGSYWKLVFSDEFNAEGRTFYDGEDQFWTAPDIHYDATKDLEWYSPDASTTRNGTLQLRMDAFKNHNLYYRSGMLQSWNKLCFTQGAIEVSANLPNYGRVSGLWPGLWTMGNLGRPGYLGSTDGVWPYSYSSCDAGITPNQSSPDGISYLPGQRLSVCTCDGEEHPNQGTGRGAPEIDILEGATDTVLGVGTASQSYQVAPFDIWYIPDYDFIEIHNFTTTTMNTYCGGPFQQAISAVTTLNTSWYQYGEGSGYYQKFAIEFLNDDEDGYIQWYVGDKATWTLMNTALHANGNIDNRHVSKEPMSIILNLGISNNWAYIDWQMIYFPVTMSIDYVRIYQPNNSVSVTCDPPDYPTYDYIKDHPIVYNDANVTKWNLAGYSTPKNILTGNCKSSKFKLSS

SEQ ID NO: 5563 - DNA, 2232 bp, Candida glabrata CBS 138
  CDS (1)..(2232)
atgtcatatagagaccttactgggaaccacccagacgacgctaatagggatgctggcagctcagcactatccagctcctcgtcttcaatcgctaatgaacataagcaaatggcaaatgataaaaacttacgtaaccccttcgttaccactagtgaagaggatgtgcactctacttcttcttcccaaaacttgctaccacacgataacaactatgagctggctcatacccccgatctaatcgctcccgaacaccacttcactagcagttctggcagtaatagcaaccctgcctccttgaatgagaagatggcagccgactacaagggctattactcaaagcacaacaaggggtcccccagcagattctactctgcaaactctaggaagaactccagctctataactccgcccctgaacataggcaactactctgacctgtcgagcaacgatatacgtgcgccacctgctttcgacaggtacccgctagtgggctcgcggttgcatctcagcaactacagacagaacttcataaagaacgactcacctccgccacctttcaaaaacgagaaactcgcagacggcgagagctcattgatagtgccttcctcagtcatgtttctggatgaccaggacttctccccgttcggtggctacccagcatcggcgttccctctgtccatggatgagaaagaggacgacgacttcctgcacaacccggacccagaagaagaagctaggctggacaaacacaggttctcagaggacttgaagcacatgaacaagaaatccttcggtggtatactgggcgtgctgttcttgttcctcggtgccatcgccttgttcatcatcttgccagtgctaacatactcgggcgcagtagaccaccacgacaataacatacaccctgcgaactccacaaacttcacaaaccacaacgcggtaccgctgtccctgtaccaataccctcaactgtcggccatcagaacatcgctggtggaccccgacacccctcagagcgccttgactagaaaagccaaggacggcagtgattggaggctggtcttctcagatgaatttaacgctgccggaaggactttctacgacggagatgatcaattttggaccgccccagatatccattacgatgcaacaaaggacttggaatggtactccccagatgcgaccacaacaagaaacggtaccttgcaattgagaatggacgctttcaaaaaccacaatctatactacagatctggtatggtacagagctggaacaaattatgctttactcaaggagctttggagatttctgccaacttgcccaattatggtaaaatcagtggcttgtggccaggtttatggacaatgggtaaccttggcagaccaggttacctagcatccactgaaggtgtctggccatactcttattcttcctgtgatgcaggcatcacacccaaccagagttcaccagacggactatcatacttgccaggccaaaagctaagtgcttgtacgtgtgatggagaagatcatcctaacccaggtgttggtagaggtgctcctgaacttgatattctggaggcagaagcaagcactgagcttcgtgtaggtgtggcatctcaatcgttacaaattgcgccattcgacatttggtacatccctgattataattttgttgaaatctacaacttcagcactaccactatgaatacttactgtggtgggccatttcaacaagcgatctctgctgtgacaactttaaatgcctcatggtatgaatttggagaaggctctggtaaattccagaaatttgcaatcgaatatctaaacgataagaacaaaggttacatcagatggtttgtaggagataatccaacgttcaccatgtattcgacagctcttcatcctaatggtaatattgattggaggtatattagtcaagagccaatgtctattattatgaacttgggtatttcaccaaattgggcgtatattgactggcagatgatttatttccccgtggttatgtcaatagactatgtgagactatatcaaccagaaaatgccgtgtcattgacttgtgacccagaagactatccaacgtatgactacattgaatcccacaaaaatgcgtattataatgcaaatttgacaagctggaagatggctggctacacattcccgaaaaatcaattgactgggaactgtaagagttccaatttcaagcattga

SEQ ID NO: 5564 - protein, 743 aa, Candida glabrata CBS 138
MSYRDLTGNHPDDANRDAGSSALSSSSSSIANEHKQMANDKNLRNPFVTTSEEDVHSTSSSQNLLPHDNNYELAHTPDLIAPEHHFTSSSGSNSNPASLNEKMAADYKGYYSKHNKGSPSRFYSANSRKNSSSITPPLNIGNYSDLSSNDIRAPPAFDRYPLVGSRLHLSNYRQNFIKNDSPPPPFKNEKLADGESSLIVPSSVMFLDDQDFSPFGGYPASAFPLSMDEKEDDDFLHNPDPEEEARLDKHRFSEDLKHMNKKSFGGILGVLFLFLGAIALFIILPVLTYSGAVDHHDNNIHPANSTNFTNHNAVPLSLYQYPQLSAIRTSLVDPDTPQSALTRKAKDGSDWRLVFSDEFNAAGRTFYDGDDQFWTAPDIHYDATKDLEWYSPDATTTRNGTLQLRMDAFKNHNLYYRSGMVQSWNKLCFTQGALEISANLPNYGKISGLWPGLWTMGNLGRPGYLASTEGVWPYSYSSCDAGITPNQSSPDGLSYLPGQKLSACTCDGEDHPNPGVGRGAPELDILEAEASTELRVGVASQSLQIAPFDIWYIPDYNFVEIYNFSTTTMNTYCGGPFQQAISAVTTLNASWYEFGEGSGKFQKFAIEYLNDKNKGYIRWFVGDNPTFTMYSTALHPNGNIDWRYISQEPMSIIMNLGISPNWAYIDWQMIYFPVVMSIDYVRLYQPENAVSLTCDPEDYPTYDYIESHKNAYYNANLTSWKMAGYTFPKNQLTGNCKSSNFKH

SEQ ID NO: 5565 - DNA, 2223 bp, Kluyveromyces lactis NRRL Y-1140
  CDS (1)..(2223)
atgtcaagaagggcaaacgataatcagtttggtagaactgccggtggtactaacaacggcagtttcgattccgattataatgataactacagagcgcaagatcctggatcgagtaatccatttctggacgaatcagaactgaatggactgttcaacagtggaaagaactctgctacgtcactccttcatcaagattctacttcagattcagtcccatcaagtggttacaataatagtaatcctagcgcccagctgctgcatccaagcaacaacaatactaatagcaacaagaatttaaacaaccaacctgtttctgattacaaaggttattacgccagaaataataataacaacagcagcaatagcggtaatatacagggaaggtcacccaatggggctggactgagggtccccagtactattagccagcaacaaccaaatcacggatttccctcaagtacatcaatggcctcaaatcttatcgcaacctccgatatcatgtcccccccagcatttgacagatatcctcaagtagggaattcacgtaccgtatctatgcatgctggaggaacgccattacaaggctcatcttcagggaataactctaactcttccatcaattcatcaaatccctttttatcggaccaggacttctctccatttggtggatatccagcatcatctttccccttgaaaatggatgaaaaggaagacgatgattatttacataacccagatttggaagaagatctgagactcgataaaaaaagatttgaattagatttgaaaaatatggataaaaggtctgcaggtggattaatcggtatattattattatttttgggtgccattgctgtctttatcattctacccgttgttacatttactggagcaggtcgtcatggtagtgcagaagttaccgagcttttgactttatatgaatacccgcaactatcagctataagaacaagtcttgtagaccctgacacgccatcttctgccaagacagtaaaatctttaagtggcgatacatgggaactagtattctccgatgagttcaacgcggaaggaagaacgttctttgataatgaagatcagttctggactgctccaaatttccattacgatgccaccaaggatttagaatggtattctccccaacaggtaatcacttctgaaggtactttgaaattaagaatggatgcatacaagaacaacgatctttactacaggtcggggatgcttcaatcttggaataaactatgtttcactcaaggacgactagaaatcagcgtaaatcttccaaactacggtacaatatctggtctatggcctggtgcttggacattgggtaatttaggtaggccaggctatcaggccactactgaaggtgtttggccttattcatatgaagcgtgcgatgctggtataacaccaaatcaatcttctccagatggtatttcttacttgccaggacaaaaactttctgcatgtacatgtgatggtgaagatcatcctaaccttggggttggtagaggtgcgcctgaaattgatattatcgaaatcgaaacagacacttcacttcatggcactggtgttggtgttgcatcacaatcatatcaagttgctccatttgatatttggtacattccagattatgacttcgttgagatttacaacgaaagtataacatcaatgaacacgtactgcggtggtccattccaacaagcagtctctgctgtctcaacattgaatgcctcctggtatgaatttggacagactgcaggacattatcagaagtatgctattgaatatttgcatgataatgatgatggatatattcgttggcatgtgggtgataatccaactttcaccgtatttgcaacagccttacatcctaatggtaacatcgattggagacgtatttcaaaagaacctatgtcgattatccttaacttgggtatctccaataattgggcttatatcgattggcaatctatatatttcccggttaccatgtcaattgattacgtcagactataccaaccaaacgatagcataagtgtcacttgtgatccatcagaccatccaacatatgactacatcgtagcacacgaaactgcatattataatgttaacttgactagctgggaagctgctggatacacttacccaaagaatgctttaacaggaaattgtaagagttccaaattttcaggctag

SEQ ID NO: 5566 - protein, 740 aa, Kluyveromyces lactis NRRL Y-1140
MSRRANDNQFGRTAGGTNNGSFDSDYNDNYRAQDPGSSNPFLDESELNGLFNSGKNSATSLLHQDSTSDSVPSSGYNNSNPSAQLLHPSNNNTNSNKNLNNQPVSDYKGYYARNNNNNSSNSGNIQGRSPNGAGLRVPSTISQQQPNHGFPSSTSMASNLIATSDIMSPPAFDRYPQVGNSRTVSMHAGGTPLQGSSSGNNSNSSINSSNPFLSDQDFSPFGGYPASSFPLKMDEKEDDDYLHNPDLEEDLRLDKKRFELDLKNMDKRSAGGLIGILLLFLGAIAVFIILPVVTFTGAGRHGSAEVTELLTLYEYPQLSAIRTSLVDPDTPSSAKTVKSLSGDTWELVFSDEFNAEGRTFFDNEDQFWTAPNFHYDATKDLEWYSPQQVITSEGTLKLRMDAYKNNDLYYRSGMLQSWNKLCFTQGRLEISVNLPNYGTISGLWPGAWTLGNLGRPGYQATTEGVWPYSYEACDAGITPNQSSPDGISYLPGQKLSACTCDGEDHPNLGVGRGAPEIDIIEIETDTSLHGTGVGVASQSYQVAPFDIWYIPDYDFVEIYNESITSMNTYCGGPFQQAVSAVSTLNASWYEFGQTAGHYQKYAIEYLHDNDDGYIRWHVGDNPTFTVFATALHPNGNIDWRRISKEPMSIILNLGISNNWAYIDWQSIYFPVTMSIDYVRLYQPNDSISVTCDPSDHPTYDYIVAHETAYYNVNLTSWEAAGYTYPKNALTGNCKSSKFSG

SEQ ID NO: 5567 - DNA, 2058 bp, Debaryomyces hansenii CBS767
  CDS (1)..(2058)
atggcacaaagggatttaacgtataatacgccaaatgacgctaaccagggaaacccagaggtggaaaacccgtttgcttccccaatagacgatgagagctcatttgagctgaatcaaccgtcatcttcgagtcaactggcagattataaccagatgaaccgccatttaaatgaccctaattacggaggtgccttcaacactttcaatgggtattactcacaaaatggaaccacatccaatttgttgtcccacgaagactcccaagacgatactacagggcttcggaactctttggggatccctaacggggactcgtcgcagaacatccaagtaccgtcagaatacgacagatatccatctatggcgggctcgagagtggtatcttcgacctcactttcatcgaacatgttcggtagttccaacaacctccaacagaaccaccagagcacgcgtaagtcggatgacgattcgtcaatttctaataagtctaccaacccgtttttaccgggaactgacttcagtcctttcggaggataccctgcatcgtcatttcctttacatatagacgaaaaggaaccggatgattatttacacaacccagatcccatcgaggacgcagcgtacgataagaacagattcattcacgatttaaagaatatggatagaagatcgttgggtgggttaataggggtaattttcttggtagtgggagctattgttgtgttcatcttgttacctgtgttgacatattctggtgttaccgagccttatactcctgagagctacgagattttgacatcgtaccattatccccttttgagtgctattaggacagatttggttgatccagatactcccgcagaagctttaactaaaaagacttccaagggtgaaacgtggaagttagttttttccgatgaatttaatgcagaaggtagaaccttctacgaaggtgacgatcaatttttccaagctgcagatctttggtacggtggtaccatggatttagaatactatgatccagatgctgtgacgactgccaatggtaccttgaacttgagaatggatgcatacaagaatcatgatgtgttttacagatctggtatggtccaaagttggaataaaatgtgctttacccaagggtacttagaattttctgccagactaccagggtacggtaatgtgtctggattgtggccaggtttatggtctatgggtaatttaggtcgtcctggatacatggcgactactgaaggtgtatggccatacacgtacgactcgtgtgatgccggtattactgcaaaccaatcatctcctgatggaatttcgtacttgccaggtcagagattaaataaatgtacttgttctggggaggatcatcctagtccaggtaaaggaagaggttgtccagaatatgatgttcttgaaggtgaagttagtactgatgtaggtgttggtgtggcgtcacaatcgatgcaaattgctccatttgatatctggtattatcctgattataatttcgtatcaattcataatgattcggtcacaactttgaacacttatacgggtggtccattgcaacaagcagtttctggtacaacgaccttgaacgtgtcgtggtattctgaaggtgacaatgaacataatttccagacctatggatatgaatatttaaatgatgacgatgatggatatttgacatggcatgtcggtgaggatccaacattgaccgttcatgcttatgccttaggaccgaatggaaatgtggggcgtagattgatgtctaaagaaccaatgtcattggttatgaattttggtatctccaataactgggcttatatcgactggaacgctttgcatttcccacttaccatgcgtgttgatcatgtcagagtttaccagccagaagatgccatcaatgtaagttgtgatccggatgattatccaacctccaactacattgagacccacccaaaggcataccaaaataccaatctcacatcatgggaagatactggatacgactggcccaaaaattctttgcttcatcaatgttag

SEQ ID NO: 5568 - protein, 685 aa, Debaryomyces hansenii CBS767
MAQRDLTYNTPNDANQGNPEVENPFASPIDDESSFELNQPSSSSQLADYNQMNRHLNDPNYGGAFNTFNGYYSQNGTTSNLLSHEDSQDDTTGLRNSLGIPNGDSSQNIQVPSEYDRYPSMAGSRVVSSTSLSSNMFGSSNNLQQNHQSTRKSDDDSSISNKSTNPFLPGTDFSPFGGYPASSFPLHIDEKEPDDYLHNPDPIEDAAYDKNRFIHDLKNMDRRSLGGLIGVIFLVVGAIVVFILLPVLTYSGVTEPYTPESYEILTSYHYPLLSAIRTDLVDPDTPAEALTKKTSKGETWKLVFSDEFNAEGRTFYEGDDQFFQAADLWYGGTMDLEYYDPDAVTTANGTLNLRMDAYKNHDVFYRSGMVQSWNKMCFTQGYLEFSARLPGYGNVSGLWPGLWSMGNLGRPGYMATTEGVWPYTYDSCDAGITANQSSPDGISYLPGQRLNKCTCSGEDHPSPGKGRGCPEYDVLEGEVSTDVGVGVASQSMQIAPFDIWYYPDYNFVSIHNDSVTTLNTYTGGPLQQAVSGTTTLNVSWYSEGDNEHNFQTYGYEYLNDDDDGYLTWHVGEDPTLTVHAYALGPNGNVGRRLMSKEPMSLVMNFGISNNWAYIDWNALHFPLTMRVDHVRVYQPEDAINVSCDPDDYPTSNYIETHPKAYQNTNLTSWEDTGYDWPKNSLLHQC

SEQ ID NO: 5569 - DNA, 2040 bp, Debaryomyces hansenii CBS767
  CDS (1)..(2040)
atggtccacagagatttgacgtataatactcctagtgaagccaacgaacggggtgcaagcgtagcaaacccgtttgtttcgcctaatgatgatgatgatatttcatttgaactgagtcgggaatcatcttcgagtcagttgaacgactttgaccaaatgaatactcatttgaacgatcctcaatacggagggacttttgatagttataacgggtattactcacaaaacggcaccacatcgaacttgttatcgaaagaaggatcacctagcatggagaatacgggaaatgcagcatttcaatcgtccctgatgcctccagaatacgacagatatccgtctatggcgggctcaagagtggtgtcgtcgacatcactttcatccaacatgatcactagccccaacaacatccagcagaatcaactgagcacgcgtaggtcggatgacgattcgtcaatttctaataagtctgccaacccatttttgcttggaaccgacttcagtcctttcggaggataccctgcatcgtcatttcctttacatatagacgaaaaggaaccggacgactatttacacaacccaaatcccgtagaggatgcagcatatgacaagaacagattcattcacgatttaaagcatatggacagaagatcgttgggtgggttgctaggagttgtctttatgttgttaggagctattgttgtgtttatcttgttgcccgtattgacatattctggtgttaccgagccttatactcctgagagctacgagattttgacatcgtaccattatcctcttttgagtgctatcagaaccgatttggttgatccagacactcctgaaactgccttaactagaaaaactgccaccggagatacatggaagttggtgttctctgaagaatttaatgcggaaggtagaacgttttacgaaggtgatgatcaatttttccaagctgcagatctttggtacggtggtaccatggatttagaatactatgacccagatgctgtgacgactgcaaatggtaccttgaacttgagaatggatgcatacaagaatcatgatttgttttacagatctggtatggttcaaacttggaataaaatgtgctttacccaagggttacttgaatattctgccagattgcctggttatggtaatgtatctggattgtggccaggtttatggtctattggtaatttagctcgtccaggatacatgtcaacaagtgaaggtgtctggccatatacatatgactcgtgcgatgccggtattactgcaaaccaatcatctcctgatggtatttcatatttgccaggtcaaagattaagcaaatgtacctgttctggggaggatcatcctagtccaggtaaaggaagaggtgctccagaatatgatgttcttgaaggtgaagttagtactgatgtaggtgttggtgtggcgtcacaatcgatgcaaattgctccatttgatatctggtattatcctgactataatttcgtatcaattcataatgattcggtcacaactatgaacacttatacgggtggtccattacaacaagcagtttctgggacaacgaccttgaacgtgtcgtggtattccgaaggtgacaatgaacataatttccagacctatgggtatgaatatttgaatgatgatgacgatggatatttgacatggtatgttggaatggatcctactgtcactgttcattcgaaagctttggggcccaacggaaacatcgggcataggttaatgtccaaggaaccaatgtcattggttatgaattttggtatctccaataactgggcttatatcgactggaacgctttgcacttcccgcttaccatgcgtattgatcatgtcagaatataccagccagaagatgctatcaatgtaagttgtgaccccgatgattatccaacctctaactacattgagacccacccaaaggcttaccaagacaacaatctcacatcatgggcagatactggatacgactggcccaaaaattcacttgttcataaatgtagctga

SEQ ID NO: 5570 - protein, 679 aa, Debaryomyces hansenii CBS767
MVHRDLTYNTPSEANERGASVANPFVSPNDDDDISFELSRESSSSQLNDFDQMNTHLNDPQYGGTFDSYNGYYSQNGTTSNLLSKEGSPSMENTGNAAFQSSLMPPEYDRYPSMAGSRVVSSTSLSSNMITSPNNIQQNQLSTRRSDDDSSISNKSANPFLLGTDFSPFGGYPASSFPLHIDEKEPDDYLHNPNPVEDAAYDKNRFIHDLKHMDRRSLGGLLGVVFMLLGAIVVFILLPVLTYSGVTEPYTPESYEILTSYHYPLLSAIRTDLVDPDTPETALTRKTATGDTWKLVFSEEFNAEGRTFYEGDDQFFQAADLWYGGTMDLEYYDPDAVTTANGTLNLRMDAYKNHDLFYRSGMVQTWNKMCFTQGLLEYSARLPGYGNVSGLWPGLWSIGNLARPGYMSTSEGVWPYTYDSCDAGITANQSSPDGISYLPGQRLSKCTCSGEDHPSPGKGRGAPEYDVLEGEVSTDVGVGVASQSMQIAPFDIWYYPDYNFVSIHNDSVTTMNTYTGGPLQQAVSGTTTLNVSWYSEGDNEHNFQTYGYEYLNDDDDGYLTWYVGMDPTVTVHSKALGPNGNIGHRLMSKEPMSLVMNFGISNNWAYIDWNALHFPLTMRIDHVRIYQPEDAINVSCDPDDYPTSNYIETHPKAYQDNNLTSWADTGYDWPKNSLVHKCS

SEQ ID NO: 5571 - DNA, 2025 bp, Debaryomyces hansenii CBS767
  CDS (1)..(2025)
atggcaaaacgagatttgacatataatacaccgagggagagatataatgacgactatgaagttgaagatccgtttactctgcctatagatgaggagagttcatttgaactgaacgaacaatggtcctcaagtcagctggaagattatgaaaggattaacagccatctgggcaatccagtttatgacgtcagtttcaaaaagtataatggatactactcgaaaaatcctactaagacatattcaaatgaatattcgccagacaaaagtaatggtattcgcaactcaccaggaatcatcaatattcaaccttctcagaacattcaggtgccactggagtacgacagatacccaactatgactggatcaaagatgatttcaactacttcgctcacatcgaacgtattcaattctcagaacattccaaacccagacgacgattcgtccacgtcaaatagatcaagtaagccgctcttagtgtcaaaagactttagtccctttggtgggtatccgacaacatcatttcctttgcatatagatgagaaagagccagatgattatttacacaaccctgatcctctcaaggatgcagcttatgataaaaacaggtttttctacgacttgaaaaatatggatagaaggtcgatgggtgggttactaggcgtcgtatttttaattgtggctgcagttgttgtattcattttgttacccatattgacgtattctggtatcactgagccatatactccagagagttacgaaattttgacttcttatcgctatcctttattgagcgctattaggacaggcttggttgatccagatacaccggaagatgcattaaccaaaaagacttccaaggatgccacatggaagttggtattctctgacgaatttaacgcagcaggtagaaccttctacgaaggtgatgatcagtttttccaagctgcagacctttggtacggtggtactcaagatttggaatactatgatccagatgctgtgacgactgccaatggtaccttgaacttgagaatggatgcatacaagaatcacgatttgttttacagatctggtatggttcaaagttggaataaaatgtgtttcactcaaggtttccttgaaatttctgcgaggttgcctggttatggtaatgccaccggattatggccaggtttatggaccatgggtaatttaggccgcccaggatacatggccagtaccgaggggttgtggccatatacatatgactcgtgtgatgccggtatcacagcaaaccaatcatccgctgatggtatttcgtacttgccaggtcaaagattgagcaaatgtacctgttcaggagaggatcatcctagtccaggtaaaggaagaggtgctccagaatatgatgttcttgagggtgaaatggatctagaacaattgattggcgttgcatcacaatccatgcaaattgctccctttgatatttggtattaccctgattataattttatttccatttacaataaatcagtaaccaccattaatacgtatactggtggtccattgcaacaagctgtctctggtacgactgtattaaaccgaacctggtattcagaaggcgtggggcaaaagttccagacatacgcatacgagtatctaaacgacgatgatgacgggtacttgacatggtatgtgggtaatgaccctactgtgaccgtagaagcagctgctttggggcccaatggaaatataggccgcagattaatgtcaaaagagccaatgtcgatggtgatgaattttggtatttcaaatagttgggctcaaattgactggctctctttgattttccctcttactatgagtattgatcatgtccgattataccagccccaagacgctatcaacttaacatgtgatcccgaggattatccaacgtccaactatattcaagcacatccagaagcatatcaaaacaataatttaacatcatgggcggagactaaatatgataatcctaaaaactctttagtacatggatgttaa

SEQ ID NO: 5572 - protein, 674 aa, Debaryomyces hansenii CBS767
MAKRDLTYNTPRERYNDDYEVEDPFTLPIDEESSFELNEQWSSSQLEDYERINSHLGNPVYDVSFKKYNGYYSKNPTKTYSNEYSPDKSNGIRNSPGIINIQPSQNIQVPLEYDRYPTMTGSKMISTTSLTSNVFNSQNIPNPDDDSSTSNRSSKPLLVSKDFSPFGGYPTTSFPLHIDEKEPDDYLHNPDPLKDAAYDKNRFFYDLKNMDRRSMGGLLGVVFLIVAAVVVFILLPILTYSGITEPYTPESYEILTSYRYPLLSAIRTGLVDPDTPEDALTKKTSKDATWKLVFSDEFNAAGRTFYEGDDQFFQAADLWYGGTQDLEYYDPDAVTTANGTLNLRMDAYKNHDLFYRSGMVQSWNKMCFTQGFLEISARLPGYGNATGLWPGLWTMGNLGRPGYMASTEGLWPYTYDSCDAGITANQSSADGISYLPGQRLSKCTCSGEDHPSPGKGRGAPEYDVLEGEMDLEQLIGVASQSMQIAPFDIWYYPDYNFISIYNKSVTTINTYTGGPLQQAVSGTTVLNRTWYSEGVGQKFQTYAYEYLNDDDDGYLTWYVGNDPTVTVEAAALGPNGNIGRRLMSKEPMSMVMNFGISNSWAQIDWLSLIFPLTMSIDHVRLYQPQDAINLTCDPEDYPTSNYIQAHPEAYQNNNLTSWAETKYDNPKNSLVHGC

SEQ ID NO: 5573 - DNA, 2049 bp, Debaryomyces hansenii CBS767
  CDS (1)..(2049)
atgggacaaagagatttaacatataatgtgccaaatacagggtacaatacggagcccgaagttgagaatccatttgtttcaccaatagatgaagagagctcatatgagctgaatcaggacttatcccccagccaactggaggattatagtcaaataaatatgaacgaccctaattatggaggaacatttgacaattataatggatattactcgaagaacgggacgacatcgaacttgttaccgaatgatgggacgtctgaagatacgttgggcatacgtaactcgatgggaataggtagggtaagttcatcgaaaaatttatatataccaccagagtacgatagatatccgtcaatggcaggttcaagggtagtatcatcgacatctctctcgtcagatatgtataacagtacccataaccttcgcaatgcgcaaaatgtgcctggatcagaaggagacggttcctccatatcgaataaatcgacaaatccgcttgttgagaacgactttagtccatttggaggataccctgctacatcatttcctttgcatatagacgaaaaggaaccagatgactatttgcacaatcctgatcctatcaaagatgcgaaatatgacaagaacagattcatttatgatttgaagaacatggacaggagatctttgggtggattgctaggaattgttttcatgttgttagcagctattgtggtgtttatcttgttacctgtgttgacatattctggtgttaccgagccttatactcctgagagctacgagattttgacatcgtaccattatcctcttttgagtgctatcagaaccgatttggttgatccagacacccctgcaactgccttgactagaaaggctaacaatggtgatgaatggaagttggtgttctctgacgagtttaatgcggaaggcagaactttctatgaagatgatgaccaatttttccaggctgcagatatctggtatggtggtactcaagatttggagtactatgatccagatgctgtgacgactgcaaatggtaccttgaacttgagaatggatgcatacaagaatcacgatttgttttacagatctggtatggtccaaagttggaataaaatgtgctttacccaagggttactcgaaatttcagcccgtttgcctggttacggtaatacttccggtttatggccaggtttatggaccatgggtaatttaggccgtcctggatacatggccagtaccgaaggtgtgtggccatatacatacaactcgtgcgatgccggtattactgcaaaccaatcatctcctgatggtatttcatatttgccaggtcaaagattaagcaaatgtacctgttctggggaggatcatcctagtccaggtaaaggaagaggtgctccagaatatgatgttctcgaaggtgaagttagtactgatgtaggtgttggtgtggcgtcgcaatcgatgcagattgctccatttgatatctggtattatcctgattataatttcatatcaattcataatgactcagttaccactatgaacacttatacgggtggtccattacaacaagcagtttctggtacgacgaccttgaacgtgtcgtggtattctgaaggtgacaatgaacataatttccagacctatgggtacgaatatttgaatgatgatgacgacggatatttgacatggtacgttggtactgatccaaccgtcactgtacaagcagcagcgttaggtcctaatggaaatattggtcgcagattgatgtctaaggaaccaatgtctatggtgatgaattttggtatttcaaatagttgggcttatatcgactggaacgctctatttttcccacttactatgcgaattgaccatgttaggttataccaaccagaagattccataaatttgacctgtgacccagatgattacccaacttatgaatatatcgaagcacacccgaaggcatatcaagacaacaaccttacatcttgggaagaaactggttatgatttccctaaaaattctttagtccataagtgttag

SEQ ID NO: 5574 - protein, 682 aa, Debaryomyces hansenii CBS767
MGQRDLTYNVPNTGYNTEPEVENPFVSPIDEESSYELNQDLSPSQLEDYSQINMNDPNYGGTFDNYNGYYSKNGTTSNLLPNDGTSEDTLGIRNSMGIGRVSSSKNLYIPPEYDRYPSMAGSRVVSSTSLSSDMYNSTHNLRNAQNVPGSEGDGSSISNKSTNPLVENDFSPFGGYPATSFPLHIDEKEPDDYLHNPDPIKDAKYDKNRFIYDLKNMDRRSLGGLLGIVFMLLAAIVVFILLPVLTYSGVTEPYTPESYEILTSYHYPLLSAIRTDLVDPDTPATALTRKANNGDEWKLVFSDEFNAEGRTFYEDDDQFFQAADIWYGGTQDLEYYDPDAVTTANGTLNLRMDAYKNHDLFYRSGMVQSWNKMCFTQGLLEISARLPGYGNTSGLWPGLWTMGNLGRPGYMASTEGVWPYTYNSCDAGITANQSSPDGISYLPGQRLSKCTCSGEDHPSPGKGRGAPEYDVLEGEVSTDVGVGVASQSMQIAPFDIWYYPDYNFISIHNDSVTTMNTYTGGPLQQAVSGTTTLNVSWYSEGDNEHNFQTYGYEYLNDDDDGYLTWYVGTDPTVTVQAAALGPNGNIGRRLMSKEPMSMVMNFGISNSWAYIDWNALFFPLTMRIDHVRLYQPEDSINLTCDPDDYPTYEYIEAHPKAYQDNNLTSWEETGYDFPKNSLVHKC

SEQ ID NO: 5575 - DNA, 1929 bp, Debaryomyces hansenii CBS767
  CDS (1)..(1929)
atggccagacgggatttgacatttaataccccaaatggggcacaggatgaagaatcaggggtcgagaacccgtttatatcgcctgttgacgaagaaagttcttcatttggcctgaaccaacaatcatcgtccagtcagctggatgataataatcggataaataatcatatgaatgagcaaagctatggagaagcatttaatgtttataatggatattactctcgaaccggaaccacaacaaacttaatatccaatgagacactgggtggtggtagaaatggtaataataattctctaggagtttctaatttggggataccacgaaacatacaactgccaatagagttcgatagatatccttcgaactttagtagttgtaataacatcaacagcttaatcaactctaaacacgacgaaagcgatttgccggtgtcaaaaaaatcttcgagctcctttttacctgggaatgatttcagtccgtttgatgcggattatgacaaaaacaggtttattcatgacttgaagaacatggacagaagatcattgggtgggttgataggagtcatatttttagtgttagctgcagttgcggtgtttattttgttacccgtattaacatattctggtgttaccgacccatatacgccagagagttacgagatattaacttcatatagatatcctctactaaatgctatcaggacagatttggttgacccagatactcctgaagatgcattaactaaaaagacttccaaaggtgaaacgtggaagttggttttttccgatgaatttaatgcagaaggtagaaccttttatgacggcgatgatcagtttttccaagctgcagacctttggtacggtggtactcaagatttggaatactatgatccagatgctgtgacgactgccaatggtaccttgaacttgagaatggatgcatacaagaatcacgatttgttttacagatctggaatggtccaaagttggaataaaatgtgctttacccaagggtacttagaattttctgccagactaccagggtacggtaatgtatctgggttgtggccaggtttatggtccatgggtaatttaggtcgccctggatacttggccagtactgaaggtatatggccatatacatatgactcatgtgatgccggtattactgcaaaccaatcatctcctgatggaatttcgtacttgccaggtcaaagattgaacaaatgtacttgttctggagaagatcatcctagtccaggtaaaggaagaggtgctccagaatatgatgttctcgaaggtgaagttagtactgatgtaggtgttggtgtggcgtcgcaatcgatgcagattgctccatttgatatctggtattatcctgattataatttcatatcaattcataatgactcagttaccactatgaacacttatacgggtggtccattacaacaagcagtttctggtacgacgaccttgaacgtgtcgtggtattctgaaggtgacaatgaacataatttccagacctatgggtacgaatatttgaatgatgatgacgacggatatttgacatggtacgttggtactgatccaaccgtcactgtacaagcagcagcgttaggtcctaatggaaatattggtcgcagattgatgtctaaggaaccaatgtctatggtgatgaattttggtatttccaacaactgggcctatatcgactggaactctttgaaatttcctattacaatgaatattgatcatgttagagtgtatcaacctgaggatgctattaatttaacctgtgaccctgacgactacccaacgtatgattatattcaagcacatcccaaggcgtatcaaaataacaaccttacctcatgggaagagactgaatacagtattccaaaaaattccttagtccatggttgctga

SEQ ID NO: 5576 - protein, 642 aa, Debaryomyces hansenii CBS767
MARRDLTFNTPNGAQDEESGVENPFISPVDEESSSFGLNQQSSSSQLDDNNRINNHMNEQSYGEAFNVYNGYYSRTGTTTNLISNETLGGGRNGNNNSLGVSNLGIPRNIQLPIEFDRYPSNFSSCNNINSLINSKHDESDLPVSKKSSSSFLPGNDFSPFDADYDKNRFIHDLKNMDRRSLGGLIGVIFLVLAAVAVFILLPVLTYSGVTDPYTPESYEILTSYRYPLLNAIRTDLVDPDTPEDALTKKTSKGETWKLVFSDEFNAEGRTFYDGDDQFFQAADLWYGGTQDLEYYDPDAVTTANGTLNLRMDAYKNHDLFYRSGMVQSWNKMCFTQGYLEFSARLPGYGNVSGLWPGLWSMGNLGRPGYLASTEGIWPYTYDSCDAGITANQSSPDGISYLPGQRLNKCTCSGEDHPSPGKGRGAPEYDVLEGEVSTDVGVGVASQSMQIAPFDIWYYPDYNFISIHNDSVTTMNTYTGGPLQQAVSGTTTLNVSWYSEGDNEHNFQTYGYEYLNDDDDGYLTWYVGTDPTVTVQAAALGPNGNIGRRLMSKEPMSMVMNFGISNNWAYIDWNSLKFPITMNIDHVRVYQPEDAINLTCDPDDYPTYDYIQAHPKAYQNNNLTSWEETEYSIPKNSLVHGC

SEQ ID NO: 5577 - DNA, 1977 bp, Yarrowia lipolytica CLIB122
  CDS (1)..(1977)
atgcgaaatctgacaggggagccggaaaacccgtttgaccagcagtcgtaccagtcatcggacgagcggtcgcacgggtcgggcgactacctataccccgaaaacgacagctaccacgacgttaccagccagacggacacgccaaaccccagcggcaccgaacatctgatgccgcaggtgcccagccgggccacaaagccgtactttgacagcaaccacgacggcgcctcgtcacgacaacatctggtggaccgatcttcatcttcgggctcactggcaggcatgggcggaagcatgacgcccaacgggtttgatcggtacccggaccggatttcctcggtcaacattcgatctgccacagcgtccgaggtcggctccatctcggagaatgatgacaacccgtttgtggtgaacgcagacttttcgccgtttggcggctacccagcatcgtccttccccctgcacattgacgagaaggagcaggacgattatctacacaacccggacccggtgctggaccaggagatggacaagcggtgccagtgccagaaaatggaccgccggggaatctcgtcgctcatcgccttcattctgctcattggcggcctgattgttgtcttcatcgttctgcccatcctcacttactccggagtcactgaacgagtggcacaccccgtcgtgcacagggaggtcgaggtgctgtcggcataccaattcccccagctctcgttccgaaaggagctcgtggaccccgataccccctcttcggccatgacacataccgccgacgacggctcgaaatgggacctcgttttctccgacgagttcaacatggaaggacgaaccttctaccccaacgacgaccccttctggaccgccgtcgacattcattacgctgccaccaaggatctggagtggtacgaccccgatgccgccatcaccgaaaacggaaccctggtgctccagctggacgccttcaagtcgcacgatctctactaccgatctggaatggtccagtcgtggaacaaggtctgtttcactcaggggtatattgagatctccgcgtctctgcccggccagggtcgaacccccggtctgtggcccggtctctggaccatgggtaacctgggtcgtcccggctacctgtccaccaccgatggtgtgtggccctacggatacaacaactgtgatgccggaatcactcctaaccagtcttctactgatggtatctcctacctgcccggtcagcgacttaacaagtgtacctgcaagggtgaggaacatcccaatcccggtactggacgaggagctcccgagattgatgctcttgaaggttccgtcggccccaaggtcggtgttgcttcccagtctcttcaggtcgctccctttgatatttggtacattcccgactacaacttcattgaaatctacaacgcctccgtcacctccatgaacacatacgccggaggtatgttccagcaggccatttctggtatcaccatgctcaacaacgactggtatgatgtggtcagtgtggaaggccaggacgagtccgagctgcattaccaaacgttcggtttcgagtatctcaacgatgacgacaagggctacatcaagtggtttgtgggccaggaccctaccttcaacctccacggctacgccctgggtcccaacggtaacgtgggacgacgagacatttccaaggagcccatgtccatcattatgaacctgggtctgtccaattcttggacctacattgactggcccgctcttaatttcccctctaagctgcgaattgattacgttcgaatctaccagccctccgatcagcacagtatcacctgtgacccggacgactaccctacctacgactacattgagaagcacaagaacgcgtacgagaacgccaacttgaccctgtggaccgatgccggttacaccttcccccaaaacaccctgatgcacagttgcacttag

SEQ ID NO: 5578 - protein, 658 aa, Yarrowia lipolytica CLIB122
MRNLTGEPENPFDQQSYQSSDERSHGSGDYLYPENDSYHDVTSQTDTPNPSGTEHLMPQVPSRATKPYFDSNHDGASSRQHLVDRSSSSGSLAGMGGSMTPNGFDRYPDRISSVNIRSATASEVGSISENDDNPFVVNADFSPFGGYPASSFPLHIDEKEQDDYLHNPDPVLDQEMDKRCQCQKMDRRGISSLIAFILLIGGLIVVFIVLPILTYSGVTERVAHPVVHREVEVLSAYQFPQLSFRKELVDPDTPSSAMTHTADDGSKWDLVFSDEFNMEGRTFYPNDDPFWTAVDIHYAATKDLEWYDPDAAITENGTLVLQLDAFKSHDLYYRSGMVQSWNKVCFTQGYIEISASLPGQGRTPGLWPGLWTMGNLGRPGYLSTTDGVWPYGYNNCDAGITPNQSSTDGISYLPGQRLNKCTCKGEEHPNPGTGRGAPEIDALEGSVGPKVGVASQSLQVAPFDIWYIPDYNFIEIYNASVTSMNTYAGGMFQQAISGITMLNNDWYDVVSVEGQDESELHYQTFGFEYLNDDDKGYIKWFVGQDPTFNLHGYALGPNGNVGRRDISKEPMSIIMNLGLSNSWTYIDWPALNFPSKLRIDYVRIYQPSDQHSITCDPDDYPTYDYIEKHKNAYENANLTLWTDAGYTFPQNTLMHSCT

SEQ ID NO: 5579 - DNA, 2223 bp, Candida albicans SC5314
  CDS (1)..(2223): transl_table=12
atggcgtctcaaagagatttaacttcaaataatcctcatttccatatatcgagttctcgtaacaataccaatgatgatttcaattctgatcataatccaagaaatccatttggtgatgaaccagaagaagaagaagaattagattcagcatcattttcatcctcatcacaaaataatcaaccccatcacccttttgctacatcaaatcaaaccctgagcactaataatcttcatagtaccaacagtattcgaaatgaagctgaatatggcaaaccattccaagcttatagtggctactattcaaatggtggtagttcactgtatttaaatcaagaaggtgtgatttctgatgaaagtagactattatcatcgggtaataataataataataataataataatcgagatgtatctagtgttggtggtggtggtggtagtggtgacaatagattgaatccaaccagtccagcagaatttgatagatatccatcaatggcaggttcaagagtagtatcatctacttcattagtgtcgtttaataatccttccaatatgatgcgtaaccaccatcaacatcaacctcatctcggttcatcttcatctccaacttctagtagcatgaataatgattctatatcagataaatcaactagcccctttcctaatgatttcagtccatttggtggataccctgctagttcattcccattgagtattgatgaaaaagaaccagatgattatttgcataatccagatccagtacaggatgctgaatacgaaaagaaccgatttatgcacgatttaaagaacatggataaacgatcattgggtgggttgattggatttattatattatttatagctgcattagcagtgtttatcattttacctgcattgacttattctggagctactaacccttatcatccagaaagttacgaagttttaactaaatatctgtacccaatgttgagtgctataagaatgaatttagtggatccagatactcctgaatcagcttataaaaagaaggctaaagatggtagtgaatgggtattagttttcagtgatgaatttgatgctgaaggtagaactttttatgaaggcgatgatcaatttttcactgctcctgacattcattacgatgccactaaagatttagaatggtatgatccagatgctgtaaccacagccaatggaacattaaatttacgtatggatgcttataaaaatcataatttattctatcgttcaggaatggtacaaagttggaatcaattgtgttatactcaaggtcatttagaaattctggctcgtttaccaaattatggtaatgtaacagggttatggcctgggttatggtctatggggaatttaggtagaccagggtatttgggatctactgatggggtatggccatattcttacgattcatgtgatgccggtattacacctaatcaatcttctcctgatgggatttcttatttgccaggtcaaagattaaataaatgtacttgtccaggtgaattacatcctaatcgaggtgttggtagaggtgcccctgaaattgatgttattgaaggtgaagtgatgactgatagtagtggtaaaaaagaaaattgtggtgttgcctctcaatccttacaattagcccctatggatatttggtatattcctgattataattgggtggaaatttacaatttttcagtttcaacaatgaatacttatactggtggaccattccaacaagcattatcagcaacaaccatgttgaatgttacatggtatgaatttggtgataatgcccataatttccaaacttatggttatgagtatttaaatgaccctgaaacgggttatttacgatggtttgttggtgatgatccaacattaacggtttattcacaagctttacatccagacggaaatattggttggagacctttaagtaaagaaccaatgtcattaattttaaatttggggatttcaaataattgggcttatattgattggccaagtatatctttccccgtcacatttagaatcgattatgtaagagtttatcaaccaccagatcaaattaatgttggttgtgatccaaccgatttcccaacttatgattatattcaacaacatttgaatctttatgaaaatgccaatataacttcatttgaagatggtggatataaattccctaaaaatagtttaattggatgttaa

SEQ ID NO: 5580 - protein, 740 aa, Candida albicans SC5314
MASQRDLTSNNPHFHISSSRNNTNDDFNSDHNPRNPFGDEPEEEEELDSASFSSSSQNNQPHHPFATSNQTSSTNNLHSTNSIRNEAEYGKPFQAYSGYYSNGGSSSYLNQEGVISDESRLLSSGNNNNNNNNNRDVSSVGGGGGSGDNRLNPTSPAEFDRYPSMAGSRVVSSTSLVSFNNPSNMMRNHHQHQPHLGSSSSPTSSSMNNDSISDKSTSPFPNDFSPFGGYPASSFPLSIDEKEPDDYLHNPDPVQDAEYEKNRFMHDLKNMDKRSLGGLIGFIILFIAALAVFIILPALTYSGATNPYHPESYEVLTKYSYPMLSAIRMNLVDPDTPESAYKKKAKDGSEWVLVFSDEFDAEGRTFYEGDDQFFTAPDIHYDATKDLEWYDPDAVTTANGTLNLRMDAYKNHNLFYRSGMVQSWNQLCYTQGHLEISARLPNYGNVTGLWPGLWSMGNLGRPGYLGSTDGVWPYSYDSCDAGITPNQSSPDGISYLPGQRLNKCTCPGELHPNRGVGRGAPEIDVIEGEVMTDSSGKKENCGVASQSLQLAPMDIWYIPDYNWVEIYNFSVSTMNTYTGGPFQQALSATTMLNVTWYEFGDNAHNFQTYGYEYLNDPETGYLRWFVGDDPTLTVYSQALHPDGNIGWRPLSKEPMSLILNLGISNNWAYIDWPSISFPVTFRIDYVRVYQPPDQINVGCDPTDFPTYDYIQQHLNLYENANITSFEDGGYKFPKNSLIGC

SEQ ID NO: 5581 - DNA, 2157 bp, Candida albicans SC5314
  CDS (1)..(2157): transl_table=12
atggcaagacgtaatttaaccaagaataccaatggtaatgaatatcaaaatacaaacccatttgttaatcaagctaatcaaaattataacaacaactccacaagacaatcttatcccgggttcactgatcctttcgattctagcaacagacttgatgatggatcatttgattttgaaaatcgttcttcttatccatcttcttccacatccacttcgtctattgccaatcaatatggtcgtcctttcacagtaggtaacggattatcatcaagtaacggaagcagcggctctcatttattacaaggtcaaaatgattacaatctactgctgctgccaaatctacaacaccaacaactccaagctgctgaaaatgataaatcgtcgtcccttctaaattccaatataaataacatcaaagtcgacgtaccttatgactatgacagataccccaaaatcattggcagagtatcatcgagtaactcgttaaataatactagcaacactgccccctatcagtctgaaacaccatcaatatcatccaactcattcaataaaaatgtcaataatacattaaacggtagctacaacaacattattgattttagtccatttggtggctatcctgccagttcattcccacttaatatcgatgaaaaagaacctgatgattatcttcataatcctgacccagttcacgacgtgatttatgagaaaaatagattttggaatgatttgaaaactgctgatcgtaaatcatttggtgggattttgggcttcttatttttgattgcagcagcagtggcggtgtttgtcgtggtcccagcattgacttattcgggagtaaccactcatagtcctccacaggaatacgagattttaagccactattcatatccattactttcagcaattcgtacttcattgatcgacccggatactccacaggacgctttgaaaatgaaagctaaagacggtagtaattggtctttggttttcagtgatgaatttaatattatgggaaggactttctatgaaggcgacgatcaattttggacagcccctgacttgcactatgacgccactaaggacttggaatggtacgaccccgatgcagcaactacgagtaatggtactctcaatttacaaatggatgcatttaaaaatcatgatttgttttatcggtcagggatggtacaaagctggaaccagttatgctttactcagggtaaacttgttatctcggcacgtttagctaacaaaggtaccgtttctggattatggccagggatatggacaatgggtaacttaggtcgccccggatacttggcttctaccgaggggatatggccatattcgtatgactcttgtgattctggtatcactcctaaccaatcatcacccgacggtatttcatatttacccgggcaaagattaaacaaatgtacttgtcctggtgagtcgcatcctaatcgtggtgttgggcgtggtgctccggaaattgatgtcattgaagcagaaattagtactgatgccactggcaatagagaaaatcttggtgttgcatcccaatcattacaattagcaccaatggatatttggtactaccctgaccttgactatttggagatttacaacacttctataaccaccatgaatacttatactggtggtccgtttcaacaagcattgtcaggaaccaccacattaaataaaacttggtacgaactaggaggtaatggtgtacacaattttcaaacgtatggatatgaatatttaaatgataaagacaatgggtatttaagatggtttgttggtgataatcctacattgacagtttacccacaagcattgcaccctaatgggaatgttggatggagaccattgagtagagaacccatgtcaattgttatgaatttgggggtttcaaataattgggcttatattgattggcctagtttgagtttcccatcaacattccgtattgattatgttcgtctttatcaaccaccaaatcaaattaacgttggatgtgacccagcagggttccctacttctgattatatcgaacagcacatcaatgtgtatcaaaatgctaatttaacttcatttgaagatggtgggtatagttttccaaaacattcgttaattggttgctaa

SEQ ID NO: 5582 - protein, 718 aa, Candida albicans SC5314
MARRNLTKNTNGNEYQNTNPFVNQANQNYNNNSTRQSYPGFTDPFDSSNRLDDGSFDFENRSSYPSSSTSTSSIANQYGRPFTVGNGLSSSNGSSGSHLLQGQNDYNLSSSPNLQHQQLQAAENDKSSSLLNSNINNIKVDVPYDYDRYPKIIGRVSSSNSLNNTSNTAPYQSETPSISSNSFNKNVNNTLNGSYNNIIDFSPFGGYPASSFPLNIDEKEPDDYLHNPDPVHDVIYEKNRFWNDLKTADRKSFGGILGFLFLIAAAVAVFVVVPALTYSGVTTHSPPQEYEILSHYSYPLLSAIRTSLIDPDTPQDALKMKAKDGSNWSLVFSDEFNIMGRTFYEGDDQFWTAPDLHYDATKDLEWYDPDAATTSNGTLNLQMDAFKNHDLFYRSGMVQSWNQLCFTQGKLVISARLANKGTVSGLWPGIWTMGNLGRPGYLASTEGIWPYSYDSCDSGITPNQSSPDGISYLPGQRLNKCTCPGESHPNRGVGRGAPEIDVIEAEISTDATGNRENLGVASQSLQLAPMDIWYYPDLDYLEIYNTSITTMNTYTGGPFQQALSGTTTLNKTWYELGGNGVHNFQTYGYEYLNDKDNGYLRWFVGDNPTLTVYPQALHPNGNVGWRPLSREPMSIVMNLGVSNNWAYIDWPSLSFPSTFRIDYVRLYQPPNQINVGCDPAGFPTSDYIEQHINVYQNANLTSFEDGGYSFPKHSLIGC

SEQ ID NO: 5583 - DNA, 1974 bp, Aspergillus oryzae
  CDS (1)..(1974)
atgtcagacaaccccatgagccaatcggcacgagatacccctcacattcgactcaattccggccagcatgatccattcagtgatccagacgaaaatgggccaccggtccctagccacgggggcattggacgcgccttgacacctggcatgtcgaattcaacgtcaactgggacattcttgaccatgcaaactgggatgggttcaccgactcctcaggactccacagatttcttgttaccaccgcggccacagaggcaccgggaacagtatgatgggtttcaatctccggatttgtcggggcaatcgtcaagacgaacaagttggagctcggaaggtgggagtgagagcagaggctacttctacccccgctatgaggacatgagatctccttcgcacggagagggtgatggggatgatgtgaatacacaaacagtcacggagaagttcaacatcatgccgtcagaaggtctgcttctattcccagaggatgtggagaaggacgattatttgcacaacccggatccaaacgacaaagaacgagactgtgacatttggaaccgacgaggaatagtcaacggtggaggtttagttttgttgactctgggtctcctgatgctgttcattgggtaccctgttcttactgctgttcgaggaatggagaaaggctcagcctctgtctgcaaagctggggacacgttatgtcttgatgtgggagagagatcgacactaaaaaatgtgcggaccggattgatagacccggacactccggcctccgcaatgacaaagaagtcggctgatggcaaggaatggaagctggtgttttcggatgagttcaacacaccggggcggacgttttatgacggtgatgatgcttttctccaggcggttgatatctggtacggtgtgacgcaggatctcgagtggtacgatcctgatgcagttactacgaaagatggtgtattggagcttcggttcgatgcattcccgaatcatgaaatgaagtataggtccggcatggtccagagttggaacaaattatgtttcactggtggtcgtttggaagcaagtatatccctgccaggaaatggtgaagtgtccggtttctggcctggtttctgggcaatgggtaacctagggcgcccgggctatgccgccaccacggaaggaatgtggccgtacagctactatgatggttgtgatgcgggaatcacgccgaatcaaagttctacagatggtctgagctggttacctggaatgcgtctacctgcatgctcctgcgacagtgcagaacaccctacccctggcaaatcaaggagcgcaccggaaatcgatgttattgaagctagcgttgctgctttgaacggtgacgcggcgacgatggtagggtctgtttctcaaagtctgcagatggccccattcgatatttggtatatgcctgattacgaatacgcagctgtatacgatcccaagatcacagagattaactcctatcgtggcgggccttatcaacaggcaatgtctgggctcagcaatctcaataacgattggtataacggaacacaataccaggtttatgccttcgactacacaccgggagcccgtggtaatatcacctggtatgtcggccaggataagacatggactctcgacggtagagccctgggacccaacggcaacatcggccagcgggtgattcctctggaaccgatgtctattatcatgaacctgggtatggcatacagtttcgctccagttgatgacaacatcaagaaatttttgcctgggtacatgcgtttcgattacctccgcatctatcaggatccagacaacattagccttacctgcgacccaccgggctatgaaacaacggagtatatcgcgaaacaccccaaggcgtaccaaaacgtcaacaaaactacatggactgatgctggatatgaatggcctaaaaactcattcatgcatgaatgttga

SEQ ID NO: 5584 - protein, 657 aa, Aspergillus oryzae
MSDNPMSQSARDTPHIRLNSGQHDPFSDPDENGPPVPSHGGIGRALTPGMSNSTSTGTFLTMQTGMGSPTPQDSTDFLLPPRPQRHREQYDGFQSPDLSGQSSRRTSWSSEGGSESRGYFYPRYEDMRSPSHGEGDGDDVNTQTVTEKFNIMPSEGLLLFPEDVEKDDYLHNPDPNDKERDCDIWNRRGIVNGGGLVLLTLGLLMLFIGYPVLTAVRGMEKGSASVCKAGDTLCLDVGERSTLKNVRTGLIDPDTPASAMTKKSADGKEWKLVFSDEFNTPGRTFYDGDDAFLQAVDIWYGVTQDLEWYDPDAVTTKDGVLELRFDAFPNHEMKYRSGMVQSWNKLCFTGGRLEASISLPGNGEVSGFWPGFWAMGNLGRPGYAATTEGMWPYSYYDGCDAGITPNQSSTDGLSWLPGMRLPACSCDSAEHPTPGKSRSAPEIDVIEASVAALNGDAATMVGSVSQSLQMAPFDIWYMPDYEYAAVYDPKITEINSYRGGPYQQAMSGLSNLNNDWYNGTQYQVYAFDYTPGARGNITWYVGQDKTWTLDGRALGPNGNIGQRVIPLEPMSIIMNLGMAYSFAPVDDNIKKFLPGYMRFDYLRIYQDPDNISLTCDPPGYETTEYIAKHPKAYQNVNKTTWTDAGYEWPKNSFMHEC

SEQ ID NO: 5585 - DNA, 2163 bp, Saccharomyces cerevisiae
  CDS (1)..(2163)
atgcctttgagaaatctaactgaaacgcacaactttagtagcacaaacctggacacagatggtacaggcgacgatcatgatggtgctcctctttcctcatctccttcttttggacaacaaaatgacaatagcaccaacgataatgctggtctcacaaacccttttatggggagtgacgaagaatctaatgcgcgggatggagaatctctgtcttcttctgttcattatcagccacaggggagtgactcttcactacttcatgacaattctcgtctagatctaagtcaaaataaaggtgtatctgattacaaaggttactattccaggaacaatagtagagctgtgagtacggctaatgataactcatttcttcagccaccacatagagctatagcctcttctccttctttgaattctaatttatcgaagaatgatattctctcaccgccagaatttgatagatatcccttagtgggttccagagtcacttctatgactcaactgaaccatcatggtcgctcgccaacatcatctccaggaaacgagtcgtccgcctcattctcttctaatccgtttttgggcgagcaagatttttctccatttggtgggtatcctgcttcatcgttcccacttatgatagatgaaaaggaagaagatgattatttacacaatcctgaccccgaagaagaggcaagactggatagaaggaggttcatagatgacttcaagtacatggataaaaggtctgctagtgggctagctggtgtattgctcttgtttctggcagccatctttatttttattgttttgccagcgttgacctttaccggtgctattgatcacgaaagcaacactgaagaagttacatatttaactcaataccaatatcctcaactatccgccattagaacatctctggttgacccagacacacctgatacagcgaagacaagagaagctatggatggctctaagtgggaattagtattttctgatgagtttaatgcagaaggcagaacattttatgatggggatgatccatactggacagcccctgatgttcactatgatgctactaaggatttagaatggtacagtccagacgcttccacaactgtgaacggaaccttgcagctgagaatggatgcctttaagaaccatggcttatattacagatcaggtatgttgcagagttggaataaggtttgtttcacgcagggtgctctagaaatctctgcaaatctaccaaattatggccgtgtttcaggtttgtggcccggtctttggactatgggtaatttagggaggcccggttatttggctagtacccaaggtgtctggccttattcttatgaatcgtgtgatgctggtattacacccaaccaaagttccccggatggtatttcttacttgccgggacaaaagttaagtatttgtacttgtgatggtgaagatcatccgaatcaaggtgttggtagaggagctccagaaattgatgttttggaaggtgaaactgatactaagattggtgtaggtatagcctctcaatccttgcaaattgcaccttttgatatctggtacatgcctgactatgattttatcgaggtttacaatttcacaacaacgaccatgaacacttatgctggcggtccatttcaacaagccgtatctgctgtctcaactttgaacgtaacttggtatgaattcggtgagtacggtggctactttcaaaaatatgccattgagtatctgaacgatgacgacaatggttatatccgttggtttgttggtgatactccaacttatactattcatgctaaagccttacatcctgatggtaatattggttggagaagaatcagtaaagaaccaatgtcgattattctaaatctgggtatttccaacaattgggcttatattgattggcagtatattttcttcccagtggttatgtcgattgactatgttagaatataccaaccaagtaatgctatatccgtgacatgcgatccaagtgactatccaacatatgattatattcaatcgcacttaaatgcattccagaatgcaaacttaactacttgggaagatgctggttacacgttccctaagaatatcctaactggtaaatgtactagctcgaagttcaagttatcctcttaa

SEQ ID NO: 5586 - protein, 720 aa, Saccharomyces cerevisiae
MPLRNLTETHNFSSTNLDTDGTGDDHDGAPLSSSPSFGQQNDNSTNDNAGLTNPFMGSDEESNARDGESLSSSVHYQPQGSDSSLLHDNSRLDLSQNKGVSDYKGYYSRNNSRAVSTANDNSFLQPPHRAIASSPSLNSNLSKNDILSPPEFDRYPLVGSRVTSMTQLNHHGRSPTSSPGNESSASFSSNPFLGEQDFSPFGGYPASSFPLMIDEKEEDDYLHNPDPEEEARLDRRRFIDDFKYMDKRSASGLAGVLLLFLAAIFIFIVLPALTFTGAIDHESNTEEVTYLTQYQYPQLSAIRTSLVDPDTPDTAKTREAMDGSKWELVFSDEFNAEGRTFYDGDDPYWTAPDVHYDATKDLEWYSPDASTTVNGTLQLRMDAFKNHGLYYRSGMLQSWNKVCFTQGALEISANLPNYGRVSGLWPGLWTMGNLGRPGYLASTQGVWPYSYESCDAGITPNQSSPDGISYLPGQKLSICTCDGEDHPNQGVGRGAPEIDVLEGETDTKIGVGIASQSLQIAPFDIWYMPDYDFIEVYNFTTTTMNTYAGGPFQQAVSAVSTLNVTWYEFGEYGGYFQKYAIEYLNDDDNGYIRWFVGDTPTYTIHAKALHPDGNIGWRRISKEPMSIILNLGISNNWAYIDWQYIFFPVVMSIDYVRIYQPSNAISVTCDPSDYPTYDYIQSHLNAFQNANLTTWEDAGYTFPKNILTGKCTSSKFKLSS

SEQ ID NO: 5587 - DNA, 24 bp, Artificial sequence
  primer
atgtctgtgcgaaacctcaccaat

SEQ ID NO: 5588 - DNA, 26 bp, Artificial sequence
  primer
tcaggataatgagaattttgaactac

SEQ ID NO: 5589 - protein, 794 aa, Artificial sequence
  consensus sequence
  Variant (2)..(3): Xaa in position 2 to 3 is any amino acid
  Variant (5)..(5): Xaa in position 5 is any amino acid
  Variant (8)..(23): Xaa in position 8 to 23 is any amino acid
  Variant (24)..(53): Xaa in position 24 to 53 is any or no amino acid
  Variant (56)..(96): Xaa in position 56 to 96 is any amino acid
  Variant (97)..(122): Xaa in position 97 to 122 is any or no amino acid
  Variant (125)..(153): Xaa in position 125 to 153 is any amino acid
  Variant (154)..(187): Xaa in position 154 to 187 is any or no amino acid
  Variant (189)..(191): Xaa in position 189 to 191 is any amino acid
  Variant (196)..(226): Xaa in position 196 to 226 is any amino acid
  Variant (227)..(254): Xaa in position 227 to 254 is any or no amino acid
  Variant (264)..(266): Xaa in position 264 to 266 is any amino acid
  Variant (270)..(272): Xaa in position 270 to 272 is any amino acid
  Variant (276)..(276): Xaa in position 276 is any amino acid
  Variant (284)..(286): Xaa in position 284 to 286 is any amino acid
  Variant (287)..(291): Xaa in position 287 to 291 is any or no amino acid
  Variant (293)..(294): Xaa in position 293 to 294 is any amino acid
  Variant (297)..(297): Xaa in position 297 is any amino acid
  Variant (298)..(298): Xaa in position 298 is any or no amino acid
  Variant (300)..(300): Xaa in position 300 is any amino acid
  Variant (302)..(302): Xaa in position 302 is any amino acid
  Variant (305)..(305): Xaa in position 305 is any amino acid
  Variant (308)..(309): Xaa in position 308 to 309 is any amino acid
  Variant (311)..(312): Xaa in position 311 to 312 is any amino acid
  Variant (314)..(316): Xaa in position 314 to 316 is any amino acid
  Variant (318)..(324): Xaa in position 318 to 324 is any amino acid
  Variant (327)..(327): Xaa in position 327 is any amino acid
  Variant (330)..(330): Xaa in position 330 is any amino acid
  Variant (333)..(334): Xaa in position 333 to 334 is any amino acid
  Variant (336)..(350): Xaa in position 336 to 350 is any amino acid
  Variant (351)..(363): Xaa in position 351 to 363 is any or no amino acid
  Variant (365)..(365): Xaa in position 365 is any amino acid
  Variant (368)..(368): Xaa in position 368 is any amino acid
  Variant (370)..(370): Xaa in position 370 is any amino acid
  Variant (375)..(375): Xaa in position 375 is any amino acid
  Variant (383)..(384): Xaa in position 383 to 384 is any amino acid
  Variant (386)..(392): Xaa in position 386 to 392 is any amino acid
  Variant (394)..(395): Xaa in position 394 to 395 is any amino acid
  Variant (397)..(397): Xaa in position 397 is any amino acid
  Variant (406)..(407): Xaa in position 406 to 407 is any amino acid
  Variant (413)..(414): Xaa in position 413 to 414 is any amino acid
  Variant (417)..(417): Xaa in position 417 is any amino acid
  Variant (419)..(420): Xaa in position 419 to 420 is any amino acid
  Variant (422)..(422): Xaa in position 422 is any amino acid
  Variant (424)..(425): Xaa in position 424 to 425 is any amino acid
  Variant (427)..(428): Xaa in position 427 to 428 is any amino acid
  Variant (430)..(430): Xaa in position 430 is any amino acid
  Variant (434)..(434): Xaa in position 434 is any amino acid
  Variant (436)..(436): Xaa in position 436 is any amino acid
  Variant (440)..(440): Xaa in position 440 is any amino acid
  Variant (443)..(443): Xaa in position 443 is any amino acid
  Variant (448)..(448): Xaa in position 448 is any amino acid
  Variant (454)..(454): Xaa in position 454 is any amino acid
  Variant (458)..(458): Xaa in position 458 is any amino acid
  Variant (460)..(460): Xaa in position 460 is any amino acid
  Variant (466)..(466): Xaa in position 466 is any amino acid
  Variant (472)..(472): Xaa in position 472 is any amino acid
  Variant (478)..(478): Xaa in position 478 is any amino acid
  Variant (481)..(481): Xaa in position 481 is any amino acid
  Variant (484)..(484): Xaa in position 484 is any amino acid
  Variant (487)..(488): Xaa in position 487 to 488 is any amino acid
  Variant (490)..(492): Xaa in position 490 to 492 is any amino acid
  Variant (498)..(498): Xaa in position 498 is any amino acid
  Variant (500)..(500): Xaa in position 500 is any amino acid
  Variant (510)..(512): Xaa in position 510 to 512 is any amino acid
  Variant (514)..(514): Xaa in position 514 is any amino acid
  Variant (516)..(516): Xaa in position 516 is any amino acid
  Variant (520)..(520): Xaa in position 520 is any amino acid
  Variant (521)..(521): Xaa in position 521 is any or no amino acid
  Variant (523)..(524): Xaa in position 523 to 524 is any amino acid
  Variant (531)..(531): Xaa in position 531 is any amino acid
  Variant (536)..(536): Xaa in position 536 is any amino acid
  Variant (546)..(546): Xaa in position 546 is any amino acid
  Variant (548)..(549): Xaa in position 548 to 549 is any amino acid
  Variant (553)..(553): Xaa in position 553 is any amino acid
  Variant (556)..(556): Xaa in position 556 is any amino acid
  Variant (559)..(560): Xaa in position 559 to 560 is any amino acid
  Variant (562)..(562): Xaa in position 562 is any amino acid
  Variant (569)..(569): Xaa in position 569 is any amino acid
  Variant (571)..(572): Xaa in position 571 to 572 is any amino acid
  Variant (574)..(581): Xaa in position 574 to 581 is any amino acid
  Variant (582)..(587): Xaa in position 582 to 587 is any or no amino acid
  Variant (589)..(589): Xaa in position 589 is any amino acid
  Variant (594)..(594): Xaa in position 594 is any amino acid
  Variant (596)..(596): Xaa in position 596 is any amino acid
  Variant (604)..(604): Xaa in position 604 is any amino acid
  Variant (608)..(613): Xaa in position 608 to 613 is any amino acid
  Variant (615)..(617): Xaa in position 615 to 617 is any amino acid
  Variant (619)..(620): Xaa in position 619 to 620 is any amino acid
  Variant (624)..(624): Xaa in position 624 is any amino acid
  Variant (628)..(628): Xaa in position 628 is any amino acid
  Variant (632)..(632): Xaa in position 632 is any amino acid
  Variant (634)..(637): Xaa in position 634 to 637 is any amino acid
  Variant (640)..(641): Xaa in position 640 to 641 is any amino acid
  Variant (644)..(644): Xaa in position 644 is any amino acid
  Variant (645)..(645): Xaa in position 645 is any or no amino acid
  Variant (647)..(650): Xaa in position 647 to 650 is any amino acid
  Variant (651)..(658): Xaa in position 651 to 658 is any or no amino acid
  Variant (660)..(663): Xaa in position 660 to 663 is any amino acid
  Variant (669)..(670): Xaa in position 669 to 670 is any amino acid
  Variant (671)..(671): Xaa in position 671 is any or no amino acid
  Variant (674)..(675): Xaa in position 674 to 675 is any amino acid
  Variant (677)..(677): Xaa in position 677 is any amino acid
  Variant (680)..(681): Xaa in position 680 to 681 is any amino acid
  Variant (684)..(684): Xaa in position 684 is any amino acid
  Variant (686)..(689): Xaa in position 686 to 689 is any amino acid
  Variant (692)..(692): Xaa in position 692 is any amino acid
  Variant (694)..(694): Xaa in position 694 is any amino acid
  Variant (697)..(699): Xaa in position 697 to 699 is any amino acid
  Variant (701)..(702): Xaa in position 701 to 702 is any amino acid
  Variant (704)..(704): Xaa in position 704 is any amino acid
  Variant (709)..(711): Xaa in position 709 to 711 is any amino acid
  Variant (713)..(713): Xaa in position 713 is any amino acid
  Variant (715)..(715): Xaa in position 715 is any amino acid
  Variant (718)..(718): Xaa in position 718 is any amino acid
  Variant (725)..(728): Xaa in position 725 to 728 is any amino acid
  Variant (729)..(729): Xaa in position 729 is any or no amino acid
  Variant (732)..(735): Xaa in position 732 to 735 is any amino acid
  Variant (738)..(738): Xaa in position 738 is any amino acid
  Variant (741)..(741): Xaa in position 741 is any amino acid
  Variant (745)..(751): Xaa in position 745 to 751 is any amino acid
  Variant (755)..(755): Xaa in position 755 is any amino acid
  Variant (757)..(757): Xaa in position 757 is any amino acid
  Variant (760)..(761): Xaa in position 760 to 761 is any amino acid
  Variant (764)..(765): Xaa in position 764 to 765 is any amino acid
  Variant (767)..(769): Xaa in position 767 to 769 is any amino acid
  Variant (771)..(773): Xaa in position 771 to 773 is any amino acid
  Variant (775)..(775): Xaa in position 775 is any amino acid
  Variant (777)..(777): Xaa in position 777 is any amino acid
  Variant (779)..(781): Xaa in position 779 to 781 is any amino acid
  Variant (784)..(785): Xaa in position 784 to 785 is any amino acid
  Variant (789)..(789): Xaa in position 789 is any amino acid
  Variant (791)..(792): Xaa in position 791 to 792 is any amino acid
  Variant (793)..(793): Xaa in position 793 is any or no amino acid
MXXRXLTXXXXXXXXXXXXXXXXXXXXXXXXXXXXXXXXXXXXXXXXXXXXXXPFXXXXXXXXXXXXXXXXXXXXXXXXXXXXXXXXXXXXXXXXXXXXXXXXXXXXXXXXXXXXXXXXXXXGYXXXXXXXXXXXXXXXXXXXXXXXXXXXXXXXXXXXXXXXXXXXXXXXXXXXXXXXXXXXXXXXPXXXDRYPXXXXXXXXXXXXXXXXXXXXXXXXXXXXXXXXXXXXXXXXXXXXXXXXXXXXXXXXXXXDFSPFGGYPXXXFPLXXXEKEXDDYLHNPXXXXXXXXDXXRFXXDXKXMDXRSXXGXXGXXXLXXXXXXXFIXLPXLTXXGXXXXXXXXXXXXXXXXXXXXXXXXXXXXYXYPXLXAIRTXLVDPDTPXXAXXXXXXXGXXWXLVFSDEFNXXGRTFYXXDDXFXXAXDXXYXXTXDLEXYXPDAXTTXNGTLXLRMDAXKNHXLXYRSGMXQSWNKXCFTQGXLEXSAXLPXXGXXXGLWPGXWXMGNLGRPGYXXXTXGXWPYXXYXXCDAGITXNQSSXDGISYLPGQXLXXCTCXGEXHPXXGXGRGAPEXDXXEXXXXXXXXXXXXXXGXASQSXQXAPFDIWYXPDYXXXXXXNXXXTXXNTYXGGPXQQAXSXXXXLNXXWYXXGXXXXXXXXXXXXQXXXXEYLNDXXXGYXXWXVGXXPTXTXXXXALXPXGNXXXRXXSXEPMSXXXNXGXSNXWAYIDWXXXXXFPXXXXIDXVRXYQPXXXXXXXCDPXDXPTXXYIXXHXXXYXXXNXTXWXXXGYXXPKNXLXXXC

SEQ ID NO: 5590 - protein, 59 aa, Artificial sequence
  protein pattern
  Variant (4)..(4): Xaa in position 4 is Phe or Tyr
  Variant (5)..(5): Xaa in position 5 is Lys or Arg
  Variant (7)..(7): Xaa in position 7 is any amino acid
  Variant (8)..(8): Xaa in position 8 is Asp, Gly or Asn
  Variant (9)..(9): Xaa in position 9 is Leu or Val
  Variant (10)..(10): Xaa in position 10 is Phe or Tyr
  Variant (16)..(16): Xaa in position 16 is Leu or Val
  Variant (18)..(18): Xaa in position 18 is Ser or Thr
  Variant (21)..(21): Xaa in position 21 is any amino acid
  Variant (22)..(22): Xaa in position 22 is Leu, Met or Val
  Variant (24)..(24): Xaa in position 24 is Phe or Tyr
  Variant (26)..(26): Xaa in position 26 is Glu or Gln
  Variant (28)..(28): Xaa in position 28 is any amino acid
  Variant (29)..(29): Xaa in position 29 is Ile or Leu
  Variant (30)..(31): Xaa in position 30 to 31 is any amino acid
  Variant (33)..(33): Xaa in position 33 is Ala or Val
  Variant (34)..(34): Xaa in position 34 is Asn or Arg
  Variant (36)..(36): Xaa in position 36 is Ala or Pro
  Variant (37)..(37): Xaa in position 37 is Gly or Asn
  Variant (38)..(38): Xaa in position 38 is any amino acid
  Variant (40)..(41): Xaa in position 40 to 41 is any amino acid
  Variant (42)..(42): Xaa in position 42 is Ser or Thr
  Variant (48)..(48): Xaa in position 48 is any amino acid
  Variant (50)..(50): Xaa in position 50 is Ser or Thr
  Variant (51)..(51): Xaa in position 51 is Ile, Leu or Met
  Variant (55)..(55): Xaa in position 55 is Ala or Gly
MDAXXNXXXXYRSGMXQXWNXXCXTXGXXXXSXXLXXXGXXXGLWPGXWXXGNLXRPGY

SEQ ID NO: 5591 - protein, 50 aa, Artificial sequence
  protein pattern
  Variant (6)..(6): Xaa in position 6 is Ala or Pro
  Variant (11)..(11): Xaa in position 11 is Ala, Pro or Thr
  Variant (14)..(14): Xaa in position 14 is Ile or Leu
  Variant (21)..(21): Xaa in position 21 is Lys or Arg
  Variant (23)..(23): Xaa in position 23 is Asn or Ser
  Variant (24)..(24): Xaa in position 24 is any amino acid
  Variant (28)..(28): Xaa in position 28 is any amino acid
  Variant (29)..(29): Xaa in position 29 is Gly or Asn
  Variant (31)..(31): Xaa in position 31 is any amino acid
  Variant (34)..(34): Xaa in position 34 is Asn or Ser
  Variant (35)..(35): Xaa in position 35 is any amino acid
  Variant (37)..(37): Xaa in position 37 is any amino acid
  Variant (41)..(41): Xaa in position 41 is Ala or Cys
  Variant (44)..(44): Xaa in position 44 is any amino acid
  Variant (46)..(46): Xaa in position 46 is Ala, Ile or Val
  Variant (47)..(47): Xaa in position 47 is Ile or Leu
  Variant (49)..(49): Xaa in position 49 is Ala, Gly or Ile
  Variant (50)..(50): Xaa in position 50 is Ala, Glu or Ser
DAGITXNQSSXDGXSYLPGQXLXXCTCXXEXHPXXGXGRGXPEXDXXEXX

SEQ ID NO: 5592 - protein, 58 aa, Artificial sequence
  protein pattern
  Variant (6)..(6): Xaa in position 6 is Ala, Asp, Glu, Gln or Ser
  Variant (7)..(7): Xaa in position 7 is Asp, Glu, Ser or Thr
  Variant (9)..(12): Xaa in position 9 to 12 is any amino acid
  Variant (13)..(13): Xaa in position 13 is Ala, Ser or Thr
  Variant (14)..(15): Xaa in position 14 to 15 is any amino acid
  Variant (17)..(18): Xaa in position 17 to 18 is any amino acid
  Variant (20)..(20): Xaa in position 20 is any amino acid
  Variant (28)..(28): Xaa in position 28 is Asp or Asn
  Variant (29)..(30): Xaa in position 29 to 30 is any amino acid
  Variant (35)..(35): Xaa in position 35 is Phe or Tyr
  Variant (36)..(36): Xaa in position 36 is Asp, Glu or Pro
  Variant (37)..(37): Xaa in position 37 is Asp, Gly or Asn
  Variant (38)..(38): Xaa in position 38 is Asp or Glu
  Variant (40)..(40): Xaa in position 40 is any amino acid
  Variant (41)..(41): Xaa in position 41 is Phe or Tyr
  Variant (42)..(42): Xaa in position 42 is any amino acid
  Variant (43)..(43): Xaa in position 43 is Gln or Thr
  Variant (45)..(45): Xaa in position 45 is Ala, Pro or Val
  Variant (46)..(46): Xaa in position 46 is Asp or Asn
  Variant (47)..(47): Xaa in position 47 is Phe, Ile, Leu or Val
  Variant (48)..(48): Xaa in position 48 is His or Trp
  Variant (50)..(50): Xaa in position 50 is Ala, Asp or Gly
  Variant (51)..(51): Xaa in position 51 is Ala, Gly or Val
  Variant (53)..(53): Xaa in position 53 is any amino acid
  Variant (57)..(57): Xaa in position 57 is Trp or Tyr
DPDTPXXAXXXXXXXGXXWXLVFSDEFXXXGRTFXXXXDXXXXAXXXXYXXTXDLEXY

SEQ ID NO: 5593 - protein, 57 aa, Artificial sequence
  protein pattern
  Variant (2)..(2): Xaa in position 2 is any amino acid
  Variant (5)..(5): Xaa in position 5 is any amino acid
  Variant (7)..(7): Xaa in position 7 is Ile, Leu or Val
  Variant (10)..(10): Xaa in position 10 is Phe or Met
  Variant (15)..(15): Xaa in position 15 is any amino acid
  Variant (19)..(19): Xaa in position 19 is Asp or Asn
  Variant (20)..(20): Xaa in position 20 is Phe or Trp
  Variant (21)..(21): Xaa in position 21 is Ile or Val
  Variant (22)..(22): Xaa in position 22 is Glu or Ser
  Variant (23)..(23): Xaa in position 23 is Ile or Val
  Variant (24)..(24): Xaa in position 24 is His or Tyr
  Variant (26)..(26): Xaa in position 26 is any amino acid
  Variant (27)..(27): Xaa in position 27 is Ser or Thr
  Variant (28)..(28): Xaa in position 28 is any amino acid
  Variant (29)..(30): Xaa in position 29 to 30 is Ser or Thr
  Variant (31)..(31): Xaa in position 31 is Ile, Leu or Met
  Variant (35)..(35): Xaa in position 35 is Ala, Cys or Thr
  Variant (38)..(38): Xaa in position 38 is any amino acid
  Variant (39)..(39): Xaa in position 39 is Phe or Leu
  Variant (43)..(43): Xaa in position 43 is Ile, Leu or Val
  Variant (45)..(45): Xaa in position 45 is Ala or Gly
  Variant (46)..(46): Xaa in position 46 is any amino acid
  Variant (47)..(47): Xaa in position 47 is Ser or Thr
  Variant (48)..(48): Xaa in position 48 is any amino acid
  Variant (51)..(51): Xaa in position 51 is any amino acid
  Variant (52)..(52): Xaa in position 52 is Asp, Ser or Thr
  Variant (55)..(55): Xaa in position 55 is Asp, Glu, Gln or Ser
  Variant (56)..(56): Xaa in position 56 is any amino acid
  Variant (57)..(57): Xaa in position 57 is Gly or Val
AXQSXQXAPXDIWYXPDYXXXXXXNXXXXXXNTYXGGXXQQAXSXXXXLNXXWYXXX

SEQ ID NO: 5594 - protein, 29 aa, Artificial sequence
  protein pattern
  Variant (3)..(3): Xaa in position 3 is Ile or Val
  Variant (4)..(4): Xaa in position 4 is Asp or Gly
  Variant (5)..(5): Xaa in position 5 is any amino acid
  Variant (7)..(7): Xaa in position 7 is any amino acid
  Variant (8)..(8): Xaa in position 8 is Ile, Leu, Met or Val
  Variant (10)..(10): Xaa in position 10 is Lys or Arg
  Variant (15)..(15): Xaa in position 15 is any amino acid
  Variant (16)..(16): Xaa in position 16 is Ile or Val
  Variant (17)..(17): Xaa in position 17 is Leu or Met
  Variant (19)..(19): Xaa in position 19 is Phe or Leu
  Variant (21)..(21): Xaa in position 21 is Ile, Leu or Val
  Variant (24)..(24): Xaa in position 24 is Asn or Ser
  Variant (26)..(26): Xaa in position 26 is Ala or Thr
  Variant (27)..(27): Xaa in position 27 is any amino acid
GNXXXRXXSXEPMSXXXNXGXSNXWXXID

SEQ ID NO: 5595 - protein, 59 aa, Artificial sequence
  protein pattern
  Variant (3)..(4): Xaa in position 3 to 4 is any amino acid
  Variant (5)..(5): Xaa in position 5 is Phe, Leu or Met
  Variant (6)..(6): Xaa in position 6 is Asn, Arg or Ser
  Variant (7)..(7): Xaa in position 7 is Ile or Val
  Variant (9)..(9): Xaa in position 9 is His or Tyr
  Variant (12)..(12): Xaa in position 12 is Ile, Leu or Val
  Variant (16)..(16): Xaa in position 16 is any amino acid
  Variant (17)..(17): Xaa in position 17 is Asp, Gly or Asn
  Variant (18)..(18): Xaa in position 18 is Ala, Gln or Ser
  Variant (19)..(19): Xaa in position 19 is any amino acid
  Variant (20)..(20): Xaa in position 20 is Asn or Ser
  Variant (21)..(21): Xaa in position 21 is Ile, Leu or Val
  Variant (22)..(22): Xaa in position 22 is Gly, Ser or Thr
  Variant (26)..(26): Xaa in position 26 is any amino acid
  Variant (27)..(27): Xaa in position 27 is Asp or Gly
  Variant (28)..(28): Xaa in position 28 is Phe, His or Tyr
  Variant (31)..(32): Xaa in position 31 to 32 is any or no amino acid
  Variant (34)..(35): Xaa in position 34 to 35 is any or no amino acid
  Variant (37)..(38): Xaa in position 37 to 38 is any amino acid
  Variant (40)..(41): Xaa in position 40 to 41 is any amino acid
  Variant (42)..(42): Xaa in position 42 is Ala, Leu or Val
  Variant (44)..(44): Xaa in position 44 is any amino acid
  Variant (45)..(45): Xaa in position 45 is Asp or Asn
  Variant (46)..(46): Xaa in position 46 is Ala, Asn, Thr or Val
  Variant (48)..(48): Xaa in position 48 is Ile, Leu or Val
  Variant (50)..(50): Xaa in position 50 is any amino acid
  Variant (51)..(51): Xaa in position 51 is Phe or Trp
  Variant (52)..(53): Xaa in position 52 to 53 is any amino acid
  Variant (54)..(54): Xaa in position 54 is Ala, Gly or Thr
  Variant (55)..(55): Xaa in position 55 is any amino acid
  Variant (57)..(58): Xaa in position 57 to 58 is any amino acid
FPXXXXXDXVRXYQPXXXXXXXCDPXXXPTXXYXXIXXHXXXYXXXNXTXXXXXXYXXP

SEQ ID NO: 5596 - protein, 30 aa, Artificial sequence
  protein pattern
  Variant (10)..(10): Xaa in position 10 is any amino acid
  Variant (11)..(11): Xaa in position 11 is any or no amino acid
  Variant (13)..(13): Xaa in position 13 is any or no amino acid
  Variant (17)..(17): Xaa in position 17 is any amino acid
  Variant (18)..(18): Xaa in position 18 is Ile, Leu or Met
  Variant (19)..(19): Xaa in position 19 is Asp or Glu
  Variant (23)..(23): Xaa in position 23 is Asp, Glu, Pro or Gln
  Variant (26)..(26): Xaa in position 26 is Phe or Tyr
  Variant (27)..(27): Xaa in position 27 is Ile or Leu
DFSPFGGYPXXSXFPLXXXEKEXDDXXHNP

SEQ ID NO: 5597 - protein, 32 aa, Artificial sequence
  protein pattern
  Variant (2)..(3): Xaa in position 2 to 3 is any amino acid
  Variant (5)..(5): Xaa in position 5 is Ile or Leu
  Variant (6)..(6): Xaa in position 6 is Ala, Ile or Leu
  Variant (8)..(9): Xaa in position 8 to 9 is any amino acid
  Variant (10)..(11): Xaa in position 10 to 11 is any or no amino acid
  Variant (13)..(18): Xaa in position 13 to 18 is any amino acid
  Variant (19)..(20): Xaa in position 19 to 20 is any or no amino acid
  Variant (22)..(22): Xaa in position 22 is Ile or Val
  Variant (23)..(23): Xaa in position 23 is Ile, Leu or Val
  Variant (24)..(24): Xaa in position 24 is Leu or Val
  Variant (26)..(26): Xaa in position 26 is Ala, Ile or Val
  Variant (27)..(27): Xaa in position 27 is Ile, Leu or Val
  Variant (29)..(29): Xaa in position 29 is Phe or Tyr
  Variant (30)..(30): Xaa in position 30 is Ser or Thr
  Variant (32)..(32): Xaa in position 32 is Ala, Ile or Val
SXXGXXGXXXXFXXXXXXXXFXXXPXXTXXGX

SEQ ID NO: 5598 - protein, 9 aa, Artificial sequence
  protein pattern
  Variant (2)..(2): Xaa in position 2 is Asp, Glu or Gln
  Variant (4)..(4): Xaa in position 4 is Ile, Leu or Val
  Variant (8)..(8): Xaa in position 8 is Gly, Ser or Thr
TXGXWPYXY

SEQ ID NO: 5599 - protein, 12 aa, Artificial sequence
  protein pattern
  Variant (3)..(3): Xaa in position 3 is any amino acid
  Variant (4)..(4): Xaa in position 4 is Asp, Glu or Asn
  Variant (5)..(5): Xaa in position 5 is any amino acid
  Variant (8)..(8): Xaa in position 8 is Ile or Leu
  Variant (9)..(9): Xaa in position 9 is any amino acid
  Variant (11)..(11): Xaa in position 11 is Phe, His or Tyr
NDXXXGYXXWXV

SEQ ID NO: 5600 - protein, 14 aa, Artificial sequence
  protein pattern
  Variant (2)..(2): Xaa in position 2 is Ser or Thr
  Variant (3)..(3): Xaa in position 3 is any amino acid
  Variant (5)..(5): Xaa in position 5 is any amino acid
  Variant (8)..(8): Xaa in position 8 is any or no amino acid
  Variant (10)..(10): Xaa in position 10 is any amino acid
  Variant (11)..(11): Xaa in position 11 is any or no amino acid
LXXYXYPXLXXAIR

SEQ ID NO: 5601 - protein, 11 aa, Artificial sequence
  protein pattern
  Variant (4)..(4): Xaa in position 4 is Ala, Ser, Thr or Val
  Variant (7)..(7): Xaa in position 7 is any amino acid
  Variant (8)..(8): Xaa in position 8 is Asp or Asn
  Variant (10)..(10): Xaa in position 10 is Thr or Val
PDAXTTXXGXL

SEQ ID NO: 5602 - DNA, 1038 bp, Saccharomyces cerevisiae
  CDS (1)..(1038)
atgagttacggcttaacaggtacctcttctaagctaagaggaactagttcaatattttcatggactcaggtgaggcacttttctcgtagaagaatagcctatccattttatccattcaagaaattgggaagacaacacccgaagaagcatgatacaaacttaaagactgctatgagacagtttttaggtccaaaaaattacaaaggagaatatgtcatgaacaagtattttacggttccgacgaatcatgtacctaactacattaagccagatttggaaaggggacaaagtttagaacacccggtaaccaagaagccattgcaactaaggtatgatgggacattaggtcctcctcctgtagaaaataaaaggttacaaaacattttcaaggatagattgttgcaacctttcccttcaaatccacattgtaagacgaattacgtattaagcccgcaattgaagcaaagcattttcgaagagattactgtggaaggactttctgcccaacaagtttctcaaaagtatggattaaaaattcctcgtgtagaggctattgttaaactggttagcgtggaaaacagctggaacagacggaatagagtatcttctgatttgaaaactatggacgagactttatatagaatgtttcccgtcttcgactcagatgcctcttttaaacgggagaatttaagcgaaattcctgttccgcaaaagactttggcgtcaagattcctcaccattgcagagtcagaaccttttgggcctgttgatgcagcccatgttttagaattagagcctgctgtagagaccttaaggaatttgtctactgtgggggaacattctagtggccatcaacaatccactaataagaatacgaaggttatatatggtgagcttgtcgaaggtgaaagatcacaatataaatttactaacgcaaaggttggaaaagtgggataccgttacggtagcggaaatagggataacaagaaagacagaagaattggctttaataaactgggccaaatggtatatatataa

SEQ ID NO: 5603 - protein, 345 aa, Saccharomyces cerevisiae
MSYGLTGTSSKLRGTSSIFSWTQVRHFSRRRIAYPFYPFKKLGRQHPKKHDTNLKTAMRQFLGPKNYKGEYVMNKYFTVPTNHVPNYIKPDLERGQSLEHPVTKKPLQLRYDGTLGPPPVENKRLQNIFKDRLLQPFPSNPHCKTNYVLSPQLKQSIFEEITVEGLSAQQVSQKYGLKIPRVEAIVKLVSVENSWNRRNRVSSDLKTMDETLYRMFPVFDSDASFKRENLSEIPVPQKTLASRFLTIAESEPFGPVDAAHVLELEPAVETLRNLSTVGEHSSGHQQSTNKNTKVIYGELVEGERSQYKFTNAKVGKVGYRYGSGNRDNKKDRRIGFNKLGQMVYI

SEQ ID NO: 5604 - DNA, 1035 bp, Candida glabrata CBS 138
  CDS (1)..(1035)
atgtttcgcccggccgccagtggtaagagcagttcgctcctgcaaggaaacatatgctgctatcagcaggtcaggaacctttcgagaaggagactagcgtatccgttctatcctttcaagagattggggaggcagcatccaaagaaacatgacaccaatctgaagtatgccatgagacaatttcttggcccaaagaactacaagggtgagtatgtcatgaacacttattttgcagtacctaacaaccatgtgcctaactatatcaaaccggacatcgaaagagggcaggctctgagggatccaaacacaggtaaaagactaactgaacgttatgatggtgctttggttgacgctccacataacaagagactcgaagatgtttctgagagaagacagctacaaccgttcccttcaaatccacactgcaagaccaactacatggtgagtgaggaacttaaggctcagatatacaacgacatagagactaatggtctttctacccaacaggtttctcataactacggtttgaagattccccgcgtagaggcaattgtgaagttgatgaaagttgaaaagaagtgggagaaactcaacagaatatccccagatttaaaggttatgtctgagacactgtataagatgtttccattgtttgtcccagaagttccagctaacagagaaaacctatcagaaattccggtcccacagaaggccctatcttctagattcttaaccatcgctgagtcacaaccatttggtccagtagatgctgccaaagtgttagagttagagcctgctgtaaaaacattggaaaagttgtctaccattggtgaacacagtgagggccacatagagaagaaagaacacaagaagaaggtagtttacggtgaattgaaggagggcgaaagatccgtgctaaagtttacacacgccaaagtaggtgaagtgggacaccgttacggtcgtgtgcttcgcgacaacaagaaggacagaaagattggatttaatgaacttggtcaaatggtttacatatga

SEQ ID NO: 5605 - protein, 344 aa, Candida glabrata CBS 138
MFRPAASGKSSSLLQGNICCYQQVRNLSRRRLAYPFYPFKRLGRQHPKKHDTNLKYAMRQFLGPKNYKGEYVMNTYFAVPNNHVPNYIKPDIERGQALRDPNTGKRLTERYDGALVDAPHNKRLEDVSERRQLQPFPSNPHCKTNYMVSEELKAQIYNDIETNGLSTQQVSHNYGLKIPRVEAIVKLMKVEKKWEKLNRISPDLKVMSETLYKMFPLFVPEVPANRENLSEIPVPQKALSSRFLTIAESQPFGPVDAAKVLELEPAVKTLEKLSTIGEHSEGHIEKKEHKKKVVYGELKEGERSVLKFTHAKVGEVGHRYGRVLRDNKKDRKIGFNELGQMVYI

SEQ ID NO: 5606 - DNA, 24 bp, Artificial sequence
  primer
atgagttacggcttaacaggtacc

SEQ ID NO: 5607 - DNA, 26 bp, Artificial sequence
  primer
ttatatatataccatttggcccagtt

SEQ ID NO: 5608 - DNA, 3417 bp, Saccharomyces cerevisiae
  CDS (1)..(3417)
atgaggattattaagggcagaaagcgaggcaagaacaagaagccaacgctaattttaaaaattcatgtcattcaagctgaaaatattgaagccttgaagacattcaattgtaacccggtatgttttgttaccactaatacattttatagtcaaaagacgaacaagctcaagaactcaaatacacactggaatcaaaccttgaggatcaaacttccgagaaatccaacatctgaatggttaaggattatagtatacgacgccctaccaaccggagctccccctactacccccagtagaccaaggacaaccactgcaaatacatcttcatcgacactgtcaaattcagggctaagttctcactctcattcgtcgagaaatttgaatgttacgtccaaaggtaatcaaacttcaacatcaattaattcagtatcatcttcagctacaccggccccttcacattcttcctcttctctctcaacaacaggtcccgggtccacacacaaaaataggattaatagctatctatatttgggtgaagcaaaaatttcattactggatttattcaagaggaaggacaccacgacgagctataaattttcaattgaagctcagcggtaccatctatacgatatgaaaggagggaaagaccaagattccttgaactgcaactttctagtgggcgatattttgcttggatttaagctagaatgtaacgttaaaagaaccccgacttttcaggctttcaatgcttggagaaatgagttgaacacttacttgggcagaatagatagaaataaggcccgcatgagatcttctagttctttgccacctccactagaagatatgttgagcaatagttcagctgttagtggaaatgaaatacgacgcgagaaaccatatagcgatactgatctagcccacgatgaagaggtcaatgccgaggatgaaatagatgctgaggaatctattgaagatatgaatagcagcggcagcatttgtacggagaggaggtacgatatagacaatgatactatattcgactctatatctgaggttgtttcgctaaatgatgaagaactagatattctaaatgattttgaagaagcagatcatccaaatgtgccagacataaatgtgcatgacatcgacgaagatacccgtatcagtctatcttcaatgataacagctttagatgaatatgatatcgtagaaccagaagatgttgcaaaattacctgcagtgtcggaaaatgacataacatcagtggatgacgaagaatctgaaaaccaacaggaaagtgatgaggagtttgatatatataatgaggatgagcgtgaagattctgattttcaatcaaaagaatacattgggagtcggcttttacacctgcaaaggggtaaacataataaatcatatgcaaattacttatacagaagagcaaaaagtaacttttttatatcgaaaaaggaacatgcgatgggggtagtatttatgcatattggggctatcaaaaatttacctgcattaaggaatcggttgtccaagactaattatgaaatggatccatttatcgttatttcgtttggtagaagagtattcaagacatcttggagaaaacatactttaaacccagaatttaatgaatatgccgctttcgaagtttttccccatgaaacgaattttgctttcagtatcaaagttgttgataaagactcattttcattcaatgatgacgttgcaaaatgcgaactggcttggtttgatatgctgcaacagcaacaacatgaaaacgaatggataccttatgagataccattggatctcactgttgagccagcacatgctcctaagcaaccggtattatattcgagcttcaaatatgtttcatatccgttcttaaaaaagagcttttggaaagaagctgttgacacatcagtcaacttagagagactcgacattattcaagtaatgctctatcttgaacgtcttggttcattcacgatggccgattcttttgaactctttcagcatttcaataaatctgcttgggccggccagagcattactagatcacaattagttgaagggctacagtcatggagaaaatccactaattttaaacgcatctggacatgtcctagatgcatgcgttcatgcaaaccaactagaaatgctagacgttctaaactggttctagaaaatgacttgataacccattttgccatatgtacgttttcaaaagaacacaaaactttaaagccgtcgtacgtctcatctgcatttgcatccaagagatggttctctaaggttttgataaaattaacttatggtaaatatgctttgggatctaacaatgcaaacatcttggttcaagaccgagacacagggataattattgaggaaaaaataagcgcacacgtaaagttgggaatgaggattatatacaatggtaaaagtcccgagtctaaaaaatttagatccctcttgaagactttatcaatcaggcaaggcaaaaaatttgacagcactgcatctgccaaacaaattgaacctttcataaagtttcactcgctagacctttcacaatgccgagataaagattttaaaacattcaatgaatttttttacaggaaactaaaaccaggaagccggctgcctgaaagtaataataaagaaatattgttttcaccagcagattcaagatgcacagtgttcccaactatacaagaatcgaaggaaatatgggtgaaaggaagaaaattttctattaagaaactagccaataactataatccggaaacatttaatgacaataactgcagtattggtatatttagactggcgccacaagattatcaccggtttcactcaccatgtaatggtacgattggaaaacctgtatatgtggatggagagtattatactgtaaatccaatggccgttcgtagtgagttagacgtctttggtgaaaatatcagagttattatccccatcgattctcctcaatttggcaaactactgtacatacctattggtgcaatgatggttggatccatactattgacctgcaaagaaaacgatgtagttgagagtggacaggagctgggctattttaaatttggaggttctactataataatcattatcccgcacaacaacttcatgtttgattccgaccttgtgaaaaactcttcagaacgcattgaaacgttagtcaaagtcgggatgagtataggacacacatcaaatgtgaatgaattgaagagaatccgtattaaagtagacgacccaaagaaaattgaacggatcaagagaacaattagtgttagcgatgaaaatgccaagagtacaggaaatgtaacatgggaatatcatactttacgggaaatgatgaataaagattttgctgggctatga

SEQ ID NO: 5609 - protein, 1138 aa, Saccharomyces cerevisiae
MRIIKGRKRGKNKKPTLILKIHVIQAENIEALKTFNCNPVCFVTTNTFYSQKTNKLKNSNTHWNQTLRIKLPRNPTSEWLRIIVYDALPTGAPPTTPSRPRTTTANTSSSTLSNSGLSSHSHSSRNLNVTSKGNQTSTSINSVSSSATPAPSHSSSSLSTTGPGSTHKNRINSYLYLGEAKISLLDLFKRKDTTTSYKFSIEAQRYHLYDMKGGKDQDSLNCNFLVGDILLGFKLECNVKRTPTFQAFNAWRNELNTYLGRIDRNKARMRSSSSLPPPLEDMLSNSSAVSGNEIRREKPYSDTDLAHDEEVNAEDEIDAEESIEDMNSSGSICTERRYDIDNDTIFDSISEVVSLNDEELDILNDFEEADHPNVPDINVHDIDEDTRISLSSMITALDEYDIVEPEDVAKLPAVSENDITSVDDEESENQQESDEEFDIYNEDEREDSDFQSKEYIGSRLLHLQRGKHNKSYANYLYRRAKSNFFISKKEHAMGVVFMHIGAIKNLPALRNRLSKTNYEMDPFIVISFGRRVFKTSWRKHTLNPEFNEYAAFEVFPHETNFAFSIKVVDKDSFSFNDDVAKCELAWFDMLQQQQHENEWIPYEIPLDLTVEPAHAPKQPVLYSSFKYVSYPFLKKSFWKEAVDTSVNLERLDIIQVMLYLERLGSFTMADSFELFQHFNKSAWAGQSITRSQLVEGLQSWRKSTNFKRIWTCPRCMRSCKPTRNARRSKLVLENDLITHFAICTFSKEHKTLKPSYVSSAFASKRWFSKVLIKLTYGKYALGSNNANILVQDRDTGIIIEEKISAHVKLGMRIIYNGKSPESKKFRSLLKTLSIRQGKKFDSTASAKQIEPFIKFHSLDLSQCRDKDFKTFNEFFYRKLKPGSRLPESNNKEILFSPADSRCTVFPTIQESKEIWVKGRKFSIKKLANNYNPETFNDNNCSIGIFRLAPQDYHRFHSPCNGTIGKPVYVDGEYYTVNPMAVRSELDVFGENIRVIIPIDSPQFGKLLYIPIGAMMVGSILLTCKENDVVESGQELGYFKFGGSTIIIIIPHNNFMFDSDLVKNSSERIETLVKVGMSIGHTSNVNELKRIRIKVDDPKKIERIKRTISVSDENAKSTGNVTWEYHTLREMMNKDFAGL

SEQ ID NO: 5610 - DNA, 3702 bp, Candida glabrata CBS 138
  CDS (1)..(3702)
atgggtattgggaagaggaagaggagaggtgagaaggaggaccggatgcgtaatgggttgttcttggaggtccaccttgttggcactaagaagatagagcttttccagcgattccagtgttgtcccacctgttttgtgaccactaatacattttttgtgaaaaggtcatcgcggctgaagaattccaataccaggtggaaccagatagtaaagttgaagctgccggccaggccagtgtcgccgtatgtagacttggttgtttacgattgcatttcttctaaacattctcacggagtgaatgatgaaagtgatttgaatagtggttccgaggtggaaaataagagaaagagaggttactcttcgagttctgcgctgacgccatactcaagaacaaacctcagtgttagcggtgaaagcatttctgatgcatcgatatatggaaactcaacagcggaaggaaccaggtcgaacgtaacgtccaaaaacttgccatacttgacaattgacaataacaaaagctctacaacagcacatagacattctagatctttcggaaatttgagtctacagagacttagtatcccaagtccaagtgtgagttcttctcccagtggttatagtccatcagggcaaaagcgaaatttcacgtctgatagtaataatcaaggtagcttgggcacaaggaataagtcttcctatctctacgttggtgaaactagagtttctctgactgacatattcaaagtaaaagatacagctactggatacaatttctttcaacctccgcaatggttcccgctttatgataagaaaagacaaaaatcagatgattttggtaaagaacaaatcattggagagatccaagtgggatttcggttgaagtgtaataacagaagccattcaattgtacaggaatttaacgaatggaacaaatacctgcatgagaataagaaaagtaaccttgatttaagaaatgtttacagttcatcagcttatctggatgatgaaaacgaagatcttttatcaatgaaggaccccgatgctagagacttgtgtgacgagtttatcgaagaaaacattaaccttgatgaagagcaagtggtcatggatgaagatgatgatgatgaacttgaagatgatgtattggctatacccaatgaattgattgaaccacttggtcttttgcatctaagttctaataactctgatgattcaacaagccccgatgcatctggcaaaaatgatagtgatccaagtaacgatgcatttgatgaattagaaaacggttatgaagatgacgttgaatcattttcagatgaactaaaagatatcgactattttccagatgagccattaatatctgaaaatttggaaaattcaagtatcttgactataccgacaatggtgacagctctagatgaatacgaagttgtcctgcccagtagtgatgaagttatgaccttggatgatgtcatagcatctagaaacagctcaccggacacgcctacagatggtttatccaggattaagagcggaagtccacatatcagatctactggttcttttaaggatgatagaaatgaagaatctgaaaatagttcagatctgaacagtacaattttgaaaatgaacagaaagaaattatttccaatgctgaaaaggaagagaacaagagctaactactcttcgttctctaactattatgagacactgctaagtagaaaatttcagctctcaaagagagaacatgcacttggtgtaatgtttgtgcattttgagtccatagaaggtttgccagaattaaagaataagatatctaaaacatactacgcaatggatccatttattattatgacatttggtcggagagtgtttaaaacttcgtggagaaagcacacgttaaaccctgtgtttgatgaacgcgctgctttcgaaatttatccaaacgaaaagcattacgatatacatctaagtgttatggacaaagattctttttcatataatgatatgatagctaagtatgaattaacactgcaagaagtaatgcagaaacaaactccagatcatgattggaaggttattgaaattcctctaaaattgacattacgagattctgaaaattttgattctccagttttaagattaggaattagatatgtaccctattcgcatttgaagagttatttctggaaaagggctgtatctctttctacagatagagagacttttgacctcgttcaaaccctgttatttttgcaaagattaggctctttttccgagtttgatgtcttggagtttttttcttattacaaaaaattgccctggagtggagaaacattaacacaggatgaactagtgaatgggcttcaacaatggacaaaatcaggagattttaaaaatatctggaagtgtccatcctgttttagatcatttcgcccttctaataatgatatgaattcaaaattaatactggaaaatgatttgataacccattttgctctttgtagtttcaaaaaatgtggaaaagttctaaagccatcatatgtttcatctcaatttgcttccaaaaggtggttcagtaagttattgattaagctaacttatggtaagtatgcagttgggtcaaataatgccaatattttagtacaggacagagatactggtattgttttggaagaaaagataagtgcacatgtaaaggtgggtatgagaataatatataatgggaaaggtaaagaatcaaaaaagtttaaaacgctattgaaaacgctatccgtgagacaaggcaaaaaatttgataatcccttatccgctaaacaaattgactccttcattaaatttcatgacttggatatgagtcagtgtgaacctacagaatatcgtacctttaatgaatttttttaccggaagctaaaaccagggagtaggccacctgaaggtgatacttctgaggtgatggtttcggcagcagattctagatgtactgtttattctactattcaaaaatctaaagaaatctggatcaaaggaagtaagttcagcttgaatagattaacaggtggttatcgtccagaaatctttaacgattcttcatgcagcatagcaatttttagattggcaccgcaagactatcataggatacattgtcctgtagatggtgtggttggaaagcctatatttattaaaggagaatattacacagttaatccaatggctgtcagaagtgaattagacgtctttggtgaaaatgtaagagttattgtaccaatagaaactaaggagtttggtcctttattatatattgcagtcggtgctatgatggtcgggtcaataattttaacgtgtcaagaaggtgattttaagagacgaggtgacgaaatgggctatttcaagtttggaggctcgacagtaatattggttatgcaatcgaagaagttaatatttgattctgatctagttagcaactctttagagggcatagaaactttggttaaagttgggatgagcattggacatactcctaatattaaagaaataaaaagaagaaaagtgaaacccacggatgaaaagcaaatagaaaaaattaagagaagtatatcagtagccgaacataaagctgaaaatgctggcaatattccctggcagatgcagcttctcgagaaagatatcagagaaggtaatttatggggaaccgacacttga

SEQ ID NO: 5611 - protein, 1233 aa, Candida glabrata CBS 138
MGIGKRKRRGEKEDRMRNGLFLEVHLVGTKKIELFQRFQCCPTCFVTTNTFFVKRSSRLKNSNTRWNQIVKLKLPARPVSPYVDLVVYDCISSKHSHGVNDESDLNSGSEVENKRKRGYSSSSALTPYSRTNLSVSGESISDASIYGNSTAEGTRSNVTSKNLPYLTIDNNKSSTTAHRHSRSFGNLSLQRLSIPSPSVSSSPSGYSPSGQKRNFTSDSNNQGSLGTRNKSSYLYVGETRVSLTDIFKVKDTATGYNFFQPPQWFPLYDKKRQKSDDFGKEQIIGEIQVGFRLKCNNRSHSIVQEFNEWNKYLHENKKSNLDLRNVYSSSAYLDDENEDLLSMKDPDARDLCDEFIEENINLDEEQVVMDEDDDDELEDDVLAIPNELIEPLGLLHLSSNNSDDSTSPDASGKNDSDPSNDAFDELENGYEDDVESFSDELKDIDYFPDEPLISENLENSSILTIPTMVTALDEYEVVLPSSDEVMTLDDVIASRNSSPDTPTDGLSRIKSGSPHIRSTGSFKDDRNEESENSSDLNSTILKMNRKKLFPMLKRKRTRANYSSFSNYYETLLSRKFQLSKREHALGVMFVHFESIEGLPELKNKISKTYYAMDPFIIMTFGRRVFKTSWRKHTLNPVFDERAAFEIYPNEKHYDIHLSVMDKDSFSYNDMIAKYELTLQEVMQKQTPDHDWKVIEIPLKLTLRDSENFDSPVLRLGIRYVPYSHLKSYFWKRAVSLSTDRETFDLVQTLLFLQRLGSFSEFDVLEFFSYYKKLPWSGETLTQDELVNGLQQWTKSGDFKNIWKCPSCFRSFRPSNNDMNSKLILENDLITHFALCSFKKCGKVLKPSYVSSQFASKRWFSKLLIKLTYGKYAVGSNNANILVQDRDTGIVLEEKISAHVKVGMRIIYNGKGKESKKFKTLLKTLSVRQGKKFDNPLSAKQIDSFIKFHDLDMSQCEPTEYRTFNEFFYRKLKPGSRPPEGDTSEVMVSAADSRCTVYSTIQKSKEIWIKGSKFSLNRLTGGYRPEIFNDSSCSIAIFRLAPQDYHRIHCPVDGVVGKPIFIKGEYYTVNPMAVRSELDVFGENVRVIVPIETKEFGPLLYIAVGAMMVGSIILTCQEGDFKRRGDEMGYFKFGGSTVILVMQSKKLIFDSDLVSNSLEGIETLVKVGMSIGHTPNIKEIKRRKVKPTDEKQIEKIKRSISVAEHKAENAGNIPWQMQLLEKDIREGNLWGTDT

SEQ ID NO: 5612 - DNA, 25 bp, Artificial sequence
  primer
atgaggattattaagggcagaaagc

SEQ ID NO: 5613 - DNA, 25 bp, Artificial sequence
  primer
tcatagcccagcaaaatctttattc

SEQ ID NO: 5614 - DNA, 1275 bp, Saccharomyces cerevisiae
  CDS (1)..(1275)
atggcaaacccaacaacagggaagtcctcgattagggctaagctttctaactcatcgctatcaaacctatttaaaaaaaataaaaataaaagacagcgtgaggaaacggaagagcaggacaatgaggataaggatgagagtaagaaccaggatgaaaataaggacacacagctcactccccgcaagcgtcgccggttgacgaaggagtttgaagagaaggaggctcgttacaccaacgagttgcccaaggaactgcgcaagtatcgtcctaaaggtttcagattcaatttgcctccaacggatagacccatcaggatatatgcagatggtgtttttgatcttttccatcttggccacatgaagcaactggaacagtgtaagaaggctttccccaatgtaacactgatagttggtgtgcctagcgacaaaatcactcacaaactaaaaggtttgactgtgctgaccgataagcagcgttgtgaaactttaacgcactgcagatgggttgacgaagtcgtgcccaacgctccctggtgtgtcaccccagaatttctactagaacacaagattgactacgtggcacatgacgatattccttacgttagcgccgacagcgacgatatctacaagccaataaaggagatgggaaaattcttgactacccaaagaaccaatggtgtctctacaagtgatattatcacaaagatcatcagagattatgacaaatatttgatgagaaactttgcaaggggtgctaccagacaggagctgaacgtttcttggttgaagaaaaacgaactggagttcaaaaaacacatcaatgaattcaggtcatatttcaagaaaaaccagacaaatttgaataacgcctccagagacttgtacttcgaagtccgtgaaatcttgctaaagaaaacgttgggcaaaaaactctactccaagttaataggcaatgaattaaagaaacaaaatcaacgacaaagaaaacagaattttttggatgatccgtttactaggaagctaatcagggaggcctctccggctacagagtttgccaacgaatttacgggcgaaaactctaccgctaaatcaccggatgacaatggaaatcttttcagtcaggaagatgatgaagacacaaattctaacaacacgaatacaaattcagattcagattcaaacactaactcaacgcctcccagtgaagatgacgacgacaacgacaggttaactttggaaaacctaacacagaagaagaaacaatcagcgaactga

SEQ ID NO: 5615 - protein, 424 aa, Saccharomyces cerevisiae
MANPTTGKSSIRAKLSNSSLSNLFKKNKNKRQREETEEQDNEDKDESKNQDENKDTQLTPRKRRRLTKEFEEKEARYTNELPKELRKYRPKGFRFNLPPTDRPIRIYADGVFDLFHLGHMKQLEQCKKAFPNVTLIVGVPSDKITHKLKGLTVLTDKQRCETLTHCRWVDEVVPNAPWCVTPEFLLEHKIDYVAHDDIPYVSADSDDIYKPIKEMGKFLTTQRTNGVSTSDIITKIIRDYDKYLMRNFARGATRQELNVSWLKKNELEFKKHINEFRSYFKKNQTNLNNASRDLYFEVREILLKKTLGKKLYSKLIGNELKKQNQRQRKQNFLDDPFTRKLIREASPATEFANEFTGENSTAKSPDDNGNLFSQEDDEDTNSNNTNTNSDSDSNTNSTPPSEDDDDNDRLTLENLTQKKKQSAN

SEQ ID NO: 5616 - DNA, 1206 bp, Ashbya gossypii
  CDS (1)..(1206)
atggggcctgtgacgcgccagggctcgttgaaacagcggctagccaactcgtcgctcacaaatttgttcaacctgaaccgcaagcggcggcatggggagctggaagacggggaggacggcgttgtcggggtgcggcggtcgcggcgggccagcgtgcgcagctgcaacggggagctggcggaggggtcggagtcggacgaggagcgccggcacagccgtaagcggcggcacacagagcgagaggagcaggagcggcggtacgatgaggcgatcccggaggaattccggaagttccggccgcgcgggtttccgttcaacctcccgccgcaggaccgcgcggtgcgggtgtatgcagacggggtgtttgaccttttccacctcgggcacatgaagcagttggagcagtgcaagaagtcctttgagaacgtaacgctcatctgcggcgtgcccagcgaccgcatcacgcacaagctcaagggcttgaccgtgctcacggacaagcagcgctgcgagtccttgcgccactgccggtgggtcgacgaggtcgttgaggacgccccgtggtgtgtgactcccgagttcctcgaactgcacaaaatcgactatgtagcacacgatgacatcccctacacgagcggcgatagcgatgacatctaccgccccatcaagcagatgggcaagttcttggccacccagcgcaccaacggcatttcgacgagcgacatcataaccaagatcatccgcgactatgacaagtacttgatgcgcaacttcgcgcgcggtgcgtcgcgccaggagttaaacgtctcctggctcaagaagaacgagttggagtttaagaaacacatacaggatttccgctcttacttccgcaaaaaccaggagaagctcaatgacgcgtccaaggacctttacttcgaggtgcgcgaaatgcttttgaagaagacgctagggcgcaacctgtactccaagcttgttggccccgcgggcccgcccgaaaagcgcggcaagctgcaggaggcttctcccgcaactcaattcgcacacatatacacgggcgaggcccctgcgattgccggccaggcgatgctaccctccagcgagagtgacgatgaaaatatcaaccgcgcgggctcggtgctgtcccacctgaaccggtggctctcgcaggagacaccccactatacgacagaggagagcgaataa

SEQ ID NO: 5617 - protein, 401 aa, Ashbya gossypii
MGPVTRQGSLKQRLANSSLTNLFNLNRKRRHGELEDGEDGVVGVRRSRRASVRSCNGELAEGSESDEERRHSRKRRHTEREEQERRYDEAIPEEFRKFRPRGFPFNLPPQDRAVRVYADGVFDLFHLGHMKQLEQCKKSFENVTLICGVPSDRITHKLKGLTVLTDKQRCESLRHCRWVDEVVEDAPWCVTPEFLELHKIDYVAHDDIPYTSGDSDDIYRPIKQMGKFLATQRTNGISTSDIITKIIRDYDKYLMRNFARGASRQELNVSWLKKNELEFKKHIQDFRSYFRKNQEKLNDASKDLYFEVREMLLKKTLGRNLYSKLVGPAGPPEKRGKLQEASPATQFAHIYTGEAPAIAGQAMLPSSESDDENINRAGSVLSHLNRWLSQETPHYTTEESE

SEQ ID NO: 5618 - DNA, 948 bp, Oryza sativa (japonica cultivar-group)
  CDS (1)..(948)
atggccgaccacgctgcggcggaggcggcgccgcagtcgtcgcaggaggaggaggaggactggaaggaggccgaggggggagacggggacgtcgaggtggcggacaggggcggcggaggcggcgccgccaatgggggaatcccggaggggaggccgatccgggtctacgcggacggaatctacgatctcttccacttcggccacgccaagtcgctcgagcaggccaagaggctgtttcctaacacatatctccttgtcggatgctgcaatgatgagttgacacataagtacaaagggagaactgttatgacagaggatgagcgatatgaatcacttcgtcactgcaagtgggtggatgaagtcattcctgatgctccatgggtggtaacggaagaattcttgaataaacataacattgattttgttgcacatgattctctgccgtatgctgatgctagtggagctggtaacgatgtctatgaatttgtcaaaaaacttggtaaatttaaggaaacccagcgcacagatgggatatcgacgtcagatattataatgcggattgttaaggattataatgagtatgttatgcggaacctggccagggggtacaccagaaaggatcttggtgtcagttacgttaaggaaaaaagactgagagttaacatgggattaaaaaacctgcgtgacaaagtgaagcagcaccaagaaaaagtaggggagaagtggaatacaatggcgaaactccaggaagagtgggtggaaaatgcagatcgatgggttgctggttttctggagaagtttgaagaaggctgccactcaatgggaactgccatcaaagagcggatccaagagaggctcaaggcgcaatccagggatttcagccttctacagtatgatggcgaggatgttgacgaggatgaggacgacgacgaatatgtcagagaataa

SEQ ID NO: 5619 - protein, 315 aa, Oryza sativa (japonica cultivar-group)
MADHAAAEAAPQSSQEEEEDWKEAEGGDGDVEVADRGGGGGAANGGIPEGRPIRVYADGIYDLFHFGHAKSLEQAKRLFPNTYLLVGCCNDELTHKYKGRTVMTEDERYESLRHCKWVDEVIPDAPWVVTEEFLNKHNIDFVAHDSLPYADASGAGNDVYEFVKKLGKFKETQRTDGISTSDIIMRIVKDYNEYVMRNLARGYTRKDLGVSYVKEKRLRVNMGLKNLRDKVKQHQEKVGEKWNTMAKLQEEWVENADRWVAGFLEKFEEGCHSMGTAIKERIQERLKAQSRDFSLLQYDGEDVDEDEDDDEYVRE

SEQ ID NO: 5620 - DNA, 846 bp, Oryza sativa (japonica cultivar-group)
  CDS (1)..(846)
atgaagccactgaaggacgcggacgcgcaggagaaggcggcgccgccgccgacggagtggtacgacccgctgtcgtcgccggggcggccggtcagggtgtacgccgatggcatctacgacctcttccacttcggccatgcccgcgccctcgagcaggccaagaaatcattccccaacacatatttgctcgtgggctgctgcagcgacgagatcaccaacctttacaaaggcaagaccgtcatgactgaagacgagcgctacgaatcgcttcgccattgcaagtgggtggatgaggtgataccagatgctccatgggttatcaatcaggagttcctagacaagcaccgcatcgactacgtcgctcatgatgctcttccgtatgcggacaccagtggagctgccaatgatgtctatgaatttgtgaaggccgttgggaagttcaaggagacgaagcgcaccgagggcgtctcgacgtctgacatcatcatgaggatcttgaaggactacaaccagtacatcatgcgaaatctgacccggggatactcccgcaaagacctcggtgtgagctatgtcaaggagaagcaacttagagtaaacatggggatcagcaagctaagggagaaggtgaaggagcatcaagagaagtttcacagcgcggcaaagatagctggaagcaatcctgtggagtggatggagaatgccgaccgttggatcgttgggtttcttgaaaagtttgaggaaggttgccacatgatggaaaccgcgattaaagatcggattcaggaggggctgaagaggcaaagcaggtcggaccccaacctttctggggaggattccgactcataa

SEQ ID NO: 5621 - protein, 281 aa, Oryza sativa (japonica cultivar-group)
MKPLKDADAQEKAAPPPTEWYDPLSSPGRPVRVYADGIYDLFHFGHARALEQAKKSFPNTYLLVGCCSDEITNLYKGKTVMTEDERYESLRHCKWVDEVIPDAPWVINQEFLDKHRIDYVAHDALPYADTSGAANDVYEFVKAVGKFKETKRTEGVSTSDIIMRILKDYNQYIMRNLTRGYSRKDLGVSYVKEKQLRVNMGISKLREKVKEHQEKFHSAAKIAGSNPVEWMENADRWIVGFLEKFEEGCHMMETAIKDRIQEGLKRQSRSDPNLSGEDSDS

SEQ ID NO: 5622 - DNA, 870 bp, Oryza sativa (japonica cultivar-group)
  CDS (1)..(870)
atggcgcgcgtttcgcattccagaaagcggactagggctccctccaactccaactccaagcccacttcacaaacccaaccgccgccgccggagctcaccgaccgccctgtccgcgtctacgccgacggcatcttcgatctcttccacttcggccatgcccgcgccctcgagcaggccaagttgctgttccccaacacgtacctgctagtgggctgctgcaacgacgagctcaccaaccgctacaagggcaagaccgtcatgacccaggatgagcgatacgagtcccttcgccactgcaaatgggttgatgaggtcattcctgatgctccatgggtcctcacgcaagagttcattgacaaacatcagattgactatgttgctcatgatgcactgccttatgccgatactagtggagctgctaatgatgtctatgaatttgttaaaaagattggcaaattcaaggaaacgaaacggacagacggtgtatccacatcagacctcataatgaggatattgaaggactacaatcagtatgtcatgaggaatttagcacgtggatacacaaggaaagatttaggcgtaagctatgttaaggaaaagcaactccaggtcaacatgaagataaataaactgcgagagactgtaaaggcgcatcaagaaaagttgcaaacggtggcgaagacagctggaataaatcatgaagaatggttggccaatgcagatcgctgggttgctggtttcttggagaagtttgaggaacactgccacaacatggaaactgccatcaaggggcgtatccaggagaaattgaggaggcaaacaagcagagggataattgggggtctaatgcagcaaccggtggcagcgtaa

SEQ ID NO: 5623 - protein, 289 aa, Oryza sativa (japonica cultivar-group)
MARVSHSRKRTRAPSNSNSKPTSQTQPPPPELTDRPVRVYADGIFDLFHFGHARALEQAKLLFPNTYLLVGCCNDELTNRYKGKTVMTQDERYESLRHCKWVDEVIPDAPWVLTQEFIDKHQIDYVAHDALPYADTSGAANDVYEFVKKIGKFKETKRTDGVSTSDLIMRILKDYNQYVMRNLARGYTRKDLGVSYVKEKQLQVNMKINKLRETVKAHQEKLQTVAKTAGINHEEWLANADRWVAGFLEKFEEHCHNMETAIKGRIQEKLRRQTSRGIIGGLMQQPVAA

SEQ ID NO: 5624 - DNA, 999 bp, Arabidopsis thaliana
  CDS (1)..(999)
atgagcaacgttatcggcgatcgcactgaagacggcctttccaccgccgctgcggcctctggctctacggctgtccagagttctcctcccactgatcgtcctgtccgcgtctacgccgatgggatctacgatcttttccactttggtcatgctcgatctctcgaacaagccaaattagcgtttccaaacaacacttaccttcttgttggatgttgcaatgatgagactacccataagtacaagggaaggactgtaatgactgcagaagagcgatatgaatcacttcgacattgcaagtgggtggatgaagtcatccctgatgcaccatgggtggtcaaccaggagtttcttgacaagcaccagattgactatgttgcccacgattctcttccctatgctgattcaagcggagctggaaaggatgtctatgaatttgttaagaaagttgggaggtttaaggaaacacagcgaactgaaggaatatcgacctcggatataataatgagaatagtgaaagattacaatcagtatgtcatgcgtaacttggatagaggatactcaagggaagatcttggagttagctttgtcaaggaaaagagacttagagttaatatgaggctaaagaaactccaggagagggtcaaagaacaacaagaaagagtgggagaaaagatccaaactgtaaaaatgctgcgcaacgagtgggtagagaatgcagatcgatgggtcgctggatttcttgaaatatttgaagaaggttgccataagatgggaactgcaatcgtagacagtatccaagaaaggttaatgagacaaaagtcggcagagaggctggagaacggtcaggatgatgacacagacgaccagttctatgaagaatacttcgatcatgacatgggtagtgacgatgatgaagatgaaaaattctacgacgaggaagaagtaaaggaagaagagacagagaaaactgttatgacggatgctaaagacaacaagtaa

SEQ ID NO: 5625 - protein, 332 aa, Arabidopsis thaliana
MSNVIGDRTEDGLSTAAAASGSTAVQSSPPTDRPVRVYADGIYDLFHFGHARSLEQAKLAFPNNTYLLVGCCNDETTHKYKGRTVMTAEERYESLRHCKWVDEVIPDAPWVVNQEFLDKHQIDYVAHDSLPYADSSGAGKDVYEFVKKVGRFKETQRTEGISTSDIIMRIVKDYNQYVMRNLDRGYSREDLGVSFVKEKRLRVNMRLKKLQERVKEQQERVGEKIQTVKMLRNEWVENADRWVAGFLEIFEEGCHKMGTAIVDSIQERLMRQKSAERLENGQDDDTDDQFYEEYFDHDMGSDDDEDEKFYDEEEVKEEETEKTVMTDAKDNK

SEQ ID NO: 5626 - DNA, 900 bp, Arabidopsis thaliana
  CDS (1)..(900)
atgagcgttaatggtgagaacaaggtctcaggaggagatagttcatcttcagatcgacctgttagagtctacgccgatgggatcttcgatttgttccatttcggccacgctcgtgccatcgaacaagccaaaaaatcgttcccgaatacgtatctgcttgttggatgttgcaatgacgaaattacgaacaaattcaaggggaaaactgtgatgactgaatctgagcgatacgaatctcttcgacattgcaagtgggttgatgaagtgattccagatgcaccatgggttcttacaacagagtttcttgataagcataagatagattacgtagctcacgatgctcttccctatgcggatactagtggagctggaaatgatgtttatgagtttgtaaagtcgattgggaagtttaaggagactaaacgaacagaggggatatcgacatctgatataatcatgagaatagtgaaagattataaccagtatgtgttgcgtaatcctggaccgaggtattcaagagaagaactctcgtgtcagctcgaggagaagaggcttagagtgaatatgagattgaagaaactacaagagaaagttaaagaacaacaagaaaagatacaaaccgtagcaaaaactgctgggatgcaccatgatgagtggcttgaaaatgctgatcgttgggtggctggatttcttgaaatgtttgaggaaggttgtcataaaatgggaacagccatcagagatgggattcagcaacggctaatgaggcaagaatcggaagagaaccggcgattgcttcaaaatggactgacgatttccaaagacaatgacgatgaacaaatgtctgatgacaacgagtttgcagaagaaagactgcgtcaatgtgagcaacaaagggattga

SEQ ID NO: 5627 - protein, 299 aa, Arabidopsis thaliana
MSVNGENKVSGGDSSSSDRPVRVYADGIFDLFHFGHARAIEQAKKSFPNTYLLVGCCNDEITNKFKGKTVMTESERYESLRHCKWVDEVIPDAPWVLTTEFLDKHKIDYVAHDALPYADTSGAGNDVYEFVKSIGKFKETKRTEGISTSDIIMRIVKDYNQYVLRNPGPRYSREELSCQLEEKRLRVNMRLKKLQEKVKEQQEKIQTVAKTAGMHHDEWLENADRWVAGFLEMFEEGCHKMGTAIRDGIQQRLMRQESEENRRLLQNGLTISKDNDDEQMSDDNEFAEERLRQCEQQRD

SEQ ID NO: 5628 - DNA, 1065 bp, Schizosaccharomyces pombe 972h-
  CDS (1)..(1065)
atgtattgtaatttagctaaaatgtatgaagtggaaccatctgaaaaagaagataatgtagaaagacagacgaagaagtataatttcgagattgatgaacctgaagaacaagaaaagaaagatgagaaggaagatgataaagaggaaagcccttctaaatctttggaagagatatctcaatcagtttcacctgtagaggaggagcctcgtgatgttcggtttaaagagctgtccactccttttagttaccctatcaatgatcctcctgagggtcgtcctgttcgagtttacgccgatggagtttttgacttgtttcatattgggcatatgagacaactagaacaggccaaaaaagtatttcctaatgtgcatcttattgttggtcttcccaacgatcaattgactcatcgccttaaaggattaacagtgatgaatgacaaggaacgagctgaagcccttcgacattgtaagtgggttgacgaggtcttagaaaatgcaccttgggtaattaccccagaatttttggaagaacacaagattgattttgtcgcccacgacgacattccatatgctagcgatgattccggagatatctatcttccggttaagaaggttggtaaatttattcctacaaagcgtacagagggtgtttctacatccgatctcattactcgaattattcgggactatgatcaatatgtgatgcgaaaccttgctcgcggtgtaaaccgaaaggaattaaacgtttcgttgtttaagaagaatgaacttgatcttagacaccacattaaggttcttcgtgatacattgagaaatcactgggtttctacaactcgtgatctgaaggctgatatcaaatcatttttgtcaatggcgactaccgattatcaattgcagaagaatcctctgcacggctctagtgaaccttcaagtcctggtcccacaggatttttaggtggtatcaatcgttggatgcaacgtaggtctagcagtcattatgacttacctcgtgtcggcaatgagatagctgcttcaagctcttcagcgactgaagaaaatcattaa

SEQ ID NO: 5629 - protein, 354 aa, Schizosaccharomyces pombe 972h-
MYCNLAKMYEVEPSEKEDNVERQTKKYNFEIDEPEEQEKKDEKEDDKEESPSKSLEEISQSVSPVEEEPRDVRFKELSTPFSYPINDPPEGRPVRVYADGVFDLFHIGHMRQLEQAKKVFPNVHLIVGLPNDQLTHRLKGLTVMNDKERAEALRHCKWVDEVLENAPWVITPEFLEEHKIDFVAHDDIPYASDDSGDIYLPVKKVGKFIPTKRTEGVSTSDLITRIIRDYDQYVMRNLARGVNRKELNVSLFKKNELDLRHHIKVLRDTLRNHWVSTTRDLKADIKSFLSMATTDYQLQKNPLHGSSEPSSPGPTGFLGGINRWMQRRSSSHYDLPRVGNEIAASSSSATEENH

SEQ ID NO: 5630 - DNA, 1359 bp, Magnaporthe grisea 70-15
  CDS (1)..(1359)
atgtcgtcaacaacacaagcagccgccaacaagcgcaaacgcctcacgggtggcagcaccacctcgctgcctgacgaggttgcggccgccgagcgggcacagatctcggagtcccgcgacgcgtctgcagaagagggcgacaccacagcggcggaaacgccggcgacggcacccacctcgcacccgccgattaagcgccagcggtcgagcaacaatgccgtcggcgatgcgacggtcgacctgggcgagcctagcgatactaccgaggcgagcgtggacattgaaaaccgggtaggccgcaagggcaggaagagcagcaaccccgagaaggaggaggagagcatggcgccgccacccatcggcaagctcacacatccagttggctatcgtaccaatgacccgccggttggtaggccagtccggatctacgccgacggcgtgtttgatttgttccatcttggccacatgcgacagctcgaacaagccaagaaggcgttccccgacgtctacctgatcgtcggagtaactggtgacgccgagactcacaagcgcaagggcctgacggtgctttccggtaaggaacgcgccgagacggtccgtcactgcaagtgggtcgacgaggttatcgagaactgcccgtggatcgtcacgcccgagttcctcgaggagcacaagctcgactatgttgcgcacgacgacattccatatggcgccgacgagggggacgacatctacggacccatcaaggccgagggcaagttcctggtgacgcaacgcacagagggcgtcagcacgacaggaatcattaccaagatcgtacgcgactacgaaaagtatattgcaaggcagctcaagcgcggtacttcgaggcaggagctcaacgtcagctggctgaagaagaacgagttggacctgaagcgacacgtacaggatctgcgagaaaacatccgcagcaactggacgacgacgggtcaggagctcagccgcgagctgaggcaatactggccggcttccaggccacagagccccgccccctcgaggccctcgctgcaggttcctaacggggaccagctcacaagcccgcaacagcagagcagcttgagggaggcgcagctccgatcgccaaccacgccaggaggcgccaacgtcaactcaaacgacttcgtcgccggatacgcggtcgggttgatcggcggtgtaaggtcttggagccgtcgcagcctgagggatgagagagatgactcctcatcgcgcccgccaagtgacgactcatccgaggagagtgagggcaaggagaagacgacgcgaactcgcagggttgttcccaagggcaacaacgctgctgctacaggagcctaa

SEQ ID NO: 5631 - protein, 452 aa, Magnaporthe grisea 70-15
MSSTTQAAANKRKRLTGGSTTSLPDEVAAAERAQISESRDASAEEGDTTAAETPATAPTSHPPIKRQRSSNNAVGDATVDLGEPSDTTEASVDIENRVGRKGRKSSNPEKEEESMAPPPIGKLTHPVGYRTNDPPVGRPVRIYADGVFDLFHLGHMRQLEQAKKAFPDVYLIVGVTGDAETHKRKGLTVLSGKERAETVRHCKWVDEVIENCPWIVTPEFLEEHKLDYVAHDDIPYGADEGDDIYGPIKAEGKFLVTQRTEGVSTTGIITKIVRDYEKYIARQLKRGTSRQELNVSWLKKNELDLKRHVQDLRENIRSNWTTTGQELSRELRQYWPASRPQSPAPSRPSLQVPNGDQLTSPQQQSSLREAQLRSPTTPGGANVNSNDFVAGYAVGLIGGVRSWSRRSLRDERDDSSSRPPSDDSSEESEGKEKTTRTRRVVPKGNNAAATGA

SEQ ID NO: 5632 - DNA, 1299 bp, Gibberella zeae PH-1
  CDS (1)..(1299)
atgtcgtcgccctccggatcatctcaaggcggcaagcgcaagagaaactcgcttcgcgtcgaatccacacacgactttgctgagaatggcatccagacatcctcgcgcgatgcttcaggcgaggagggtgataccacagccgctgagtcgggacgtcttcacgcccgcggctcagctccaattcctaagaggcagcgctctagctcgaaccgtgataacaccattgaccctggtgagcccagcgacaccaccgaggccagtatcgacattgctgagcgagttggtcgcaaaggacgccaagccttgaaggagctcgatgaagaggagcaacgcagaattgaggctatgccccctcctcccattggcaacctacaagaccctgctggtggctacaagaccaaccctccccctgttggacgacctgtccgtgtctacgccgatggcgtctttgatctcttccacttgggtcacatgcgacaactcgagcaggccaagaaggctttccccgacacaacgctggtcgtcggcgtcacaggcgatcacgaaacacacaagcgcaagggtttgactgtcatgtctgccgctgagcgtgccgagaccctccgtcactgcaaatgggtcgatgaggttatcgaagactgcccatgggttgtcactcccgagttcctcgacgagaacaagctcgattacgttgcccacgacgatctcccctatggcgctgacgaaggtgacgacatttaccagcccatcaaggccgctggcaagttcctcgttacccagcgtacagagggtgtcagcacaactggcctcatcacaagaatcgtgcgcgactacgagaagtatattgccagacagttcaagcgcggtacttcccgccaggaactcaacgtcagctggctcaagaagaacgaattggacctcaagcgtcacgtccaggacctccgagagaacatcacaaacaactggtccaccactggccaagaacttggtcgtgagctgaagcagttctggcccgtcagccgtcctcaaagtcctgcccgatttaacagcgcgggtaccgccgagggacttcgttcacctacgaccccaggtacttctggtacacccaaggagtttatcactggatacgccctcggccttgtcggtggtgttaggggatggatgaccaagagccgaacgaatgtcgccgatggcagccgacctcccagtgacgatgagtctgaagagagcgatgcccacgccaagtcgccaaaggagtcgtcaaacaccccgacggcggtcgctccctccaagctgtaa

SEQ ID NO: 5633 - protein, 432 aa, Gibberella zeae PH-1
MSSPSGSSQGGKRKRNSLRVESTHDFAENGIQTSSRDASGEEGDTTAAESGRLHARGSAPIPKRQRSSSNRDNTIDPGEPSDTTEASIDIAERVGRKGRQALKELDEEEQRRIEAMPPPPIGNLQDPAGGYKTNPPPVGRPVRVYADGVFDLFHLGHMRQLEQAKKAFPDTTLVVGVTGDHETHKRKGLTVMSAAERAETLRHCKWVDEVIEDCPWVVTPEFLDENKLDYVAHDDLPYGADEGDDIYQPIKAAGKFLVTQRTEGVSTTGLITRIVRDYEKYIARQFKRGTSRQELNVSWLKKNELDLKRHVQDLRENITNNWSTTGQELGRELKQFWPVSRPQSPARFNSAGTAEGLRSPTTPGTSGTPKEFITGYALGLVGGVRGWMTKSRTNVADGSRPPSDDESEESDAHAKSPKESSNTPTAVAPSKL

SEQ ID NO: 5634 - DNA, 1209 bp, Candida glabrata CBS 138
  CDS (1)..(1209)
atggccaaactatctagaactacatctttgaagaaaaggctctcaaactcttcctttacaaaattgttcaaagctaagcgtaagagagaggacgatgaggatagtactactgacagtgctgatcatgaagagacccctgggaaggagaacagggaaatagctactccttctgctaagcgtcatcgtccaattagtaaagaacaacaggagttcgagaaaaaggaggcattgctggatgctgagcttcctgaagagctaagaaaatacagacctaaaggttttaggcttaacatacctcctaaggatagacctattcgtatatatgcggatggtatctttgatctgttccatttgggacacatgaaacagttggaacaatgtaagaaggcgttccctaatgttgaattggtgtgtggtattccaagtgatgaggttactcacaaattgaagggtcttactgtcctaactgacaagcaacgttgtgagacactaatgcattgtaaatgggtggacgaagttgttccaaatgcaccatggtgtgtaacaccagagttccttgccgaacataagatcgactatgtagctcacgatgacattccatatgttagtagcgatagtgacgatatctataaaccaatcaaagagcttggtaagtttttaactacccagcgtacagacggtatatctacaagtgatattattaccaagattattagagactatgacaagtacttgatgagaaattttgctcgtggtgctacaagacaggaactgaacgtgtcatggttgaagaaaaatgagctggagtttaagaaacacatcagtgattttagatcgtacttcaagaagaaccaaggtaacttgaataatgcgtcaagagatctgtatttcgaagtcagggagatcctattgagaaagacgttgggaaggaagctatactcaaagctgctgggagacaagcacattccaagaagtattgcattgggatccctttcggcaacctcagatgaagaagagcagagtgatgatttgcctgagccaaagagaaagaagatgctattgatcagagaaccatccccagcaaccgagttcgctagcaaatacacaggtgctaaggtaaccaaacaagaatcggaggaggacgctgaatcagaagatataaatgatgaagatgatgaagaagaagcggatgaagaagacagccattga

SEQ ID NO: 5635 - protein, 402 aa, Candida glabrata CBS 138
MAKLSRTTSLKKRLSNSSFTKLFKAKRKREDDEDSTTDSADHEETPGKENREIATPSAKRHRPISKEQQEFEKKEALLDAELPEELRKYRPKGFRLNIPPKDRPIRIYADGIFDLFHLGHMKQLEQCKKAFPNVELVCGIPSDEVTHKLKGLTVLTDKQRCETLMHCKWVDEVVPNAPWCVTPEFLAEHKIDYVAHDDIPYVSSDSDDIYKPIKELGKFLTTQRTDGISTSDIITKIIRDYDKYLMRNFARGATRQELNVSWLKKNELEFKKHISDFRSYFKKNQGNLNNASRDLYFEVREILLRKTLGRKLYSKLLGDKHIPRSIALGSLSATSDEEEQSDDLPEPKRKKMLLIREPSPATEFASKYTGAKVTKQESEEDAESEDINDEDDEEEADEEDSH

SEQ ID NO: 5636 - DNA, 1230 bp, Kluyveromyces lactis NRRL Y-1140
  CDS (1)..(1230)
atggctccgcttactcgtgctccttccttgaaagaacgtctttctagtacaggtgcttctttcactaacctgttcaaattgggaaagaaaaggtcccacgatgagatgacagtaagtgacgatgaacgagtagaaagtaacgatactgcaccagatgcagcagcatcgattgtatctgaaacaacaacaacaaccagcgaagatgcagagactgaggaatcggaaggtcctttgcggaaaagaccacactctgaaacaaatgatttcaaggccagggaaaaggagttggatgaagagctacctgttgagtatagaaagtttagacctaagggcttcaagttcaatttaccaccaacagatcgtccgattcgtatatatgcggatggtgtgtttgatcttttccatttgggtcatatgaaacaattggaacagtgtaagaagtcgttccccaacgtgacgttgatttgtggtgttccaagcgataaagtgacgcacaagttgaaagggttgactgtccttaccgataagcagagatgcgagacgttgacacattgtagatgggttgatgaagtgataccggatgccccatggactgtgacgccgaaatttttagaagaacacaagatcgattatgtggcacatgacgatctaccatacgctagtgctgataatgacgatatctacagaccaattaaagcaatgggtaagtttttaactacccaacgtaccgaaggtgtttctaccagtgatattatcaccaagatcatcagagactatgacaagtacttgatgagaaatttcgcaagaggtgccacgagacaggagttgaacgtatcttggttgaagaagaacgaattggaattcaagaaacatattcaagatttcagatcgtatttcaagaagaaccaagaatctgtcaacgtcgcatcaaaggacttgtatttcgaagttagagaaatgcttcttaaaaagacacttggaaagaagttgtattcaaaacttattggacccatgggtcatgaaagcgttagaagaagtaaaaggatttcgggtagatccccagtaactcaattcgcgaaagactacactggtgaagaggttgaatctccaactagtgatagtgatcctgaactgcatagaggtagttctgaatcgccgaatcatttgttttcagatgaagatgacgacgaagaggaaggggacagggaaaggtcaccaactaccgattga

SEQ ID NO: 5637 - protein, 409 aa, Kluyveromyces lactis NRRL Y-1140
MAPLTRAPSLKERLSSTGASFTNLFKLGKKRSHDEMTVSDDERVESNDTAPDAAASIVSETTTTTSEDAETEESEGPLRKRPHSETNDFKAREKELDEELPVEYRKFRPKGFKFNLPPTDRPIRIYADGVFDLFHLGHMKQLEQCKKSFPNVTLICGVPSDKVTHKLKGLTVLTDKQRCETLTHCRWVDEVIPDAPWTVTPKFLEEHKIDYVAHDDLPYASADNDDIYRPIKAMGKFLTTQRTEGVSTSDIITKIIRDYDKYLMRNFARGATRQELNVSWLKKNELEFKKHIQDFRSYFKKNQESVNVASKDLYFEVREMLLKKTLGKKLYSKLIGPMGHESVRRSKRISGRSPVTQFAKDYTGEEVESPTSDSDPELHRGSSESPNHLFSDEDDDEEEGDRERSPTTD

SEQ ID NO: 5638 - DNA, 1341 bp, Debaryomyces hansenii CBS767
  CDS (1)..(1341)
atgtcccaagattctagatctaattctgcggaagttgctgatttgaggactggtagtccattaggtagaacgatctctgttgattctatcgcatcgttatttagaaagagaaagagagcggatagtgaatcagcaaccccaacaccagttgaatcaccacatgattcagatactactgaaagcgataaagaaggtacgcgtgacaccaaaagaagaaaggttaaaactaaagaagagatagagtttgaagagaatgaaaaaaagttagatgctgagttgccagaggaattaagaaaatataggccgcttgggtttaagtttaacatcccacccaaagatagacctatcaggatttatgctgacggggtgtttgatttgtttcacttaggtcatatgaagcaattagagcaagccaagaaagcatttcctaatgttgcgttggtgtgtggaattccttctgatgtggaaacccataagagaaagggattgaccgtgttgactgatcaacagagaatcgaaacattgcagcattgtagatgggttgatgaggttattcccaatgctccttggtgtgtaactactgaatttttactccagcataaaattgattatgttgcccatgatgatttgccatacgcgtctaccgattcagacgatatttataagcctatcaaagaaatggggatgttcttaacgacccaaagaacagagggcatttcaacgtcagatatcatcaccaaaatcattagagattacgataagtatttgatgagaaactttgcccgtggtgcaacaagagaagaattgaatgttagttggttaaagaaaaatgaattagaattcaaaaagcatattaatgatttcagatcctactggacgaaaaataaaacaaatattaataatgtttccaaagatctttatttcgaagtaagggaatatatcaggggtaagaaaacaggatcatcttccctgtcagataataatagtatcacttcagaatttgatgaagtgaattcaagagccaactctccattgacggactttgcttccaagtatatcggaaatgctaataaagacctcaatggtaaatctattttagctaacgttaaaggatggataaaaggggatgaattatcagctaatgagaaatctgaaccatctctggaatctttatctagaaaatcgactagatcttccacaagatcttcgaagttgaacaataataaatcctcggcgtcttctgtatcaagttccaagtcgcctaaaatgacctccaagtcggttacaagtactcctaaaaattcaaagaagatcaacaagagaactcaaaaatctagttaa

SEQ ID NO: 5639 - protein, 446 aa, Debaryomyces hansenii CBS767
MSQDSRSNSAEVADLRTGSPLGRTISVDSIASLFRKRKRADSESATPTPVESPHDSDTTESDKEGTRDTKRRKVKTKEEIEFEENEKKLDAELPEELRKYRPLGFKFNIPPKDRPIRIYADGVFDLFHLGHMKQLEQAKKAFPNVALVCGIPSDVETHKRKGLTVLTDQQRIETLQHCRWVDEVIPNAPWCVTTEFLLQHKIDYVAHDDLPYASTDSDDIYKPIKEMGMFLTTQRTEGISTSDIITKIIRDYDKYLMRNFARGATREELNVSWLKKNELEFKKHINDFRSYWTKNKTNINNVSKDLYFEVREYIRGKKTGSSSLSDNNSITSEFDEVNSRANSPLTDFASKYIGNANKDLNGKSILANVKGWIKGDELSANEKSEPSLESLSRKSTRSSTRSSKLNNNKSSASSVSSSKSPKMTSKSVTSTPKNSKKINKRTQKSS

SEQ ID NO: 5640 - DNA, 1101 bp, Yarrowia lipolytica CLIB122
  CDS (1)..(1101)
atggccaaaagcaaacgacggtcggaggctgtggaagagcacgtgaccggctcggacgagggcttgaccgatacttcgggtcacgtgagccctgccgccaagaagcagaagaactcggagattcatttcaccacccaggctgcccagcagttggatcgggagcgcaaggaggagtatctggactcgctgatcgacaacaaggactatctcaagtaccgtcctcgaggctggaagctcaacaacccgcctaccgaccgacctgtgcgaatctacgccgatggagtgtttgatttgttccatctgggacacatgcgtcagctggagcagtccaagaaggccttccccaacgcagtgttgattgtgggcattcccagcgacaaggagacccacaagcggaagggattgaccgtgctgagtgacgtccagcggtacgagacggtgcgacactgcaagtgggtggacgaggtggtggaggatgctccctggtgtgtcaccatggactttctggaaaaacacaaaatcgactacgtggcccatgacgatctgccctacgcttccggcaacgacgatgatatctacaagcccatcaaggagaagggcatgtttctggccacccagcgaaccgagggcatttccacctcggacatcatcaccaagattatccgagactacgacaagtatttaatgcgaaactttgcccggggtgctaaccgaaaggatctcaacgtctcgtggctcaagaagaacgagctggacttcaagcgtcatgtggccgagttccgaaactcgttcaagcgaaagaaggtcggtaaggatctctacggcgagattcgcggtctgctgcagaatgtgctcatttggaacggcgacaactccggcacttccactccccagcgaaagacgctgcagaccaacgccaagaagatgtacatgaacgtgctcaagactctgcaggctcctgacgctgttgacgtggactcctcggagaacgtgtctgagaacgtcactgatgaggaggaggaagacgacgacgaggttgatgaggacgaagaagccgacgacgacgacgaagacgacgaagacgaggaagacgacgagtag

SEQ ID NO: 5641 - protein, 366 aa, Yarrowia lipolytica CLIB122
MAKSKRRSEAVEEHVTGSDEGLTDTSGHVSPAAKKQKNSEIHFTTQAAQQLDRERKEEYLDSLIDNKDYLKYRPRGWKLNNPPTDRPVRIYADGVFDLFHLGHMRQLEQSKKAFPNAVLIVGIPSDKETHKRKGLTVLSDVQRYETVRHCKWVDEVVEDAPWCVTMDFLEKHKIDYVAHDDLPYASGNDDDIYKPIKEKGMFLATQRTEGISTSDIITKIIRDYDKYLMRNFARGANRKDLNVSWLKKNELDFKRHVAEFRNSFKRKKVGKDLYGEIRGLLQNVLIWNGDNSGTSTPQRKTLQTNAKKMYMNVLKTLQAPDAVDVDSSENVSENVTDEEEEDDDEVDEDEEADDDDEDDEDEEDDE

SEQ ID NO: 5642 - DNA, 1419 bp, Aspergillus nidulans FGSC A4
  CDS (1)..(1419)
atgtcttctccgctctccaacagcaaacgtaagcgcgccgactcccaacacttgtccacagcagatatcgcaaaatcatcaactaccgatctcttgcaaccatcgtcacgcgatgcttccggtgaagagggagacgagtcaactggcccaattatttctccggtcaaggcttcgaacaatccgcctccgaaacgggcgcggaaggcttccgtgagcgaaggacaaagtggtgatgcgggaaaggacacttcaattagcaaggaggatcctggcgagccatccgaaaccacaccggccagtagtgacattgaaacacacaccaaaactcggcctggattgcacttaaatacgaagcccgatgaagagttgatgaaaccaccagtgctaggcaaactgcaggatcctgctggtggatataaaaccaatccgccacctgtgggccgtccggtgcgagtatatgctgacggagtctttgatttgtttcacgtgggtcatatgcgacagcttgagcaagccaagaaggctttccctgacgtttaccttatagttggggtgaccggagataaggagactcacgagcggaaaggtcttacagttctaagcggcgcagagcgagccgagagtgttcgtcactgcaaatgggttgacgaggttttcccaaactgcccgtggattgttactccagaattcatggaagagcataagattgactatgttgcgcacgacgacttgccgtacggggccgcggagggagacgatatatatgcccccatcaaggcccaaggaaagttcctggttactcaacggacggaaggtgtgagtactacgggtgttattacaagaattgttcgcgactacgaccgttacatctctcgacaattcaaacgtggtgcatcgagacaggaactaaatgtttcatggctgaagaagaacgaattggagatcaagcggcacgtgtcggagctccgcgacagcatcatgaccaattggacgaacactggccaggaactgagtcgagagctgcgccaactgtggaactccagacctaatagtccagctcctagcacgaggaccagtatggactggggaagctcgcgcggggttgttagtcctacagctggtggtaagtcacatgtctcccgcgtggaagcactgggtcgcacggaaagtatcactgggagggagccggatttcgccacaggctatagcttagggttaatcgggggcgtcagggcatggaaagccgaggccagtcaccagccagtgaagaagaacacgagtctgaactggaacgcagcaacggtgagggacccgccgaacctaagcggtaaactggcagtccatcggatgtgtcgaaccggcgaggttacattcatgatcttcatcttcgaggcaatcttaggtcatatcggcacataa

SEQ ID NO: 5643 - protein, 472 aa, Aspergillus nidulans FGSC A4
MSSPLSNSKRKRADSQHLSTADIAKSSTTDLLQPSSRDASGEEGDESTGPIISPVKASNNPPPKRARKASVSEGQSGDAGKDTSISKEDPGEPSETTPASSDIETHTKTRPGLHLNTKPDEELMKPPVLGKLQDPAGGYKTNPPPVGRPVRVYADGVFDLFHVGHMRQLEQAKKAFPDVYLIVGVTGDKETHERKGLTVLSGAERAESVRHCKWVDEVFPNCPWIVTPEFMEEHKIDYVAHDDLPYGAAEGDDIYAPIKAQGKFLVTQRTEGVSTTGVITRIVRDYDRYISRQFKRGASRQELNVSWLKKNELEIKRHVSELRDSIMTNWTNTGQELSRELRQLWNSRPNSPAPSTRTSMDWGSSRGVVSPTAGGKSHVSRVEALGRTESITGREPDFATGYSLGLIGGVRAWKAEASHQPVKKNTSLNWNAATVRDPPNLSGKLAVHRMCRTGEVTFMIFIFEAILGHIGT

SEQ ID NO: 5644 - DNA, 1374 bp, Candida albicans SC5314
  CDS (1)..(1374): transl_table=12
atggctagacttactagaaagaggacaattgagaaagaactcaatggatcgtctagagtcaccagaactttatcaatggaatcgatttcttcgttatttaaacgaaataaaaaaagaaaacataatgatggcaacgattcaagcgtgaattccagtgataatgaaaacatcaacataactgatgatgaagaacaagatcacattgacactaaaccaaatcacaagaaaagaaaaatcaaaacaaaggcagaagaagaatttgaagccaatgaaaagaaattggatgaagaattgccaattgatttgcgcaaatatagaccaagagggtttagattcaatttacctcctgaagatcgtccaatcaggatttatgctgatggtgtttttgatttatttcatttgggtcatatgaaacaattggaacaagctaaaaaatcatttcctaatgttgaattggtttgtggaattccatctgatattgaaacccataaacgtaaggggttgacagttttgactgacgaacaacggtgtgaaactttaatgcattgtaaatgggtcgatgaagttattcctaatgctccttggtgtgttacccctgagtttttacaagaacataaaatcgattatgttgcacatgacgatttaccgtatgcaagtagtgatagtgatgatatctataaacctataaaagaacaagggaagtttttgacaacccagagaacagaggggatttctacttccgatataattaccaaaatcattcgtgattatgataaatatttgatgagaaatttttctcgaggtgccactagaaaagaattgaatgttagttggttaaagatgaatgaactagaatttaagaaacacattaatgatttcagaacttattggatgaagaataaaactaacatcaacaatgtctcacgtgatttgtattttgagattagagagtttatgagaggtaaaaaatttgattttcaaaaatttattgaagatggcaatagtcaaaacagtagtaatcacggcagtgatgaagaatcaacaaattcatccaaagtgagttctccattgagtgattttgcatcaaaatatattggtaacagaaacaaagatttgaaccgtaaaggtattttgaacaatttcaagggctggataaaccgtgacgatcattctgaacaggaaaccgaagaggagatcaaaccaatagttattaagccaatcagaagaagtcgtagattgagtggtggtagtagtaccagtagtgtccctagcacgcctgtaaaaagaactgctagtagtgcttcaactacaccaaaaagaaagtcaccattaaagaagtcatctagtgttaaaaacaccccaaagacaaaataa

SEQ ID NO: 5645 - protein, 457 aa, Candida albicans SC5314
MARLTRKRTIEKELNGSSRVTRTLSMESISSLFKRNKKRKHNDGNDSSVNSSDNENINITDDEEQDHIDTKPNHKKRKIKTKAEEEFEANEKKLDEELPIDLRKYRPRGFRFNLPPEDRPIRIYADGVFDLFHLGHMKQLEQAKKSFPNVELVCGIPSDIETHKRKGLTVLTDEQRCETLMHCKWVDEVIPNAPWCVTPEFLQEHKIDYVAHDDLPYASSDSDDIYKPIKEQGKFLTTQRTEGISTSDIITKIIRDYDKYLMRNFSRGATRKELNVSWLKMNELEFKKHINDFRTYWMKNKTNINNVSRDLYFEIREFMRGKKFDFQKFIEDGNSQNSSNHGSDEESTNSSKVSSPLSDFASKYIGNRNKDLNRKGILNNFKGWINRDDHSEQETEEEIKPIVIKPIRRSRRLSGGSSTSSVPSTPVKRTASSASTTPKRKSPLKKSSSVKNTPKTK

SEQ ID NO: 5646 - DNA, 1240 bp, Pisum sativum
  CDS (106)..(963)
taaaatagaaaaaacaaaaacaggaaagaaaatcgtgtgactgggttttgaatgccgttttgactctctgcacattgcaacagcacaaacacaagcagagtgatcatgaacgatcaccaggagtgtgaagttcgccaaaacgataaacctgttcgagtttatgccgatggaatttacgatctcttccacttcggtcatgcacgttctcttgaacaagccaagaaatcgtttccaaacacttatctccttgttggatgctgcaatgatgagaccactcataagtacaagggtaaaactgttatgactgaggccgaacgctatgagtctcttcgccactgcaagtgggttgatgaagttattccagatgtgccatgggtaatcaatcaggagttcattgacaagcatcaaattgactatgtggctcatgattctcttccttatgctgatacaagtggagctggaaaggatgtctatgaatttgttaaggctattggaaaatttaaggaaacacagcgaacggaaggaatttctacttctgatatcataatgagaatcatcaaagattataaccagtatgtaatgcgtaatttggatcgtggttattcaagaaaagacctaggagttagctatgtcaaggagaaaagattgagaatgaacatgggacttaaaaagttgcaggagagagtgaagaaacagcaagagactgtgggaaagaagataggaacagtgaaaaaaattgctggcatgaaccgtactgagtgggtcgaaaatgctgatcgattagttgctggattcctcgagatgtttgaagaaggatgccacaaaatgggaacggcgatcagagacagaattcaagaacaactgaaggcacagcagctaagatctcttctatacgacgagtgggatgatgacgttgacgatgaattctatgaaaatgaatctgtggaatactacagcgactaaagggacgaatatgcttgtttatttacagattgtgaaccgtttgacaaaattatgtgtcctttgtgtaaaatatttgatatatgtcatatacatgcaagatggtttggacattatttgtctttcttcatagtttgttatctattatctgtgcggttgtgtagcatttgagttcaatatgacctagtcttgtgtcatggaagatcatgactagatttcttatgtggttctttcttacaataaagcatctttgagttatttcttaaaaaaaaaaaaaaaa

SEQ ID NO: 5647 - protein, 285 aa, Pisum sativum
MNDHQECEVRQNDKPVRVYADGIYDLFHFGHARSLEQAKKSFPNTYLLVGCCNDETTHKYKGKTVMTEAERYESLRHCKWVDEVIPDVPWVINQEFIDKHQIDYVAHDSLPYADTSGAGKDVYEFVKAIGKFKETQRTEGISTSDIIMRIIKDYNQYVMRNLDRGYSRKDLGVSYVKEKRLRMNMGLKKLQERVKKQQETVGKKIGTVKKIAGMNRTEWVENADRLVAGFLEMFEEGCHKMGTAIRDRIQEQLKAQQLRSLLYDEWDDDVDDEFYENESVEYYSD

SEQ ID NO: 5648 - DNA, 1447 bp, Arabidopsis thaliana
  CDS (111)..(1106)
aaaattaaaaaaaaaaagagtaggagaagagggaagcgactagcaccttttgtagttttccgtttattttctgtataaggcgggtgatctcggctccttcatcggaaattatgagcaacgttatcggcgatcgaactgaagacggcctttccaccgccgctgcctctggctctacggctgtccagagttctcctcccactgatcgtcctgtccgcgtctacgccgatgggatctacgatcttttccactttggtcatgctcgatctctcgaacaagccaaattagcgtttccaaacaacacttaccttcttgttggatgttgcaatgatgagactacccataagtacaagggaaggactgtaatgactgcagaagagcgatatgaatcacttcgacattgcaagtgggtggatgaagtcatccctgatgcaccatgggtggtcaaccaggagtttcttgacaagcaccagattgactatgttgcccacgattctcttccctatgctcattcaagcggacgtggaaaggatgtctatgaatttgttaagaaagttgggaggtttaaggaaacacagcgaactgaaggaatatcgacctcggatataataatgagaatagtgaaagattacaatcagtatgtcatgcgtaacttggatagaggatactcaagggaagatcttggagttagctttgtcaaggaaaagagacttagagttaatatgaggctaaagaaactccaggagagggtcaaagaacaacaagaaagagtgggagaaaagatccaaactgtaaaaatgctgcgcaacgagtgggtagagaatgcagatcgatgggtccctggatttcttgaaatatttgaagaaggttcccataagatgggaactgcaatcgtagatcagtatccaagaaaggttaatgaggcaaagtcggcagagaggctggagaacggtcaggatgatgacacagacgaccagttctatgaagaatacttcgatcatgacatgggtagtgacgatgatgaaggggaaaaattctacgacgaggaagaagtaaaggaagaagagacagagaaaaccgttatgacggatgctaaagacaacaagtaagaacaaatttggcttgcagaaacctcagattagctctacttatggccacttctactaaactcccttaagcctcgcactctctctcgaaattcatctacttaacatataataccaatgtttagaaagagagagtgtgtgatgtgtttgtttgtgtgtgttgaacaaacgaacgtgtgtggttgtctttggtgagttggtctcatctttgttgatttttgaatgcgcatgtatttttttcttctttttctagacgggcaaagtgttatacaagaacaatgcaattgtctaaaacaggataagtcaatggttcgtgtgtgccataaagtaaaaaaaaaaaaaaa

SEQ ID NO: 5649 - protein, 331 aa, Arabidopsis thaliana
MSNVIGDRTEDGLSTAAASGSTAVQSSPPTDRPVRVYADGIYDLFHFGHARSLEQAKLAFPNNTYLLVGCCNDETTHKYKGRTVMTAEERYESLRHCKWVDEVIPDAPWVVNQEFLDKHQIDYVAHDSLPYAHSSGRGKDVYEFVKKVGRFKETQRTEGISTSDIIMRIVKDYNQYVMRNLDRGYSREDLGVSFVKEKRLRVNMRLKKLQERVKEQQERVGEKIQTVKMLRNEWVENADRWVPGFLEIFEEGSHKMGTAIVDQYPRKVNEAKSAERLENGQDDDTDDQFYEEYFDHDMGSDDDEGEKFYDEEEVKEEETEKTVMTDAKDNK

SEQ ID NO: 5650 - DNA, 1321 bp, Brassica napus
  CDS (31)..(1026)
gtgatttctaccccttcgatcagagagaatatgagcaacgttaccgccgatccaactgccgacggtccttccaccgccgtcgcagtctccaactctacagcaatccagacttcgcctcctaccgatcgtcccgtccgcgtctacgccgacgggatctacgatctcttccactttggccacgctcgatctctcgaacaggccaagaaatcgtttccaaacacttaccttcttgtgggatgttgcaacgatgagactactcataagtacaagggaaggactgtgatgactgctgaagagcgttatgaatcacttcgtcattgcaagtgggtggatgaagtcattcccgatgcaccgtgggtgatcaaccaagagtttcttgataaccaccggattgactacgttgcccatgattcccttccgtatgcagacaccagcggagctggaaaggatgtctatgaatttgttaagaaagttgggaggtttaaggaaacaatgcgaactgaggggatatcaacctcggacattatcatgagaatagtgaaagattataaccagtatgttatgcgtaatttggatagaggatattcaagggaagatcttggagttagctttgtcaaggaaaagagacttagagttaatatgaggctaaagaaactccaggagagagtcaaagaacagcaagaaaaagtgggagaaaagattcaaactgtaaaaatgctgcgcaacgagtgggtagagaatgcagatcgatgggtcgctggatttcttgaaatatttgaagaaggttgccataagatgggtactgcaatcagagacagaatccaagagaggttaataagacagattcccagaaacaggctggagaacggtcaggatgatgacacagacgatcaattctatgaagaatatttcgaccatgacatgggcagtgacgaggatgaagaggaacgatactatgacgaggaggaagatgttgaagaagagaaatataaaaccgttaagccagatgcaaaagacgacaagtaagaacaaatttgtgtctcagaaacctaagtttagcctctcactctatctccctcgcaataatatgcatctacttaacatatagtatcaaatgtttagaaagggagcgtgtgtgagtgtgatgtgtgtatgtgtcttttaaaaaacgtcgaacgtgcgtgcttgtctttgataagttgtctcatcgttgtttattttcgtataagcaatgtttttcgatacttggttttgggatcttgtgtatctaatgtttcatcattgttctttcttctttgtataatgggcaaagtgttatgaa

SEQ ID NO: 5651 - protein, 331 aa, Brassica napus
MSNVTADPTADGPSTAVAVSNSTAIQTSPPTDRPVRVYADGIYDLFHFGHARSLEQAKKSFPNTYLLVGCCNDETTHKYKGRTVMTAEERYESLRHCKWVDEVIPDAPWVINQEFLDNHRIDYVAHDSLPYADTSGAGKDVYEFVKKVGRFKETMRTEGISTSDIIMRIVKDYNQYVMRNLDRGYSREDLGVSFVKEKRLRVNMRLKKLQERVKEQQEKVGEKIQTVKMLRNEWVENADRWVAGFLEIFEEGCHKMGTAIRDRIQERLIRQIPRNRLENGQDDDTDDQFYEEYFDHDMGSDEDEEERYYDEEEDVEEEKYKTVKPDAKDDK

SEQ ID NO: 5652 - DNA, 1382 bp, Brassica napus
  CDS (34)..(1023)
aacaagggacgcgggtgatcgatcggagagaatatgagcaacgtcaccgccgatccaactaccgacggaccttccaccgccgtcgcagtctccggctctgcagcaatccaggcttcgcctcctaccgatcgtcccgtccgcgtctacgccgacgggatctacgatctcttccactttggccacgctcgatctctcgaacaggccaagaaatcgtttccaaacacttaccttcttgtgggatgttgcaacgatgagactactcataagtacaagggaaggactgttatgactgctgaagagcgttatgaatcacttcgtcactgcaagtgggtggatgaagtcattcccgatgcaccgtgggtgatcaaccaagagtttcttgataaccaccggattgactacgttgcccatgattcccttccgtatgcagacaccagcggagctggaaaggatgtctatgaatttgttaagaaagttgggaggtttaaggaaacaatgcgaactgaagggatatcgacctcggacattatcatgagaatagtgaaagattataaccagtatgttatgcgtaacctggatagaggttattcaagggaagatcttggtgttagctttgtcaaggaaaagagacttagagttaatatgaggcttaagaaactccaggagagagtcaaagaacagcaagaaaaagtgggagaaaagattcaaactgtaaaaatgctgcgcaacgagtgggtagagaatgcagatcgatgggtcgctggatttctggaaatatttgaagaaggttgccataagatggggactgcaatcagagacagtatccaagagaggttaatcagacaaattcccagaaagaagctggagaacggtgaggatgatgatacagacgatcagttctatgaagaatatttcgaccatgacatgggcagtgacgaggatgaagatgaacgatactatgacgaagaggaagatgttgaagaagagaaaagtgttaagaaggatgcacaagacaacaagtaagatcattattctcatgatcacttctactaaactcccttagtgtctcactcttatctcccttagtgtctcactctctcctctctcagtaatacgcgtctacttaacatataatatcaaatgtttagaaagggagagctaagtgagcgtgtttgtgatgtgtgttttaaaaaatcgaacgtgcgtgcttgtctttagtaagttgtctcatcgttgttgatttttgtatgcgcatgatttctctttaatttggatacttggtgtcttgtgcatcttttatttcatagtttttcttatctttgtataacaggcaaagtgttatgaataatgcaatggtgtgaaacaagaaaaaaaaaaaaaaa

SEQ ID NO: 5653 - protein, 329 aa, Brassica napus
MSNVTADPTTDGPSTAVAVSGSAAIQASPPTDRPVRVYADGIYDLFHFGHARSLEQAKKSFPNTYLLVGCCNDETTHKYKGRTVMTAEERYESLRHCKWVDEVIPDAPWVINQEFLDNHRIDYVAHDSLPYADTSGAGKDVYEFVKKVGRFKETMRTEGISTSDIIMRIVKDYNQYVMRNLDRGYSREDLGVSFVKEKRLRVNMRLKKLQERVKEQQEKVGEKIQTVKMLRNEWVENADRWVAGFLEIFEEGCHKMGTAIRDSIQERLIRQIPRKKLENGEDDDTDDQFYEEYFDHDMGSDEDEDERYYDEEEDVEEEKSVKKDAQDNK

SEQ ID NO: 5654 - DNA, 1099 bp, Brassica napus
  CDS (9)..(983)
tctaaagtatgactaacgtcaccggagatcgcaacggagacggacgttcaaccgccgtcacggagagttcgcctccgtctgatcctccaatccgtgtctacgctgatgggatctacgatctgttccatttcggccacgctcgatctctcgaacaggctaagaaatcgtttccaaacacttaccttcttgtgggatgctgcaacgacgatactactcataagtacaagggaaagactgtgatgaatgatcaagaacgatatgaatctcttcgacattgcaaatgggtggatgaagttatccctgatgcaccgtgggtgatcaaccaagagtttcttgacaaacaccgtattgcctatgtggcccatgatgctcttccgtatgctgatgctagtggagctggaaaagatgtctatgagttcgtcaaaaaagtagggaggttcaaggagactaagcgaactgaagggatatctacttcggatataataatgaggatagtgaaagattataatcagtatgtcatgcgtaaccttgacaggggatattcaagggaggatcttggagttagctttgtcaaaagacttagagttaatatgaggttgaagaaacttcaggagaaggtcaaagaacaacaagaaaaagttggggaaaagatccaaactgtgaaaatggtacgtaatgagtgggtggagaatgcagatcgttgggtagctggattccttgaaatgtttgaagaaggctgccataagatgggaactgccatcagagaccgaatccaagagaagttaatgagacaggagtccaaagagttgctcgagaagggtcaaaacggtcagcgtgaagacacggaggaacagttctacgaagaatatttcgagcatgacattgttgacagctgtgaagacaatgaagacgatgaagaagagtactatgacgagattgaagagcaatgtagtagtgcctcaaaagctttaaaaagtaactagatcgaggaacaaaaaatttatgttgttttagtgccctattgttcactgcttttgcagtaaaaatgcttatcaacatgacttattagttagctataagagtttagtaaacgtttgtg

SEQ ID NO: 5655 - protein, 324 aa, Brassica napus
MTNVTGDRNGDGRSTAVTESSPPSDPPIRVYADGIYDLFHFGHARSLEQAKKSFPNTYLLVGCCNDDTTHKYKGKTVMNDQERYESLRHCKWVDEVIPDAPWVINQEFLDKHRIAYVAHDALPYADASGAGKDVYEFVKKVGRFKETKRTEGISTSDIIMRIVKDYNQYVMRNLDRGYSREDLGVSFVKRLRVNMRLKKLQEKVKEQQEKVGEKIQTVKMVRNEWVENADRWVAGFLEMFEEGCHKMGTAIRDRIQEKLMRQESKELLEKGQNGQREDTEEQFYEEYFEHDIVDSCEDNEDDEEEYYDEIEEQCSSASKALKSN

SEQ ID NO: 5656 - DNA, 1196 bp, Brassica napus
  CDS (39)..(1019)
gatcgcacctttgtgaatttcgcaacctaccggaagttatgactaacgtcaccggagatcgcaacggagacggacgttcaaccgccgtcacggagagttcgcctccgtctgatcctccaatccgtgtctacgctgatgggatctacgatctgttccatttcggccacgctcgatctctcgaacaggctaagaaatcgtttccaaacacttaccttcttgtgggatgctgcaacgacgatactactcataagtacaagggaaagactgtgatgaatgatcaagaacgatatgaatctcttcgacattgcaaatgggtggatgaagttatccctgatgcaccgtgggtgatcaaccaagagtttcttgacaaacaccgtattgcctatgtggcccatgatgctcttccgtatgctgatgctagtggagctggaaaagatgtctatgagttcgtcaaaaaagtagggaggttcaaggagactaagcgaactgaagggatatctacttcggatataataatgaggatagtgaaagattataatcagtatgtcatgcgtaaccttgacaggggatattcaagggaggatcttggagttagctttgtcaaagagaagagacttagagttaatatgaggttgaagaaacttcaggagaaggtcaaagaacaacaagaaaaagttggggaaaagatccaaactgtgaaaatggtacgtaatgagtgggtggagaatgcagatcgttgggtagctggattccttgaaatgtttgaagaaggctgccataagatgggaactgccatcagagaccgaatccaagagaagttaatgagacaggagtccaaagagttgctcgagaagggtcaaaacggtcagcgtgaagacacggaggaacagttctacgaagaatatttcgagcatgacattgttgacagctgtgaagacaatgaagacgatgaagaagagtactatgacgagattgaagagcaatgtagtagtgcctcaaaagctttaaaaagtaactagatcgaggaacaaaaaatttatgttgttttagtgccctattgttcactgcttttgcagtaaaaatgcttatcaacatgacttattagttagctataagagtttagtaaacgtttgtgtgatctttttttatacacatcatccttttgctgccccctttttattagatttttgtttttt

SEQ ID NO: 5657 - protein, 326 aa, Brassica napus
MTNVTGDRNGDGRSTAVTESSPPSDPPIRVYADGIYDLFHFGHARSLEQAKKSFPNTYLLVGCCNDDTTHKYKGKTVMNDQERYESLRHCKWVDEVIPDAPWVINQEFLDKHRIAYVAHDALPYADASGAGKDVYEFVKKVGRFKETKRTEGISTSDIIMRIVKDYNQYVMRNLDRGYSREDLGVSFVKEKRLRVNMRLKKLQEKVKEQQEKVGEKIQTVKMVRNEWVENADRWVAGFLEMFEEGCHKMGTAIRDRIQEKLMRQESKELLEKGQNGQREDTEEQFYEEYFEHDIVDSCEDNEDDEEEYYDEIEEQCSSASKALKSN

SEQ ID NO: 5658 - DNA, 1157 bp, Arabidopsis thaliana
  CDS (63)..(980)
gaaacattttaacaaacccaaacccaaaaattctcaaggaggccgaagaagaagaagaagaaatgagcgttaatggtgagaacaaggtctcaggaggagatagttcatcttcagatcgacctgttagagtctacgccgatgggatcttcgatttgttccatttcggccacgctcgtgccatcgaacaagccaaaaaatcgtttccgaatacgtatctgcttgttggatgttgcaatgacgaaattacgaacaaattcaaggggaaaactgtgatgactgaatctgagcgatacgaatctcttcgacattgcaagtgggttgatgaagtgattccagatgcaccatgggttcttacaacagagtttcttgataagcataagatagattacgtagctcacgatgctcttccctatgcggatactagtggagctggaaatgatgtttatgagtttgtaaagtcgattgggaagtttaaggagactaaacgaacagaggggatatcgacatctgatataatcatgagaatagtgaaagattataaccagtatgtgttgcgtaatctggaccgaggttattcaagagaagaactcggtgtcagcttcgttaaggagaagaggcttagagtgaatatgagattgaagaaactacaagagaaagttaaagaacaacaagaaaagatacaaaccgtagcaaaaactgctgggatgcaccatgatgagtggcttgaaaatgctgatcgttgggtggctggatttcttgaaatgtttgaggaaggttgtcataaaatgggaacagccatcagagatgggattcagcaacggctaatgaggcaagaatcggaagagaaccggcgattgcttcaaaatggactgacgatttccaaagacaatgacgatgaacaaatgtctgatgacaacgagtttgcagaagaagactgcgtcaatgtgagcaacaaagggattgaaacagtaaagaaatgagagattttgggtcatggttgaagtatttccagatacagaaccaaaatctactagatttcaccagtaatggtattaggcttgtttattcaactgtacatcaaactctgtttcaaaatctctacttgtgtctaaaactcaaatgcatcagaaatcaaaagcagtcatggaaaaaaaaaa

SEQ ID NO: 5659 - protein, 305 aa, Arabidopsis thaliana
MSVNGENKVSGGDSSSSDRPVRVYADGIFDLFHFGHARAIEQAKKSFPNTYLLVGCCNDEITNKFKGKTVMTESERYESLRHCKWVDEVIPDAPWVLTTEFLDKHKIDYVAHDALPYADTSGAGNDVYEFVKSIGKFKETKRTEGISTSDIIMRIVKDYNQYVLRNLDRGYSREELGVSFVKEKRLRVNMRLKKLQEKVKEQQEKIQTVAKTAGMHHDEWLENADRWVAGFLEMFEEGCHKMGTAIRDGIQQRLMRQESEENRRLLQNGLTISKDNDDEQMSDDNEFAEEDCVNVSNKGIETVKK

SEQ ID NO: 5660 - DNA, 23 bp, Artificial sequence
  primer
atggcaaacccaacaacagggaa

SEQ ID NO: 5661 - DNA, 25 bp, Artificial sequence
  primer
tcagttcgctgattgtttcttcttc

SEQ ID NO: 5662 - protein, 169 aa, Artificial sequence
  consensus sequence
  Variant (3)..(3): Xaa in position 3 is any amino acid
  Variant (5)..(5): Xaa in position 5 is any amino acid
  Variant (10)..(11): Xaa in position 10 to 11 is any amino acid
  Variant (16)..(16): Xaa in position 16 is any amino acid
  Variant (19)..(21): Xaa in position 19 to 21 is any amino acid
  Variant (25)..(25): Xaa in position 25 is any amino acid
  Variant (28)..(28): Xaa in position 28 is any amino acid
  Variant (32)..(33): Xaa in position 32 to 33 is any amino acid
  Variant (34)..(34): Xaa in position 34 is any or no amino acid
  Variant (36)..(37): Xaa in position 36 to 37 is any amino acid
  Variant (39)..(41): Xaa in position 39 to 41 is any amino acid
  Variant (43)..(44): Xaa in position 43 to 44 is any amino acid
  Variant (48)..(48): Xaa in position 48 is any amino acid
  Variant (51)..(51): Xaa in position 51 is any amino acid
  Variant (54)..(58): Xaa in position 54 to 58 is any amino acid
  Variant (60)..(60): Xaa in position 60 is any amino acid
  Variant (62)..(62): Xaa in position 62 is any amino acid
  Variant (64)..(64): Xaa in position 64 is any amino acid
  Variant (73)..(75): Xaa in position 73 to 75 is any amino acid
  Variant (79)..(82): Xaa in position 79 to 82 is any amino acid
  Variant (86)..(87): Xaa in position 86 to 87 is any amino acid
  Variant (89)..(89): Xaa in position 89 is any amino acid
  Variant (97)..(98): Xaa in position 97 to 98 is any amino acid
  Variant (101)..(106): Xaa in position 101 to 106 is any amino acid
  Variant (107)..(108): Xaa in position 107 to 108 is any or no amino acid
  Variant (110)..(110): Xaa in position 110 is any amino acid
  Variant (112)..(114): Xaa in position 112 to 114 is any amino acid
  Variant (116)..(117): Xaa in position 116 to 117 is any amino acid
  Variant (119)..(119): Xaa in position 119 is any amino acid
  Variant (121)..(122): Xaa in position 121 to 122 is any amino acid
  Variant (124)..(124): Xaa in position 124 is any amino acid
  Variant (127)..(127): Xaa in position 127 is any amino acid
  Variant (129)..(129): Xaa in position 129 is any amino acid
  Variant (136)..(137): Xaa in position 136 to 137 is any amino acid
  Variant (139)..(140): Xaa in position 139 to 140 is any amino acid
  Variant (143)..(144): Xaa in position 143 to 144 is any amino acid
  Variant (146)..(147): Xaa in position 146 to 147 is any amino acid
  Variant (150)..(151): Xaa in position 150 to 151 is any amino acid
  Variant (154)..(155): Xaa in position 154 to 155 is any amino acid
  Variant (157)..(158): Xaa in position 157 to 158 is any amino acid
  Variant (160)..(160): Xaa in position 160 is any amino acid
  Variant (163)..(164): Xaa in position 163 to 164 is any amino acid
  Variant (166)..(166): Xaa in position 166 is any amino acid
  Variant (167)..(168): Xaa in position 167 to 168 is any or no amino acid
RPXRXYADGXXDLFHXGHXXXLEQXKKXFPNXXXLXXGXXXDXXTHKXKGXTVXXXXXRXEXLXHCKWVDEVXXXAPWXXXXEFLXXHXIDYVAHDXXPYXXXXXXXXDXYXXXKXXGXFXXTXRTXGXSTSDIIXXIXXDYXXYXXRNXXRGXXRXXLXVSXXKXXXL

SEQ ID NO: 5663 - protein, 61 aa, Artificial sequence
  protein pattern
  Variant (2)..(2): Xaa in position 2 is any amino acid
  Variant (3)..(3): Xaa in position 3 is Cys, Pro or Thr
  Variant (4)..(4): Xaa in position 4 is Gly, Asn or Ser
  Variant (6)..(7): Xaa in position 6 to 7 is any amino acid
  Variant (10)..(11): Xaa in position 10 to 11 is any or no amino acid
  Variant (13)..(14): Xaa in position 13 to 14 is any or no amino acid
  Variant (16)..(16): Xaa in position 16 is any amino acid
  Variant (19)..(19): Xaa in position 19 is Leu or Met
  Variant (20)..(20): Xaa in position 20 is Asn, Ser or Thr
  Variant (21)..(21): Xaa in position 21 is Ala, Asp, Glu or Gly
  Variant (22)..(22): Xaa in position 22 is any amino acid
  Variant (23)..(23): Xaa in position 23 is Glu or Gln
  Variant (25)..(25): Xaa in position 25 is any amino acid
  Variant (27)..(27): Xaa in position 27 is Ala, Ser or Thr
  Variant (28)..(28): Xaa in position 28 is Leu or Val
  Variant (29)..(29): Xaa in position 29 is any amino acid
  Variant (32)..(32): Xaa in position 32 is Lys or Arg
  Variant (38)..(38): Xaa in position 38 is Phe, Ile, Leu or Val
  Variant (39)..(39): Xaa in position 39 is Glu or Pro
  Variant (40)..(40): Xaa in position 40 is Asp or Asn
  Variant (41)..(41): Xaa in position 41 is Ala, Cys or Val
  Variant (44)..(44): Xaa in position 44 is any amino acid
  Variant (45)..(45): Xaa in position 45 is Ile or Val
  Variant (46)..(46): Xaa in position 46 is Asn or Thr
  Variant (47)..(47): Xaa in position 47 is any amino acid
  Variant (48)..(48): Xaa in position 48 is Asp, Glu or Lys
  Variant (50)..(50): Xaa in position 50 is Ile, Leu or Met
  Variant (51)..(54): Xaa in position 51 to 54 is any amino acid
  Variant (55)..(55): Xaa in position 55 is Ile or Leu
  Variant (56)..(56): Xaa in position 56 is Ala or Asp
  Variant (57)..(57): Xaa in position 57 is Phe or Tyr
GXXXDXXTHXXKXXGXTVXXXXXRXEXXXHCXWVDEVXXXXPWXXXXXFXXXXXXXXVAHD

SEQ ID NO: 5664 - protein, 59 aa, Artificial sequence
  protein pattern
  Variant (2)..(4): Xaa in position 2 to 4 is any amino acid
  Variant (5)..(5): Xaa in position 5 is any or no amino acid
  Variant (7)..(7): Xaa in position 7 is any amino acid
  Variant (8)..(8): Xaa in position 8 is any or no amino acid
  Variant (10)..(10): Xaa in position 10 is any amino acid
  Variant (12)..(13): Xaa in position 12 to 13 is any amino acid
  Variant (15)..(15): Xaa in position 15 is any amino acid
  Variant (18)..(18): Xaa in position 18 is Asp, Glu or Asn
  Variant (20)..(20): Xaa in position 20 is Ile or Val
  Variant (25)..(25): Xaa in position 25 is Ile or Leu
  Variant (27)..(27): Xaa in position 27 is any amino acid
  Variant (28)..(28): Xaa in position 28 is Lys or Arg
  Variant (30)..(30): Xaa in position 30 is Ile, Leu or Val
  Variant (31)..(31): Xaa in position 31 is Lys or Arg
  Variant (34)..(34): Xaa in position 34 is Asp or Asn
  Variant (35)..(35): Xaa in position 35 is any amino acid
  Variant (37)..(37): Xaa in position 37 is Ile, Leu or Val
  Variant (38)..(38): Xaa in position 38 is Leu or Met
  Variant (41)..(41): Xaa in position 41 is Phe or Leu
  Variant (42)..(42): Xaa in position 42 is Ala, Asp, Ser or Thr
  Variant (45)..(45): Xaa in position 45 is any amino acid
  Variant (46)..(46): Xaa in position 46 is Asn, Ser or Thr
  Variant (48)..(48): Xaa in position 48 is any amino acid
  Variant (49)..(49): Xaa in position 49 is Asp or Glu
  Variant (51)..(51): Xaa in position 51 is Gly or Asn
  Variant (54)..(54): Xaa in position 54 is any amino acid
  Variant (55)..(55): Xaa in position 55 is Phe, Leu or Val
  Variant (57)..(58): Xaa in position 57 to 58 is any amino acid
  Variant (59)..(59): Xaa in position 59 is Glu, Gln or Arg
YXXXXKXXGXFXXTXRTXGXSTSDXIXXIXXDYXXYXXRNXXRGXXRXXLXVSXXKXXX

SEQ ID NO: 5665 - protein, 41 aa, Artificial sequence
  protein pattern
  Variant (2)..(3): Xaa in position 2 to 3 is any amino acid
  Variant (4)..(6): Xaa in position 4 to 6 is any or no amino acid
  Variant (8)..(8): Xaa in position 8 is any amino acid
  Variant (9)..(9): Xaa in position 9 is any or no amino acid
  Variant (11)..(11): Xaa in position 11 is Ile or Val
  Variant (16)..(16): Xaa in position 16 is Ile or Val
  Variant (17)..(17): Xaa in position 17 is Phe or Tyr
  Variant (22)..(22): Xaa in position 22 is Phe, Ile, Leu or Val
  Variant (25)..(25): Xaa in position 25 is any amino acid
  Variant (26)..(26): Xaa in position 26 is Lys or Arg
  Variant (27)..(27): Xaa in position 27 is Ala, Gln or Ser
  Variant (31)..(31): Xaa in position 31 is Ala, Cys or Ser
  Variant (33)..(34): Xaa in position 33 to 34 is any amino acid
  Variant (37)..(37): Xaa in position 37 is Asp or Asn
  Variant (38)..(38): Xaa in position 38 is Ala, Asn, Thr or Val
  Variant (39)..(40): Xaa in position 39 to 40 is any amino acid
  Variant (41)..(41): Xaa in position 41 is Ile, Leu or Val
PXXXXXPXXRXYADGXXDLFHXGHXXXLEQXKXXFPXXXXX

SEQ ID NO: 5666 - DNA, 2106 bp, Saccharomyces cerevisiae
  CDS (1)..(2106)
atgcatgctacaaactggttcgacgattggaacccagaagctctttatagagacgatgtcactggctgcgatgactgttccgaaacttcgccaattccaaagtctggtattatatgtggaccgatattaagactcatcaacatggattttaaggaaaaaacctacgaggggtctattatggtggtagttagaggcgaggaaaactttccgaaaattacctatcagctagggccctctttgccctctgaggatgaagacatcgaagttaacgaggcattcttcgaaggtaaactttttcataaggacattttaaaagatgataatatatggttttacaggtatgagattaagttgcccatgtccaactatgagcagatggtaaaatatgctgttgacggtactatggaaccacattataggttcttcgttccctctttcactcaaaattcgaacgttatctcctattcatgcaacggattttcactgagcgtagatacatcgaaattcaaaggttctctatggtatgatgtccttaaaaagcatcgatacgttcattatcatgccattctcggcggcggagatcaaatttactccgataatattaaactgcatgcgccaaatcttaaagcttggctggagacaaaggacccaattaagaagtataatactcagaccactgaagaaacaaaagagcagattaggcagttttatttagaacactatttaaactggtacggttacggtcactggtatggttctaccccaaaatccaagaccacccaaaaatgctttgtcaagtcactagcttgtattcctgccattaatgtctgggatgaccacgatattattgatggctatggatcgtacaacgattccttcatgaagactgaaaatttcctcacagtgggaagaatggcttaccgatactatatgcttttccagcagcatgtcagtgcttctaaacaagatggcgatgagtatgcttatctcaagagcaaacaatggattctaggtaatgaaaaagggagttcttatatcggtgaaaggtctcactcaatattctcttggttgggtccgaaaatggccatgttagggttggactgtagaactgagaggaaattacacgagattttctcagaaagaagttattccttaatttgggaacgtgtcgaaagggaaataaaaaatttaaaaggtggccacttattgctgatgctcggtatcccgattgcatatccaaggttagtatggttagaatggctttttacctcaaaactactggctccaattaaatatttatctaaaaaagggatatttgctagtggcttcgttaacgaatttaatggagatgtagaactgttggatgatttaaatgatcattggtgcgcgagacatcataaaaaagaaagaaactacttgataatgaaattgcaagacataggtgctaaatatggcgtcagaataaccatattatcaggcgatgtacatttggcatctgttgggagatttagggcaaaaattcatagacaccatctcatcatgtctgaggagaaggaaaaggaaaacaccagaattattgaagaaccaacgaaagacgtaaggctgatttttaatatcattgctagcgccatagtaaataccccaccgccagatgcaatggccacgctattgcaaaaaagatgtcgcttgcatcatttcgatttggaaacggatgaagatgccgtaccaatttttgccaaggaagtggatggagtacataaacgtaaagaatcatgtttcatgaacaagagaaactggtcagatattatacctatagaaaacctgttgaataatccccaattgagtaaagaattaggcgtaaaggttggtgatatagtcattcctggtatcatcacagaacagcaaaagctacagaaattggaaaacgatgaccaaattaactcttatccagtaacttctggtggcttgtttaccaccattcatgttgaaagagatgcaaatcaaacaaactcacaaactgtgagctactgtttacccattccagagttaacagttacctgcgaacggttgtctcacaagggtatcaaacatctgaatatcacatag

SEQ ID NO: 5667 - protein, 701 aa, Saccharomyces cerevisiae
MHATNWFDDWNPEALYRDDVTGCDDCSETSPIPKSGIICGPILRLINMDFKEKTYEGSIMVVVRGEENFPKITYQLGPSLPSEDEDIEVNEAFFEGKLFHKDILKDDNIWFYRYEIKLPMSNYEQMVKYAVDGTMEPHYRFFVPSFTQNSNVISYSCNGFSLSVDTSKFKGSLWYDVLKKHRYVHYHAILGGGDQIYSDNIKLHAPNLKAWLETKDPIKKYNTQTTEETKEQIRQFYLEHYLNWYGYGHWYGSTPKSKTTQKCFVKSLACIPAINVWDDHDIIDGYGSYNDSFMKTENFLTVGRMAYRYYMLFQQHVSASKQDGDEYAYLKSKQWILGNEKGSSYIGERSHSIFSWLGPKMAMLGLDCRTERKLHEIFSERSYSLIWERVEREIKNLKGGHLLLMLGIPIAYPRLVWLEWLFTSKLLAPIKYLSKKGIFASGFVNEFNGDVELLDDLNDHWCARHHKKERNYLIMKLQDIGAKYGVRITILSGDVHLASVGRFRAKIHRHHLIMSEEKEKENTRIIEEPTKDVRLIFNIIASAIVNTPPPDAMATLLQKRCRLHHFDLETDEDAVPIFAKEVDGVHKRKESCFMNKRNWSDIIPIENLLNNPQLSKELGVKVGDIVIPGIITEQQKLQKLENDDQINSYPVTSGGLFTTIHVERDANQTNSQTVSYCLPIPELTVTCERLSHKGIKHLNIT

SEQ ID NO: 5668 - DNA, 2757 bp, Magnaporthe grisea 70-15
  CDS (1)..(2757)
atggcggacccacaggcgactcacgcccacgagcaacacgacgacctcccggccgaagagcagcagcacagaaacccatactcttccgccaaccgatggaggcaccaggagtcgtccaagtttgcgcgccacgccgcggccgcccatgcgcagggctctgcgccccagccgcgcgagcccgagaaccacagcaactcggccgacctcgccgccttcctcaacaagacgcgcataacaccggccgagggtgcggaggccggaggctcatcgcctaaggaccccgagaccaagttcactcccatcgtcgttggcgccgccgaggcgcgcaaggaggcgggcaccgcggaccaccccgatgtattcaccagccagcctgagcccaagggtgacggcaaggaggttgcctgcgggccgctgctcaactatcggcgcatggaggccgggcgctggcttggcagtgtcttgattgttacaagaggtggtggaaaggttcagcagcacaccccgacgttggtcatccggaagcttgggccccgggtcgccgcccctaatggagttgtcccagccggcacagaggtagaggctgctgcaaagggaccgtctcaacctgacgacgtcacagatgcagagacggcggaggtttcaaagccagaagctgccaataataccgcgccggcccagactactgttgcggaaagcactcacgacgccccggcgcaacaagaggggtcgcctgtcacggggtactgtctatactcggacccgcgcaacaccttctggcgctttgatattgatgtcccagtcgagagtgaggagatgaggtgggagtatactctgcctggcttgcacttcatcagcaagaccaagccccaaaggagcatctttcatgtcccggcagcatccgagtcgatgcgcatcatgttccattcatgcaacggtttcagcgtggggaccgatgaggaggcatggagcggtccggcgctgtggaacgacgttctccgtgttcacgaggaaaggccattccacgttatgattggcggcggtgatcagatctacaatgacggaatccgtgtggacggaccgcttcgcaagtggacggatatcggtaacccgaagaagcgccgtgatcatccataccccgagagcctgcgccaggaatgtgacgattactacctcaaaaactacatccgatggggtatcggtggcacagcccacaaatactatcttttgttccagcaccatctaccgcctcccgcatcaacatacacatccgatgtcgccgctgtcgagagggcacctgagggcggggtccaagatcccaaccaacttatggacacttacgtggcgccacgcatgactgaatcacaatacatcgtgggaaacaagcctgggccctatgtagccgaacactcgcacaacatgtattcacgtctgggtgcacgaatggcctttgtcggcatcgatgctcggacggagagaacaaggcaccaggtcaactacccagagacatacgacttgatctttagtcgcttgcgagaagagttgagcgccgccaagcaacagggccaacccattcggcacttgatagtgcttctgggtatccccatcgcctatccgcgtctcacctggcttgagaacgtcttctccagcccatttcttggcccgctcaagttgctgaacaggcggttcgggtttggaggtggcttcttcaatcattttgacggcagtgttgacctgctggatgatttggatgaccactacacggcgcgaacacacaagcgagaacgaaacagcctcattgagcggctgcagggtgtttgcgccgaacactctgtccgcgccaccatcttgggcggcgacgttcacctggcggcattcggtcgcttctactccaacccgaagctcgggatccccattgagaatgatcacaggtacattcctaatgtgatctcgtcagccattgtcaacaaacctcccccggcagcggtcgcaaatctacttgcacgccgcaacaagatccaccatttgaaccgcgacacagacgagacgctgttgaagttgttcgacaaggacccgggcgagtccagcaagacagccgggcacaacaatgtgaccatgcccagtcgcaactttgcaatcatcactgagaactcggccaacaatgggagccatcaacaagccgcgggatcgggagctacacacctcgctcccccgggggctgcgaatggcacaaatggcacaaacgccagtgctgccaacggaaacacgagcaatacccacttggctcctccgggatcgtccgctggtgctagcgccatcacctcggcagcttcgtcggtccgctcgcaggtccccggcaaggacgggcactacccgatcagtgcaggcgagacgggatgcggtacgacccaccgcgccgcgacggcaaagcacggcacggcgacggacggcagcctggacgtctgcatccgcgtcgagattgacaactcggacaagaagggcaccacgcagtcgtacggcctctcgatcccggtcctcgactttgacgcggcgcagcccgcgcacaggaggacgctggccgaggctgccaaggctgccgtctcggccggccatacggacacggcggcggacggcaagcagaagaccgaaaagggcgctttggctggacagatcaacgggaacggacaggctgccgatggggccgccgctgcggggagcgctccggtcgctgctgtgaatggtcacaagacgcagtag

SEQ ID NO: 5669 - protein, 918 aa, Magnaporthe grisea 70-15
MADPQATHAHEQHDDLPAEEQQHRNPYSSANRWRHQESSKFARHAAAAHAQGSAPQPREPENHSNSADLAAFLNKTRITPAEGAEAGGSSPKDPETKFTPIVVGAAEARKEAGTADHPDVFTSQPEPKGDGKEVACGPLLNYRRMEAGRWLGSVLIVTRGGGKVQQHTPTLVIRKLGPRVAAPNGVVPAGTEVEAAAKGPSQPDDVTDAETAEVSKPEAANNTAPAQTTVAESTHDAPAQQEGSPVTGYCLYSDPRNTFWRFDIDVPVESEEMRWEYTLPGLHFISKTKPQRSIFHVPAASESMRIMFHSCNGFSVGTDEEAWSGPALWNDVLRVHEERPFHVMIGGGDQIYNDGIRVDGPLRKWTDIGNPKKRRDHPYPESLRQECDDYYLKNYIRWGIGGTAHKYYLLFQHHLPPPASTYTSDVAAVERAPEGGVQDPNQLMDTYVAPRMTESQYIVGNKPGPYVAEHSHNMYSRLGARMAFVGIDARTERTRHQVNYPETYDLIFSRLREELSAAKQQGQPIRHLIVLLGIPIAYPRLTWLENVFSSPFLGPLKLLNRRFGFGGGFFNHFDGSVDLLDDLDDHYTARTHKRERNSLIERLQGVCAEHSVRATILGGDVHLAAFGRFYSNPKLGIPIENDHRYIPNVISSAIVNKPPPAAVANLLARRNKIHHLNRDTDETLLKLFDKDPGESSKTAGHNNVTMPSRNFAIITENSANNGSHQQAAGSGATHLAPPGAANGTNGTNASAANGNTSNTHLAPPGSSAGASAITSAASSVRSQVPGKDGHYPISAGETGCGTTHRAATAKHGTATDGSLDVCIRVEIDNSDKKGTTQSYGLSIPVLDFDAAQPAHRRTLAEAAKAAVSAGHTDTAADGKQKTEKGALAGQINGNGQAADGAAAAGSAPVAAVNGHKTQ

SEQ ID NO: 5670 - DNA, 2382 bp, Gibberella zeae PH-1
  CDS (1)..(2382)
atgtcggacaccaaagaaagaccagtgaccactgagtcgcaacggaatcctcatgcatcagccagccgttggcgacaccaggagtcatctgcttatgctgcgcatgcttcgcagctcactggcgaaggtccaccccgagaccctcaccaagagaataccgacacgggcggcctcgtaaacttcctcaaccagtcgcgtatcgagccggaagatgaaaaccgcgaaacagaaaaatacaggcccatcactgccgccgcgggcgatgctaatggggcaattgtgggcgacaatgtaggccaaagccatgctgggcaagaccctcctgatggaaagacgattgtttgtggccctctcctgaactatcgccatatgaacgagggacgctggcatggtagtgtgcttgttgtagtggaaggtggtggtaagattcctctacaccagccttacttgacgctcaacctggctgtcactcttccagacggtggtaacgcgaccaacggagcccgcgaggaggtgcgttcagacggacactgcctctactccgacccgcgcaacaccttctgggctttcgacattagtgttccaattcaggacaccgaatgtggctacgactatgctctacccgagatgcgcttctcaagcgagcacaagcctcgggtgaatcgattctttgttcctgccgcaaccgagtcttttcgcatcatgttccactcgtgtaacggtttcagtgtcggaaccgacgaggaggcttggagtggcccagctctgtggaatgatgttacacgaaagcatcgcgaagttccctatcatgttatgattggcggtggtgatcagatctacaacgatgggatccgagttgacggtcctctgcgccaatggaccagcatcagtaaccccaagaagcgaagacatcaccccttccccgagacactacgggctgaatgcgacgactactacctcaagaactacatccgttggtacaacactgagccattttctggtgtcaacggccagattccccagatcaatatttgggatgaccacgacattattgacggattcggctcatatgtcgacgatttcatgcaatgtgatgtgtttcgtggtattggtggtactgcccataaatattacatgctattccagcatcatttgccgccgcctccatcaacatatacttctgaccatgccgcccttgaagaaagcactcagggacctgaccccaatcagcttatcgatacctatgtagcaccaatgattgaatcgcctgagtacattgttggtgaccatcctggcccatatgttgccgaacgctcctttaacatttacacccgcctcggagctcgcatcgctcttattggcatcgacgcacgagtagagcgcacgcgccaccaagtcaattatcctgagacgtataagaagattttctcaagactgcgttcggagctccaagcgacggcagcgtcagggcagccaatcaagcatgtgattctgctcctcgggatccccatcgcctacccgcgtttgacatggcttgaaaacatcttccgcagcccagttatgggtcccatcaagattctcaacaaacgatttggactcggaggaagtctctttaaccaattcgacggtagcattgatcttctggatgacctggatgaccattacactgcgagaacgcacaagaaggaaagacggcagctcatggaggagcttcaaaggatttctgccgagtataacgcccgtgtgacaattcttggaggcgacgtgcatctggctgcactggggcgtttctactccaaccctgacctcaagattcccgtcgaggaggaccaccggtacatggttaacgtcatttcctcagccattgtcaacaagccaccacctcaggctgttgcaaaccttctggccaggaggaacaagattcatcatttgaacgccaagacggacgagactctgctggatctgttcaacaaggaccccggcgagtccaacaagacagccaaccacaacaactgcacaatgcctagccgcaactttgcgaccatcaccgaaaactcgcccaacaaccctcacgttcacaacggcaatgtagatgacaatggaacagagacctcggagcagaacttcttggggaatgacggccacaaggttcttcacaagggcgaagttcaggccggaacaacacatagggcggcatcacgagagacccatggtcgagccaatgatggaacactcgatgtgtgcatcaacgtggaaattgaccagcacgacaaggagggtcgaacagagatgtacggattgactgtgccattactcaactaccgacaaagagatgagccaagcacacccaggacgtcagtcacgtcaggaagccagcagtag

SEQ ID NO: 5671 - protein, 793 aa, Gibberella zeae PH-1
MSDTKERPVTTESQRNPHASASRWRHQESSAYAAHASQLTGEGPPRDPHQENTDTGGLVNFLNQSRIEPEDENRETEKYRPITAAAGDANGAIVGDNVGQSHAGQDPPDGKTIVCGPLLNYRHMNEGRWHGSVLVVVEGGGKIPLHQPYLTLNLAVTLPDGGNATNGAREEVRSDGHCLYSDPRNTFWAFDISVPIQDTECGYDYALPEMRFSSEHKPRVNRFFVPAATESFRIMFHSCNGFSVGTDEEAWSGPALWNDVTRKHREVPYHVMIGGGDQIYNDGIRVDGPLRQWTSISNPKKRRHHPFPETLRAECDDYYLKNYIRWYNTEPFSGVNGQIPQINIWDDHDIIDGFGSYVDDFMQCDVFRGIGGTAHKYYMLFQHHLPPPPSTYTSDHAALEESTQGPDPNQLIDTYVAPMIESPEYIVGDHPGPYVAERSFNIYTRLGARIALIGIDARVERTRHQVNYPETYKKIFSRLRSELQATAASGQPIKHVILLLGIPIAYPRLTWLENIFRSPVMGPIKILNKRFGLGGSLFNQFDGSIDLLDDLDDHYTARTHKKERRQLMEELQRISAEYNARVTILGGDVHLAALGRFYSNPDLKIPVEEDHRYMVNVISSAIVNKPPPQAVANLLARRNKIHHLNAKTDETLLDLFNKDPGESNKTANHNNCTMPSRNFATITENSPNNPHVHNGNVDDNGTETSEQNFLGNDGHKVLHKGEVQAGTTHRAASRETHGRANDGTLDVCINVEIDQHDKEGRTEMYGLTVPLLNYRQRDEPSTPRTSVTSGSQQ

SEQ ID NO: 5672 - DNA, 2106 bp, Candida glabrata CBS 138
  CDS (1)..(2106)
atgacttcagaagacggtgttagcggggactgggatgcgacccagtaccacaagctggtggaaggcgtggatagttgcagtgatacctcgccaattaagcaggacggtgttgtatgcgggccgactttgagactcaagtcgattgactacgagagggatgtctggctggggtctatgctgattgtagttcgggatgcctttgacccttcgtcgccaagagccccaaaggtcacatacgagctcggtggaggctcgcattcaggtgagttccaaggcaagcttttccacaccgattacttcggtgacgacaattccaataagagtgtgttccagttctacaggtacgacattgagctcccattggccgacaatgaagccgagtgtaaatacacagttgccgacaaagctgaagaacactataggtttttcatcccagggagaaatcagaactgtaactctatctcttactcttgcaatgggttttccctctcagttgatacaaccaagttcaagggctcgctgtggtacgatattctgcaaaagcatgctaatgtacactaccatgtaatgcttggcggtggtgatcagatttactcagactctgttaaaatttatagtgaacgtgtcaagaagtggctagagactcatgacccagtgaagaaatacacaatgaaagccgacgaattctttgtcaaagaagtagcaaacttttatttgaaagagtacttggaatggtacggctatggacattggaaaggagctactgaaaaatctaagaccactcagcgctgctttccgattgcaacagcgacgattccatcggttaatatgtgggatgaccatgacattatcgatggtttcggttcttatcccgatcgatttatgagcacaaacgtgtttagttctttgggtaatatcgcctacaagtactatatgctcttccagcatcatgtaagtattgaagaaaagcaagcatacttggaagacaagcattgggtattgagtaaaggaaaaggtgctttcattcagcaacaatctcactcagtattcactaggctaggaccttcaattggtttgttaggattagactgtagaactgaaagaaaactaaaggccattcttccaaagtcgacatatgatattgcatttgagcgtatcacaaaagagcttcaagccaaaaggttcgatcatttgtatttaatgttaggtgtcccaattgcgtatcccaggttggttcttttggaatatattttctcttcaaagcttttggcgccaataaaatatttatcaaaaaaaggtatttttgcgaaaggtttagttaatgaatttaatggtgatgttgaattgcttgatgacttgaacgatcattggtgtgcacactatcacaagaaggagagaaataattttattgcggcattacaagattggggtgccaaatacggtgttagaataacaattttatctggagatgtgcatcttgccgctgttggtagattcagatctaaattgcacagacaccatttgattacctcagaagaaaccaaaaaggaaaacgaggagattcttgatagtgcgcaagaagataataggctgatgtttaatgttatctcaagtgccgttgttaatacaccacctccggatggtatggcaaaactattgcaaaccaaaaatcgtattcataaatttgattatgaaactgatgaagattcggtaccactattcaaaatgaatccggatcaaaaatctaaaagagacgaagattgtttcttgaatggaagaaattggtctgatttaataccagtagaaaatttaatgaaaaacaaatatttagcaaatacatttaaggttgaaaacggagacaaagttctacctggtatggtcaaagaagggctgggttttgaagttaaaaataaaaagcccaaatcggatgaaaacccattgtatcctgtaacaccaaatggaataatggtaactattcatgttgagaaggaccgtaaaagcaatgcatctgagagcaccatgtacagtttccctattcccgaattgacagttaaaggggagaagttgtctcataagggtgcaaagcacttagttgggttccactaa

SEQ ID NO: 5673 - protein, 701 aa, Candida glabrata CBS 138
MTSEDGVSGDWDATQYHKLVEGVDSCSDTSPIKQDGVVCGPTLRLKSIDYERDVWLGSMLIVVRDAFDPSSPRAPKVTYELGGGSHSGEFQGKLFHTDYFGDDNSNKSVFQFYRYDIELPLADNEAECKYTVADKAEEHYRFFIPGRNQNCNSISYSCNGFSLSVDTTKFKGSLWYDILQKHANVHYHVMLGGGDQIYSDSVKIYSERVKKWLETHDPVKKYTMKADEFFVKEVANFYLKEYLEWYGYGHWKGATEKSKTTQRCFPIATATIPSVNMWDDHDIIDGFGSYPDRFMSTNVFSSLGNIAYKYYMLFQHHVSIEEKQAYLEDKHWVLSKGKGAFIQQQSHSVFTRLGPSIGLLGLDCRTERKLKAILPKSTYDIAFERITKELQAKRFDHLYLMLGVPIAYPRLVLLEYIFSSKLLAPIKYLSKKGIFAKGLVNEFNGDVELLDDLNDHWCAHYHKKERNNFIAALQDWGAKYGVRITILSGDVHLAAVGRFRSKLHRHHLITSEETKKENEEILDSAQEDNRLMFNVISSAVVNTPPPDGMAKLLQTKNRIHKFDYETDEDSVPLFKMNPDQKSKRDEDCFLNGRNWSDLIPVENLMKNKYLANTFKVENGDKVLPGMVKEGLGFEVKNKKPKSDENPLYPVTPNGIMVTIHVEKDRKSNASESTMYSFPIPELTVKGEKLSHKGAKHLVGFH

SEQ ID NO: 5674 - DNA, 2085 bp, Kluyveromyces lactis NRRL Y-1140
  CDS (1)..(2085)
atgtccgatgcttccacctggttcaatgaagtggatccccgtgaattatacgctgataaggtcattgggtgcgatgggtgcggtgattctccgttaaatgggaaaaaagatgggattgtttgtggtccgatattacgtctcataaacgttgattatgaaaagaatttgtaccgtgggtcgatgcttatcgttaccaagggtgaagttgctgagccaaaagttgaatttcaagttggccagagtgaggagaagaatttagggtctgaatccaagcatcctaatttggaaacgggccaatttgttgcgacgaaattttattcggagtctgattacagcttctatcgttatgcgattgagatcgagcttgattctgtggaacgtatgtgtaagtattccattgatggtaaattggaacctcagtataggtttttcatcccaagccaaactaccaattttaacacaatttccgtgtcctgtaatgggttttccttgtctgttgatactaccaagttcaaagggtctatgtggtacgatatcttgaggaaacatgcaaacgtccattatcatgtcattttaggtggtggtgaccagatttattctgattccatcaaactttattgtgagagcttccaaaactggctgaaaactagcgacccgatcaagaaatattctacgaaatgttccccggagatgagatctgacatggaccagttttatttgaaagaatatttggaatggttcgggtacggccattggaaggggtctactgaaaattcaaggaccacccagagatgtttcccaattgcaatgtcgactatcccatctattaacatgtttgatgaccacgatatcatcgacgggtacggttcttactctcataaattcatgtttactgacgttttcaaatccgttggtaaatccgcgtacaagtactacatgttattccagcatcatacctctattgaggaacctgaagcatataacaaggaaaaatgttgggtgattggcgctcagccaggtgcgtacatcggcgaaaaatcccattccgtttatactagactcggccccaccatggctgttcttggtatcgattgtagaactgaacgtaaattgaccgagatctgttccaagaaaacctacgatatcctttttgataagttggcacaagatgcgaaactgggcaaattagaccatcttttactcatgctcggtgttccaatcgcttatcccagattagtttggttggagtacatcttctccagcaagttcctcttcatcttcaaatggttatcgaagaaggggatccttgccaagggcttggtgaatgagtttaatggggacgtcgagctattggacgatttgaacgaccattggtgtgcgcattaccataagaaggagagaaactatctcttggctagattacaagacttctcagccaagcaagggatcagagttaccatcctttctggtgatgtccacttggcctctgtcggtagattcaaatccaaggttcatacccaccatatcacttctgcgaaagtcgatcaagacaaaaaagtcttgaacgaacctgaaaaggacgtcagattgatgttgaacgtcatttcaagtgctgtggtaaacacaccaccaccagaccaaatggccaagttgctacaaaaaagagtgaagaaccatcatttcgatgcaagcacggacgaggattcggtgccaatcttcaccactgacgtcgatggcgaaaatcgttccagtaacgccttcatgaaccgtagaaactggtccgatatcatacctgtcacgacggtcctcaagaacaaatatctaaacgaccaatacaaatttgaaatcggtgataagatagtccctggaagagtcggaatcaagacccaaattgacgaaaagactaatattggccacatcccatatccagttaccgaaaagggtattattgcaacaattcatattgaaaaggataccagttctgcagaatcagaaacggtaggttacacaattccaatcccagaactacaagccactgaagaaaacctctcccatgcaggtatcaagcatttagatctagcataa

SEQ ID NO: 5675 - protein, 694 aa, Kluyveromyces lactis NRRL Y-1140
MSDASTWFNEVDPRELYADKVIGCDGCGDSPLNGKKDGIVCGPILRLINVDYEKNLYRGSMLIVTKGEVAEPKVEFQVGQSEEKNLGSESKHPNLETGQFVATKFYSESDYSFYRYAIEIELDSVERMCKYSIDGKLEPQYRFFIPSQTTNFNTISVSCNGFSLSVDTTKFKGSMWYDILRKHANVHYHVILGGGDQIYSDSIKLYCESFQNWLKTSDPIKKYSTKCSPEMRSDMDQFYLKEYLEWFGYGHWKGSTENSRTTQRCFPIAMSTIPSINMFDDHDIIDGYGSYSHKFMFTDVFKSVGKSAYKYYMLFQHHTSIEEPEAYNKEKCWVIGAQPGAYIGEKSHSVYTRLGPTMAVLGIDCRTERKLTEICSKKTYDILFDKLAQDAKLGKLDHLLLMLGVPIAYPRLVWLEYIFSSKFLFIFKWLSKKGILAKGLVNEFNGDVELLDDLNDHWCAHYHKKERNYLLARLQDFSAKQGIRVTILSGDVHLASVGRFKSKVHTHHITSAKVDQDKKVLNEPEKDVRLMLNVISSAVVNTPPPDQMAKLLQKRVKNHHFDASTDEDSVPIFTTDVDGENRSSNAFMNRRNWSDIIPVTTVLKNKYLNDQYKFEIGDKIVPGRVGIKTQIDEKTNIGHIPYPVTEKGIIATIHIEKDTSSAESETVGYTIPIPELQATEENLSHAGIKHLDLA

SEQ ID NO: 5676 - DNA, 2100 bp, Debaryomyces hansenii CBS767
  CDS (1)..(2100)
atgacagttgatgctacgaattggtttgaaccactcccaattgctgattttcaatacattaacaagctgaccggcgaaaatgtgcctaaggaattgccgattggagaaccgattggaggattagacattagatgtggacctattttgaaattagtcggcacattggaggaaaacactaagaactacagagccactatcttgcttgttacaaaagttgagagcaatgatgccgtgcaaccaaagattacgtatcaaattgggccagctgtggatgagggaagcaagcccaccttaacagtaggggaatttccaggaactaatttctttacggaggacggatttcaattctggagatttaatgttgatttgacattggtcgattacgaacaaaagatcaagtattttatcaatgattgttacaaacagtcataccagtttttcgtcccatcgctcgagcagtctatgaatgtgatttcctattcatgtaatgggttttctttgggttgcgatccaaaggagtacaagtcatcactttggtttgatgtcttgcaaaaacatgctaaacaacattaccatgtcatgttaggaggaggggaccagatctactctgattctattaaattgcattccaagaacttgcaaaaatggttcagcgaaagaaatcctatgaagaagagaatgatgaaggtggatgatcaaactattcgtgattttgaaaactactacttgaaccactatatggcgtggtttggtaaaggtttctgggaaggttcgaatggtagaacataccaagccttatttcctatgtccatgtctcaaattccttctgtgaatatctatgatgaccatgatatcatagatggttttggatcgtaccataattctactatgtctcaagactattttaagactgttggtaacgttgcatacaaatattacatgttattccaacaccatatgtcaccccatgagaatattcataattcacctaaagctgagccttcctggattttgtctgatacctcaggtccttacattaatcagaaaaaccattcgaactacgttagattaggtaaggaaattagtttgcttggtttggattgtagaactgaaagaaaattaaatgaaattgtcaaacctgatacgtataagaaggtatttgaacgtttaaagaacgaattcaagaatgcgcctgaggttaagcatttgttagtcatgttaggtgtgcctattctttaccctcgtttagtctggttagaatggatgttaagttcgcctgttttgaaaccaattaaggcattagcagcgaagggcgttattagcaaggggttggtaaatgaatttgatggcggggttgaagtattagatgatttaaacgatcactggtgttctgcaaaccacaagcgtgaaagaaattatttggttaaaaagttggttgattttggtgcgtcacatggtgtcagagtcactatattatcgggtgatgttcacttgtgttgtatcggtagattaaagtctaagatccacacttatccaaacttccatgttttaaccgattaccctgaggacatcgaaaaagaaaatattgatgtccttaagcacccagaattagatccaaggttaattttcaatgttacgtcttcggcaattattaatgctcctccaccagatgcgatggctacattgttgaaaaagagatcaaaaattcatcatttcaatagaaacgcagatgaagatgttgttcccctcttccttcaagacccagatggaaagcctagagaaaatcatcttttcttaaataagcgtaattgggctgatttaatcattgcaaaacaatcgatctacaaagaagaagttgatacagatattcgtaaattccctgctcctatctcagatgctattcaggatacattgaaaaacaaacaaatcgattctactcatgctaaatatcctttgaactcggattcattggtgacaacattacatgttgaagatgatccaaatgattttgaatgtaagactgcaggctacgaagtgttaattccaagattatcttccaaattcaaattagataaggttgatatcaagcacttaaattaa

SEQ ID NO: 5677 - protein, 699 aa, Debaryomyces hansenii CBS767
MTVDATNWFEPLPIADFQYINKLTGENVPKELPIGEPIGGLDIRCGPILKLVGTLEENTKNYRATILLVTKVESNDAVQPKITYQIGPAVDEGSKPTLTVGEFPGTNFFTEDGFQFWRFNVDLTLVDYEQKIKYFINDCYKQSYQFFVPSLEQSMNVISYSCNGFSLGCDPKEYKSSLWFDVLQKHAKQHYHVMLGGGDQIYSDSIKLHSKNLQKWFSERNPMKKRMMKVDDQTIRDFENYYLNHYMAWFGKGFWEGSNGRTYQALFPMSMSQIPSVNIYDDHDIIDGFGSYHNSTMSQDYFKTVGNVAYKYYMLFQHHMSPHENIHNSPKAEPSWILSDTSGPYINQKNHSNYVRLGKEISLLGLDCRTERKLNEIVKPDTYKKVFERLKNEFKNAPEVKHLLVMLGVPILYPRLVWLEWMLSSPVLKPIKALAAKGVISKGLVNEFDGGVEVLDDLNDHWCSANHKRERNYLVKKLVDFGASHGVRVTILSGDVHLCCIGRLKSKIHTYPNFHVLTDYPEDIEKENIDVLKHPELDPRLIFNVTSSAIINAPPPDAMATLLKKRSKIHHFNRNADEDVVPLFLQDPDGKPRENHLFLNKRNWADLIIAKQSIYKEEVDTDIRKFPAPISDAIQDTLKNKQIDSTHAKYPLNSDSLVTTLHVEDDPNDFECKTAGYEVLIPRLSSKFKLDKVDIKHLN

SEQ ID NO: 5678 - DNA, 2211 bp, Candida albicans SC5314
  CDS (1)..(2211): transl_table=12
atgccttcatcaactaacccaacacaaggtaataacaacgacaattggtttaatccaattccaattgacgattattataaaatcaatgaacaagctcgtcagaatgttccaacttcacctcctaatgatgaaacattaggtaattatactattagttgtggaccaattttaagattggctggtacttgggaaaacaataatgatactactgaagatccaaattatcgtggtagtatattattggtaatcaaaaaagatactgatagtactactgcgaatgaaacaggaccagctattacttataaaattggtccttcatcaccatcaactacggttgctctggccaagttttctactggtgaatttcctgggacaaaattttatcaagaaaatgattattcattttatagatattcaattgaattaaccttgacgggaaatgaacaaaaagtggaatatttcattgataatcattttaaacccaatttccaattttatttacctagtaaaactcaatcgatgaatgttatatcttattcatgtaatggattcagtttaggttccgatgccaatgagtataaatcatcattatggttagatgtattaactaaacattctcaacaacattatcatgtcatgttaggtgggggtgatcaaatttattgtgatgccattaaattacatagtgaacgattaaaacaatggacagaaatttctaaccctataaaaaaaaaatcattccccgttgatgatgaaattattgatgaatttaaaaatttttatttaaatcattatttaggttggtttggtaaaggattttggaaggggactaattctacagtattagagtctttattcccattaagtgctgcacaaatcccttgtgttaatatttatgatgatcatgatataattgatggatttggttcttatcatgattctactatgaatgcccccattttcaccgctgtaggtaatattgcttataaatattatatgttatttcaacatcatataaacccggaagaaaaattacatttatcagatccatcatgggtattgggatcaactacaggtccatttattaaacaaaaaaatcattcagtattcatgagattgggtaaagaaatttcattattaggattagattgtcgtactgaaagaaaattaaaacaaattgttaatccatcaacttataatataatttttgatcgattgaaaaaagaacttaccaccactactactgctactactactacaaaacatttattggttatgttgggtgtaccgattttatatcctcgattagtatggttagaaaaagtattaacatcaactgcattaatccccattagaaaattggctcaaaagggtgtcattgccaaaggtttagtcaatgaatttgatggtgatgttgaagttttagatgatttaaatgatcattggtgttctaaacatcataaagcagaaagaaatcgtcttatcaaaagattacaagaatttggtgctgccaatggaattagaatcacgatattatctggtgatgttcatttgggttgtattggaagattaaaatcaaaattccattctcatgctcatgctcatgctcataaattcttacataatgttgaaggtgaccatcaactgacagaaaaattaaataaagatgttattgaaactccagaatatgatccaagattaatatttaatattactagttcagctatagttaatgcaccacctcctgatgctatggcaactttattgaataaaagaagtggtattcatcattttaatcgtgatactgatgaagatattgttccattatttattaaaaatcttgatggatcaaatcgtgataataaacaatttttaaatgaaagaaattggagtgatttaattcttgccaaacaatcaattctttataaagatcaatttaccaatgatgatgatgatgatgatgaaaatccaattcgtaaatttcctcaaccagtgcttgataacaaaggtgaagatttattaaaagatcaaactgttgatagcagacatgtgaaatatccattatattcggattctttggtgactacattaagatttgaaaaagataaatctgatttaagtagtccaagtgttggttatgaagttttaattccaaaattatttggtaaatataaattagacccagctccagttaaacacgttgatcaatag

SEQ ID NO: 5679 - protein, 736 aa, Candida albicans SC5314
MPSSTNPTQGNNNDNWFNPIPIDDYYKINEQARQNVPTSPPNDETLGNYTISCGPILRLAGTWENNNDTTEDPNYRGSILLVIKKDTDSTTANETGPAITYKIGPSSPSTTVASAKFSTGEFPGTKFYQENDYSFYRYSIELTLTGNEQKVEYFIDNHFKPNFQFYLPSKTQSMNVISYSCNGFSLGSDANEYKSSLWLDVLTKHSQQHYHVMLGGGDQIYCDAIKLHSERLKQWTEISNPIKKKSFPVDDEIIDEFKNFYLNHYLGWFGKGFWKGTNSTVLESLFPLSAAQIPCVNIYDDHDIIDGFGSYHDSTMNAPIFTAVGNIAYKYYMLFQHHINPEEKLHLSDPSWVLGSTTGPFIKQKNHSVFMRLGKEISLLGLDCRTERKLKQIVNPSTYNIIFDRLKKELTTTTTATTTTKHLLVMLGVPILYPRLVWLEKVLTSTALIPIRKLAQKGVIAKGLVNEFDGDVEVLDDLNDHWCSKHHKAERNRLIKRLQEFGAANGIRITILSGDVHLGCIGRLKSKFHSHAHAHAHKFLHNVEGDHQSTEKLNKDVIETPEYDPRLIFNITSSAIVNAPPPDAMATLLNKRSGIHHFNRDTDEDIVPLFIKNLDGSNRDNKQFLNERNWSDLILAKQSILYKDQFTNDDDDDDENPIRKFPQPVLDNKGEDLLKDQTVDSRHVKYPLYSDSLVTTLRFEKDKSDLSSPSVGYEVLIPKLFGKYKLDPAPVKHVDQ

SEQ ID NO: 5680 - DNA, 2028 bp, Ustilago maydis 521
  CDS (1)..(2028)
atgattgatatccgtgatcacgagaaccatccgatctctccaaaacagaaagcatatctgaagcctttcttagaaattcaattgccccctgcttcttctctcgctctcgccgccaggtccatcggaatcaccaactcgttcgaaaagatgacgacgctcaacgtcaaagcggggcctatgctccgatacgataacgtcgatcttggcacaggtatttaccatgcctacgccatgattgtcaccgaagatgccaccagtgactacaatctcacccccacccttcagtatcgatgggagaatgcttccggtgtctcggcggctgccgatggtaccaccgccgtctccgaagccgactctcacaaccactctgaggccatcaagctccaccaataccaaggtcaggagggctcttttaccttttggcgcttcaaaattgaggttcccttggccgatagcgagttggcggttcactactcgattgacggcgaaccgcaccccaattcgcagtccgaagccatcaagggcatgactggccacaccttcttcgttccctccaagacggacaacttccgatgggctggtcacagctgcaatggtttcagctctggtgtcgaccaggctgagttcaacggccccaaccctctctgggacgatttgctcaaggcgcatgctactaagccataccacgccgtcatcggtggtggcgaccagatctactgcgatacgctcgtgcgggagcccgagatgcaggagtggaacaaccagagcgatgcaaagaaacgcatggctatgcctctcaccgacgagattcgcacctgcatcgatcgctacatgttcaaccactactgcgagtggttcggcggtggatcctttgctaagaccatcgcacaaatccccatgatcaacatgctcgacgaccacgacctcatcgacggcttcggtacctaccctgacgaccttatgcgtgcacccgtcttcaaccacgtcggagctcgtggttacttttactttctcctcttccagctgtttgtcaacgacgaggtggacggtgtcagcgagacgtcgcaccccaacaagagcatgctcattggtggcgacggtgtctacatccccttcaagaaccacagtctgctctcttaccttggacccaaacagtggatcctgttggccgactgccgttctgagcgcaagcttgaccaaatctgcagcaaggtcacctaccagcgtctgtttgatgctgttcgcaaactgccacctggtgtcgagcatctaatccttttgctcggtgtgccactcgcctatccgcgaatggtgtttttggaacgcacgctctcgagctctatgaacccgctcatcatgctcgccaagggtctttctcccggcttcaccaacaactttaacggccaagtcgagctgctcgacgatctgggcgaccactggtgtgcgggaccgcacaaacatgagcgcaactggctcgtcgagcgcgttcaggagctggcgctcgagaagcacctccgcgtttcgtacattagcggtgacgtgcatgccgctggtgtcggcgtgttctatggctaccaccagcatgatcccagtctcgacccaaaatactcgcttgccgtcatcacctcggccatcgtcaacacgccacctccacccgctgtcatctcgatgctcaacaagctggctagcaaaaagcatcgttcgcttttctactgcggaactaaggaaaccatggtcccgctcttcgagacggatttggagggtaacaaacagaaggataagtacatcattggcgcacgaaattggtgctctgtagagtatcaacctgcgacggccgagttggagttcgatatccgagtcgagaaggtccgaggtagtggagaaacaaagagctacgctgtcaaggctccagctccgaggtgggatgttgctaagcaccaccatcatcttctgctcacgaaaaactttgataaggatgttgggacgctcaagggtgcaccggacggcgtcacgcatgtcaaagcttga

SEQ ID NO: 5681 - protein, 675 aa, Ustilago maydis 521
MIDIRDHENHPISPKQKAYLKPFLEIQLPPASSLALAARSIGITNSFEKMTTLNVKAGPMLRYDNVDLGTGIYHAYAMIVTEDATSDYNLTPTLQYRWENASGVSAAADGTTAVSEADSHNHSEAIKLHQYQGQEGSFTFWRFKIEVPLADSELAVHYSIDGEPHPNSQSEAIKGMTGHTFFVPSKTDNFRWAGHSCNGFSSGVDQAEFNGPNPLWDDLLKAHATKPYHAVIGGGDQIYCDTLVREPEMQEWNNQSDAKKRMAMPLTDEIRTCIDRYMFNHYCEWFGGGSFAKTIAQIPMINMLDDHDLIDGFGTYPDDLMRAPVFNHVGARGYFYFLLFQLFVNDEVDGVSETSHPNKSMLIGGDGVYIPFKNHSLLSYLGPKQWILLADCRSERKLDQICSKVTYQRLFDAVRKLPPGVEHLILLLGVPLAYPRMVFLERTLSSSMNPLIMLAKGLSPGFTNNFNGQVELLDDLGDHWCAGPHKHERNWLVERVQELALEKHLRVSYISGDVHAAGVGVFYGYHQHDPSLDPKYSLAVITSAIVNTPPPPAVISMLNKLASKKHRSLFYCGTKETMVPLFETDLEGNKQKDKYIIGARNWCSVEYQPATAELEFDIRVEKVRGSGETKSYAVKAPAPRWDVAKHHHHLLLTKNFDKDVGTLKGAPDGVTHVKA

SEQ ID NO: 5682 - DNA, 2337 bp, Cryptococcus neoformans var. neoformans B-3501A
  CDS (1)..(2337)
atggactacacctctctccgaaccaaacaccgtgcagagcacctcgcacgagacgctgccgcagcatctcatgcctcatactacgcgcacccagcccttcacatccacacatacctcgacaagtcaaagcctgctgtagtgacacaggaaggtaaggttgtcggtgcgctcaacgatccagctcaacctctggcccaatctccggcgcccgaaacgctcggcgaagcaccgcccacaggtgcccctaccaaaccaggagagcatgttcacaatattccgcaagtgaatgccaacaccgacgaagcgagaaaggttggaactgaaggtaccaaggaggaagaaggcggtaaggaagatgccggtgctcctagtgggcttgataaaggtgctttggaggttggcggcgaagcaggagggacaaagacctcccctggccctactgctgaagaggttgctagccatgcccatatgattggtgataaggctaatatggctgcgcttggtgttccaaatggtaggccgggtatggagaggcactggagtgtgagcgggaaaatgcagccgcatttgcagttgatgtgtggacctttattggcgtactacactgtcaaggataatgtctggcaaggtgctgccatggtggtcgtccgcgatgaaggttctgtgcttgatcctccgccatacctcaagctttcattccacccttacacccctccttctgctgaacagcccaccctctatgaaccagagatacagctgcttcctccgactaccattggctcacagaacatcttcacctacaactctccagaaggtaatatgagcttccacagattcatcatggaaatccccctgcaaaagatacaaacggctgtccgatataggttgaatgggggtgccggaatggatttcatcgttcctgccttgggtcaaaacatgcgttgggcagcccacagctgtaatggtttctcatccggtgtcaatcctgacgactttaagggtccgtacccctcaggttacgaccctgtctgggaagacttgctcctaaaacaccaagaaaaggctttccattgtatggttgggggaggggatcagatttactgtgatgctgtaacaagagagcccgagttacagagctggattaatgcgcccactaggaagagcaagcttggccaccctttgaccgatgagatgagaatagcaattgatagattttacttcaaccactattgcaagattttcaggagcaatgcctttggtcgtgccaattctactattcctatggtgaacatgcttgatgatcatgatctgatcgatggtttcggaacatatgacgacgaaacgcagagtgccgcagtgatgtcgtttgtggggagccgaggctacttttggttcctcctgtttcaacttttcatttgtgatgcgtttgatggtgtaaacccagtccccggaactcatgccgtcaaatctctcattatcggggacaagaatggtccctggattcctttcccttctcactccctcctcatctacctcggccccaaggtcacccttctggctcttgattgccgtgctgaacgcaagttaactgagatctgtcgaccagagtcgtatgccaaggttttcaacgaggtaaagaaggtgcaagggattgagcagctggtcatccttctgggtgtgcccattgcctacccacgaatgtctttcctggaacacttcctcgaactgaaatggaaccccatcaacatccttgctcgacacaacgccctcggtctaggcagtatggttaacaagttcaaccaagcatccgagcttctcgacgacttgaacgaccactggtgcgcaaacactcacaaaaaggaacgaaattggctagtactcgaatgtcaagaacttgccaaacaactgcacgcgcgtatcacctttttgagtggtgacgttcaccttgcggctgttggatgcttattcacaaagaagaagaagggtgcccaagagttaaaaccggagcaagattggagatacatgttgaacgtgattacgagtgcgattgtcaatacgcctcctcctgcaggcgctgcgaagttggtggccatgctgggcgggcataggcataggactttgcatcacaaggacacagatgaacacatgatgccactttttggaaaagataccgatggctcaaaactcagccgcaaatttgttcagcctcgaagaaattatgcgatagtagaatatacctctcagtccgagctcctctttgacatacgagttgaaaagagtcagggtgcgggtgaaactgtcagttatcccgttactgcgcctgcgcccaagtggtaa

SEQ ID NO: 5683 - protein, 778 aa, Cryptococcus neoformans var. neoformans B-3501A
MDYTSLRTKHRAEHLARDAAAASHASYYAHPALHIHTYLDKSKPAVVTQEGKVVGALNDPAQPLAQSPAPETLGEAPPTGAPTKPGEHVHNIPQVNANTDEARKVGTEGTKEEEGGKEDAGAPSGLDKGALEVGGEAGGTKTSPGPTAEEVASHAHMIGDKANMAALGVPNGRPGMERHWSVSGKMQPHLQLMCGPLLAYYTVKDNVWQGAAMVVVRDEGSVLDPPPYLKLSFHPYTPPSAEQPTLYEPEIQLLPPTTIGSQNIFTYNSPEGNMSFHRFIMEIPLQKIQTAVRYRLNGGAGMDFIVPALGQNMRWAAHSCNGFSSGVNPDDFKGPYPSGYDPVWEDLLLKHQEKAFHCMVGGGDQIYCDAVTREPELQSWINAPTRKSKLGHPLTDEMRIAIDRFYFNHYCKIFRSNAFGRANSTIPMVNMLDDHDLIDGFGTYDDETQSAAVMSFVGSRGYFWFLLFQLFICDAFDGVNPVPGTHAVKSLIIGDKNGPWIPFPSHSLLIYLGPKVTLLALDCRAERKLTEICRPESYAKVFNEVKKVQGIEQLVILLGVPIAYPRMSFLEHFLELKWNPINILARHNALGLGSMVNKFNQASELLDDLNDHWCANTHKKERNWLVLECQELAKQLHARITFLSGDVHLAAVGCLFTKKKKGAQELKPEQDWRYMLNVITSAIVNTPPPAGAAKLVAMLGGHRHRTLHHKDTDEHMMPLFGKDTDGSKLSRKFVQPRRNYAIVEYTSQSELLFDIRVEKSQGAGETVSYPVTAPAPKW

SEQ ID NO: 5684 - DNA, 2280 bp, Phaeosphaeria nodorum
  CDS (1)..(2280)
atggccgaccaacaccccgtccccgagagtgaaccgatcccgcaacaagacgctagcggcgtcactggcattggaaacggaccgcaggtcctcagcacttcaggtggcctcgatgtcattgccggtcctcttctcaactacaggcgcaccagcaaccagcagactggacagccaatttggcatggaagtgtcctgatcgtcaccacacctggacaacagaacccccagctcgtgctgtcaccggctggcgcagtcgacgcgagtgcaggcaatgcggcctttagcgtagaggcgaggacattccacggcgagaagctgtacgaggatcccaagagggcgttctggcgcttcatcatcgaagcccccttccaacagtttgagtcgcgatggcaatacgatatccagaacctggtctacgtcgaccgccagaagctcgagaagccgcaggtcttcgttgtccccgccgcgtcccagtccatgcgcatcatgttccactcctgcaacggcttcagtgtaggcactgacgttgaggcttggtctggcccggcgctctggaacgacgtactccgcatgcacgagcaaaggcctttccacgtcatgattggcggtggcgatcagatttacaacgatggagtgcgtgtggatggaccgttgaaggcctggacggcgattagcaacccgcacaagcgccgcgattatccctttggccggcagatgcgcgacgactgcgatgagtactacttcaacaactatgtgaagtggtatggtcagcgtccgttctcgactgccaacagccagatcgcccaggtcaacatctgggacgaccacgatatcattgatggcttcggctcgtataccgatcacttcatgaagtgcgctgtcttcagaggtattggcggtgttgcgcacaagtactacctactcttccagcaccaccttgctcccccgaagagcacgtacactaccgatgcacccaagacaacggatgtggctgcgcatagcacaactggcactacgcctgccgatcctgtacaggtcaaggacacattcgtcatgacggacgatgtaggcgacccatcatacatcattggacacaagccggggccatacgtcgaggagcgcagtcgcagcatctactgccagcttggcgcccgcattgcctttgctggtattgatgcgagaaccgagcgcactcgtcatcagatcaactatcccgagacctacaaggctctatttgatcgtctggacaaggaatactcagccaacaaggatttgaagcatctcatcttgctgcttggtgttcccatcgcctacccacgtctgatctggttggagaacatccttcagtcgccactcattgcgcccatcaagttcctgaacaagcgctttggtctggctggtagcttcttcaaccagttcgacggcaaagtcgatttgctcgatgacttggacgaccactacacggcgcgccagcacaagactgagcgccgcgagctcatccagatgctccagaacttctctaagaagcactccgctcgcgtgaccatcctcggaggagacgttcatctgggtgccatcggccgcttctactcgaaccccaaacacgccatccccgctgagcaggattggcggtacatccccaacatcatcagctctgccatcaccaacaagccacctccccaggccgttgccaatctccttgcccgccgcaacaaggtccaccacctcgaccacgacacggacgagacgctcctggagatcttcgaccgcgacccaggcctcgactccaacggccagaagatcaacaccaacggcaccacccgcaccgacacgagcctgacaaacggcaacgtcgacctccccggcgacgacaaaatcgacaagaaaacaagcgacaaaaaccacgccaccatgccgtcccgcaactacgccataatctgcgaatctgctactcccccatcagccactctatcagcccccgcgccagcaccaggccaagctccgtccgtcaccagcgcgacttccgcactctccgcgcccccaactaagaaggataatccccgccacccgatccacatcggcgagcagggcgcgggtacgcagcatcctgccgccaatggcctggcgccaacgggtctttgcggaccgtatggattggatgtggctctcagggtggagattagtaatagcgatcgcgagggcaggacggatgggtatggatttagcattcccgggttggtggtgggcgaggggttgaaggagcaggggagtagatggtag

SEQ ID NO: 5685 - protein, 759 aa, Phaeosphaeria nodorum
MADQHPVPESEPIPQQDASGVTGIGNGPQVLSTSGGLDVIAGPLLNYRRTSNQQTGQPIWHGSVLIVTTPGQQNPQLVLSPAGAVDASAGNAAFSVEARTFHGEKLYEDPKRAFWRFIIEAPFQQFESRWQYDIQNLVYVDRQKLEKPQVFVVPAASQSMRIMFHSCNGFSVGTDVEAWSGPALWNDVLRMHEQRPFHVMIGGGDQIYNDGVRVDGPLKAWTAISNPHKRRDYPFGRQMRDDCDEYYFNNYVKWYGQRPFSTANSQIAQVNIWDDHDIIDGFGSYTDHFMKCAVFRGIGGVAHKYYLLFQHHLAPPKSTYTTDAPKTTDVAAHSTTGTTPADPVQVKDTFVMTDDVGDPSYIIGHKPGPYVEERSRSIYCQLGARIAFAGIDARTERTRHQINYPETYKALFDRLDKEYSANKDLKHLILLLGVPIAYPRLIWLENILQSPLIAPIKFLNKRFGLAGSFFNQFDGKVDLLDDLDDHYTARQHKTERRELIQMLQNFSKKHSARVTILGGDVHLGAIGRFYSNPKHAIPAEQDWRYIPNIISSAITNKPPPQAVANLLARRNKVHHLDHDTDETLLEIFDRDPGLDSNGQKINTNGTTRTDTSLTNGNVDLPGDDKIDKKTSDKNHATMPSRNYAIICESATPPSATLSAPAPAPGQAPSVTSATSALSAPPTKKDNPRHPIHIGEQGAGTQHPAANGLAPTGLCGPYGLDVALRVEISNSDREGRTDGYGFSIPGLVVGEGLKEQGSRW

SEQ ID NO: 5686 - DNA, 2184 bp, Aspergillus oryzae
  CDS (1)..(2184)
atgttgctgactttgctcggtggtcgatttgcggaaggtgcagccttcaatggccaatcacgcgattcgaatgcacaaatagatgtaatctgcgggcccttaatcaatttcaagaatatggatgtcaacccgtcctcctcgatctggcgtggaagtgttttgattgtgacaaaacctggtcaaaagcagccacagctcgttttgcgccaggctggacctgtcgaaagcaatgcttcagtcaatgggaatctacccaatagtcaaagcattatgatcgacggtctccgccttttcgaagatccatcgaaagcattttggcgattttcaatctcactacctctcgagtcatatgaagcgtgctgggagtacagcattccgggtttccaatatgcggagggacagggagtaagatcgccttgggatttcgtggtcccgtctataaaccaatccatgcgtctcatgtttcattcctgcaatggcttctctgttgggacggatatggatgcctggatcggtccaaacctgtggaacgatgtcttgcgcgtgcataagcaaaaaccttttcatgcgatgattggtggtggtgaccagctctacaatgatggaatccgcgtcgacggcccattgaaagaatggacctctatctcaaatccccacaagagacgtgcgcacaattttgataataacttgcgagctagatgtgatgagtactattatgaaaattatgtacgatggtattctactgagccattcaaggcggcaaatggacgcatacctcagatcaatatctgggacgatcacgatataatcgatggcttcggttcctacaccgatcacttcatgcgttgttctgtctttcgtggcattggaggcgttgccttcaaatactactgcttgtttcagcatcacgtcgcaccgcccagatcgacctacacgacggatgccccgcagaccatgcatgcagtcaatggaacggcaggagcggatcctcgacagttggagaacacctttatcttggaagatcaggccgaggacgatagctggatagttggaaagcgaccaggcccctatgtagaggagaagagtaggaacttgtacatgcgtctcggtaagcgagtcgccttcatcggtatcgacgcacgcacggaacgcacccgtcatcaggtgaattaccctgatacgtacgatctcatcttttctcgacttgaaaacgaattgaccgcggccaatggtgacatcaagcatctgattgtgcttttgggtgtccccattgcttatccacgccttgcatggctggagaatattctcagctccccaattattgcgccaattcgcttgctcaacaagcggtttgggtttgcaggcggcttgttcaaccaatttgacggtcaggtagacctgcttgatgatctagatgaccactacacagctcgtcagcacaagcgcgagcgcaggttatttattcaacgtcttcaagaatttgccaaggtccattccgttcgtgtttcaatcctaggtggagatgtgcacttggcggctattggacgtttttattcgaaccctaatctcggccttcagagtgtcaacgaccctcgatatatggtcaatgtcattagcagcgcaatcacaaacaagccacctccgaaggcagttgcgaatcttttggcccgaagaaataagctccaccatctcgacccaaatactgatgagactttgatggacctgtttgatcagcagccaggaggtcaggagaagagcgcttcctggaacaaggttacaatgccgtcacgcaactatgcgtgcatcacagaagttgataccccattcgccaatgagggttacccaacacaacagaacgatagtacggtgacaccattgcctagagacggccactctcccctccataagggggagaccaatgctggtgcaagccactctgcggcggatggcttcagcaacaatagcggcatgtacggcggtctggatgtagccattcgcgtagaaatcgacccacaaaaccgggaaggaatcaccgaaggatatggattcagcattcctccattagtatatgatgcaaccaaagacaatgcgcgcccaacttctcaaagtcattccgtacgctcaggatttcaccgcgctgagtcgcgtccccaatctgctcgcccgcagactgctgtcaattaa

SEQ ID NO: 5687 - protein, 727 aa, Aspergillus oryzae
MLLTLLGGRFAEGAAFNGQSRDSNAQIDVICGPLINFKNMDVNPSSSIWRGSVLIVTKPGQKQPQLVLRQAGPVESNASVNGNLPNSQSIMIDGLRLFEDPSKAFWRFSISLPLESYEACWEYSIPGFQYAEGQGVRSPWDFVVPSINQSMRLMFHSCNGFSVGTDMDAWIGPNLWNDVLRVHKQKPFHAMIGGGDQLYNDGIRVDGPLKEWTSISNPHKRRAHNFDNNLRARCDEYYYENYVRWYSTEPFKAANGRIPQINIWDDHDIIDGFGSYTDHFMRCSVFRGIGGVAFKYYCLFQHHVAPPRSTYTTDAPQTMHAVNGTAGADPRQLENTFILEDQAEDDSWIVGKRPGPYVEEKSRNLYMRLGKRVAFIGIDARTERTRHQVNYPDTYDLIFSRLENELTAANGDIKHLIVLLGVPIAYPRLAWLENILSSPIIAPIRLLNKRFGFAGGLFNQFDGQVDLLDDLDDHYTARQHKRERRLFIQRLQEFAKVHSVRVSILGGDVHLAAIGRFYSNPNLGLQSVNDPRYMVNVISSAITNKPPPKAVANLLARRNKLHHLDPNTDETLMDLFDQQPGGQEKSASWNKVTMPSRNYACITEVDTPFANEGYPTQQNDSTVTPLPRDGHSPLHKGETNAGASHSAADGFSNNSGMYGGLDVAIRVEIDPQNREGITEGYGFSIPPLVYDATKDNARPTSQSHSVRSGFHRAESRPQSARPQTAVN

SEQ ID NO: 5688 - DNA, 24 bp, Artificial sequence
  primer
atgcatgctacaaactggttcgac

SEQ ID NO: 5689 - DNA, 26 bp, Artificial sequence
  primer
ctatgtgatattcagatgtttgatac

SEQ ID NO: 5690 - protein, 873 aa, Artificial sequence
  consensus sequence
  Variant (3)..(15): Xaa in position 3 to 15 is any amino acid
  Variant (16)..(38): Xaa in position 16 to 38 is any or no amino acid
  Variant (40)..(43): Xaa in position 40 to 43 is any amino acid
  Variant (45)..(51): Xaa in position 45 to 51 is any amino acid
  Variant (52)..(58): Xaa in position 52 to 58 is any or no amino acid
  Variant (60)..(94): Xaa in position 60 to 94 is any amino acid
  Variant (95)..(148): Xaa in position 95 to 148 is any or no amino acid
  Variant (150)..(150): Xaa in position 150 is any amino acid
  Variant (152)..(153): Xaa in position 152 to 153 is any amino acid
  Variant (155)..(161): Xaa in position 155 to 161 is any amino acid
  Variant (163)..(166): Xaa in position 163 to 166 is any amino acid
  Variant (168)..(176): Xaa in position 168 to 176 is any amino acid
  Variant (177)..(189): Xaa in position 177 to 189 is any or no amino acid
  Variant (191)..(192): Xaa in position 191 to 192 is any amino acid
  Variant (194)..(204): Xaa in position 194 to 204 is any amino acid
  Variant (211)..(213): Xaa in position 211 to 213 is any amino acid
  Variant (215)..(219): Xaa in position 215 to 219 is any amino acid
  Variant (221)..(221): Xaa in position 221 is any amino acid
  Variant (222)..(228): Xaa in position 222 to 228 is any or no amino acid
  Variant (231)..(231): Xaa in position 231 is any amino acid
  Variant (233)..(233): Xaa in position 233 is any amino acid
  Variant (235)..(236): Xaa in position 235 to 236 is any amino acid
  Variant (238)..(242): Xaa in position 238 to 242 is any amino acid
  Variant (244)..(246): Xaa in position 244 to 246 is any amino acid
  Variant (254)..(254): Xaa in position 254 is any amino acid
  Variant (256)..(265): Xaa in position 256 to 265 is any amino acid
  Variant (266)..(266): Xaa in position 266 is any or no amino acid
  Variant (268)..(272): Xaa in position 268 to 272 is any amino acid
  Variant (274)..(274): Xaa in position 274 is any amino acid
  Variant (276)..(292): Xaa in position 276 to 292 is any amino acid
  Variant (294)..(296): Xaa in position 294 to 296 is any amino acid
  Variant (298)..(299): Xaa in position 298 to 299 is any amino acid
  Variant (301)..(305): Xaa in position 301 to 305 is any amino acid
  Variant (306)..(319): Xaa in position 306 to 319 is any or no amino acid
  Variant (321)..(326): Xaa in position 321 to 326 is any amino acid
  Variant (329)..(330): Xaa in position 329 to 330 is any amino acid
  Variant (332)..(333): Xaa in position 332 to 333 is any amino acid
  Variant (338)..(338): Xaa in position 338 is any amino acid
  Variant (342)..(342): Xaa in position 342 is any amino acid
  Variant (344)..(344): Xaa in position 344 is any amino acid
  Variant (346)..(349): Xaa in position 346 to 349 is any amino acid
  Variant (351)..(354): Xaa in position 351 to 354 is any amino acid
  Variant (356)..(357): Xaa in position 356 to 357 is any amino acid
  Variant (358)..(358): Xaa in position 358 is any or no amino acid
  Variant (360)..(361): Xaa in position 360 to 361 is any amino acid
  Variant (363)..(364): Xaa in position 363 to 364 is any amino acid
  Variant (367)..(367): Xaa in position 367 is any amino acid
  Variant (371)..(371): Xaa in position 371 is any amino acid
  Variant (373)..(392): Xaa in position 373 to 392 is any amino acid
  Variant (393)..(427): Xaa in position 393 to 427 is any or no amino acid
  Variant (429)..(441): Xaa in position 429 to 441 is any amino acid
  Variant (442)..(442): Xaa in position 442 is any or no amino acid
  Variant (445)..(450): Xaa in position 445 to 450 is any amino acid
  Variant (452)..(452): Xaa in position 452 is any amino acid
  Variant (454)..(454): Xaa in position 454 is any amino acid
  Variant (456)..(456): Xaa in position 456 is any amino acid
  Variant (459)..(467): Xaa in position 459 to 467 is any amino acid
  Variant (470)..(472): Xaa in position 470 to 472 is any amino acid
  Variant (474)..(483): Xaa in position 474 to 483 is any amino acid
  Variant (484)..(491): Xaa in position 484 to 491 is any or no amino acid
  Variant (494)..(496): Xaa in position 494 to 496 is any amino acid
  Variant (499)..(499): Xaa in position 499 is any amino acid
  Variant (507)..(508): Xaa in position 507 to 508 is any amino acid
  Variant (511)..(514): Xaa in position 511 to 514 is any amino acid
  Variant (516)..(523): Xaa in position 516 to 523 is any amino acid
  Variant (525)..(532): Xaa in position 525 to 532 is any amino acid
  Variant (533)..(535): Xaa in position 533 to 535 is any or no amino acid
  Variant (537)..(537): Xaa in position 537 is any amino acid
  Variant (539)..(539): Xaa in position 539 is any amino acid
  Variant (541)..(541): Xaa in position 541 is any amino acid
  Variant (543)..(543): Xaa in position 543 is any amino acid
  Variant (549)..(549): Xaa in position 549 is any amino acid
  Variant (552)..(553): Xaa in position 552 to 553 is any amino acid
  Variant (555)..(556): Xaa in position 555 to 556 is any amino acid
  Variant (559)..(559): Xaa in position 559 is any amino acid
  Variant (562)..(563): Xaa in position 562 to 563 is any amino acid
  Variant (565)..(567): Xaa in position 565 to 567 is any amino acid
  Variant (570)..(577): Xaa in position 570 to 577 is any amino acid
  Variant (579)..(579): Xaa in position 579 is any amino acid
  Variant (583)..(583): Xaa in position 583 is any amino acid
  Variant (589)..(591): Xaa in position 589 to 591 is any amino acid
  Variant (594)..(604): Xaa in position 594 to 604 is any amino acid
  Variant (605)..(633): Xaa in position 605 to 633 is any or no amino acid
  Variant (635)..(635): Xaa in position 635 is any amino acid
  Variant (637)..(639): Xaa in position 637 to 639 is any amino acid
  Variant (641)..(641): Xaa in position 641 is any amino acid
  Variant (643)..(643): Xaa in position 643 is any amino acid
  Variant (647)..(647): Xaa in position 647 is any amino acid
  Variant (649)..(649): Xaa in position 649 is any amino acid
  Variant (653)..(655): Xaa in position 653 to 655 is any amino acid
  Variant (657)..(657): Xaa in position 657 is any amino acid
  Variant (660)..(665): Xaa in position 660 to 665 is any amino acid
  Variant (668)..(671): Xaa in position 668 to 671 is any amino acid
  Variant (672)..(674): Xaa in position 672 to 674 is any or no amino acid
  Variant (678)..(682): Xaa in position 678 to 682 is any amino acid
  Variant (684)..(700): Xaa in position 684 to 700 is any amino acid
  Variant (701)..(735): Xaa in position 701 to 735 is any or no amino acid
  Variant (738)..(748): Xaa in position 738 to 748 is any amino acid
  Variant (749)..(845): Xaa in position 749 to 845 is any or no amino acid
  Variant (847)..(851): Xaa in position 847 to 851 is any amino acid
  Variant (854)..(865): Xaa in position 854 to 865 is any amino acid
  Variant (867)..(870): Xaa in position 867 to 870 is any amino acid
  Variant (872)..(872): Xaa in position 872 is any amino acid
GPXXXXXXXXXXXXXXXXXXXXXXXXXXXXXXXXXXXXGXXXXVXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXXXXXXXXXXXXXFXRXXIXXXXXXXEXXXXYXXXXXXXXXXXXXXXXXXXXXXFXXPXXXXXXXXXXXSCNGFSXXXDXXXXXGXXXXXXXXLWXDXLXXHXXXXXHXXXGGGDQIYXDXXXXXXXXXXXWXXXXXPXKXXXXXXXXXXXXXXXXXYXXXYXXWXXXXXXXXXXXXXXXXXXXFXXXXXXIPXXNXXDDHDXIDGXGXYXXXXMXXXXFXXXGXXAXXYYXLFQXHXXXXXXXXXXXXXXXXXXXXXXXXXXXXXXXXXXXXXXXXXXXXXXXXXXXXXXXGXXXXXXXXXXXXXXLGXXXXXXGXDXRXERXXXXXXXXXTYXXXFXXXXXXXXXXXXXXXXXXHLXXXLGXPIAYPRLXXLEXXXXSXXXXXXXXLXXXXXXXXXXXNXFXGXVXLLDDLXDHXXAXXHKXERXXLXXXLQXXXXXXXXRXTILXGDVHLXXXGRXXXXXXXXXXXXXXXXXXXXXXXXXXXXXXXXXXXXXXXXDXRXXXNXIXSAIXNXPPPXXXAXLLXXXXXXHHXXXXXXXTDEXXXXXFXXXXXXXXXXXXXXXXXXXXXXXXXXXXXXXXXXXXXXXXXXXXXXXXXXXXRNXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXLXXXXXVEXXXXXXXXXXXXYXXXXPXL

SEQ ID NO: 5691 - protein, 61 aa, Artificial sequence
  protein pattern
  Variant (2)..(2): Xaa in position 2 is any amino acid
  Variant (4)..(4): Xaa in position 4 is Asp or Asn
  Variant (5)..(5): Xaa in position 5 is Gly or Gln
  Variant (6)..(7): Xaa in position 6 to 7 is any amino acid
  Variant (8)..(8): Xaa in position 8 is Asp or Glu
  Variant (14)..(14): Xaa in position 14 is Asp, Gly or Asn
  Variant (17)..(17): Xaa in position 17 is Trp or Tyr
  Variant (18)..(18): Xaa in position 18 is Cys or Thr
  Variant (20)..(21): Xaa in position 20 to 21 is any or no amino acid
  Variant (23)..(24): Xaa in position 23 to 24 is any or no amino acid
  Variant (26)..(26): Xaa in position 26 is any amino acid
  Variant (29)..(29): Xaa in position 29 is Asn or Arg
  Variant (30)..(30): Xaa in position 30 is any amino acid
  Variant (31)..(31): Xaa in position 31 is Phe or Leu
  Variant (32)..(32): Xaa in position 32 is Ile, Leu, Met or Val
  Variant (33)..(35): Xaa in position 33 to 35 is any amino acid
  Variant (37)..(38): Xaa in position 37 to 38 is any amino acid
  Variant (39)..(39): Xaa in position 39 is Ala, Cys, Gly or Ser
  Variant (40)..(43): Xaa in position 40 to 43 is any amino acid
  Variant (44)..(44): Xaa in position 44 is Ala, Ile, Leu or Val
  Variant (46)..(46): Xaa in position 46 is Ala, Ile or Val
  Variant (47)..(47): Xaa in position 47 is Ser or Thr
  Variant (48)..(48): Xaa in position 48 is any amino acid
  Variant (49)..(49): Xaa in position 49 is Ile or Leu
  Variant (50)..(50): Xaa in position 50 is Gly or Ser
  Variant (55)..(55): Xaa in position 55 is Ala or Leu
  Variant (56)..(56): Xaa in position 56 is Ala or Gly
  Variant (57)..(57): Xaa in position 57 is Ala, Gly or Ser
  Variant (58)..(58): Xaa in position 58 is Phe, Ile, Leu or Val
  Variant (60)..(60): Xaa in position 60 is any amino acid
  Variant (61)..(61): Xaa in position 61 is Phe or Leu
NXFXXXXXLLDDLXDHXXAXXHXXKXERXXXXXXXQXXXXXXXXRXXXXXGDVHXXXXGXX

SEQ ID NO: 5692 - protein, 29 aa, Artificial sequence
  protein pattern
  Variant (3)..(3): Xaa in position 3 is any amino acid
  Variant (5)..(5): Xaa in position 5 is Ile, Leu or Val
  Variant (6)..(8): Xaa in position 6 to 8 is any amino acid
  Variant (10)..(13): Xaa in position 10 to 13 is any amino acid
  Variant (14)..(14): Xaa in position 14 is Phe or Tyr
  Variant (16)..(16): Xaa in position 16 is Ala or Val
  Variant (17)..(17): Xaa in position 17 is Ile, Met or Val
  Variant (18)..(18): Xaa in position 18 is Ile or Leu
  Variant (24)..(24): Xaa in position 24 is Ile or Leu
  Variant (26)..(26): Xaa in position 26 is Cys, Asn or Ser
  Variant (28)..(28): Xaa in position 28 is Ala, Gly, Asn, Ser or Thr
  Variant (29)..(29): Xaa in position 29 is Ile, Leu or Val
LWXDXXXXHXXXXXHXXXGGGDQXYXDXX

SEQ ID NO: 5693 - protein, 26 aa, Artificial sequence
  protein pattern
  Variant (2)..(2): Xaa in position 2 is any amino acid
  Variant (3)..(3): Xaa in position 3 is Lys or Arg
  Variant (4)..(6): Xaa in position 4 to 6 is any amino acid
  Variant (7)..(7): Xaa in position 7 is Ala or Asn
  Variant (8)..(8): Xaa in position 8 is Ile or Val
  Variant (9)..(9): Xaa in position 9 is any amino acid
  Variant (10)..(10): Xaa in position 10 is Ala, Ser or Thr
  Variant (14)..(14): Xaa in position 14 is any amino acid
  Variant (16)..(16): Xaa in position 16 is any amino acid
  Variant (20)..(20): Xaa in position 20 is any or no amino acid
  Variant (22)..(22): Xaa in position 22 is any amino acid
  Variant (23)..(23): Xaa in position 23 is Ala or Ile
  Variant (24)..(24): Xaa in position 24 is Ala, Asn, Ser or Thr
  Variant (25)..(25): Xaa in position 25 is any amino acid
DXXXXXXXXXSAIXNXPPPXAXXXXL

SEQ ID NO: 5694 - protein, 34 aa, Artificial sequence
  protein pattern
  Variant (2)..(2): Xaa in position 2 is Ser or Thr
  Variant (4)..(7): Xaa in position 4 to 7 is any amino acid
  Variant (9)..(12): Xaa in position 9 to 12 is any amino acid
  Variant (14)..(14): Xaa in position 14 is any amino acid
  Variant (15)..(16): Xaa in position 15 to 16 is any or no amino acid
  Variant (18)..(22): Xaa in position 18 to 22 is any amino acid
  Variant (23)..(24): Xaa in position 23 to 24 is any or no amino acid
  Variant (26)..(26): Xaa in position 26 is Phe or Tyr
  Variant (27)..(27): Xaa in position 27 is any amino acid
  Variant (31)..(31): Xaa in position 31 is any amino acid
  Variant (32)..(32): Xaa in position 32 is Phe or His
  Variant (33)..(33): Xaa in position 33 is any amino acid
  Variant (34)..(34): Xaa in position 34 is Ala, Asn, Pro or Ser
GXYXXXXMXXXXFXXXGXXXXXXXYXXLFQXXXX

SEQ ID NO: 5695 - protein, 53 aa, Artificial sequence
  protein pattern
  Variant (2)..(7): Xaa in position 2 to 7 is any amino acid
  Variant (8)..(9): Xaa in position 8 to 9 is any or no amino acid
  Variant (11)..(14): Xaa in position 11 to 14 is any amino acid
  Variant (15)..(16): Xaa in position 15 to 16 is any or no amino acid
  Variant (19)..(20): Xaa in position 19 to 20 is any amino acid
  Variant (21)..(21): Xaa in position 21 is Ile, Met or Val
  Variant (22)..(22): Xaa in position 22 is Ala, Gly or Ser
  Variant (23)..(23): Xaa in position 23 is Phe, Leu, Met or Val
  Variant (24)..(24): Xaa in position 24 is Ala, Ile, Leu or Val
  Variant (26)..(26): Xaa in position 26 is Ile or Leu
  Variant (28)..(28): Xaa in position 28 is Ala or Cys
  Variant (30)..(30): Xaa in position 30 is Thr or Val
  Variant (33)..(35): Xaa in position 33 to 35 is any amino acid
  Variant (36)..(36): Xaa in position 36 is Ala, Glu or Gln
  Variant (37)..(37): Xaa in position 37 is Ile or Val
  Variant (38)..(41): Xaa in position 38 to 41 is any amino acid
  Variant (42)..(42): Xaa in position 42 is Ser or Thr
  Variant (44)..(45): Xaa in position 44 to 45 is any amino acid
  Variant (46)..(46): Xaa in position 46 is Ala, Ile, Leu or Val
  Variant (47)..(47): Xaa in position 47 is Phe or Trp
  Variant (48)..(48): Xaa in position 48 is Asp, Glu or Ser
  Variant (49)..(49): Xaa in position 49 is Lys or Arg
  Variant (50)..(50): Xaa in position 50 is Ile, Leu or Val
  Variant (51)..(52): Xaa in position 51 to 52 is any amino acid
  Variant (53)..(53): Xaa in position 53 is Asp or Glu
GXXXXXXXXSXXXXXXLGXXXXXXGXDXRXERXXXXXXXXXXYXXXXXXXXXX

SEQ ID NO: 5696 - protein, 22 aa, Artificial sequence
  protein pattern
  Variant (2)..(2): Xaa in position 2 is Leu or Val
  Variant (3)..(3): Xaa in position 3 is any amino acid
  Variant (4)..(4): Xaa in position 4 is Leu or Val
  Variant (5)..(5): Xaa in position 5 is Leu or Met
  Variant (8)..(8): Xaa in position 8 is Ile or Val
  Variant (11)..(11): Xaa in position 11 is Ala or Leu
  Variant (16)..(17): Xaa in position 16 to 17 is any amino acid
  Variant (20)..(20): Xaa in position 20 is any amino acid
  Variant (21)..(21): Xaa in position 21 is Ile, Leu, Met or Val
  Variant (22)..(22): Xaa in position 22 is Phe or Leu
HXXXXLGXPIXYPRLXXLEXXX

SEQ ID NO: 5697 - protein, 27 aa, Artificial sequence
  protein pattern
  Variant (2)..(2): Xaa in position 2 is any amino acid
  Variant (3)..(3): Xaa in position 3 is Ile or Val
  Variant (5)..(5): Xaa in position 5 is Ala, Gly or Ser
  Variant (6)..(6): Xaa in position 6 is any amino acid
  Variant (7)..(7): Xaa in position 7 is Gly, Asn, Ser or Thr
  Variant (8)..(8): Xaa in position 8 is Asp, Glu, Gln or Thr
  Variant (9)..(9): Xaa in position 9 is Asn or Ser
  Variant (10)..(10): Xaa in position 10 is any amino acid
  Variant (11)..(11): Xaa in position 11 is Asn or Arg
  Variant (12)..(15): Xaa in position 12 to 15 is any amino acid
  Variant (22)..(23): Xaa in position 22 to 23 is any or no amino acid
  Variant (25)..(26): Xaa in position 25 to 26 is any or no amino acid
FXXPXXXXXXXXXXXSCNGFSXXVXXD

SEQ ID NO: 5698 - protein, 16 aa, Artificial sequence
  protein pattern
  Variant (2)..(2): Xaa in position 2 is any amino acid
  Variant (3)..(3): Xaa in position 3 is Ile or Val
  Variant (5)..(5): Xaa in position 5 is Ile, Met or Val
  Variant (6)..(6): Xaa in position 6 is any amino acid
  Variant (11)..(11): Xaa in position 11 is any or no amino acid
  Variant (13)..(13): Xaa in position 13 is any or no amino acid
  Variant (16)..(16): Xaa in position 16 is Phe or Tyr
PXXNXXDDHDXIXDGX

SEQ ID NO: 5699 - protein, 20 aa, Artificial sequence
  protein pattern
  Variant (2)..(4): Xaa in position 2 to 4 is any amino acid
  Variant (5)..(6): Xaa in position 5 to 6 is any or no amino acid
  Variant (10)..(11): Xaa in position 10 to 11 is any amino acid
  Variant (12)..(12): Xaa in position 12 is Leu, Met or Val
  Variant (13)..(13): Xaa in position 13 is any amino acid
  Variant (14)..(14): Xaa in position 14 is Ile or Leu
  Variant (16)..(17): Xaa in position 16 to 17 is any amino acid
  Variant (18)..(18): Xaa in position 18 is Asp, Glu, Asn or Gln
  Variant (19)..(19): Xaa in position 19 is any amino acid
  Variant (20)..(20): Xaa in position 20 is Asp or Gly
HXXXXXTDEXXXXXFXXXXX

SEQ ID NO: 5700 - protein, 14 aa, Artificial sequence
  protein pattern
  Variant (2)..(2): Xaa in position 2 is Trp or Tyr
  Variant (3)..(3): Xaa in position 3 is any amino acid
  Variant (4)..(4): Xaa in position 4 is Phe or Tyr
  Variant (5)..(5): Xaa in position 5 is any amino acid
  Variant (7)..(7): Xaa in position 7 is any amino acid
  Variant (8)..(8): Xaa in position 8 is Ala, Ile, Leu or Val
  Variant (9)..(9): Xaa in position 9 is Glu, Pro or Thr
  Variant (10)..(10): Xaa in position 10 is Phe, Ile, Leu, Met or Val
  Variant (11)..(11): Xaa in position 11 is Ala, Asp, Glu, Gln, Ser or Thr
  Variant (12)..(12): Xaa in position 12 is Asp, Gly, Asn, Gln or Ser
  Variant (13)..(13): Xaa in position 13 is any amino acid
FXXXXIXXXXXXXE

SEQ ID NO: 5701 - DNA, 942 bp, Saccharomyces cerevisiae
  CDS (1)..(942)
atgcgtttctctactacactcgctactgcagctactgcgctatttttcacagcctcccaagtttcagctattggtgaactagcctttaacttgggtgtcaagaacaacgatggtacttgtaagtccacttccgactatgaaaccgaattacaagctttgaagagctacacttccaccgtcaaagtttacgctgcctcagattgtaacactttgcaaaacttaggtcctgctgctgaagctgagggatttactatctttgtcggtgtttggccaacagacgacagtcattacgctgctgaaaaggctgctttgcaaacctatttgccaaaaattaaagaatccactgttgctggtttcttggttggttctgaagccttataccgtaacgatttgactgcctctcaattatcagacaaaattaatgacgtccgtagtgtcgttgctgacatttccgattctgacggaaagtcatactctggtaagcaagtcggtactgtcgattcctggaatgttttggttgctggttacaattctgccgttatcgaagcttccgattttgttatggctaacgcgttctcctactggcaaggtcaaaccatgcaaaatgcctcttactcattctttgatgatattatgcaagctctacaggttatccaatctactaaaggttctaccgatattaccttctgggttggtgagaccggttggccaactgatggtaccaactttgaaagttcttacccatctgttgacaacgccaaacaattctggaaagaaggtatctgttccatgagagcttggggtgttaacgttattgtttttgaagcctttgatgaagattggaagccaaacacctctggtacctctgatgtcgagaagcactggggtgttttcacttcaagtgacaatttgaaatactccttggactgtgacttttcatga

SEQ ID NO: 5702 - protein, 313 aa, Saccharomyces cerevisiae
MRFSTTLATAATALFFTASQVSAIGELAFNLGVKNNDGTCKSTSDYETELQALKSYTSTVKVYAASDCNTLQNLGPAAEAEGFTIFVGVWPTDDSHYAAEKAALQTYLPKIKESTVAGFLVGSEALYRNDLTASQLSDKINDVRSVVADISDSDGKSYSGKQVGTVDSWNVLVAGYNSAVIEASDFVMANAFSYWQGQTMQNASYSFFDDIMQALQVIQSTKGSTDITFWVGETGWPTDGTNFESSYPSVDNAKQFWKEGICSMRAWGVNVIVFEAFDEDWKPNTSGTSDVEKHWGVFTSSDNLKYSLDCDFS

SEQ ID NO: 5703 - DNA, 930 bp, Williopsis californica
  CDS (1)..(930)
atgcgtttcactacactcgttgccctcgcaggtgccatttcctcagtccaggccatcggccaactagcttttaacttgggtgtcaaggataactcaggtcagtgcaagactgcctcagagtacaaggatgacttgtctaccctttcaggctacacatctaaggttagagtctacgctgcctcagactgtaacactttgcagactttgggtccagttgtcgaagaggctggcttctcatttttcgttggtatttggccaaacgatgatgctcacttccaggaagagcaagacgctttgaaaacttatttgccaaagattaagagatccacagtggaggccttcactgttggttctgaggccttgtatagagatgatatgactgctcaagagttggctgacagaatcaaaactattagagagttggttgccactattgacgactccgaaggtaactcatatgctggtattccagttggtttcgttgactcctggaacgttttggttgatggtgcttctcacccagctattgttgaggctgatgttgtgttcgccaatgctttctcttactggcaaggtcagactcagcagaactcgtcatactctttctttgacgacattatgcaagctttgcaaaccattcaaactgctaagggtgagacagatatcactttctgggttggtgagaccggctggccaaccgatggtactcactttgaagactctgtcccatctgttgagaatgctcagaccttctggaaagatgccgtctgtgccattagaggttggggtatcaatgttattgcctttgaggcctttgacgaagcttggaagccagatacctctggtacctctgatgtggaaaagtactggggtgtttgggactctaacagcaagttgaagtatgatttgtcctgtgactttacctcttag

SEQ ID NO: 5704 - protein, 309 aa, Williopsis californica
MRFTTLVALAGAISSVQAIGQLAFNLGVKDNSGQCKTASEYKDDLSTLSGYTSKVRVYAASDCNTLQTLGPVVEEAGFSFFVGIWPNDDAHFQEEQDALKTYLPKIKRSTVEAFTVGSEALYRDDMTAQELADRIKTIRELVATIDDSEGNSYAGIPVGFVDSWNVLVDGASHPAIVEADVVFANAFSYWQGQTQQNSSYSFFDDIMQALQTIQTAKGETDITFWVGETGWPTDGTHFEDSVPSVENAQTFWKDAVCAIRGWGINVIAFEAFDEAWKPDTSGTSDVEKYWGVWDSNSKLKYDLSCDFTS

SEQ ID NO: 5705 - DNA, 1814 bp, Pichia jadinii
  CDS (133)..(1053)
atcgatcgagcaccggttttgttttttttttggcctcctccatcgttttcctttttcttcaacacttttggcctttctttccctttttcccattgtttacgttccatcggatcaacactttatagaacaaacatgcgtttttccactctcgctgctaccgctgctgttctctcttctgttcacgccgttggtgatttggcattcaacttgggtgtccaaaactctgctggttgtaaaaccgctgccgactacaagaaggagctcgaggtgttgtcagcctacacaagcgctgtcagagtttacgctgcatctgactgtaacactctacaaatcctcggtccagttgctgaggaagctggtttctcaatcttccaaggtatctggccaaacgacgatgcccactttgaggctgagcaagaggcattgaagacctacttgccaactttgaagaagtcaacgatcaaggccatcactgttggttccgaagcgttgtaccgtgatgatatgaccgccagcgacttggcctctcgtatccaaacagtcaaggatttgattgctgatattaaggactccgagggtaactcctacgctggtaccccagttggtttcgttgactcttggaacgttttggttgacggtgccgctcacccagctatcgctgcatctgacattgtctttgccaacgccttctcctactggcaaggtcagacaaaggctaactccaccttctccttctttgacgatatcatgcaagctttgcaaaccatccaaaccgacaagggtgagactgatatcactttctgggtcggtgaaactggctggccaaccgatggttccgcttttgaggcttctgttccatcggtggagaatgctgctcacttctggcaagatgccatcggtgccatgagaggatggggtgttaacgtcatcgtctttgaggcctttgacgagtcctggaaaccagatacctctggtacctctgacgttgaaaagtactggggtgtctgggactcggactaccaattgaagtacgatttgacttgtaatttctaaaatatttaactcaaatactctataatgaccataaatactccttcgtgaaagatgtctctatctaatggagaaaatgtgtagttctcccaataacgtctgcttatgcctttccaaggttgtcaatggcatcaaacatgtcctccaacttgtcatctttctctcctgttaagccactctcgttgtccttcgctgaatcctccttcactgctgcaatccaattcaccacctggttgacaaagctcttgctattcggtacgaaatgcccaccttggtgcttcaacaagtgtcgatgatcttcacgacaggaatcgtaaagctttatggatctcgactcttcaaccactgtatccagctcaccaagcacatggagagttggtaacgatatctttggttcgtaatgctcctggaacctctctggcatcagtttgaacccagagaagtagatagcccactgtaagtgtggcaaaaactccttataccttgcagtgagatagccagaaagcccagcaccttgtgagaatccaacaatcccttccacgtcctcaatatcgtgcttgtccaattccttcttgatggtttgttctgccgtctctaattcatagtctggtgcgccgtatggccaccatccataaagctcggaatctgttaatgaggagtgaggcatatctccttgtagtaacaacggcgcatttacatacacagtttcatacccagacttctgtagagccttacgcagcccacctgtctttgcagagaagatc

SEQ ID NO: 5706 - protein, 306 aa, Pichia jadinii
MRFSTLAATAAVLSSVHAVGDLAFNLGVQNSAGCKTAADYKKELEVLSAYTSAVRVYAASDCNTLQILGPVAEEAGFSIFQGIWPNDDAHFEAEQEALKTYLPTLKKSTIKAITVGSEALYRDDMTASDLASRIQTVKDLIADIKDSEGNSYAGTPVGFVDSWNVLVDGAAHPAIAASDIVFANAFSYWQGQTKANSTFSFFDDIMQALQTIQTDKGETDITFWVGETGWPTDGSAFEASVPSVENAAHFWQDAIGAMRGWGVNVIVFEAFDESWKPDTSGTSDVEKYWGVWDSDYQLKYDLTCNF

SEQ ID NO: 5707 - DNA, 1194 bp, Magnaporthe grisea 70-15
  CDS (1)..(1194)
atgcgtaactcgttctcccttttcaccgctcttgcggccgtcgccgctgcacagaactacctgggtttcaactcgggatcgaccaaggccgactactccgtcaaggtcaaggccgacttcttgcaagagttcaccacggcacagaatcttgagggcgcccccggcaccttcaacgctgtccgtctgtacaccaacatccagggcggtaccacggacgaccccatctctgcctttgaggccgccattgagaccaagaccaagatcctgctcggcgtctggacctcgggcaccacctcgatcgagaaggagcttaacgcccttcaaaaggcagtcaagcagtacggccccaagttcaccgaccttgtcatcggtatctctatcggatccgaggatctctaccgcaactcggtgactggcatgaccaacaaggctggtgtaggtgctcagcccgaccagctcgttgccttcatcggcgacttcaagaaggccttcaaggacacccccctcggcaagacccccgtcggccacgtcgacacctgggacgtctggcccaacgcgaccaacaaggccgtccttgacgccatcgactgggtcggtgtcgacgagtacccctactacgagaacggcaagggcaacaacatcaagaacagcggtaaccttttcgacaaggccttcaacgccaccatccaggccgccggcggcaagcccgtctgggttaccgagaccggctggccctcgagcggtcccgactgggaccaggctgttccctcgatcgagaacgccaagtactactggcaggagattggctgccgtcagctgttcaacaaggtccccaccttctggtacaacctccgcgacagcaaccccgacaacaagcagcagttcgccatcaccaagaacctgtccaccaagcccctcttcgacctcaagtgccctacctccttcgacaccgacaagcagcgccaggccaacagccccagcagcagcagcagcagcagcggaaacagcactggtggtagcaacagcagcacccccagctccaccaacggctcctccaactcgggaagcaacagcagccccgctgccgctggcgccacctccaaggctcctagcaacgctgctggcatccttgaggttctccccgtcgctgcctacgctggtcttgttgtgattggcgcgcttgccatgtactaa

SEQ ID NO: 5708 - protein, 397 aa, Magnaporthe grisea 70-15
MRNSFSLFTALAAVAAAQNYLGFNSGSTKADYSVKVKADFLQEFTTAQNLEGAPGTFNAVRLYTNIQGGTTDDPISAFEAAIETKTKILLGVWTSGTTSIEKELNALQKAVKQYGPKFTDLVIGISIGSEDLYRNSVTGMTNKAGVGAQPDQLVAFIGDFKKAFKDTPLGKTPVGHVDTWDVWPNATNKAVLDAIDWVGVDEYPYYENGKGNNIKNSGNLFDKAFNATIQAAGGKPVWVTETGWPSSGPDWDQAVPSIENAKYYWQEIGCRQLFNKVPTFWYNLRDSNPDNKQQFAITKNLSTKPLFDLKCPTSFDTDKQRQANSPSSSSSSSGNSTGGSNSSTPSSTNGSSNSGSNSSPAAAGATSKAPSNAAGILEVLPVAAYAGLVVIGALAMY

SEQ ID NO: 5709 - DNA, 933 bp, Magnaporthe grisea 70-15
  CDS (1)..(933)
atgcgtttcacaaccgtcttcgccggagtggcggccatggctgccaccacggccaacgcaatccagggcttcaactacggcgcattcttcctgaaccagcagcccaagctgcaggccgatttcgaatacgagttccgtcgtgctcagcagctgccgggcacctctggatggaactctgcccgcctgtacaccatggttcaatggcagacggccaacgacgttgtccaggccatccccgccgccatcaacacccgcacatccctcctgctgggcctctgggtctcgggcggcccgcaggccatcgagaacgagctgactgccctccgcaaggccattgaccagtacggcacggccttcacctcgctcgtcgtcggcatctcggtcggctccgaggatctgtaccgcaacaccaacaacgaggtcggtgtcgacgccgcctaccttctcaactgcatccagcgcacacgtgacctgatccgcggcacgtccctcgccaacgtccccgtcggccacgtcgacacctacaacgccttcctcgacggccggaatgctgcagtcattcctgccattgactttatcggcttcgacggctacccctactgggagcagactctgcccaactccatcgagaacagccgcgagcgcttctacgacggtctgaacaagaccattgccatctcccagggcaagcccgtctggatcaccgagactggctggcccgtcgttggaaagcagatcaaccaggctgtggccagtgcacagaacgccaggaagtactggcaggaagttgcatgctccctggtccgcgccaacatcaacgtctggtggtatatgcttcaagaatctcaatggggtcaggcagagactgatttcggtgtttttggcgctggtgaccttttctccatcaacccttactacgatctctcctgttaa

SEQ ID NO: 5710 - protein, 310 aa, Magnaporthe grisea 70-15
MRFTTVFAGVAAMAATTANAIQGFNYGAFFLNQQPKLQADFEYEFRRAQQLPGTSGWNSARLYTMVQWQTANDVVQAIPAAINTRTSLLLGLWVSGGPQAIENELTALRKAIDQYGTAFTSLVVGISVGSEDLYRNTNNEVGVDAAYLLNCIQRTRDLIRGTSLANVPVGHVDTYNAFLDGRNAAVIPAIDFIGFDGYPYWEQTLPNSIENSRERFYDGLNKTIAISQGKPVWITETGWPVVGKQINQAVASAQNARKYWQEVACSLVRANINVWWYMLQESQWGQAETDFGVFGAGDLFSINPYYDLSC

SEQ ID NO: 5711 - DNA, 1593 bp, Magnaporthe grisea 70-15
  CDS (1)..(1593)
atggtgccctcgctaggtagtagtgcctttagcgacaaggcgactagcgatgcatcgattgcgggcagcagggcagcaaggcaggttgcaggcccccgaccggcggtacctgccgctttagtccagggtgcccatcccttgcatgcaacctttaggcaattgcaaccgcacatctgcctcgggttacccgcttcgagtatgcgtttcctttcgatcctagtggttttggccacggcacagctggcgacatgtcaacaatatcacacgggatttaactacggcagcaccttcacaactggagctgcaaaaacgcaagcagacttcgcaaaggagttcaggagtgctgccagcttatcgggagccccacaaggctttacaagtgctcgcttgtataccaatatccaagatggcacgcccaatgaccctatatctgcgattcctgcagccattgagacaaagacgtcgctgctactgggactatgggcgtcggctggtgccccagcattcgcaaacgaattggagtcactgaggaaatctattagcacttatggtgatcggctcaaaggagttgttttgggaatttcggtaggctccgaggacctgtatcggaattccccgactggtaaagccaacaaagagaatgccggggccgaccccggaactatcgtcgattatatcgcgcagacccgcgctgtcatcaaaggcactgttcttgacggagttcccatcggtcatgttgatacctggacagagtgggtcaacgtgggcagaaatcaggccgtcatcaacgctgtcgactggctcggatttgacggatatccttatttcgaaacaaccgcagctcaaggcaactccatcgatcagaacaaagccctctttgacagctcgcttcagtcaacaaggaatgttgcggccggtaaagccgtttggattaccgagaccggcttccctgttagtggaaagacgagcggtagcgccctacctagcgtcgagaacgccaggaagtactggcaacaggtcggctgcgctattgttggcagcatgaacgtgtattggtacactttgcaggatgcagctcccaataccccgaatccatcttttggcattctcgactcaagcggcaagcaactatacgacctgtcctgcaacaaggctgctgatacagcacgctcatctggctcctcgccagggactgagtctccaggggcttctgacgctgtggaaccacctttgaatccagacagcagaatatcactgggagccaccggccaacaagcaaacgtcttctcaatccaaactcagacgtcggtagctggcataggtgaagcttctccatcaagtgctgccagtgatggcgattcctctatcgggtttacaatccagacagagacatccattaccaacactgctactcctgagccaacatctgccattacgtcagggtcgaccgcatctcctgtctcttccagccgcgaccccaccgctacgcagacacagtcagagactggtgtgcccggtcttggtgctgccgtcaacgcaggctcctttgcagctgcttttgctgcaattctaggtgccgtattctatttatga

SEQ ID NO: 5712 - protein, 530 aa, Magnaporthe grisea 70-15
MVPSLGSSAFSDKATSDASIAGSRAARQVAGPRPAVPAALVQGAHPLHATFRQLQPHICLGLPASSMRFLSILVVLATAQLATCQQYHTGFNYGSTFTTGAAKTQADFAKEFRSAASLSGAPQGFTSARLYTNIQDGTPNDPISAIPAAIETKTSLLLGLWASAGAPAFANELESLRKSISTYGDRLKGVVLGISVGSEDLYRNSPTGKANKENAGADPGTIVDYIAQTRAVIKGTVLDGVPIGHVDTWTEWVNVGRNQAVINAVDWLGFDGYPYFETTAAQGNSIDQNKALFDSSLQSTRNVAAGKAVWITETGFPVSGKTSGSALPSVENARKYWQQVGCAIVGSMNVYWYTLQDAAPNTPNPSFGILDSSGKQLYDLSCNKAADTARSSGSSPGTESPGASDAVEPPLNPDSRISLGATGQQANVFSIQTQTSVAGIGEASPSSAASDGDSSIGFTIQTETSITNTATPEPTSAITSGSTASPVSSSRDPTATQTQSETGVPGLGAAVNAGSFAAAFAAILGAVFYL

SEQ ID NO: 5713 - DNA, 906 bp, Gibberella zeae PH-1
  CDS (1)..(906)
atgaagtttttcagtactctcagcaccctcgcggtggctctcatgatgactggtgaggccgtggccggcacctacaagggtttcagcatgggcgccaacagggctgatggtgtctgcaagtgggaggccgactggaagaaggatttccaggccatcaagagctggaacaagggtttcaacgctgttcgtctgtactctgcctctgactgcaacacactcgtcaaggccgtccccgctgccaaggccaccggcatgaagatccttgtcggtatctggtccaccgacgatgctcactttggccgtgataaggccgccctcctcaaggccatcaagcagcacggcactggctggatcgccgccatcagtgtcggatccgaggatctctaccgcaaggatatttccccccagaagctcgcacagcaaatctacgacgtccgaggcatggtccaccaatacaacaaggccctcaaggtcggacacaccgacacctggaccgcttgggtcgacggcaccaacgacgtcgtcaccaaggcctgcgacattgccatcacaaacggtttcccctactggcagggtgttcccatcaaggatgctctccgcctcaagactttccagaactcttactggaacgtcaagaagcacgtccaggctgtcaactccaaggctactgtctgggttggtgagaccggctggcctaccaagggacccaactaccagaaggctgctgccacgaccgccagtctgcagcagtactacaacaatgtcggttgctggctctggcagcagaaggatgccagtggtttctggttcactgcttttgacacacctgcccaaaccaccgaggtcgagaagtacttcggtgttgctaaccaggaccgcaaacttaagttcagccttacttgctaa

SEQ ID NO: 5714 - protein, 301 aa, Gibberella zeae PH-1
MKFFSTLSTLAVALMMTGEAVAGTYKGFSMGANRADGVCKWEADWKKDFQAIKSWNKGFNAVRLYSASDCNTLVKAVPAAKATGMKILVGIWSTDDAHFGRDKAALLKAIKQHGTGWIAAISVGSEDLYRKDISPQKLAQQIYDVRGMVHQYNKALKVGHTDTWTAWVDGTNDVVTKACDIAITNGFPYWQGVPIKDALRLKTFQNSYWNVKKHVQAVNSKATVWVGETGWPTKGPNYQKAAATTASLQQYYNNVGCWLWQQKDASGFWFTAFDTPAQTTEVEKYFGVANQDRKLKFSLTC

SEQ ID NO: 5715 - DNA, 927 bp, Candida glabrata CBS 138
  CDS (1)..(927)
atgcgtttcagtactgttgcagctttagcatttggtgcctcccaggttgctgccatcggtgagttggctttcaaccttggtgtcaagaacaatgacggtacctgtaagactactaacgactacgaaaacgatctgaaggtcttgaagagctacacttccactgtcaaggtgtatgctgcttcagactgtaacactttggaaaacttgggtcctgctgccgaggctgaaggtttcaacatcttcttgggtatctggccaaacgatgaggctcacttccaagctgagaagaacgctctgtccagtttcttgcctaacttgaagtcctccaccatcgccggtttcttggtcggttccgaagctctataccgtgacgacttgaccgcctcccaactggctgacaagatcaacgacatcagaaactatgtctccaacatcaaagactctcaaggtaactcctactccggtaagcaagtcggtaccgtcgactcctggaatgtcttggtcgctggttacaacgccccagtcatcactgccagtgacttcgtcatggctaacgctttctcctactggcaaggtcaaactatgcaaaacgcttcttactctttcttcgacgacattatgcaagctttgcaaaccatccaaggtgttaagggctctactgacatcactttctgggtcggtgaaactggctggccaaccgatggtactaacttcgaagcctcttacccatctgtcgacaacgctaagcaattctggaaggaaggtatctgtgctatgagagcctggggtgttaacgtcatcgtttttgaagcattcgatgaagactggaagccaaacacctctggtacttctgatgttgaaaagcactggggtgtctggacctctggtgacaacttgaagtactctttggactgtagcttcaactaa

SEQ ID NO: 5716 - protein, 308 aa, Candida glabrata CBS 138
MRFSTVAALAFGASQVAAIGELAFNLGVKNNDGTCKTTNDYENDLKVLKSYTSTVKVYAASDCNTLENLGPAAEAEGFNIFLGIWPNDEAHFQAEKNALSSFLPNLKSSTIAGFLVGSEALYRDDLTASQLADKINDIRNYVSNIKDSQGNSYSGKQVGTVDSWNVLVAGYNAPVITASDFVMANAFSYWQGQTMQNASYSFFDDIMQALQTIQGVKGSTDITFWVGETGWPTDGTNFEASYPSVDNAKQFWKEGICAMRAWGVNVIVFEAFDEDWKPNTSGTSDVEKHWGVWTSGDNLKYSLDCSFN

SEQ ID NO: 5717 - DNA, 936 bp, Kluyveromyces lactis NRRL Y-1140
  CDS (1)..(936)
atgcgtttctctacactcgtttctgccactttgttggccggtgcttcaactgttgctgctgttggtgagcttgcattcaacttaggtgttaagacccacgatggttcttgtaagcaaaaggatgattatttagctgatttcgaaactttgaagggttacacctccaaggtcaaagtatatgctgcttctgattgtaacactttacaaattttgggtcctgctgcagaagaagccggatttaccattttcttgggtatttggccaactgattctgctcatttcgaagaagaaaagcaagctttgactcaatacttgccatggatcaaaacttctaccatcgaagccttcttggttggttccgaagctttgtaccgtgaagatatgactgcttctgaattggcagatgctatctctgatgtcaaggactacattaaagacatcaaggattccgatggtaactcttacagtggcaagcaagtcggtactgttgactcatggaacgttttggtcgatggtggatctgctaccgccattcaagctgctgactttgtcatggcgaacgccttctcttactggcaaggtcaaactatggataatgcttcttactcgttcttcgacgatatcatgcaagctctacaaactatccaaactaccaagggttctactgacattcaattctgggttggtgaaactggctggccaaccgatggtaccaactttgaaagtgcttacccaggtctagataacgctaagcaattttgggctgatggtatttgtgctatgagaggctggggtgtcaacgttatcgttttcgaagctttcgatgaggactggaaaccagatacttctggtatttccgatgttgaaaagtactggggtgtttgggatgccaacagaaacttgaagttcaagttggattgtgatttcagctcttaa

SEQ ID NO: 5718 - protein, 311 aa, Kluyveromyces lactis NRRL Y-1140
MRFSTLVSATLLAGASTVAAVGELAFNLGVKTHDGSCKQKDDYLADFETLKGYTSKVKVYAASDCNTLQILGPAAEEAGFTIFLGIWPTDSAHFEEEKQALTQYLPWIKTSTIEAFLVGSEALYREDMTASELADAISDVKDYIKDIKDSDGNSYSGKQVGTVDSWNVLVDGGSATAIQAADFVMANAFSYWQGQTMDNASYSFFDDIMQALQTIQTTKGSTDIQFWVGETGWPTDGTNFESAYPGLDNAKQFWADGICAMRGWGVNVIVFEAFDEDWKPDTSGISDVEKYWGVWDANRNLKFKLDCDFSS

SEQ ID NO: 5719 - DNA, 921 bp, Debaryomyces hansenii CBS767
  CDS (1)..(921)
atgcaattaaaatatttgactgttcttgctgcagctgtttcatcagtttctgctattggagatcttgctttcaatattggtgttaaggataactccggtaactgtaaatcgatagaagaatacgaaagtgacttctctgttttagaatcacaatccaagattgttaaggcatacgctgtttctgactgtaacactttacaaaacttgggaccagccgctgaggaagccggattccaagtgatgttcggtatctggccaaatgatgacgctcacttcgaggaagaaaaacaggcattgaaagattacttgccaaacatttctgttgataccgtcaaggttttcacagttggatccgaagctttgtatagagaagatttgactgccgacgaattggccgaaaagatcaacgatatcaaggacaccttgaaggacatcaaggacaagaacggtaagtcttactcttcagttcaagttggtactgttgactcgtggaacgttttagtcgatggtggttccaagccagctattgatgctgctgactttgttttcgccaacgctttctcgtactggcaaggacaaaccagtaagaacgcctcttactcgttcttcgatgacatcatgcaagccttgcaaaccatccaagccgctaagggtaccgacattgatttctgggttggtgaaactggatggccaactgagggtaccaacttcgaatctgctgacccaactcttgaaaacgctaagaactactggcaaaacgctatctgtgctatcagaggatggggtgttaacgttgctgtcttcgaagcttttgatgaagaatggaagccaaacacttctggtacttctgacgttgaaaagcactggggtgtctttgatgagaacaacaagccaaagtttgacttgagttgtgacttctaa

SEQ ID NO: 5720 - protein, 306 aa, Debaryomyces hansenii CBS767
MQLKYLTVLAAAVSSVSAIGDLAFNIGVKDNSGNCKSIEEYESDFSVLESQSKIVKAYAVSDCNTLQNLGPAAEEAGFQVMFGIWPNDDAHFEEEKQALKDYLPNISVDTVKVFTVGSEALYREDLTADELAEKINDIKDTLKDIKDKNGKSYSSVQVGTVDSWNVLVDGGSKPAIDAADFVFANAFSYWQGQTSKNASYSFFDDIMQALQTIQAAKGTDIDFWVGETGWPTEGTNFESADPTLENAKNYWQNAICAIRGWGVNVAVFEAFDEEWKPNTSGTSDVEKHWGVFDENNKPKFDLSCDF

SEQ ID NO: 5721 - DNA, 942 bp, Yarrowia lipolytica CLIB122
  CDS (1)..(942)
atgaagttcacatttgctgccgttaccgccgcgctggcctcgtccgccatggccctcggaggcctcggagtcgacctcggagtcaagcgagagtccgacggagagtgcaagaacgccggcgactacaaggccgatcttgaggctctcaagggtctcaccgacaccatccgaatctacgccgccggcgattgcgacgccctgcgagagctcggccctgttgctgaggccgctaacttcaagctcatgattggtgtgtggcccaacgacgacaaccactttgcctccgagcagtttgctctcaagagctacctgccctggctctccaagtccaccgtgccctacatcaccgtgggctccgaggctctgtaccgaaaggacatgactccccagcagctggccgacaagatcaacgacatcaagaaccagctcaagggcatcaaggacaagaacggccagacctttgacgtccccgtcggtaccgtcgactcctggaacgtgattgtcgatggctactccagccccgccgtcaaggccgccgacgttgtcttcgccaacgccttctcctactggcagggacagaccatggctaacgcctcttactccttcttcgatgacatcatgcaggctctccagaccatccagaccaccaagggtaccaccgacattgacttctgggttggtgagaccggatggcccaccgatggcggtgctttcggcgactctcagcctggcgtgaagcaggctgctcagttctggcaggagggtatctgtgccatccgagcctggggtatcaacactctggttttcgaggctttcgacgagacctggaagcccgacactaagggtgacaacggtgaggaggtctccggcgttgagaagtactggggtgtttacgactccaacctcaagcccaagttcgacaccacttgcaagtttgactaa

SEQ ID NO: 5722 - protein, 313 aa, Yarrowia lipolytica CLIB122
MKFTFAAVTAALASSAMALGGLGVDLGVKRESDGECKNAGDYKADLEALKGLTDTIRIYAAGDCDALRELGPVAEAANFKLMIGVWPNDDNHFASEQFALKSYLPWLSKSTVPYITVGSEALYRKDMTPQQLADKINDIKNQLKGIKDKNGQTFDVPVGTVDSWNVIVDGYSSPAVKAADVVFANAFSYWQGQTMANASYSFFDDIMQALQTIQTTKGTTDIDFWVGETGWPTDGGAFGDSQPGVKQAAQFWQEGICAIRAWGINTLVFEAFDETWKPDTKGDNGEEVSGVEKYWGVYDSNLKPKFDTTCKFD

SEQ ID NO: 5723 - DNA, 1398 bp, Aspergillus nidulans FGSC A4
  CDS (1)..(1398)
atgttcaccaagacccagattctcgccctcgctctgtcgattgcttccgctgaggccgtctccaagggcttcaactatggagccaacaagcccgatgggaccctcaaggtccaggccgatttcgaggctgaattccgtactgcgaagaacctcgagaccacttctggtttcaacagtgcccgtctctacaccatgatccagggcaccggcagcaccccgatctccgctattcccgccgccatcgctgaagagaccaccctcttgctgggtctctgggcttctggggggaacatggataatgagattgccgccctcaaggcggctatcaaccagtacggtgacgagttcgccaagcttgtcgtcggtatctctgtcggcagcgaggatctctaccgcaactctgagatcggagtccaggctaatgccggtatcggcatcgagcctgaggagctcgtctcctacatccagcgcgttcgcgaggccatcgccggcaccgccttgagcggcgctccgatcggccacgtcgacacctggaacgcctggaccaacggctctaacgccgctgttgctgaggccgtcgactggctcggctttgacggctacccgttcttccagaacaccatgcaaaactccattgatgacgccaaggctcttttcgacgagtctgttcagaagaccaaggccgttgccggcaacaaggaggtctggatcaccgagaccggttggcccgtcagcggtgactcgcagaacctcgctattgcgtcggtcgagaacgcgaagcagttctgggacgaggtcggctgtcctcttttcgataatgtcaacacctggtggtacatcctccaggacgcgtcgggctcctctgtccctaaccccagcttcggtatcgtcggcaacaccctcagcaccactcctctcttcgacctgagctgctccgccagctccaagaagaacagcagctccgcctccgcgtcggcttcgggctcgtctgcccagtcaaccggtttcgtctccaccaccaagcctgctgctagcccgtccggctcctctggtctcggccacggcggctccctcggctcctctggctcgttctctggaggccactacgccggtgtcggctcctccagcgtaattgcttctccttccgccactccttccggcagcgctgtccctggctccagctcgggccctggctctagctctggatccgcctcgggctctagctctggctttggctctggcgctgctgccgactcgacctccggcaccagcacctctggtgactcgacttccagcacctctgccacgcctgctgacttcaccggtgctggtagccgtctgtccggctcgatcttcggcgcggctatgctcgtcgctgccctcgcggtcgctctctaa

SEQ ID NO: 5724 - protein, 465 aa, Aspergillus nidulans FGSC A4
MFTKTQILALALSIASAEAVSKGFNYGANKPDGTLKVQADFEAEFRTAKNLETTSGFNSARLYTMIQGTGSTPISAIPAAIAEETTLLLGLWASGGNMDNEIAALKAAINQYGDEFAKLVVGISVGSEDLYRNSEIGVQANAGIGIEPEELVSYIQRVREAIAGTALSGAPIGHVDTWNAWTNGSNAAVAEAVDWLGFDGYPFFQNTMQNSIDDAKALFDESVQKTKAVAGNKEVWITETGWPVSGDSQNLAIASVENAKQFWDEVGCPLFDNVNTWWYILQDASGSSVPNPSFGIVGNTLSTTPLFDLSCSASSKKNSSSASASASGSSAQSTGFVSTTKPAASPSGSSGLGHGGSLGSSGSFSGGHYAGVGSSSVIASPSATPSGSAVPGSSSGPGSSSGSASGSSSGFGSGAAADSTSGTSTSGDSTSSTSATPADFTGAGSRLSGSIFGAAMLVAALAVAL

SEQ ID NO: 5725 - DNA, 927 bp, Candida albicans SC5314
  CDS (1)..(927): transl_table=12
atgcaaatcaaattcttgactactctcgcaactgttcttacttcagttgccgccatgggtgatttggctttcaaccttggtgttaaaaatgatgacggtacttgtaaagacgtcagtacttttgaaggtgatttagatttcttgaaaagtcattcgaaaatcattaaaacttatgctgtttccgattgtaacactttacaaaaccttggtccagctgctgaagctgaaggattccaaatccaattaggtatctggccaaatgatgatgctcattttgaagctgaaaaggaagctttgcaaaactatttgccaaagatttccgtctccaccataaagattttcttggttggttctgaagctttatacagagaagatttgactgcttctgaattagcttccaagattaatgacatcaaggatttagttaaaggcattaaagacaaaaacggtaaatcctactcaagtgtcccagttggtactgttgattcttggaatgtcttagttgatggtgccagtaaaccagccatcgatgctgcagatgttgtctactccaactccttctcatactggcaaaaaaacagtcaagctaatgcttcatactctcttttcgatgatgttatgcaagctttgcaaactcttcaaactgctaaaggttccactgatattgaattctgggttggtgaaactggttggccaactgatggtagttcatatggtgattccgttccttctgttgaaaatgctgctgatcaatggcaaaaaggtatctgtgctcttagagcttggggtattaatgttgctgtctatgaagcttttgatgaagcctggaaaccagatacttccggtactagctccgttgaaaaacattggggtgtttggcaatccgacaaaactttgaaatactcaattgactgtaaattcaactaa

SEQ ID NO: 5726 - protein, 308 aa, Candida albicans SC5314
MQIKFLTTLATVLTSVAAMGDLAFNLGVKNDDGTCKDVSTFEGDLDFLKSHSKIIKTYAVSDCNTLQNLGPAAEAEGFQIQLGIWPNDDAHFEAEKEALQNYLPKISVSTIKIFLVGSEALYREDLTASELASKINDIKDLVKGIKDKNGKSYSSVPVGTVDSWNVLVDGASKPAIDAADVVYSNSFSYWQKNSQANASYSLFDDVMQALQTLQTAKGSTDIEFWVGETGWPTDGSSYGDSVPSVENAADQWQKGICALRAWGINVAVYEAFDEAWKPDTSGTSSVEKHWGVWQSDKTLKYSIDCKFN

SEQ ID NO: 5727 - DNA, 897 bp, marine gamma proteobacterium HTCC2207
  CDS (1)..(897): transl_table=11
atgtccaaaagagaagataaagtattatccctctccgggatcgacccatccgccgtaagcaagcagcaactcaaagatcactttcatagctatctggatagcggcatgcacggcattggctttagcgcctatgaagagggtcaggaacctggcgatgatattagccgtgagcaggtggagcggcgcatggcaatacttaagcccagtgttaaatgggtacggtctttttcatgctgtcagggcaatgacctaattcctttaatagctaaagaaatgggactaaaaactctggtcggtgcctggctgggcgatgatctagagaaaaatgaattagaaattaccggtctgatcaaactcgccaaacagggtctggttgatattgccgcggtgggcaatgaggtgatgtaccgcaaagacctcagcgaagagcaactgctcggctatattgcacgggttaaggaagcactgcccgatatacctgtgggctatgtggatgcctattatgaatttgaagatcgtccggccattacagaaatttgcgatgtaattctggccaattgttaccccttttgggaaggctgtgccattgaatactctctgctctatatgaaggatatgtaccgcagaacagtggccgtggcagagggtaaaaaagttatcatcaccgaaactggctggcccaatcaaggcgagaaattctacggagcgcagccttcagaagaaaatgcggtccgctattttctgaatactcaacattggggaaagacagaaaatattgatattttttacttttcgtcgtttgatgagtcgtggaaagtgggtgcagaaggcgatgtaggtgctttttggggcctttgggataaagatgaacaattaaaatactcagagctatcatga

SEQ ID NO: 5728 - protein, 298 aa, marine gamma proteobacterium HTCC2207
MSKREDKVLSLSGIDPSAVSKQQLKDHFHSYLDSGMHGIGFSAYEEGQEPGDDISREQVERRMAILKPSVKWVRSFSCCQGNDLIPLIAKEMGLKTLVGAWLGDDLEKNELEITGLIKLAKQGLVDIAAVGNEVMYRKDLSEEQLLGYIARVKEALPDIPVGYVDAYYEFEDRPAITEICDVILANCYPFWEGCAIEYSLLYMKDMYRRTVAVAEGKKVIITETGWPNQGEKFYGAQPSEENAVRYFLNTQHWGKTENIDIFYFSSFDESWKVGAEGDVGAFWGLWDKDEQLKYSELS

SEQ ID NO: 5729 - DNA, 915 bp, Aspergillus oryzae
  CDS (1)..(915)
atgcgtaccgctggtcttctttctcttttactcgcagcgattcccgctgttaccgcggagcggggtacccttggtctcgccctgggtaacaagaatcctgacggcacctgcaagtctactagcgactatgaggccgactttgacgcgctcaagagcctgactaccctcgttcgtacatactccgccaatgattgcaacaccgctgtgaacatcgttcctgcagccaagaacaagcagttcaaggtcgtgctgggtgtctgggctgattatgacgaatccttcaacaatgacttcaatgtcttgaagcagattgttcccggaaatgaagatgttatcccttcgatcactgtcggttctgaaactctttaccgcaaaggccttactgcccagcagctcctggacaagatccgtacggtccagaatgcgttccccaaggttaacgttggcacggtggacagctggaacattttcaatgatggtactgccgatcccatcatccaaggaggtgtcacttacttcttggccaatggcttcgcctattggcaaggaacggatattgaccatgccaccgagacctactggaatgacacgaggcttgctaaggagcatattgagaggattgctggcaacaaccaggacaagattatcttcggaaacggcgagactggttggcccaccgatggcggttctgactatggaaacgccaaggctagcactcaaaatgctgaacggtactggaaggacgctgtctgcgctatgctgacctggggcgtcgacgttttctactttgaggctttcgacgaatcctggaagcccaagagcattggtgacaacggcgaggagaaggatgagacccactggggtcttttcactgccgaccgcaaggccaagttcgacttgtcttgccctaactaa

SEQ ID NO: 5730 - protein, 304 aa, Aspergillus oryzae
MRTAGLLSLLLAAIPAVTAERGTLGLALGNKNPDGTCKSTSDYEADFDALKSLTTLVRTYSANDCNTAVNIVPAAKNKQFKVVLGVWADYDESFNNDFNVLKQIVPGNEDVIPSITVGSETLYRKGLTAQQLLDKIRTVQNAFPKVNVGTVDSWNIFNDGTADPIIQGGVTYFLANGFAYWQGTDIDHATETYWNDTRLAKEHIERIAGNNQDKIIFGNGETGWPTDGGSDYGNAKASTQNAERYWKDAVCAMLTWGVDVFYFEAFDESWKPKSIGDNGEEKDETHWGLFTADRKAKFDLSCPN

SEQ ID NO: 5731 - DNA, 1392 bp, Aspergillus oryzae
  CDS (1)..(1392)
atgcaattgacacaccttcttgccttcgccctgtcgctcgctacgtccgaggccgcctacaagggcttcaactacggtgctaccaagtcggatggcagcgtcaagtctcagtccgatttcgaatcggagttctccactgcgaagaatctggttggcacttcgggcttcaccagtgctagattgtacaccatgatccaaggtggcactaccaactcccctatctccgccattcccgctgccattgccgaaaatacatccttgttgctgggtctttgggcctctggtggtggtatggacaacgagttggccgccctcaagtcggccatctcccagtacggtgactccttcgccaaattggtcgtgggtatttccgttggtagtgaagatctctaccgtgcctcgtccgagggtgagaaggtcaatgccggcattggaattggccccgacgacctggtctcgtttatcaaggaggtccggtcgatcatctctggcaccgccctgagcagcgtccccatcggtcacgtcgacacctggaccgcctggactaacggctccaattcggccgtcattgacgccgtcgactggttgggtttcgacggttatccttacttccagagcagcatgtccaattccatctcggacgccaagtcactcttcgacgactctgtggctaagactaaggcggtcgctaagggcaaggaagtttggatcaccgaaaccggctggcccgtcagcggaagcactcagaacctcggcgtcgcttccctcgccaacgcgaagacctactgggacgaggtcggatgccccttgttcgacgagaccaacacctggtggtacatcctccaagacgccaaccccaccactcctaatcccagcttcggtgtggtcggcagcactctgagcaccaccccattgttcgacttgtcttgctctaacagcactcgcccatctgcttccgcttctagctccgctgctggctccgcgactcccgtcggctctgctgttccctctggctccgctgctgtgaacccttcgtcgtccggaatcgtgtctagtgctgttccctctactacccctggcttcaccgtcggcaagggattccgtccgtccaactcctccgctgctgcctactactccagcgcttctgctagcggctcggcctaccctaaattcaccaagaccgctagcggttcctccgctacttccaccaccgctggtagctcttctgactcttcgtcgaccaactctggcaagtcctcttcggaatcttcctcaaccaactctggcgcctctgcttcttcttccatccttgctacgggcggtgccagctccgtctcgggctccgtcttcggtgctctggttgcagtctttgcattcgtggctactttgtaa

SEQ ID NO: 5732 - protein, 463 aa, Aspergillus oryzae
MQLTHLLAFALSLATSEAAYKGFNYGATKSDGSVKSQSDFESEFSTAKNLVGTSGFTSARLYTMIQGGTTNSPISAIPAAIAENTSLLLGLWASGGGMDNELAALKSAISQYGDSFAKLVVGISVGSEDLYRASSEGEKVNAGIGIGPDDLVSFIKEVRSIISGTALSSVPIGHVDTWTAWTNGSNSAVIDAVDWLGFDGYPYFQSSMSNSISDAKSLFDDSVAKTKAVAKGKEVWITETGWPVSGSTQNLGVASLANAKTYWDEVGCPLFDETNTWWYILQDANPTTPNPSFGVVGSTLSTTPLFDLSCSNSTRPSASASSSAAGSATPVGSAVPSGSAAVNPSSSGIVSSAVPSTTPGFTVGKGFRPSNSSAAAYYSSASASGSAYPKFTKTASGSSATSTTAGSSSDSSSTNSGKSSSESSSTNSGASASSSILATGGASSVSGSVFGALVAVFAFVATL

SEQ ID NO: 5733 - DNA, 963 bp, Aspergillus fumigatus
  CDS (1)..(963)
atgcgtgtcagcaccttgctccctctcgctcttgcggccggtaccgctgctgcctccaagaatggaactttgggtttcgccctgggcaataagaacgaaggcggcaaatgcaaagtccagtcggactatgagaccgatttcgatacgttaaaagaagtcacctctctcgtgcgcatctactccgcgagtgactgcgacaccgcaaagcatatcatccctgcggctaaggcgaagaacttcaaagtcgtcctgggtgtttggtatggaacccgtcacattacatccgctttacgtcaagcggctaggcccgattacgacaaatctttcaccgacgacttcaacgccttgaaagaagctgtccccggaaacgaggaggttattgacgccatcaccgtcggctccgaagtgctctaccgaaagagtctcacccctcaggctctgcttgccagaatccagcaggtccagaaggagttccccaagattaccgtcggaatggtggacagctggaacaagttcgctgatggcacggccgaccccattattcagggtggtgtcacttatttcctggccaacggcttcgcctactggcagggccaggagctgagcaatgctactaacacctactttgatgacatggctcaggctctgggccacattgagcaagttgccggctctaatgcagacaagattcgctttggcaacggtgagaccggatggcccacaactggtggaaccaactacggaccggccgtcgccagcactgcgaatgctgctgattactacaagtctgccgtttgcggcatgctcgcatggggtgtcgatgtcttctactttgaggccttcgacgagtcctggaagcccaagaccaagggcgacaacggtgagatgcaagacgaaacgcactggggtgctttcactgcggaccgtaaggccaagttcgatttgacctgccctaagcactag

SEQ ID NO: 5734 - protein, 320 aa, Aspergillus fumigatus
MRVSTLLPLALAAGTAAASKNGTLGFALGNKNEGGKCKVQSDYETDFDTLKEVTSLVRIYSASDCDTAKHIIPAAKAKNFKVVLGVWYGTRHITSALRQAARPDYDKSFTDDFNALKEAVPGNEEVIDAITVGSEVLYRKSLTPQALLARIQQVQKEFPKITVGMVDSWNKFADGTADPIIQGGVTYFLANGFAYWQGQELSNATNTYFDDMAQALGHIEQVAGSNADKIRFGNGETGWPTTGGTNYGPAVASTANAADYYKSAVCGMLAWGVDVFYFEAFDESWKPKTKGDNGEMQDETHWGAFTADRKAKFDLTCPKH

SEQ ID NO: 5735 - DNA, 906 bp, Fusarium sporotrichioides
  CDS (1)..(906)
atgaagttcttcagcactctcagcacccttgcggtggctctcatgatgagtggcgaggccctagccggtacctacaagggtttcagcattggcgccaacagggctgatggcgcctgcaagtgggaggccgactggaagaaggatttccaggccatcaagagctggaacaagggtttcaacgctgttcgtctgtactctgctagtgattgcaacacacttgtcaaggccgtccccgctgctaaggccactggcatgaagatccttgtcggcgtttgggccaccgacgatgctcacttcggccgcgataaggccgctcttctcaaggctattaagcagcacggcacgggctggatcgccgccatcagcgtcggatccgaagacctctaccgtgaggatatctccccccagaagctcgcccagcagatctacgatgtccgaggcatggtccaccaatacaacaagaatctcaaggtcggacacaccgacacctggaccgcttgggtcgacggccgcaatgacgtcgtcaccaaggcctgcgacattgccatcacaaacggtttcccctactggcagggtgtccccatcaaggatgctctccgtctcaagactttccagaactcgtactggaacgtcaagaagcacgtcaatgctgtcaactccaaggctgctgtctgggttggtgagaccggctggcctaccaagggacccaactaccagaaggctgctgccacgaccgccagtctgcagcagttctacaacaatgtcggttgctggctctggcagcagaaggatgccagtggtttctggttcactgctttcgatactcctgcccacagcactgaagttgagaagtacttcggtattgctaaccaggaccgcaagctcaagttcggccttacttgctaa

SEQ ID NO: 5736 - protein, 301 aa, Fusarium sporotrichioides
MKFFSTLSTLAVALMMSGEALAGTYKGFSIGANRADGACKWEADWKKDFQAIKSWNKGFNAVRLYSASDCNTLVKAVPAAKATGMKILVGVWATDDAHFGRDKAALLKAIKQHGTGWIAAISVGSEDLYREDISPQKLAQQIYDVRGMVHQYNKNLKVGHTDTWTAWVDGRNDVVTKACDIAITNGFPYWQGVPIKDALRLKTFQNSYWNVKKHVNAVNSKAAVWVGETGWPTKGPNYQKAAATTASLQQFYNNVGCWLWQQKDASGFWFTAFDTPAHSTEVEKYFGIANQDRKLKFGLTC

SEQ ID NO: 5737 - DNA, 1149 bp, Candida albicans
  CDS (122)..(1048): transl_table=12
tagagcctattatatataagtcacatcaacttcagtcttatacccacttcttcccatccttatatttaatatcttcattcgttttcccttcagttttttaaaaagaagttctatttcaacaatgcaaatcaaattcttgactactctcgcaactgttcttacttcagttgccgccatgggtgatttggctttcaaccttggtgttaaaaatgatgacggtacttgtaaagacgtcagtacttttgaaggtgatttagatttcttgaaaagtcattcgaaaatcattaaaacttatgctgtttccgattgtaacactttacaaaaccttggtccagctgctgaagctgaaggattccaaatccaattaggtatctggccaaatgatgatgctcattttgaagctgaaaaggaagctttgcaaaactatttgccaaagatttccgtctccaccataaagattttcttggttggttctgaagctttatacagagaagatttgactgcttctgaattagcttccaagattaatgacatcaagggtttagttaaaggcattaaaggcaaaaacgggaaatcctactcaagtgtcccagttgggactgttgattcttgggatgtcttagttgatggtgccagtaaaccagccatcgatgctgcagatgttgtctactccaactccttctcatactggcaaaaaaacagtcaagctaatgcttcatactctcttttcgatgatgttatgcaagctttgcaaactcttcaaactgctaaaggttccactgatattgaattctgggttggtgaaactggttggccaactgatggtagttcatatggtgattccgttccttctgttgaaaatgctgctgatcaatggcaaaaaggtatctgtgctcttagagcttggggtattaatgttgctgtctatgaagcttttgatgaagcctggaaaccagatacttccggtactagctccgttgaaaaacattggggtgtttggcaatccgacaaaactttgaaatactcaattgactgtaaattcaactaagtgttttttgattgtctagaatttatttgatgtttatttaacactcaatttcattttttatcgtaacttggatttttcttatttcaacttttttttagcat

SEQ ID NO: 5738 - protein, 308 aa, Candida albicans
MQIKFLTTLATVLTSVAAMGDLAFNLGVKNDDGTCKDVSTFEGDLDFLKSHSKIIKTYAVSDCNTLQNLGPAAEAEGFQIQLGIWPNDDAHFEAEKEALQNYLPKISVSTIKIFLVGSEALYREDLTASELASKINDIKGLVKGIKGKNGKSYSSVPVGTVDSWDVLVDGASKPAIDAADVVYSNSFSYWQKNSQANASYSLFDDVMQALQTLQTAKGSTDIEFWVGETGWPTDGSSYGDSVPSVENAADQWQKGICALRAWGINVAVYEAFDEAWKPDTSGTSSVEKHWGVWQSDKTLKYSIDCKFN

SEQ ID NO: 5739 - DNA, 966 bp, Schizosaccharomyces pombe
  CDS (1)..(966)
atgcaattcctttcgtcttttgtgtttgccgctttggctttgttgcctctttctgctatggctgttgatgaagctgcttccgaaatcgcttcttccaccaagcctgcctctaccaatggcactctcagcttctgcttaggcgtgaagcatgctgatggcacctgcaagtatacggacgattacttggctgattttgaggtccttgctccttacaccaacatgattcgtacctatgccactagtgattgtaacactctcgagtacttattacccgcacttgctcagtcgccttacaacttttctgccatcctcggtgtttggcccactgacgacgctcattacgatttggaaaagcaagctcttatgcagtatttgcctcagtatggtgttgatcatgttagagctataacagttggctctgaagtcttgtacaggaatgatctacctgctgacgtccttgccgaacgcatttacgacgtccgtggccttgttcaacaaaagctcggcttcgatgttcccgttggtactgcggatagttggaacttgtgggctggtggtagcggtgatgttgttattactgccagtgactttatcatgtcgaatgacttcccttactggcaaggtcaaaacaccagtaacatgaccaacaccttcatctccgatactttggctgctttagagcgcgtccaatccgtcaagggtaccaacaacgttaccttttgggttggtgagactggttggcctactgatggtccttcttatggagaggctgatgccacggttgatattgctagtgaattcttccaagaggccttgtgtaacatacgtcgtaagggcattgatatcttctttttcgaggcatttgacgaggactggaagggtgactcctcttccgttgaaccctactttggagccatgtacagcaaccgcactctcaagtacaatttgaattgcacctctgagtaa

SEQ ID NO: 5740 - protein, 321 aa, Schizosaccharomyces pombe
MQFLSSFVFAALALLPLSAMAVDEAASEIASSTKPASTNGTLSFCLGVKHADGTCKYTDDYLADFEVLAPYTNMIRTYATSDCNTLEYLLPALAQSPYNFSAILGVWPTDDAHYDLEKQALMQYLPQYGVDHVRAITVGSEVLYRNDLPADVLAERIYDVRGLVQQKLGFDVPVGTADSWNLWAGGSGDVVITASDFIMSNDFPYWQGQNTSNMTNTFISDTLAALERVQSVKGTNNVTFWVGETGWPTDGPSYGEADATVDIASEFFQEALCNIRRKGIDIFFFEAFDEDWKGDSSSVEPYFGAMYSNRTLKYNLNCTSE

SEQ ID NO: 5741 - DNA, 24 bp, Artificial sequence
  primer
atgcgtttctctactacactcgct

SEQ ID NO: 5742 - DNA, 24 bp, Artificial sequence
  primer
tcatgaaaagtcacagtccaagga

SEQ ID NO: 5743 - protein, 375 aa, Artificial sequence
  consensus sequence
  Variant (2)..(22): Xaa in position 2 to 22 is any amino acid
  Variant (23)..(43): Xaa in position 23 to 43 is any or no amino acid
  Variant (45)..(46): Xaa in position 45 to 46 is any amino acid
  Variant (48)..(52): Xaa in position 48 to 52 is any amino acid
  Variant (53)..(53): Xaa in position 53 is any or no amino acid
  Variant (55)..(55): Xaa in position 55 is any amino acid
  Variant (56)..(56): Xaa in position 56 is any or no amino acid
  Variant (58)..(78): Xaa in position 58 to 78 is any amino acid
  Variant (79)..(84): Xaa in position 79 to 84 is any or no amino acid
  Variant (86)..(88): Xaa in position 86 to 88 is any amino acid
  Variant (89)..(91): Xaa in position 89 to 91 is any or no amino acid
  Variant (93)..(98): Xaa in position 93 to 98 is any amino acid
  Variant (100)..(109): Xaa in position 100 to 109 is any amino acid
  Variant (110)..(112): Xaa in position 110 to 112 is any or no amino acid
  Variant (114)..(114): Xaa in position 114 is any amino acid
  Variant (116)..(125): Xaa in position 116 to 125 is any amino acid
  Variant (126)..(142): Xaa in position 126 to 142 is any or no amino acid
  Variant (145)..(159): Xaa in position 145 to 159 is any amino acid
  Variant (160)..(163): Xaa in position 160 to 163 is any or no amino acid
  Variant (168)..(168): Xaa in position 168 is any amino acid
  Variant (172)..(194): Xaa in position 172 to 194 is any amino acid
  Variant (195)..(210): Xaa in position 195 to 210 is any or no amino acid
  Variant (213)..(213): Xaa in position 213 is any amino acid
  Variant (216)..(216): Xaa in position 216 is any amino acid
  Variant (218)..(228): Xaa in position 218 to 228 is any amino acid
  Variant (229)..(231): Xaa in position 229 to 231 is any or no amino acid
  Variant (233)..(233): Xaa in position 233 is any amino acid
  Variant (235)..(242): Xaa in position 235 to 242 is any amino acid
  Variant (246)..(249): Xaa in position 246 to 249 is any amino acid
  Variant (250)..(252): Xaa in position 250 to 252 is any or no amino acid
  Variant (254)..(275): Xaa in position 254 to 275 is any amino acid
  Variant (276)..(282): Xaa in position 276 to 282 is any or no amino acid
  Variant (284)..(285): Xaa in position 284 to 285 is any amino acid
  Variant (291)..(292): Xaa in position 291 to 292 is any amino acid
  Variant (294)..(304): Xaa in position 294 to 304 is any amino acid
  Variant (305)..(305): Xaa in position 305 is any or no amino acid
  Variant (308)..(315): Xaa in position 308 to 315 is any amino acid
  Variant (317)..(330): Xaa in position 317 to 330 is any amino acid
  Variant (331)..(333): Xaa in position 331 to 333 is any or no amino acid
  Variant (335)..(343): Xaa in position 335 to 343 is any amino acid
  Variant (344)..(356): Xaa in position 344 to 356 is any or no amino acid
  Variant (358)..(368): Xaa in position 358 to 368 is any amino acid
  Variant (369)..(372): Xaa in position 369 to 372 is any or no amino acid
  Variant (374)..(374): Xaa in position 374 is any amino acid
MXXXXXXXXXXXXXXXXXXXXXXXXXXXXXXXXXXXXXXXXXXFXXGXXXXXXGXXKXXXXXXXXXXXXXXXXXXXXXXXXXXXYXXXXXXTXXXXXXAXXXXXXXXXXXXXGXWXXXXXXXXXXXXXXXXXXXXXXXXXXXALXXXXXXXXXXXXXXXXXXXVGSEXLYRXXXXXXXXXXXXXXXXXXXXXXXXXXXXXXXXXXXXXXXVGXVDXWXXXXXXXXXXXXXXAXDXXXXXXXXYWQXXXXXXXNXXXXXXXXXXXXXXXXXXXXXXXXXXXXXWXXETGWPXXGXXXXXXXXXXXXNAXXXXXXXXCXXXXXXXXXXXXXXXXXDXXXXXXXXXXXXXXXXXXXXXXGXXXXXXXXXXXXXXXLXC

SEQ ID NO: 5744 - protein, 13 aa, Artificial sequence
  protein pattern
  Variant (5)..(5): Xaa in position 5 is Ala, Asp or Val
  Variant (9)..(9): Xaa in position 9 is any amino acid
  Variant (10)..(10): Xaa in position 10 is Asp or Ser
  Variant (11)..(12): Xaa in position 11 to 12 is any amino acid
  Variant (13)..(13): Xaa in position 13 is Ala, Gly or Pro
VGSEXLYRXXXXX

SEQ ID NO: 5745 - protein, 11 aa, Artificial sequence
  protein pattern
  Variant (2)..(2): Xaa in position 2 is Ile or Val
  Variant (3)..(3): Xaa in position 3 is Gly or Thr
  Variant (9)..(9): Xaa in position 9 is Ser, Thr or Val
  Variant (10)..(10): Xaa in position 10 is any amino acid
WXXETGWPXXG

SEQ ID NO: 5746 - protein, 14 aa, Artificial sequence
  protein pattern
  Variant (2)..(2): Xaa in position 2 is Ser or Thr
  Variant (4)..(4): Xaa in position 4 is Asp, Asn or Thr
  Variant (5)..(6): Xaa in position 5 to 6 is any amino acid
  Variant (7)..(7): Xaa in position 7 is Ala, Asn, Thr or Val
  Variant (8)..(8): Xaa in position 8 is Ala, Asp, Gly or Asn
  Variant (10)..(10): Xaa in position 10 is any amino acid
  Variant (11)..(11): Xaa in position 11 is Ala, Gly, Asn or Ser
  Variant (12)..(12): Xaa in position 12 is any amino acid
  Variant (13)..(13): Xaa in position 13 is Ala, Pro, Thr or Val
  Variant (14)..(14): Xaa in position 14 is Ala, Ile or Val
DXWXXXXXGXXXXX

SEQ ID NO: 5747 - protein, 17 aa, Artificial sequence
  protein pattern
  Variant (2)..(2): Xaa in position 2 is Ala or Val
  Variant (4)..(4): Xaa in position 4 is any amino acid
  Variant (5)..(5): Xaa in position 5 is Ala, Glu or Asn
  Variant (6)..(9): Xaa in position 6 to 9 is any amino acid
  Variant (10)..(10): Xaa in position 10 is Ile, Leu or Val
  Variant (11)..(12): Xaa in position 11 to 12 is any amino acid
  Variant (14)..(14): Xaa in position 14 is Ile, Leu or Val
  Variant (16)..(16): Xaa in position 16 is any amino acid
  Variant (17)..(17): Xaa in position 17 is Asp, Gly, Asn, Ser or Thr
PXAXXXXXXXXXGXWXX

SEQ ID NO: 5748 - protein, 26 aa, Artificial sequence
  protein pattern
  Variant (2)..(4): Xaa in position 2 to 4 is any or no amino acid
  Variant (6)..(6): Xaa in position 6 is Ala, Cys, Asn or Ser
  Variant (7)..(7): Xaa in position 7 is any amino acid
  Variant (9)..(15): Xaa in position 9 to 15 is any amino acid
  Variant (16)..(16): Xaa in position 16 is any or no amino acid
  Variant (18)..(19): Xaa in position 18 to 19 is any amino acid
  Variant (20)..(20): Xaa in position 20 is Ala, Asp, Glu, Asn or Ser
  Variant (21)..(21): Xaa in position 21 is Asp, Glu or Thr
  Variant (22)..(22): Xaa in position 22 is Phe, Trp or Tyr
  Variant (23)..(24): Xaa in position 23 to 24 is any amino acid
  Variant (25)..(25): Xaa in position 25 is Asp or Glu
  Variant (26)..(26): Xaa in position 26 is Phe or Leu
GXXXFXXGXXXXXXXXKXXXXXXXXX

SEQ ID NO: 5749 - protein, 18 aa, Artificial sequence
  protein pattern
  Variant (2)..(2): Xaa in position 2 is any amino acid
  Variant (3)..(3): Xaa in position 3 is Ala, Ile, Leu or Val
  Variant (4)..(5): Xaa in position 4 to 5 is any amino acid
  Variant (6)..(6): Xaa in position 6 is Asp or Asn
  Variant (7)..(7): Xaa in position 7 is Ala, Asp, Glu, Gly or Ser
  Variant (8)..(8): Xaa in position 8 is Phe or Tyr
  Variant (9)..(9): Xaa in position 9 is Pro or Ser
  Variant (11)..(11): Xaa in position 11 is Phe, Trp or Tyr
  Variant (12)..(12): Xaa in position 12 is Glu or Gln
  Variant (13)..(17): Xaa in position 13 to 17 is any amino acid
  Variant (18)..(18): Xaa in position 18 is Asp, Gly, Asn or Ser
DXXXXXXXXYXXXXXXXX

SEQ ID NO: 5750 - DNA, 444 bp, Saccharomyces cerevisiae
  CDS (1)..(444)
atggaccacagggctgcttttggatattttagcaacgcctgcttcaaagtcatgcttttttcctcgctgttagcttcatttgcatcatcagtagcgttcatctcattaatcacattctcgttatcttcgtcagaatctcctaactgggctgaattggtggtgaactctaagtggtctagctcaaaggcactatcctttttcccttcttcaaaatcttcagtattgaaaacctcctgttggtttacaatatctcttgaagactcagaaatgtttttatcctcattttttgaggcagccttcttcttgcttaccaatgaaatgatatttttcatattatactatttttttagttgtttgatgttcttctatgtagcatcagaaagaaacaccaacccgaaaattcttcaaacaatcaataccaaaccgctttatataaaaaattaa

SEQ ID NO: 5751 - protein, 147 aa, Saccharomyces cerevisiae
MDHRAAFGYFSNACFKVMLFSSLLASFASSVAFISLITFSLSSSESPNWAELVVNSKWSSSKALSFFPSSKSSVLKTSCWFTISLEDSEMFLSSFFEAAFFLLTNEMIFFILYYFFSCLMFFYVASERNTNPKILQTINTKPLYIKN

SEQ ID NO: 5752 - DNA, 22 bp, Artificial sequence
  primer
atggaccacagggctgcttttg

SEQ ID NO: 5753 - DNA, 28 bp, Artificial sequence
  primer
ttaattttttatataaagcggtttggta

SEQ ID NO: 5754 - DNA, 1398 bp, Saccharomyces cerevisiae
  CDS (1)..(1398)
atgctaagatcaaatttatgcagaggatctcgaatccttgcaagactgaccactacaccaaggacatacacatctgcggcgacagctgcggctgcgaatcggggacatatcatcaaaacatacttcaatagagattctacgacaattacgttctccatggaggagtccagcaagccggtttccgtttgctttaacaacgtttttcttagagatgcctcccatagtgccaagctggtgaccacgggagaactgtatcataacgagaaattgaccgctcctcaggacattcaaatttctgaggacggaaaatctctagtggtgaaatggaaagatggcggtcatcaccagttccctttacaattctttatcgactataaaggttccagttttgtttcgccagcaacaagaaaacaagaatccagatatagaccccagttatggaataagcgcatcctgaaagataacgtcaaggacttactttctgtgagctacaacgagtttattgatcctaaggatgactccaagcttttccaaacgctggtcaacctacaaaagtttggtatcgctttcatttccggtactccttcatcctcctctgaaggccttaccatacaaaagatctgtgaaaggatcggacccataagatcgactgtacatggtgaaggtacatttgacgtgaatgcatcccaagcgacaagtgttaatgcccattatgccaataaagacttgccgctacatacggatttaccatttttagaaaatgtgccaggtttccagattctacaatctctacctgctacagaaggggaagatcccaatactagacccatgaattacttcgtggacgcattttatgctacccgtaatgttagagaatcggattttgaggcttatgaggctttacaaattgttcctgtaaattatatatatgaaaacggcgataagaggtactaccaatccaaacctttaatcgaacatcacgacattaacgaggacaatactcttctgggtaattatgaggccttgattaaatgcattaactactctccaccataccaagcacctttcactttcggaatttatgataagccctcagatctaaataataatctggacttgaatttaattaccaccccagcaaaactaacagagagatttttgtttaagtctttcattagggggttgaacttgttcgagagtcatatcaatgacttcaacaatcaatttagattgcagttgcccgaaaactgttgtgttatctttaacaacaggagaattttgcatgctaactctttaacaagctcaaaccagcaatggttaaagggttgctatttcgattctgatactttcaagagtaaattaaagttcttggaagagaagtttcctcatgacaaataa

SEQ ID NO: 5755 - protein, 465 aa, Saccharomyces cerevisiae
MLRSNLCRGSRILARLTTTPRTYTSAATAAAANRGHIIKTYFNRDSTTITFSMEESSKPVSVCFNNVFLRDASHSAKLVTTGELYHNEKLTAPQDIQISEDGKSLVVKWKDGGHHQFPLQFFIDYKGSSFVSPATRKQESRYRPQLWNKRILKDNVKDLLSVSYNEFIDPKDDSKLFQTLVNLQKFGIAFISGTPSSSSEGLTIQKICERIGPIRSTVHGEGTFDVNASQATSVNAHYANKDLPLHTDLPFLENVPGFQILQSLPATEGEDPNTRPMNYFVDAFYATRNVRESDFEAYEALQIVPVNYIYENGDKRYYQSKPLIEHHDINEDNTLLGNYEALIKCINYSPPYQAPFTFGIYDKPSDLNNNLDLNLITTPAKLTERFLFKSFIRGLNLFESHINDFNNQFRLQLPENCCVIFNNRRILHANSLTSSNQQWLKGCYFDSDTFKSKLKFLEEKFPHDK

SEQ ID NO: 5756 - DNA, 1485 bp, Gibberella zeae PH-1
  CDS (1)..(1485)
atgttctcccgtcgactggcaacgcaaagttgcagagcaattcctcgtggattctcattaacgcgaatacatgctcaaaacgctaccacctacagaaggatcatcagtaaaccgccaccccaatttaaagtccgagactccttcaaaacttacaatgactctctcaccatttccagcagtggccgttctatcttcatggtggatagtgagaagggctggacgaaattagacgccatgctcctccgcgatagctgcacttgcgcagcgtgcgtcgacacagcctcgggccaaaaaacctttgctacaacagacataccgtcaaatattgccattgacaagatccgcaagacggaagaaggtgtcggcatcacgttcaagaacgacatgtatcccgaccacgagatggtgtttccctggttgtcagtcagtcaagcaatgggtcaccaaaaagtcccaaagatgccttttccaaggcaagaacttgtgtttcccaaaacaggccggacgttctgggacaaggccatcatccaggaacgtgttcgcaagatcgactatcacgaattcatgaaaggatctgacgcgttctggcacaccattctggacctctcaaatcttggcctcgtgttcctcaaaaatgtgccgcaggacgagaattccatcgtcgacatcaccacgcgcatcgccaacatcaaagagaccttttatggccgcacgtttgacgttcgcgcaaagccagatgccgagaacgtggcctacacgagtggctacttgggtcttcaccaagatctgctgtaccttgagagcccgcccgctatccaactgcttcattgtatggagaactcgtgtgaaggcggagaatcgctttttagcgatggtctgttcgctggcaaactgcttttcctacaatcttccccaacaatcaggaacctctggaaagtaatggttccgtatcactacgagaagcatggctacttctaccatcaaagacgaccgatccttgagctcggcccaaatgaaaacctcgccggtgtaaactggagtccgcctttccaggaccaattctcgagcgctgccgtcgatgcacgagagtggctcgagccagcgaagctgttcgatcgcatgatcaataaccctgacgttatgtacgagatgaagatggagcctggagagtgtgtgcttttcgacaatacgcggattatgcatgggcgcaataaattcgatgtcggtggtggatcgagatggttgaggggagcgtacatttcgagagaggactttgtgagccgtgcactgcatgtgcccgaggaattggcgacggaatatcgagctggcaagaaatggagccgtgatattgaagatcaagaagtgagggggtcagagtggtttggaaagacctcggaacaggtcgatgaagtgattgaaggattgaagaaagacaagagcatcgatacgatgaagtcaagagactttgagcttttgaggatgtaa

SEQ ID NO: 5757 - protein, 494 aa, Gibberella zeae PH-1
MFSRRLATQSCRAIPRGFSLTRIHAQNATTYRRIISKPPPQFKVRDSFKTYNDSLTISSSGRSIFMVDSEKGWTKLDAMLLRDSCTCAACVDTASGQKTFATTDIPSNIAIDKIRKTEEGVGITFKNDMYPDHEMVFPWLSVSQAMGHQKVPKMPFPRQELVFPKTGRTFWDKAIIQERVRKIDYHEFMKGSDAFWHTILDLSNLGLVFLKNVPQDENSIVDITTRIANIKETFYGRTFDVRAKPDAENVAYTSGYLGLHQDLLYLESPPAIQLLHCMENSCEGGESLFSDGLFAGKLLFLQSSPTIRNLWKVMVPYHYEKHGYFYHQRRPILELGPNENLAGVNWSPPFQDQFSSAAVDAREWLEPAKLFDRMINNPDVMYEMKMEPGECVLFDNTRIMHGRNKFDVGGGSRWLRGAYISREDFVSRALHVPEELATEYRAGKKWSRDIEDQEVRGSEWFGKTSEQVDEVIEGLKKDKSIDTMKSRDFELLRM

SEQ ID NO: 5758 - DNA, 1527 bp, Candida glabrata CBS 138
  CDS (1)..(1527)
atgattagaagtcatatgcgaagattcagacacaatgcagctacgtccctgctgagacacaccaggttatactcgcaagccagcggcaagattctcgatgcatcatttaccgatgagtccaccactgttacatttttgcatgaatccatggttcagcctaatgattcggtccccacatcattggatgcgacaccagacacacaagataagattaggccattcacagtatgtttcaataatatattcttgagggatgcatcgaaatctccaaaaacagtggaccctgtttcaggtcaaagactagtaacaacagctgagcttctggatgaacataacggtagaagggccactgttcctagatctgtcaacatttctgaggatggtaagagactggtagttgattggagcgatggcgatagctatgcctatgatctcgattttttcttcaagtataaaggttcctctttcttgactaaatctattagaaatcaaatgtcgaagcacaagagagtcttttggaacagagatctactaaatagcaagatagataagaacagagatggctcatttttctcttttgaccaggtgatgaatgatgataagctcttgtacaggacactggtaaatttgcaacaattcggtattacgtttatatctggaatgccaacaatcagagatgaaactgatgcaaatgatgcaaatatatatatggtcagaaacctgtgtgaaagaataggaccattgaggaagacattttatggtgaagtatttgatataaccaaccaaaacttgaaagattatgatcaggatttgcctccaccacatgactacaatattccattcgaaaacatagcatctccattgcacatggacttacaatttctggaaaacgttccggggttcaaaatcttacatgctttgaaaaatgaatccgagaatgatacaaatatatttgttgactctctttacgcggccagaaatattcgtgaaacagataacgaagcctacgaggctctacaacatgttccaatcaattataccttcaagaacaaaaacaagagatattaccaatcgaagccacttgtagaagaatatgagagtaatgagcataatacgttgatcggcaattatgaatacctagtcaagtgtgtaaactactctccaccattccaagccccattcacttatggtatctacaacaaattgacaaacgtaccaaagatcgagggaatagaagatccattgaccacctctccaggtaaagtcactgaaagattagttttcagagacttcctaagaggtttacaacagtttgagaagatggtatatgaccacgaaaaccagctaagaataaacttacctgaaaataccgcggttatctacaacaatagaagaatactgcataccaggaccaatcataacacaaggcaatcagaccttgtttggttcaagtcatgctacttcgatctggacactttcaaaagtaaattgaaattcctagaggaagcatttgagaaatccaagtga

SEQ ID NO: 5759 - protein, 508 aa, Candida glabrata CBS 138
MIRSHMRRFRHNAATSLLRHTRLYSQASGKILDASFTDESTTVTFLHESMVQPNDSVPTSLDATPDTQDKIRPFTVCFNNIFLRDASKSPKTVDPVSGQRLVTTAELLDEHNGRRATVPRSVNISEDGKRLVVDWSDGDSYAYDLDFFFKYKGSSFLTKSIRNQMSKHKRVFWNRDLLNSKIDKNRDGSFFSFDQVMNDDKLLYRTLVNLQQFGITFISGMPTIRDETDANDANIYMVRNLCERIGPLRKTFYGEVFDITNQNLKDYDQDLPPPHDYNIPFENIASPLHMDLQFLENVPGFKILHALKNESENDTNIFVDSLYAARNIRETDNEAYEALQHVPINYTFKNKNKRYYQSKPLVEEYESNEHNTLIGNYEYLVKCVNYSPPFQAPFTYGIYNKLTNVPKIEGIEDPLTTSPGKVTERLVFRDFLRGLQQFEKMVYDHENQLRINLPENTAVIYNNRRILHTRTNHNTRQSDLVWFKSCYFDLDTFKSKLKFLEEAFEKSK

SEQ ID NO: 5760 - DNA, 1263 bp, Kluyveromyces lactis NRRL Y-1140
  CDS (1)..(1263)
atgctacgtagaagtgcgctaaatcgagcgtttgttagattttactccttggataagggcaagggaagcaagattataggacgtgaggtgactcagtatggaattacagttaagtttcaacagcagggacaagtcaaggaacagtacttggaccatttattactaagggacgctagtcaaagtcccaaatcggtagatccgatttctagccagaagcttttcaccacaggatctttattgattgatcgtggtcggcccttggaaccaatccagccaggaattgctgatatagtagacgaaggtcaaggtttatatgttcattggaacgatggtgatcaatttacttacacgagtgagtatttgcagtcattggttggagaaagtgtgtccattaagaagtatgatcctaaagtttggaaccaagaaattgtgagcaaaccggattttttatccgcactaagcatcgattaccattcatacatggatccacacgatgaatccagtctttttgaaacgatcaagaagctcgaccaatatggtatagggctagtgaccgatatcccagacgaggcagctaccaattacagcgaatggtttgttcagatgatctgcgaacgaatcggacacgtaagaaccactttttatggggagcttttcgatgtgaaaaaccaagcttcacaggctaacaacatcgcttatactgcgaaacctctgcctttacatatggatttgctatatttggagaatattccaggttggcaattgttgcattgtatcaagaatagcgaaggtttggaagagaacggacagaactacttcgttgactcattgggagcgttgaactacattaaaaataaggatcccagtgtattaaaggcattggaaacgattcctatcacttatcattatagaagagatgataaaaggtactaccagcaaagacctttagtagagcacaagaagtatgaaacagtggtcaattattcaccaccattccaaggaccattcaatctcaaagatatcactgatattccactcttgaaccagttcaagaaaggtttatacatgttcgaagagtacattaacgatccgaagaaccaattccagatcaaattaccggagaattcctgtgtcatcttccacaacagaagaattttgcatgctaggagacaatttgacggtgagagatggttaaagggttgctatttggatgctgatacgttctcatcgaaattgtcgtatctatatgaaaagtttaattag

SEQ ID NO: 5761 - protein, 420 aa, Kluyveromyces lactis NRRL Y-1140
MLRRSALNRAFVRFYSLDKGKGSKIIGREVTQYGITVKFQQQGQVKEQYLDHLLLRDASQSPKSVDPISSQKLFTTGSLLIDRGRPLEPIQPGIADIVDEGQGLYVHWNDGDQFTYTSEYLQSLVGESVSIKKYDPKVWNQEIVSKPDFLSALSIDYHSYMDPHDESSLFETIKKLDQYGIGLVTDIPDEAATNYSEWFVQMICERIGHVRTTFYGELFDVKNQASQANNIAYTAKPLPLHMDLLYLENIPGWQLLHCIKNSEGLEENGQNYFVDSLGALNYIKNKDPSVLKALETIPITYHYRRDDKRYYQQRPLVEHKKYETVVNYSPPFQGPFNLKDITDIPLLNQFKKGLYMFEEYINDPKNQFQIKLPENSCVIFHNRRILHARRQFDGERWLKGCYLDADTFSSKLSYLYEKFN

SEQ ID NO: 5762 - DNA, 1335 bp, Debaryomyces hansenii CBS767
  CDS (1)..(1335)
atgactttggtctcttcgggtcgaatattaaaggcttcaataagtaagtctctttgttttttaaggtattcatcgagtttgaggttagaaaattacaatgataattatatttcggtaactttcgataatgtggatagcacccatactgttaagtttaacaatgtattcctaagagattcgtgtacatctgttagctctagagatccattttcaaaacaaaaattgttttcgacaagcgatattagccacggattatctttgcatggtacaccaaaaatagttaataccccagataatgaagattgtttagaagtaacctggagtcagaacggatcactccataaatcaaaatattcaagtgtattcttagaaggttattcctctaattcctcgattagaaagggaaagtatttcaataattcaaagattatttgggataataatcgtattatgaagaatatttcggatttgcaagtgacttatagcgattatgctgagaagaatctgctcttcgtcaaaactttaaataatttgaatcaattcgggctctcctttatcaatgatatcccaagtccacttaataatcccaagactcaggttatgaatgaagataatgcattaaaatggccggtagctgctttagcgtccaaattcggctatatcaaaaagactttctatggaactttattcgatgtaagaaatgaaaaagaggccaaaaacattgcaaatacgaatacattcttgcccttgcacatggatttattgtattatgaatcacctcctggattacaattgttgcattttatacagaattcaactctaggtggagagaacattttttgtgattcatttgcagctgctatacacgttagaaacatggatccccaggcatatttggctttgactaaaattccaatcacgtaccattacgataataataatgaacattattattatgcaagacctttgatcgttgaggagaattttaactcaaatgcaaatgtgcctgccattaaggaagttaactattccccaccatttcaaggcccattcgaggttggaacttttgaggataattcttctgaaaatgtatattttaaggattttttgagaggtttcaaattatttacagatttcgtgaatgatccaattaatcagtacgaaataaaaatgaaagaaggctcgtgtgctatattcgataatagaagagttttacactcacgtaaagagttctccgacgagaacggaggtgatagatggttaatgggatgctatgttgatgctgatagctttagatcgaaactaagaatcggtaatagatctttagaaaaataa

SEQ ID NO: 5763 - protein, 444 aa, Debaryomyces hansenii CBS767
MTLVSSGRILKASISKSLCFLRYSSSLRLENYNDNYISVTFDNVDSTHTVKFNNVFLRDSCTSVSSRDPFSKQKLFSTSDISHGLSLHGTPKIVNTPDNEDCLEVTWSQNGSLHKSKYSSVFLEGYSSNSSIRKGKYFNNSKIIWDNNRIMKNISDLQVTYSDYAEKNLLFVKTLNNLNQFGLSFINDIPSPLNNPKTQVMNEDNALKWPVAALASKFGYIKKTFYGTLFDVRNEKEAKNIANTNTFLPLHMDLLYYESPPGLQLLHFIQNSTLGGENIFCDSFAAAIHVRNMDPQAYLALTKIPITYHYDNNNEHYYYARPLIVEENFNSNANVPAIKEVNYSPPFQGPFEVGTFEDNSSENVYFKDFLRGFKLFTDFVNDPINQYEIKMKEGSCAIFDNRRVLHSRKEFSDENGGDRWLMGCYVDADSFRSKLRIGNRSLEK

SEQ ID NO: 5764 - DNA, 1362 bp, Yarrowia lipolytica CLIB122
  CDS (1)..(1362)
atgctacacactatcaagggtcttcgacaagtgcggggagctcggggcttctccgtgagctcgagagcgcttcttcagctcaaaaatgtgaccaagacaggtcttgaaattgaactggaacccggatcgacccccgttcactactccaactttttcctcagagatgccgcctcctccacaaacgccattgatccctcgacttcgcagcggtacttttcttccggcgagctggccaaggacatccatcccaagaaaatccatgtgggcaagaaggagggccaagccgactctgccgtgtactccactcaggacaccaaaatatgccagcatgatacggacattgacggcctgaaaatcgagtggtccgacggcttccaggagtactacacggcacactttctcaagcagtatgcgtcgcccgaggcttctcgaaaacgacgacatttggcccagcctattgaactgtgggagagaaaggagattactgaggcgctggacaaaaaccaaatccagaccacgtggaaggaataccagaccaccgagggtatgcataaaatcgtcaaggctctgcacgactacggtctggcgttcgtgacgggtctacctgaccagaagacaacggtggttgatgctgaagacaaggatgtgggtactgtcacagcagaacccattctcgtggaagaggtcggaaagaagattggatacatcaaggaaaccttctatggccgatcatgggacacccgatctgtccccaaccccaaaaacgtggcctacacttcgcagtacttgcctctgcacatggacctgctctactacgagtctcctcctggcattcagctgctccacgtcatcaaaaaccaggctgtcggaggcgagtccatattcacagactcgtttgcatctgctaaatacgtctgggaaaagaatcctgccgcctacagagctctgtgtgagattcctttgacattccattacatcaacgacggccagcattaccacaacaccgtgcccatgattgtcgaacaccagcagacagacaagagcaagtggaccaaccccaaagccatcaactacgctcctcctttccagggcccctttgacgcagttgagctagttgagggaggtgagaagtgcgagctattcagagaaggtctcagactgtttgaagagcaccttaccagcgctgaaaatgagctgcgaacaaagatggaagagaactcctgtgtgcttttcctaaaccgtcgagttcttcattctcgaaccgagtttgatgcacagtctggcgtcagatggctcaagggaacttatctggacatcgatgccttctactccaaactgagagttctatcaaacgattcctaa

SEQ ID NO: 5765 - protein, 453 aa, Yarrowia lipolytica CLIB122
MLHTIKGLRQVRGARGFSVSSRALLQLKNVTKTGLEIELEPGSTPVHYSNFFLRDAASSTNAIDPSTSQRYFSSGELAKDIHPKKIHVGKKEGQADSAVYSTQDTKICQHDTDIDGLKIEWSDGFQEYYTAHFLKQYASPEASRKRRHLAQPIELWERKEITEALDKNQIQTTWKEYQTTEGMHKIVKALHDYGLAFVTGLPDQKTTVVDAEDKDVGTVTAEPILVEEVGKKIGYIKETFYGRSWDTRSVPNPKNVAYTSQYLPLHMDLLYYESPPGIQLLHVIKNQAVGGESIFTDSFASAKYVWEKNPAAYRALCEIPLTFHYINDGQHYHNTVPMIVEHQQTDKSKWTNPKAINYAPPFQGPFDAVELVEGGEKCELFREGLRLFEEHLTSAENELRTKMEENSCVLFLNRRVLHSRTEFDAQSGVRWLKGTYLDIDAFYSKLRVLSNDS

SEQ ID NO: 5766 - DNA, 1224 bp, Candida albicans SC5314
  CDS (1)..(1224): transl_table=12
atgttaagacaaccattacgccaaatccgtttccactcgaaattggcacttgcaggatacaacagcaaagaagtgacagtcaccatcaacggcagaacctgtacattcaacaacgtgtttttgagagacgcatgccaaagcccagactcggtagaccccatttctagccaaaaactattcactacagcagatgcagcaaccggcttgcaaattaacgcacccccagtggtagaggattcctcattgaaaatccaatggagcaacaatggcaaactcaccaactcagtctaccccgtgtcattcttagaaaactactccaccaacaaacgactcggcaaattctttgacaaagatagaaagttatgggacaaacaagaactcgaaaacaactttgcctccctcaacatggactacgacgacattctcaccaacgacaactctttcttccagacgttgtacaacttgaataggtacgggttaacatttgtcaacaacatccccaccccacaaatttctgacatgacagaggacaacgccacgcaatggccagtgtacaagatcgccgaaaagtttggctacatcaagaaaacattctacgggacattattcgacgtcaagaacaagaaggaaaaagcaaccaacattgcctacaccaacacgtttttgccattgcacatggacttgctctactacgagtcacccccgggattacagttgctacacgctatccagaactctacgttgggcggcgaaaacatcttctgtgactcgtaccttgctgctgagcatgtccggaaaaccgaccccagggcatacacggcactcacccagaccccaatcaccttccactacgacaacaacaacgagtactactactacaagcggccgttaatcgttgaagaccccgaggttggcgacgggttcccgaaaatcgcgtccatcaactatgccccgccattccagggcccattcgaggttgacccccacccagactttatccgcggaatgcagttattcgaaaccttcatcaacgacccggcaaaccactttgaaatcaaaatgccagaaggcacttgtgtcattttcgaaaacagaagagcccttcactcgagaaacgcattctccgacctgaacaacggcgacagatggttaatgggcacttatgttgacggcgacagttttagatcaaaattacgtataggctatagaaaagtacatacctaa

SEQ ID NO: 5767 - protein, 407 aa, Candida albicans SC5314
MLRQPLRQIRFHSKLALAGYNSKEVTVTINGRTCTFNNVFLRDACQSPDSVDPISSQKLFTTADAATGLQINAPPVVEDSSLKIQWSNNGKLTNSVYPVSFLENYSTNKRLGKFFDKDRKLWDKQELENNFASLNMDYDDILTNDNSFFQTLYNLNRYGLTFVNNIPTPQISDMTEDNATQWPVYKIAEKFGYIKKTFYGTLFDVKNKKEKATNIAYTNTFLPLHMDLLYYESPPGLQLLHAIQNSTLGGENIFCDSYLAAEHVRKTDPRAYTALTQTPITFHYDNNNEYYYYKRPLIVEDPEVGDGFPKIASINYAPPFQGPFEVDPHPDFIRGMQLFETFINDPANHFEIKMPEGTCVIFENRRALHSRNAFSDSNNGDRWLMGTYVDGDSFRSKLRIGYRKVHT

SEQ ID NO: 5768 - DNA, 1311 bp, Pichia farinosa
  CDS (1)..(1311)
atgttggtgaagggttacagtattttaggtaagaggtttggtgctgcgagagcgtttcacagtagcagaattgggctcaatttagctatcaaaggctacgataacgagtccattactcttaggatcgataacgagacagtgaacttcactaatatctttttgagagatgcctgtgatttgccaggttcagttgaccccaaccataaacaaaagaagcattcgactgcccaaatttctacagggttaaagatagaggaagagccccgggtggttaagaaaggcaacgaggaagctttacgaatcttgtggtcccagccgaactcaactcacgaatcagaatacacgaaagactttcttttaaaatacagcaataaggcgaacatccggaacagtatctttttcgataaggagcaggtaccatgggatagagttaatgtttcgaaattaccagatgttctacattttgggtatgaccagtacttctcccaagagggattctctaaagtcctagcagacgtgaatagatacggaatatccttcgttagcaacattccagaccctgctctgaatattaaaacccaagagttatctgaaagcaacgtgggtgactggcctattgcaaaattagctagaaagtttggctatatcaaggaaacgttttatggtaccttattcgacgtgaaaaacaaagacgaggccgagaatattgcttatacggatacgtttctacccttacatatggatttattgtattatgaatcacctcccgggcttcaattcctccatttcataaagaattcaacagagggtggtgaaagtatgttcgctgatggttttgcaatcgcgagaaaggtcaaagagcaggatccagaggcatatgatgcattgaagaaagtccttattacgtatcgttatgagaataatggacactattactaccacaaacggcccttagttgttgaagaaacttcctgggagactctggactatgcgtctggcatcattaaagaagtgaattactctcctccattccaaggccactttgaatatggaatccatggagataaacctaaagaaagcgcattgttcaagcttttccttagaggctatctgttgtttgaatctttggcaaatcaagaacaaaaccagttgagtcttaaggtgccagcaggtgtgtgtgtcatatttgataacagacgcattttacattccagaaaatccttctcttcgtcaaatggtggtcaaagatggttgatgggctgttacgtcgacggcgatagcttcaggtctaggttgagaacgaacgattaa

SEQ ID NO: 5769 - protein, 436 aa, Pichia farinosa
MLVKGYSILGKRFGAARAFHSSRIGLNLAIKGYDNESITLRIDNETVNFTNIFLRDACDLPGSVDPNHKQKKHSTAQISTGLKIEEEPRVVKKGNEEALRILWSQPNSTHESEYTKDFLLKYSNKANIRNSIFFDKEQVPWDRVNVSKLPDVLHFGYDQYFSQEGFSKVLADVNRYGISFVSNIPDPALNIKTQELSESNVGDWPIAKLARKFGYIKETFYGTLFDVKNKDEAENIAYTDTFLPLHMDLLYYESPPGLQFLHFIKNSTEGGESMFADGFAIARKVKEQDPEAYDALKKVLITYRYENNGHYYYHKRPLVVEETSWETLDYASGIIKEVNYSPPFQGHFEYGIHGDKPKESALFKLFLRGYLLFESLANQEQNQLSLKVPAGVCVIFDNRRILHSRKSFSSSNGGQRWLMGCYVDGDSFRSRLRTND

SEQ ID NO: 5770 - DNA, 26 bp, Artificial sequence
  primer
atgctaagatcaaatttatgcagagg

SEQ ID NO: 5771 - DNA, 26 bp, Artificial sequence
  primer
ttatttgtcatgaggaaacttctctt

SEQ ID NO: 5772 - protein, 444 aa, Artificial sequence
  consensus sequence
  Variant (4)..(7): Xaa in position 4 to 7 is any amino acid
  Variant (8)..(11): Xaa in position 8 to 11 is any or no amino acid
  Variant (13)..(16): Xaa in position 13 to 16 is any amino acid
  Variant (18)..(21): Xaa in position 18 to 21 is any amino acid
  Variant (23)..(41): Xaa in position 23 to 41 is any amino acid
  Variant (42)..(64): Xaa in position 42 to 64 is any or no amino acid
  Variant (66)..(68): Xaa in position 66 to 68 is any amino acid
  Variant (70)..(99): Xaa in position 70 to 99 is any amino acid
  Variant (100)..(106): Xaa in position 100 to 106 is any or no amino acid
  Variant (108)..(137): Xaa in position 108 to 137 is any amino acid
  Variant (138)..(143): Xaa in position 138 to 143 is any or no amino acid
  Variant (145)..(147): Xaa in position 145 to 147 is any amino acid
  Variant (149)..(150): Xaa in position 149 to 150 is any amino acid
  Variant (152)..(155): Xaa in position 152 to 155 is any amino acid
  Variant (157)..(169): Xaa in position 157 to 169 is any amino acid
  Variant (170)..(187): Xaa in position 170 to 187 is any or no amino acid
  Variant (189)..(192): Xaa in position 189 to 192 is any amino acid
  Variant (197)..(199): Xaa in position 197 to 199 is any amino acid
  Variant (200)..(209): Xaa in position 200 to 209 is any or no amino acid
  Variant (211)..(218): Xaa in position 211 to 218 is any amino acid
  Variant (219)..(219): Xaa in position 219 is any or no amino acid
  Variant (221)..(227): Xaa in position 221 to 227 is any amino acid
  Variant (232)..(232): Xaa in position 232 is any amino acid
  Variant (235)..(237): Xaa in position 235 to 237 is any amino acid
  Variant (239)..(240): Xaa in position 239 to 240 is any amino acid
  Variant (243)..(243): Xaa in position 243 is any amino acid
  Variant (245)..(245): Xaa in position 245 is any amino acid
  Variant (248)..(250): Xaa in position 248 to 250 is any amino acid
  Variant (252)..(259): Xaa in position 252 to 259 is any amino acid
  Variant (260)..(264): Xaa in position 260 to 264 is any or no amino acid
  Variant (266)..(266): Xaa in position 266 is any amino acid
  Variant (268)..(284): Xaa in position 268 to 284 is any amino acid
  Variant (287)..(294): Xaa in position 287 to 294 is any amino acid
  Variant (296)..(301): Xaa in position 296 to 301 is any amino acid
  Variant (303)..(306): Xaa in position 303 to 306 is any amino acid
  Variant (308)..(318): Xaa in position 308 to 318 is any amino acid
  Variant (319)..(331): Xaa in position 319 to 331 is any or no amino acid
  Variant (334)..(334): Xaa in position 334 is any amino acid
  Variant (339)..(340): Xaa in position 339 to 340 is any amino acid
  Variant (342)..(348): Xaa in position 342 to 348 is any amino acid
  Variant (349)..(377): Xaa in position 349 to 377 is any or no amino acid
  Variant (379)..(380): Xaa in position 379 to 380 is any amino acid
  Variant (382)..(384): Xaa in position 382 to 384 is any amino acid
  Variant (386)..(393): Xaa in position 386 to 393 is any amino acid
  Variant (395)..(404): Xaa in position 395 to 404 is any amino acid
  Variant (407)..(407): Xaa in position 407 is any amino acid
  Variant (409)..(409): Xaa in position 409 is any amino acid
  Variant (413)..(413): Xaa in position 413 is any amino acid
  Variant (416)..(416): Xaa in position 416 is any amino acid
  Variant (418)..(424): Xaa in position 418 to 424 is any amino acid
  Variant (425)..(428): Xaa in position 425 to 428 is any or no amino acid
  Variant (431)..(431): Xaa in position 431 is any amino acid
  Variant (433)..(433): Xaa in position 433 is any amino acid
  Variant (435)..(435): Xaa in position 435 is any amino acid
  Variant (437)..(437): Xaa in position 437 is any amino acid
  Variant (439)..(439): Xaa in position 439 is any amino acid
  Variant (441)..(441): Xaa in position 441 is any amino acid
  Variant (443)..(443): Xaa in position 443 is any amino acid
LRDXXXXXXXXDXXXXQXXXXTXXXXXXXXXXXXXXXXXXXXXXXXXXXXXXXXXXXXXXXXXXLXXXWXXXXXXXXXXXXXXXXXXXXXXXXXXXXXXXXXXXXXWXXXXXXXXXXXXXXXXXXXXXXXXXXXXXXXXXXXXLXXXGXXFXXXXPXXXXXXXXXXXXXXXXXXXXXXXXXXXXXXXGXXXXTFYGXXXXXXXXXXXXXDXXXXXXXXXNXXXXXXXLPLHXDLXXXEXXPGXQXLHXXXNXXXXXXXXXXXXXFXDXXXXXXXXXXXXXXXXXALXXXXXXXXYXXXXXXYXXXXPXXXXXXXXXXXXXXXXXXXXXXXXNYXPPFQXXFXXXXXXXXXXXXXXXXXXXXXXXXXXXXXXXXXXXXFXXGXXXFXXXXXXXXNXXXXXXXXXXCVXFXNRRXLHXRXXXXXXXXXXXWLXGXYXDXDXFXSXL

SEQ ID NO: 5773 - protein, 32 aa, Artificial sequence
  protein pattern
  Variant (2)..(2): Xaa in position 2 is Ala, Ile or Val
  Variant (3)..(4): Xaa in position 3 to 4 is any amino acid
  Variant (5)..(5): Xaa in position 5 is Ala or Thr
  Variant (6)..(6): Xaa in position 6 is Ala, Asp, Asn or Ser
  Variant (7)..(8): Xaa in position 7 to 8 is any amino acid
  Variant (10)..(10): Xaa in position 10 is Gly or Pro
  Variant (13)..(13): Xaa in position 13 is any amino acid
  Variant (16)..(17): Xaa in position 16 to 17 is any or no amino acid
  Variant (19)..(20): Xaa in position 19 to 20 is any or no amino acid
  Variant (22)..(22): Xaa in position 22 is Asn or Ser
  Variant (23)..(23): Xaa in position 23 is Ile, Pro or Val
  Variant (25)..(25): Xaa in position 25 is Ala or Gly
  Variant (26)..(26): Xaa in position 26 is any amino acid
  Variant (28)..(28): Xaa in position 28 is Phe, Ile or Leu
  Variant (30)..(31): Xaa in position 30 to 31 is any amino acid
  Variant (32)..(32): Xaa in position 32 is Ile, Leu or Met
NXXXXXXXLXLHXDLXXLXXEXXPXXQXLXXX

SEQ ID NO: 5774 - protein, 42 aa, Artificial sequence
  protein pattern
  Variant (2)..(2): Xaa in position 2 is any amino acid
  Variant (3)..(3): Xaa in position 3 is Glu, Lys or Arg
  Variant (5)..(6): Xaa in position 5 to 6 is any or no amino acid
  Variant (8)..(9): Xaa in position 8 to 9 is any or no amino acid
  Variant (11)..(11): Xaa in position 11 is Glu or Thr
  Variant (12)..(13): Xaa in position 12 to 13 is any amino acid
  Variant (14)..(14): Xaa in position 14 is Ala, Ile, Leu or Val
  Variant (15)..(15): Xaa in position 15 is any amino acid
  Variant (16)..(16): Xaa in position 16 is Asp, Gln or Ser
  Variant (17)..(18): Xaa in position 17 to 18 is any amino acid
  Variant (20)..(21): Xaa in position 20 to 21 is any amino acid
  Variant (22)..(22): Xaa in position 22 is Glu, Gln, Arg or Ser
  Variant (23)..(24): Xaa in position 23 to 24 is any amino acid
  Variant (25)..(25): Xaa in position 25 is Leu, Met or Val
  Variant (26)..(26): Xaa in position 26 is any amino acid
  Variant (27)..(27): Xaa in position 27 is Ala or Glu
  Variant (28)..(28): Xaa in position 28 is Gly or Asn
  Variant (29)..(29): Xaa in position 29 is Cys, Ser, Thr or Val
  Variant (30)..(30): Xaa in position 30 is Ala or Cys
  Variant (31)..(31): Xaa in position 31 is Ala or Val
  Variant (32)..(32): Xaa in position 32 is Ile or Leu
  Variant (33)..(33): Xaa in position 33 is Phe or Tyr
  Variant (34)..(34): Xaa in position 34 is any amino acid
  Variant (38)..(38): Xaa in position 38 is Ala, Ile or Val
  Variant (41)..(41): Xaa in position 41 is Ala, Ser or Thr
  Variant (42)..(42): Xaa in position 42 is Asn or Arg
FXXGXXLXXFXXXXXXXXNXXXXXXXXXXXXXXXNRRXLHXX

SEQ ID NO: 5775 - protein, 56 aa, Artificial sequence
  protein pattern
  Variant (2)..(2): Xaa in position 2 is any amino acid
  Variant (3)..(9): Xaa in position 3 to 9 is any or no amino acid
  Variant (11)..(11): Xaa in position 11 is Ala, Cys, Thr or Val
  Variant (13)..(13): Xaa in position 13 is Ala, Gly or Ser
  Variant (14)..(19): Xaa in position 14 to 19 is any amino acid
  Variant (20)..(20): Xaa in position 20 is Ile or Val
  Variant (21)..(23): Xaa in position 21 to 23 is any amino acid
  Variant (24)..(24): Xaa in position 24 is Asp or Asn
  Variant (25)..(26): Xaa in position 25 to 26 is any amino acid
  Variant (27)..(27): Xaa in position 27 is Ala or Val
  Variant (28)..(29): Xaa in position 28 to 29 is any amino acid
  Variant (32)..(34): Xaa in position 32 to 34 is any amino acid
  Variant (35)..(35): Xaa in position 35 is Leu or Pro
  Variant (36)..(36): Xaa in position 36 is Ile, Leu or Val
  Variant (37)..(37): Xaa in position 37 is Asn or Thr
  Variant (38)..(38): Xaa in position 38 is Phe or Tyr
  Variant (39)..(39): Xaa in position 39 is any amino acid
  Variant (40)..(40): Xaa in position 40 is Phe or Tyr
  Variant (41)..(41): Xaa in position 41 is any amino acid
  Variant (42)..(42): Xaa in position 42 is Asn or Arg
  Variant (43)..(43): Xaa in position 43 is any amino acid
  Variant (44)..(44): Xaa in position 44 is Asp, Gly or Asn
  Variant (45)..(46): Xaa in position 45 to 46 is any amino acid
  Variant (48)..(48): Xaa in position 48 is His or Tyr
  Variant (49)..(51): Xaa in position 49 to 51 is any amino acid
  Variant (53)..(53): Xaa in position 53 is Leu or Met
  Variant (54)..(54): Xaa in position 54 is Ile or Val
  Variant (55)..(55): Xaa in position 55 is any amino acid
  Variant (56)..(56): Xaa in position 56 is Glu or His
NXXXXXXXXFXDXXXXXXXXXXXXXXXXXALXXXXXXXXXXXXXXXYXXXXPXXXX

SEQ ID NO: 5776 - protein, 14 aa, Artificial sequence
  protein pattern
  Variant (2)..(2): Xaa in position 2 is Ala, Cys or Thr
  Variant (4)..(4): Xaa in position 4 is Phe, Ile, Leu or Val
  Variant (5)..(5): Xaa in position 5 is Asp or Ser
  Variant (6)..(6): Xaa in position 6 is any amino acid
  Variant (7)..(7): Xaa in position 7 is Asp or Glu
  Variant (8)..(8): Xaa in position 8 is Ala, Asp, Ser or Thr
  Variant (10)..(10): Xaa in position 10 is any amino acid
  Variant (12)..(12): Xaa in position 12 is any amino acid
  Variant (13)..(13): Xaa in position 13 is any or no amino acid
GXYXXXXXFXSXXL

SEQ ID NO: 5777 - protein, 14 aa, Artificial sequence
  protein pattern
  Variant (2)..(4): Xaa in position 2 to 4 is any amino acid
  Variant (6)..(6): Xaa in position 6 is Ile or Leu
  Variant (7)..(7): Xaa in position 7 is Ala, Gly, Ser, Thr or Val
  Variant (8)..(8): Xaa in position 8 is Phe or Leu
  Variant (9)..(9): Xaa in position 9 is Ile, Leu or Val
  Variant (10)..(10): Xaa in position 10 is any amino acid
  Variant (11)..(11): Xaa in position 11 is Asp, Gly or Asn
  Variant (12)..(12): Xaa in position 12 is any amino acid
  Variant (14)..(14): Xaa in position 14 is Asp, Gln, Ser or Thr
LXXXGXXXXXXXPX

SEQ ID NO: 5778 - DNA, 672 bp, Saccharomyces cerevisiae
  CDS (1)..(672)
atgagctcacaaccgtctttcgtcaccataaggggcaaggccatttctctagaaacacaaacggagtcacttctttccaagtactccacattcgcgcagacaactagttcagaacaaactggccaagaaaagaagatagacaagcagttggagggaatcttaggccagagacaggatgtaatcgattcattaacacaaatctgcgattctaacccggcaatctccgcctcaaagctttcccaactgcaccgccacaaggagatcttacaagaccactggaagagcttccgcaatatcaggtcctccatccagcaagagcgcaacagactaaacttgttattcagcgtgaagaacgatattgctaattccacaacggacgcgccagctcctataggggatgctgacgagtacattcagaacgaaacaaggcgaatcgatcagtccaacaacgtagtcgaccgtctcatctcccaagcctgggagactcggtcgcagttccactcgcagagcaacgtgctgaacacggcaaacaacaaggtgttgcaaactttacaaagaataccaggtgtcaatcagcttattatgaagattaacacgagaaggaagaaaaacgcgtttgtattggccacgataaccaccctttgtatactgtttttgtttttcacatggtaa

SEQ ID NO: 5779 - protein, 223 aa, Saccharomyces cerevisiae
MSSQPSFVTIRGKAISLETQTESLLSKYSTFAQTTSSEQTGQEKKIDKQLEGILGQRQDVIDSLTQICDSNPAISASKLSQLHRHKEILQDHWKSFRNIRSSIQQERNRLNLLFSVKNDIANSTTDAPAPIGDADEYIQNETRRIDQSNNVVDRLISQAWETRSQFHSQSNVLNTANNKVLQTLQRIPGVNQLIMKINTRRKKNAFVLATITTLCILFLFFTW

SEQ ID NO: 5780 - DNA, 717 bp, Cryptococcus neoformans var. neoformans B-3501A
  CDS (1)..(717)
atgtccacgtcctgggacaacgcacgaaggcatgcccgagctcttgagacagccttggactcgaaattgtccacttattcaaagctagctgcttccatcgcacgcggctcctctctgggcggaagctctagtcgtgatgaactcagtatggaagaagaaggtatcgggggctacaagctcgttgaggaggagattgaagagcttctttcaaagcttgaacaagcgattgaagacctcacaagtcttataaattccccgagccaacctccttccacgtcaatgcaacactctgcccagactcacagggataacttggatgattacaggagggactttgtacgcacccggaacaatgttgagcaaaccatacggcggtcaaaccttttagggtctgttcgcaaggacataagtgattacaaatctggacggtctggcacaacggacgctctcttgcaagatcgatctcgaatagattcgagtcatcgcatgattgacgacaccttaaatcaagcctacgccacccgcgaagactttgcccaacaacgcaccttccttgcctctatcgactctcgaatgggcggtgttctcaaccaaatgccaggtattaattctctcatcacaatgataaggacacgtagaagaagagatactgtcattatgggatgcgttatcggcctgtgcgttgtattacttcttggttatatgtttgggttctag

SEQ ID NO: 5781 - protein, 238 aa, Cryptococcus neoformans var. neoformans B-3501A
MSTSWDNARRHARALETALDSKLSTYSKLAASIARGSSLGGSSSRDELSMEEEGIGGYKLVEEEIEELLSKLEQAIEDLTSLINSPSQPPSTSMQHSAQTHRDNLDDYRRDFVRTRNNVEQTIRRSNLLGSVRKDISDYKSGRSGTTDALLQDRSRIDSSHRMIDDTLNQAYATREDFAQQRTFLASIDSRMGGVLNQMPGINSLITMIRTRRRRDTVIMGCVIGLCVVLLLGYMFGF

SEQ ID NO: 5782 - DNA, 744 bp, Oryza sativa (japonica cultivar-group)
  CDS (1)..(744)
atgatgccgtcggcgtcggacgccgcggcggcggcggcggcgctggagctgcaggagtccgggtgggaggagctgcggcgggaggcacggaagctggagggtgacctcgacgtcaagctctcctcctacgcgcgcctcgccgcgcgctcctcctccgccgccgacgccgcctccgcctcctccccgagcgagcgctcctcctggaagtccatggagttcgagatccagtcgctgctcgacaagctgcaggacgtcaacgacgccatgagccgctgcgccgcctccaccgcccccaccacctccgtctcgcagaagctcgcccgccaccgcgacatcctccacgagttcgcgcaggagttcaggaggacgagggggaatctgagctccatcagggagcacgccgatctcctcagctctgtgcgggacgacattactgagtccaaggctactggcggcatgtcgccgagggtgcatttgctcagggagagggcctcgattcatggcagcattaaccagattgatgaggtaattggccaagctcagagcacaagggtagccctttccaatcagagggcattgtttggggatgttcaaggaaaagtcaagcagttgggtgaaaagttccctgttattagaggactacttggtgccatcaagaggaagaaatcaaaggacactatcatcctttcagcagtgatcgcggcctgcaccatctttttgattatttactggctttcgaaatga

SEQ ID NO: 5783 - protein, 247 aa, Oryza sativa (japonica cultivar-group)
MMPSASDAAAAAAALELQESGWEELRREARKLEGDLDVKLSSYARLAARSSSAADAASASSPSERSSWKSMEFEIQSLLDKLQDVNDAMSRCAASTAPTTSVSQKLARHRDILHEFAQEFRRTRGNLSSIREHADLLSSVRDDITESKATGGMSPRVHLLRERASIHGSINQIDEVIGQAQSTRVALSNQRALFGDVQGKVKQLGEKFPVIRGLLGAIKRKKSKDTIILSAVIAACTIFLIIYWLSK

SEQ ID NO: 5784 - DNA, 654 bp, Oryza sativa (japonica cultivar-group)
  CDS (1)..(654)
atggaggcgtcttcctgggacgccctccgcaagcaggcaaggaggctagaagctcagttagatgaccaaatgagtgcttaccgtaaattgatttccatgaaatctgatggttctgagaatgatatcgagtccgatatagaaagatcgctgaagcaacttcagcaagtaaattctcaaatgcagacatgggtatcatcaggaggctcagaagtcctttctcatacattgactcgtcatatggagatattgcaagaccttacacaggaattctatcgcctccgatcaagccttagagcaaagcaacaacatgcttctcttcttgacttgagagattttgacagagcgaagtttgatgttgaagagggtgctgactctgatcaagctctgctcaaagaacaagctgcgatcagcaggagtactgggcagatggataccgtgatatcacaagctcaagctacattaggcacacttatgttgcaacgatcaacatttggtggtattactacgaagataagcaacgttagcagtcggctccctacgattaatcaaattctttcatccatcaaaagaaagaaatcgatggacaccattattctatccctggttgcatctgtttgtgcatttcttatttttatctattggatgtcaaagtaa

SEQ ID NO: 5785 - protein, 217 aa, Oryza sativa (japonica cultivar-group)
MEASSWDALRKQARRLEAQLDDQMSAYRKLISMKSDGSENDIESDIERSLKQLQQVNSQMQTWVSSGGSEVLSHTLTRHMEILQDLTQEFYRLRSSLRAKQQHASLLDLRDFDRAKFDVEEGADSDQALLKEQAAISRSTGQMDTVISQAQATLGTLMLQRSTFGGITTKISNVSSRLPTINQILSSIKRKKSMDTIILSLVASVCAFLIFIYWMSK

SEQ ID NO: 5786 - DNA, 654 bp, Oryza sativa (japonica cultivar-group)
  CDS (1)..(654)
atggaggcgtcttcttgggacgcccttcgcaagcaggcaaggaggttggaagctcagttagatgatcaaatgattgcataccgtaaattggtgtctatgaaatcagatggttcagagaatgatatcgagtctgatatagaaagatcactgaagcagcttcagcaagtaaattctcaaatgcaaacttgggtatcatcaggaggctctgaagttctttctcacacattgacccgtcatatggagattttgcaagatcttactcaggaattctatcggcttcgatcaagcctcagagtgaagcaacaacatgcttcgctccttgacctaagagattttgacagagcaaagtttgatgttgagagtggagactcagccgatcaagctcttcttagagaacaagctgcaatcagtaggagttctggacagatggataatgtgatatcacatgctcaagcaacgctaggaactctcatgtcacaacgatcaacatttggtggcatcactacaaagataagcaatgttagtagccggcttcctacgatcaatcatatcctcgcgtcaattagaagaaagaagtcgatggacacaatcattctttcacttgtcgcgtctgtctgcgcctttcttattctcgtctactggttgtcaaagtag

SEQ ID NO: 5787 - protein, 217 aa, Oryza sativa (japonica cultivar-group)
MEASSWDALRKQARRLEAQLDDQMIAYRKLVSMKSDGSENDIESDIERSLKQLQQVNSQMQTWVSSGGSEVLSHTLTRHMEILQDLTQEFYRLRSSLRVKQQHASLLDLRDFDRAKFDVESGDSADQALLREQAAISRSSGQMDNVISHAQATLGTLMSQRSTFGGITTKISNVSSRLPTINHILASIRRKKSMDTIILSLVASVCAFLILVYWLSK

SEQ ID NO: 5788 - DNA, 684 bp, Magnaporthe grisea 70-15
  CDS (1)..(684)
atggcgtcgtcaggagctggaggctggtcgacattgcggaaccaggctcggaccttggaaaaagatacggaggctttgttccatacatattcacaaatcgcgacatccagcaacataccggccaagccgacagagcaggagagggaaactgaggctagactgcgggagatattagacaagcgagaaaacgtcatagcccagctcacccggctcctcgactcggactcggatctcgcgtcatcgagcacgaaagtgcgcaacctcgcactcttcagggacaagctagctgagcagcgtcgcgagctaccacggctgcggtcacggatccaggaaacccgcaatcgggcaaacctcctgtccaacgtccgcaacgacatcgacgcctaccgcgccagcaatcccgagcaggccgaggccgagtacatgctggacgagaggtcgcgcatcgacaacagccacagcatggccgacgacgtcttgtaccaagcgtacgccatcaacgacaacttcaactcgcagagggagatgctggcaagcatcaaccggcgcatcaccctggcggcgagccaggtgccgggcatcaacacgttgatgaccaggatatcggcaaagaagaggagggatggcatcatcatggggagctttattgccatttgctttttcgtcttttggtttttcctatga

SEQ ID NO: 5789 - protein, 227 aa, Magnaporthe grisea 70-15
MASSGAGGWSTLRNQARTLEKDTEALFHTYSQIATSSNIPAKPTEQERETEARLREILDKRENVIAQLTRLLDSDSDLASSSTKVRNLALFRDKLAEQRRELPRLRSRIQETRNRANLLSNVRNDIDAYRASNPEQAEAEYMLDERSRIDNSHSMADDVLYQAYAINDNFNSQREMLASINRRITLAASQVPGINTLMTRISAKKRRDGIIMGSFIAICFFVFWFFL

SEQ ID NO: 5790 - DNA, 657 bp, Gibberella zeae PH-1
  CDS (1)..(657)
atgtctacaccgtcgggaactggtagctggaccagtcttatccaacaagctcgacaactagaaaaacagttcgcggcagctcctaacatcccacccaagcccacagaaaaagaacgtgagacagaaaagaagcttgaggagttgttagaaaagcgcgaggatgtcatcagcaaactcgtccgacttctcgattccgaagccgccctcacctcatccgccatgaaacagaacaacctcgcccttttccaaaagaaactcgccagtcacagaaaagatctgatccgcctacgctcaaatttacaagaagcccgcaatcgcgcaaaccttttgaccaatgtccgttcggatattgaccaataccgccagaacaaccccgaagcagccgaggccgactatatgttgcaagagcgcaatcgcatcgacaacagtaacagcatggccgataacgtgcttagccaggcatacgctgttaacgacaacttcaacttgcagcgcgaaacgttggcaagcatcaacaggaggatcacacatgcagcaagtcaagtgcctgggattaacacgctgattggaaggatatcagccaagaagaggagggatggtattatcatgggtggtttcgttgcgttttgcttcatcgtcttcttcctcttttcgtaa

SEQ ID NO: 5791 - protein, 218 aa, Gibberella zeae PH-1
MSTPSGTGSWTSLIQQARQLEKQFAAAPNIPPKPTEKERETEKKLEELLEKREDVISKLVRLLDSEAALTSSAMKQNNLALFQKKLASHRKDLIRLRSNLQEARNRANLLTNVRSDIDQYRQNNPEAAEADYMLQERNRIDNSNSMADNVLSQAYAVNDNFNLQRETLASINRRITHAASQVPGINTLIGRISAKKRRDGIIMGGFVAFCFIVFFLFS

SEQ ID NO: 5792 - DNA, 675 bp, Candida glabrata CBS 138
  CDS (1)..(675)
atgagcaaaggaccatcgtttgttactgtgcgcagcgaagccatttcgcgtgaatccaaaactgaatcattgcttggtaaatattcaacatatgcgcaagctgcaagttctgatgctacctcgcaggagaagcatttagatgagcaaattgaaaaactgctgggtgaaagacaagacattatagacaatttgacaaagatagcggaagacactccaaatatatctgcgtcaaagcagtcccaattgcaacgtcacagagagattttacaagagcactggaagaactttagaggaataaggtcttctattcaacaagaacgtaatcgtttgaacttattgtttagtgttaagaatgatatcgcacaacaacaacaggcaactgataatgaattatttaatgatgaagaagcatacaaccagaatgaatccagaagaatagatcagtcacataatatccttgatcgtctaatagttcaagcatgggagacaagagagaacttcaatgctcagagctcaactctaaatagtgctggcaataaggctttgcaaacattacagaggattccaggtgtgaatctattgattggtaagattggaacaagaagaaggaaaaatgcaattatattagcttcggtcactaccatatgtattttgtttttattctttacttggtga

SEQ ID NO: 5793 - protein, 224 aa, Candida glabrata CBS 138
MSKGPSFVTVRSEAISRESKTESLLGKYSTYAQAASSDATSQEKHLDEQIEKLLGERQDIIDNLTKIAEDTPNISASKQSQLQRHREILQEHWKNFRGIRSSIQQERNRLNLLFSVKNDIAQQQQATDNELFNDEEAYNQNESRRIDQSHNILDRLIVQAWETRENFNAQSSTLNSAGNKALQTLQRIPGVNLLIGKIGTRRRKNAIILASVTTICILFLFFTW

SEQ ID NO: 5794 - DNA, 648 bp, Kluyveromyces lactis NRRL Y-1140
  CDS (1)..(648)
atgtcagcttcatttgtaacggtcagatctaaggcaatttctttagaatcacaaacggattctctgttgactaaatattcttcttttgctcaaacaacaagttctgaaccgtcaggacaagaaacgcaattgcaggagaaactagagaagattctcaaccagagacaggagacagtggaatctttacaaagaattgcagacagtgaaagtaatatatccacgtccaagctatcacagctacagcgccatagggaaacattacaagacaattggcaaacgttccgtgacattcgctcctccatacaacaagaacgcaatcgccttaacctcttgttttcagtgaagaaagatttacaaaatagtgctagtgataatcaaaatgaatatattcaagatgaggctcggagagtcgaaaattctcacacagtggtggattctttgatagaccaggcttatgaaaccagagagcagttcatgtcacaacgagtgtttttacaaaggtctagtgacagaatcttacagactttgcaacacattcctttgattaataatgtgatatcaaagataaacactagaagaaagaagaatgctgtaatattggcatccttaatatcaatttgtatcttagtactattttttacagcataa

SEQ ID NO: 5795 - protein, 215 aa, Kluyveromyces lactis NRRL Y-1140
MSASFVTVRSKAISLESQTDSLLTKYSSFAQTTSSEPSGQETQLQEKLEKILNQRQETVESLQRIADSESNISTSKLSQLQRHRETLQDNWQTFRDIRSSIQQERNRLNLLFSVKKDLQNSASDNQNEYIQDEARRVENSHTVVDSLIDQAYETREQFMSQRVFLQRSSDRILQTLQHIPLINNVISKINTRRKKNAVILASLISICILVLFFTA

SEQ ID NO: 5796 - DNA, 678 bp, Debaryomyces hansenii CBS767
  CDS (1)..(678)
atgtcatcagcaacatttacacaaaccagatcacaggcattgaatctagagaaacaagccgatacattattgtcacgatattctgcatttcaaaatttatctaatacaagctcaagcgacgaagaaaatgaactaagtgattccatattcgaaaatttacagaaacgagagaatgttataaatacattgaatagaatatccgaaacggacacgaatttatctacttccaagttacaacaattacaaagacataaggaaatattaagcgaacataaacggtcatatgccaagatcaaaggtgttataaaagaagaacggaatagaaacaacttgttattttcagtaagatctgacatcgatgcccatagagaaagatcaactaataattcaaacaatcgtgacttgaatgccaatgattatatattggatgagagtgttcgagcagacaatgctaattcattcgcagagagactattgcaacaagcatacaatacaagagatgaactctacagccagagggcacacttgagtaatgcgcaactgaggatgatgggtgctgttctgctgatacccggcataaatgtgcttatttccagaattaatactcggaggaagagagatacgttaatattggctacagttattgcaatttgcattttggtattgttcttcttctaa

SEQ ID NO: 5797 - protein, 225 aa, Debaryomyces hansenii CBS767
MSSATFTQTRSQALNLEKQADTLLSRYSAFQNLSNTSSSDEENELSDSIFENLQKRENVINTLNRISETDTNLSTSKLQQLQRHKEILSEHKRSYAKIKGVIKEERNRNNLLFSVRSDIDAHRERSTNNSNNRDLNANDYILDESVRADNANSFAERLLQQAYNTRDELYSQRAHLSNAQLRMMGAVLLIPGINVLISRINTRRKRDTLILATVIAICILVLFFF

SEQ ID NO: 5798 - DNA, 660 bp, Yarrowia lipolytica CLIB122
  CDS (1)..(660)
atggcgaccatatcgagctcgcgaacacaagtgcgacggctagagtctcagcttgcagagctgctctcggagtactcctcttttgccacctctcacgccatagcagcctccgaagacgaggtacggattggacgggatatcgagcaggtaattgagaagaccgccgactccctggagtcgttcgaacgtctgctggattccacccctaacgccacagcaacacaaacaggccagttgcaacgccacagagagactctcgcagagcacagatcgcaatacaagaagatcaacgctggaatcaagcaggaacgagaccgggccaacttgctgtcgtcggtgcggtcggatatcgagggacacagaaaccgaagtgctactccccaggccgaggaggagtacatgttacacgagcgaggccgggtggacaactcaaataacatgaccgatactctgcttgctcaagcgtatgcgactcgagaggagctgctgacccagcgggcgagtttggccaacatccagcgtcggctgtttaacacggctagcagcattccaggcattaacacggtcatttccaagattaacacccggaagaagcgagacagtttgattctggcggttattatcaccctgggtattttgttcattctcttcctgagatag

SEQ ID NO: 5799 - protein, 219 aa, Yarrowia lipolytica CLIB122
MATISSSRTQVRRLESQLAELLSEYSSFATSHAIAASEDEVRIGRDIEQVIEKTADSLESFERLLDSTPNATATQTGQLQRHRETLAEHRSQYKKINAGIKQERDRANLLSSVRSDIEGHRNRSATPQAEEEYMLHERGRVDNSNNMTDTLLAQAYATREELLTQRASLANIQRRLFNTASSIPGINTVISKINTRKKRDSLILAVIITLGILFILFLR

SEQ ID NO: 5800 - DNA, 675 bp, Candida albicans SC5314
  CDS (1)..(675): transl_table=12
atgtcatcatccacattttcacaaacaaggtcacaggcattaagtttggaaaagcaaacagaacaattattatcaaaattttcccaatttcaacaacaacagcaacaaaatcaatcacaatctttagatataacaccagaagaaaccattataagacaacaaatagaagagattttccagaaaagaaatgccgtaattctgaaattaaatcgtattagtgaagtagaaccaaatttatcaacatcaaaattacaacaattgactcgtcataaagaaaaattaaatgatgataatttatcatttacgaaaattattaataatattgaagatgaaagaaataaaaacaatttattattcaatgttcatcgagatataaatcatcataaacaacaaagaaacattgatggtaatgcatatattttagaagaaagtgaacgagtgaataatgttaattccatagctgatagattattacaaggtgcatttgctacaagagatgaattattaaatcaacgtcaatatttaaataatgctcaactgcaagtattaagtactatgcaaaatattcctggattaaatgtgttgattagtaagattaatactcgaagaaaaagagatacattgatattggcttcagttatagctatttgtatattatttttattctttgtgtaa

SEQ ID NO: 5801 - protein, 224 aa, Candida albicans SC5314
MSSSTFSQTRSQALSLEKQTEQLLSKFSQFQQQQQQNQSQSLDITPEETIIRQQIEEIFQKRNAVISKLNRISEVEPNLSTSKLQQLTRHKEKLNDDNLSFTKIINNIEDERNKNNLLFNVHRDINHHKQQRNIDGNAYILEESERVNNVNSIADRLLQGAFATRDELLNQRQYLNNAQSQVLSTMQNIPGLNVLISKINTRRKRDTLILASVIAICILFLFFV

SEQ ID NO: 5802 - DNA, 684 bp, Aspergillus oryzae
  CDS (1)..(684)
atggctgcctcaacaggtaccgggtgggctcagctccggcagcaagcccgctctctcgagactcagactgaaagcctgttccactcctactcgcaatatgcgtcgatgacaaaactccccccggacccatctgaagaagaaatccgcctggaatcacaattaaaagaattactcgaaaagcgtcaatccctcgtctcccaactcgcccgtctactcgactccgaagccaccctgacctcctctgccctgaaacagaacaacctcgcccgccatcgtgaagtcctccaagaccaccgccgcgaacttcaacgtctcacatccgccatcgcagaatctcgcgaccgcgcaaatctactcacgaatgtccgctccgatatagatgcctatcgggcgtcgaatcccgctgccgccgaagccgactacatgctcgaggagcggggtcggatcgaccaaagccacaatgtgatagacggcgttttgagccaagcatacgccatcaacgaaaactttgggcttcagcgcgagacgctggccagtattaatcggcgtattgttggagccgctagtcaggtgcccgggatgaatgcgttgatcgggaagattgggtcgaagcggaggcgagatgcgcttatcttgggggcctttatcgggttctgctttttgatgctgctttttttccgataa

SEQ ID NO: 5803 - protein, 227 aa, Aspergillus oryzae
MAASTGTGWAQLRQQARSLETQTESLFHSYSQYASMTKLPPDPSEEEIRLESQLKELLEKRQSLVSQLARLLDSEATLTSSALKQNNLARHREVLQDHRRELQRLTSAIAESRDRANLLTNVRSDIDAYRASNPAAAEADYMLEERGRIDQSHNVIDGVLSQAYAINENFGLQRETLASINRRIVGAASQVPGMNALIGKIGSKRRRDALILGAFIGFCFLMLLFFR

SEQ ID NO: 5804 - DNA, 672 bp, Arabidopsis thaliana
  CDS (1)..(672)
atggatgtgcctagctcttgggatgctttacggaaacaggctagaaagattgaagctcagcttgacgagcagatgcattcatatcgtagacttgtttccacaaaggctttatcaaaatcagatggtaatgagagtgatcttgaagctgggattgacttacttcttaggcaactgcaacaagttaatgctcagatgcaagcatgggtatcttctggtgggtcagaaatggtctcccatactttaactcgacatcaagagatccttcaagatctgacacaggagttttatcgacaccgctccagtcttagagcaaaacaagagcatgcttcacttcttgaggactttagagaatttgatcggactagattagatttagaagatggatatgggtctgaacaagccctgatcaaggaacatatgggaatcaaccgcaatacagctcagatggacggtgtcatttcacaagctcaggcaacactcggtacgcttgtgtttcaacgttcaacttttggaggcatcaactcaaagcttagcaatgtcgccagccgtctacctacggtgaacactattctggcagcgataaagaggaaaaagtcgatggatacaatcattctttcactcgttgcggctgtatgcacatttctcatattcatttactggataaccaagtag

SEQ ID NO: 5805 - protein, 223 aa, Arabidopsis thaliana
MDVPSSWDALRKQARKIEAQLDEQMHSYRRLVSTKALSKSDGNESDLEAGIDLLLRQLQQVNAQMQAWVSSGGSEMVSHTLTRHQEILQDLTQEFYRHRSSLRAKQEHASLLEDFREFDRTRLDLEDGYGSEQALIKEHMGINRNTAQMDGVISQAQATLGTLVFQRSTFGGINSKLSNVASRLPTVNTILAAIKRKKSMDTIILSLVAAVCTFLIFIYWITK

SEQ ID NO: 5806 - DNA, 720 bp, Arabidopsis thaliana
  CDS (1)..(720)
atgacagaatcgagtctggatctgcaggaatctggttgggaagaacttaggcgggaagctcgtaaaattgaaggagatctagacgttaagctctcttcttacgctaagctaggcgccaggtttactcaaggcgggtatgttgacactgggtctccaaccgttggatcggggagatcatggaagtctatggagatggaaattcaatcgttgcttgagaagttgttggatattaatgattccatgagtagatgtgctgcatctgctgcacccacaacatcggttactcaaaaactagcaaggcacagggatatacttcatgaatatacccaggagtttcgaagaataaaaggaaatataaactcgttgagagaacacgctgagcttctgagttctgtcagggatgacataagtgaatataaggcttctggtagtatgtcaccaggtgtgcaagtgttaagggagagagcttcaatccatggaagtatatcccatattgatgatgtgattggtcaagctcaagcgacaagagcagttcttggctctcaacgatctctgttttcagatgttcaagggaaagtaaaaaatctcggagacaaattcccagtgattcgtggcttacttggctcaattaaaaggaaacgttctcgggacacacttatcctctccgctgtcatcgctgcttgtacgttgtttctaatcatctactggctctcaaaataa

SEQ ID NO: 5807 - protein, 239 aa, Arabidopsis thaliana
MTESSLDLQESGWEELRREARKIEGDLDVKLSSYAKLGARFTQGGYVDTGSPTVGSGRSWKSMEMEIQSLLEKLLDINDSMSRCAASAAPTTSVTQKLARHRDILHEYTQEFRRIKGNINSLREHAELLSSVRDDISEYKASGSMSPGVQVLRERASIHGSISHIDDVIGQAQATRAVLGSQRSLFSDVQGKVKNLGDKFPVIRGLLGSIKRKRSRDTLILSAVIAACTLFLIIYWLSK

SEQ ID NO: 5808 - DNA, 23 bp, Artificial sequence
  primer
atgagctcacaaccgtctttcgt

SEQ ID NO: 5809 - DNA, 27 bp, Artificial sequence
  primer
ttaccatgtgaaaaacaaaaacagtat

SEQ ID NO: 5810 - protein, 230 aa, Artificial sequence
  consensus sequence
  Variant (2)..(3): Xaa in position 2 to 3 is any amino acid
  Variant (5)..(6): Xaa in position 5 to 6 is any amino acid
  Variant (9)..(9): Xaa in position 9 is any amino acid
  Variant (10)..(17): Xaa in position 10 to 17 is any or no amino acid
  Variant (19)..(33): Xaa in position 19 to 33 is any amino acid
  Variant (34)..(57): Xaa in position 34 to 57 is any or no amino acid
  Variant (59)..(88): Xaa in position 59 to 88 is any amino acid
  Variant (89)..(91): Xaa in position 89 to 91 is any or no amino acid
  Variant (93)..(93): Xaa in position 93 is any amino acid
  Variant (96)..(98): Xaa in position 96 to 98 is any amino acid
  Variant (100)..(121): Xaa in position 100 to 121 is any amino acid
  Variant (124)..(124): Xaa in position 124 is any amino acid
  Variant (125)..(125): Xaa in position 125 is any or no amino acid
  Variant (127)..(128): Xaa in position 127 to 128 is any amino acid
  Variant (129)..(129): Xaa in position 129 is any or no amino acid
  Variant (131)..(145): Xaa in position 131 to 145 is any amino acid
  Variant (146)..(155): Xaa in position 146 to 155 is any or no amino acid
  Variant (157)..(162): Xaa in position 157 to 162 is any amino acid
  Variant (164)..(167): Xaa in position 164 to 167 is any amino acid
  Variant (169)..(172): Xaa in position 169 to 172 is any amino acid
  Variant (175)..(176): Xaa in position 175 to 176 is any amino acid
  Variant (178)..(183): Xaa in position 178 to 183 is any amino acid
  Variant (186)..(202): Xaa in position 186 to 202 is any amino acid
  Variant (204)..(205): Xaa in position 204 to 205 is any amino acid
  Variant (207)..(211): Xaa in position 207 to 211 is any amino acid
  Variant (213)..(218): Xaa in position 213 to 218 is any amino acid
  Variant (220)..(221): Xaa in position 220 to 221 is any amino acid
  Variant (224)..(229): Xaa in position 224 to 229 is any amino acid
RXXAXXLEXXXXXXXXXYXXXXXXXXXXXXXXXXXXXXXXXXXXXXXXXXXXXXXXXEXXXXXXXXXXXXXXXXXXXXXXXXXXXXXXXXXLXRHXXXLXXXXXXXXXXXXXXXXXXXXXXLLXXVXXXDXXXXXXXXXXXXXXXXXXXXXXXXXEXXXXXXSXXXXDXXXXQAXXTXXXXXXQRXXXXXXXXXXXXXXXXXPXXNXXXXXIXXXXXXDXXILXXXXXXC

SEQ ID NO: 5811 - protein, 32 aa, Artificial sequence
  protein pattern
  Variant (2)..(2): Xaa in position 2 is any amino acid
  Variant (5)..(5): Xaa in position 5 is any amino acid
  Variant (6)..(6): Xaa in position 6 is Asp or Glu
  Variant (7)..(7): Xaa in position 7 is any amino acid
  Variant (9)..(9): Xaa in position 9 is any amino acid
  Variant (10)..(10): Xaa in position 10 is Asp or Glu
  Variant (11)..(13): Xaa in position 11 to 13 is any amino acid
  Variant (14)..(14): Xaa in position 14 is Glu, Asn, Gln, Ser or Thr
  Variant (15)..(19): Xaa in position 15 to 19 is any amino acid
  Variant (20)..(20): Xaa in position 20 is Ala, Gly, Asn or Ser
  Variant (21)..(21): Xaa in position 21 is Ala, Gly, Asn, Ser or Val
  Variant (22)..(22): Xaa in position 22 is Ile or Leu
  Variant (23)..(25): Xaa in position 23 to 25 is any amino acid
  Variant (26)..(26): Xaa in position 26 is Gln or Arg
  Variant (27)..(27): Xaa in position 27 is Asp, Glu, Asn or Gln
  Variant (28)..(28): Xaa in position 28 is His, Lys or Arg
  Variant (29)..(29): Xaa in position 29 is any amino acid
  Variant (30)..(30): Xaa in position 30 is Asp, Glu, Asn or Ser
LXRHXXXLXXXXXXXXXXXXXXXXXXXXXXLL

SEQ ID NO: 5812 - DNA, 1341 bp, Saccharomyces cerevisiae
  CDS (1)..(1341)
atgattataaggcgcttattttcaatttcaaatcgctcattcttcttgaagaaacctcaatttgatgtaaaaaaaataatagagatgattcctcagtaccaaacttctatccagaatagagagctgatagaggcggatagtattatacgaagcttacaactgttgggtgaacggtatcaaaatataaaagagattgataaagttattgcggatattcaaatacagaggaaatcaattgaggctcaaatcaaaaaggataaaacaaaaattacggaatactcagctgcgctgaaggccctgaaagaacagtacaacgatcaaaatagcaaatcgtcggagctgaaaaagaaaatcttggagacctgcaaatcacttccaaataccttggatcctacggtcccattagatgccccacagattgaacaatggataaaccctttaaaaacacataaaacttcagaagctcaggcgcatgttgatatcatgcttaaaaagaatatgttagacctacagactgcctcgaacgttacaggaatgtcatggtactatctattgaatgacggagcacgtctcgaacaagcattggtagcatatgcattgaaaaaggcaaacgaaaatgggttttcaagctgcgtaccgccaagcatcacgaagaaggagttaatagatgcatgtggatttaatccaagagatatgaataatgaaaggcaaatttacgctcttcaagacaccaatttaggattggtggctaccgcggagatacctttggcaggtctaggggcaaacaaagttctagagttaaactcgggagaatgttctaagaaactagttggagtaagtagatgttacagagctgaggcaggtgccaggggaaaagatacgaaaggtctctatcgcgttcatgagtttactaaagtagaattattttgctggagcaagccagaaaccagtgcaaaggtccttgaggaaataaagcaatttcagatttctgtagttgaggaattaggaataccggccaaagtactaaatatgccatcaaacgatcttggtaatcccgctttcaagaaatacgacatcgaagcttggatgccaggaagggggaaatttggcgagataagtagtgcctccaattgtaccgatttccaaagtagaagattaaatacaaagtacagggacgataacacaggaaagctagaatatgtgcacacgctgaatggcacagcaatggctatcccaagagtgatagtagcactagtagaaaatttctatgacccaagcaccggtaagatatctgttcctgaatgtttgagggagtttatgaatggccaacgatacatttaa

SEQ ID NO: 5813 - protein, 446 aa, Saccharomyces cerevisiae
MIIRRLFSISNRSFFLKKPQFDVKKIIEMIPQYQTSIQNRELIEADSIIRSLQLLGERYQNIKEIDKVIADIQIQRKSIEAQIKKDKTKITEYSAALKALKEQYNDQNSKSSELKKKILETCKSLPNTLDPTVPLDAPQIEQWINPLKTHKTSEAQAHVDIMLKKNMLDLQTASNVTGMSWYYLLNDGARLEQALVAYALKKANENGFSSCVPPSITKKELIDACGFNPRDMNNERQIYALQDTNLGLVATAEIPLAGLGANKVLELNSGECSKKLVGVSRCYRAEAGARGKDTKGLYRVHEFTKVELFCWSKPETSAKVLEEIKQFQISVVEELGIPAKVLNMPSNDLGNPAFKKYDIEAWMPGRGKFGEISSASNCTDFQSRRLNTKYRDDNTGKLEYVHTLNGTAMAIPRVIVALVENFYDPSTGKISVPECLREFMNGQRYI

SEQ ID NO: 5814 - DNA, 1338 bp, Oryza sativa (japonica cultivar-group)
  CDS (1)..(1338)
atgctcgacatcaacctcttccgcacggagaagggcggcgacccggagctgatccgcaagtcgcagcgcaaccgctccgcctccgtcgagctcgtcgacgaggtcatcgccctcgacgaccagtggcgccagaggcagttcgagctcgacaaaatccggcaggagctcaacaaaaccagcaaggaaatcggcaagctcaaggctaaaaaggaggatgcatcggctctgattcagagcacggaagaaattaagaagaggttggctgccaaggagacggaggtgcaggaggccaaaggcacgctggatgccaaactcgtgacgatcggaaacattgtgcacgaatccgtccctgtcagcgatgatgaggcaaacaatttaattgtacggacatggggagagaagaggatggaagggaatttgaagaatcacgtggatctttgcaagatgcttgacattgtagctttggagaaaggtgttgatgtagcaggtggaaggggttactatttaaaggatgaaggtgtgctactgaacttggcattgataaattttggacttgcttttctgagaaagcgaggcttcaagccaatgcaaactccttttttcatgagaaaggaaaccatgggaaaatgtgcccagttggcccaattcgacgaagagctttacaagctaacaggcgatggagaggaaaagtatctcatagctacatctgagcaaccgttgtgtgcgtatcatcttggtgatcgaatttatcctgctgaattgccaattagatatgctggatattccacctgtttccggaaagaagctggttcacatgggagggacacggctggtatcttcagagtccaccaatttgaaaagatcgaacaattctgtgtcacaagtccaaatgacaatgaatcttgggagatgcatgaagaaatgattaaaaattcagaagatttctacaaggagattggcctaccgtatcaacttgtctccatcgtgtctggtgctcttaatgatgctgcagctaagaagtatgatttagaagcatggttccctgcatcaaaaacctacagggaattagtgtcctgctcaaattgcacagattttcaagcaaggagacttggtataggttatggccagaaaaagaatgacgaacaatccaagcaatttgttcatatgttgaactcaacattgactgccactgagaggaccctttgctgtattttggagaacttccagagggagaatggtgttgaagttccaaaagcattgcaaccttacatgggtggaatcgatttccttcctttcaagctggatagcaaacaagttgctcaactccaaatcaaataa

SEQ ID NO: 5815 - protein, 445 aa, Oryza sativa (japonica cultivar-group)
MLDINLFRTEKGGDPELIRKSQRNRSASVELVDEVIALDDQWRQRQFELDKIRQELNKTSKEIGKLKAKKEDASALIQSTEEIKKRLAAKETEVQEAKGTLDAKLVTIGNIVHESVPVSDDEANNLIVRTWGEKRMEGNLKNHVDLCKMLDIVALEKGVDVAGGRGYYLKDEGVLLNLALINFGLAFLRKRGFKPMQTPFFMRKETMGKCAQLAQFDEELYKLTGDGEEKYLIATSEQPLCAYHLGDRIYPAELPIRYAGYSTCFRKEAGSHGRDTAGIFRVHQFEKIEQFCVTSPNDNESWEMHEEMIKNSEDFYKEIGLPYQLVSIVSGALNDAAAKKYDLEAWFPASKTYRELVSCSNCTDFQARRLGIGYGQKKNDEQSKQFVHMLNSTLTATERTLCCILENFQRENGVEVPKALQPYMGGIDFLPFKLDSKQVAQLQIK

SEQ ID NO: 5816 - DNA, 1530 bp, Oryza sativa (japonica cultivar-group)
  CDS (1)..(1530)
atgctgacctgcggccgcttcctctcctcctccgccgccgcctccaccccctccctctcccccttccggaacctaaccctctccctcctccgccgtccccatctccgcctcctctcctcctccgccaccgcctccgccgccgccgccgccgtcgagcccgacaccaagggtggcgcgggtggcggcgccgcgaagccgcagtggaaggcggcgatagacttcaagtggatccgggagaacacggacgccgtcgccgccaacatccgcgaccgcaactccgccgccaacctcgacctcgtcctccagctctacgacgagtacctcgccttgcagaaggaagttgaacggctccgagctgaaagaaatgcagttgctaataagatgaaagggaaattagaaccatctgtgcgtcaagcccttgttgaagaaggcaagaacctgaaagaagggcttattgccctagaagaggaccttgttcagctgactgataagcttcaactagaagcacaaagcattcctaacaccacacatccagatgctcctgtagggggtgaggaaagttctgtcgtcagaaaagaggttggtagtcagagaaacttcaatttcaccattagagatcaccttcagctgggaaaagaacttgatttgtttgattttgatgcagctgctgaggttagtggctcgaagttctactacttaaagaatgaagctgttctgttggagatggcccttgttaattgggccatcactgaggtctcaaagaaaggtttcacaccactaataactccggagattgtaaggtcatctgttgttgagaaatgtggcttccagccaagggcccaaaatactcaggtttattcgatcgataacagtgatcagtgcctcataggaactgcagagattcctgttggcggcatccatatggactctatactccctgattctgatttgcctcgaaaatatgtagcctattcacattgttttcgcacagaagctggtgccgcaggtgctgccactaggggcctctaccgtgtacatcagtttagcaaggttgagatgtttgtattttgccggccagaggagagcgacaagtgccatgaagaacttatcactattgaagaggaactttatgcatcacttggacttcatttcaaaactttggatatggcgactggggatctgggagcaccggcctacagaaagtttgacattgaggcatggatgccaggcctagataggtacggtgagatctcgagcgcgtcaaactgcacagactatcagagcaggcggctgggcatccggtttcgcccatcacctgcagatcctccaccggcgaacgccaagaaaggaaagggcagctcaggcccaacacagtttgtccacacgctcaacgcgacagcggttgctgttcctcgcttgatcatatgcatcctggagaactttcagcaagaagatggaacggttgtgatcccagagccactgaggcccttcatgggcggacttgaagtgctctccccgaaaaccaaatga

SEQ ID NO: 5817 - protein, 509 aa, Oryza sativa (japonica cultivar-group)
MLTCGRFLSSSAAASTPSLSPFRNLTLSLLRRPHLRLLSSSATASAAAAAVEPDTKGGAGGGAAKPQWKAAIDFKWIRENTDAVAANIRDRNSAANLDLVLQLYDEYLALQKEVERLRAERNAVANKMKGKLEPSVRQALVEEGKNLKEGLIALEEDLVQLTDKLQLEAQSIPNTTHPDAPVGGEESSVVRKEVGSQRNFNFTIRDHLQLGKELDLFDFDAAAEVSGSKFYYLKNEAVLLEMALVNWAITEVSKKGFTPLITPEIVRSSVVEKCGFQPRAQNTQVYSIDNSDQCLIGTAEIPVGGIHMDSILPDSDLPRKYVAYSHCFRTEAGAAGAATRGLYRVHQFSKVEMFVFCRPEESDKCHEELITIEEELYASLGLHFKTLDMATGDLGAPAYRKFDIEAWMPGLDRYGEISSASNCTDYQSRRLGIRFRPSPADPPPANAKKGKGSSGPTQFVHTLNATAVAVPRLIICILENFQQEDGTVVIPEPLRPFMGGLEVLSPKTK

SEQ ID NO: 5818 - DNA, 1383 bp, Pyrococcus horikoshii OT3
  CDS (1)..(1383): transl_table=11
atggaggggatagatatgctggatataaagctgatccgtgaaaaccccgaattagttaaaaacgacttgataaaaaggggagagctagagaaagttaagtgggtagatgagattctaaagctcgacacagaatggaggactaagcttaaggagataaacagacttaggcatgagagaaacaagatcgcagtagaaattggaaagagaagaaaaaaaggagaacccgttgatgaacttttagcaaaaagcagagagatcgtcaaaagaataggagaactcgaaaatgaagttgaggaactaaagaaaaagatcgattattacctatggagacttccaaacattacccatccaagcgtcccagttgggaaggatgaaaatgataacgtccccataagattctggggaaaagccagagtttggaaaggccaccttgaaagattcctggagcagagccaagggaagatggagtatgaaattcttgaatggaaaccaaaactgcacgttgacctcttagaaatcctaggaggagcagacttcgcaagggccgcgaaggtcagcggttccaggttctattacctcctcaacgagatagtgatacttgatctagccctaattaggttcgcccttgacaggctcatagagaagggctttacgccggtaattcctccttatatggttagaaggttcgttgaggaaggatctactagctttgaggactttgaggatgttatatacaaggttgaagatgaggatctatatctaattccgaccgctgaacaccccttagctggaatgcacgcgaacgagatattagatggaaaagatttacccctcctctacgtcggtgtttcaccatgctttagaaaagaagcaggaacagctggaaaggatactaagggaatatttagggttcaccaattccataaggtagaacagttcgtctactcaagacctgaagaaagctgggagtggcatgagaaaataataaggaacgctgaagagctattccaggagttagagataccatacagagttgtaaacatctgtaccggagatttaggttacgtcgcagctaagaagtacgacatagaagcctggatgccaggacaaggtaaatttagggaagtagtctcagcaagcaattgtactgattggcaggctaggaggcttaacataaggtttagggataggactgatgaaaagcccaggtacgttcacactctaaattcaacggcaatagctacttctagagcgatagttgcaatcctggaaaaccatcaggaggaagatggaaccgttaggatcccaaaggttctgtggaaatacacagggtttaaggagatagttccagtagaaaagaaggagaggtgttgcgcaacttga

SEQ ID NO: 5819 - protein, 460 aa, Pyrococcus horikoshii OT3
MEGIDMLDIKLIRENPELVKNDLIKRGELEKVKWVDEILKLDTEWRTKLKEINRLRHERNKIAVEIGKRRKKGEPVDELLAKSREIVKRIGELENEVEELKKKIDYYLWRLPNITHPSVPVGKDENDNVPIRFWGKARVWKGHLERFLEQSQGKMEYEILEWKPKLHVDLLEILGGADFARAAKVSGSRFYYLLNEIVILDLALIRFALDRLIEKGFTPVIPPYMVRRFVEEGSTSFEDFEDVIYKVEDEDLYLIPTAEHPLAGMHANEILDGKDLPLLYVGVSPCFRKEAGTAGKDTKGIFRVHQFHKVEQFVYSRPEESWEWHEKIIRNAEELFQELEIPYRVVNICTGDLGYVAAKKYDIEAWMPGQGKFREVVSASNCTDWQARRLNIRFRDRTDEKPRYVHTLNSTAIATSRAIVAILENHQEEDGTVRIPKVLWKYTGFKEIVPVEKKERCCAT

SEQ ID NO: 5820 - DNA, 1383 bp, Aeropyrum pernix K1
  CDS (1)..(1383): transl_table=11
gtggcaggatggagtatactcgagcttctcaggagcaatcctgaggcgcttaaagagcacgttcgcaagaggctcatggacccggcaattgttgatagggcctataggctagacgtggagtggagaaggctactcacgatggttaacgaggttaggaggaggcacaacgagataacgaggatgatagcgaaggcgggcagtagagaggagagggagaggctgatagctgaggctaagcgcctgttgagggagcgggaggatctagaggagaagcttaaaaaggtggagagggagcgggaggaggccctgctaggcctccccaacatagtggcgccggacgtgccagtgggcgacgagagcgccactcggcccatagagttctggggcaaacccaaggtgtggaaaggacatgtcgatgccttcagggagcagaccgaggcttacgggtttaaggttgaccacgaggttatagagtggaggcccagggggcatgcggacatgatggaggaggtgctgaagctcggtgacaccctgagggctgcacgtgtcgctggctccaggttctactacctcttcgaggacctcgtgttcctcgatctggcgctcctcatgtacgccatagactttatgaccagcaagggctacgtactagtcctccccccctacatgctcaggtacaacgttatgagcagggttatagacctggagactttcaaggacgcgatatacgagattgcgggtgaggacctctaccttatagccactgccgagcacccgctggccgccctctactacaactctgagatttacgatgaggacctccccctcaagctggtcggcgtgagcccctgcttcaggaaggaggcaggagctggtaatagggatctgaagggcatattcagggtacaccagttccataaggtggagcagttcgtctacagcctacctgaggagagcagcaagctgcatgaagagttgataagcaatgccaaggagatcttcaaggggcttgagatacctttcagagtcgtcaacatagcctcgggggacctgggggcctgcgccgtcaagaagtacgacctcgaggcgtggatgcctgcccagggcaagtacagggagatggttagcgcaagcaactgcaccgactggcaggcctacaggcttggtataaggcttgtaaggaggaagggcatggagagggggtacgttcacaccctcaacgcgacagcggtggcgagcacccgcaccataacagccatactggagaacttccaggatgaggagggggttgtggctatacccagggctctaaggcgctatctagaggttttcaagagggcccctacagacgccatacaccctaggagaaggccgcccgcctag

SEQ ID NO: 5821 - protein, 460 aa, Aeropyrum pernix K1
MAGWSILELLRSNPEALKEHVRKRLMDPAIVDRAYRLDVEWRRLLTMVNEVRRRHNEITRMIAKAGSREERERLIAEAKRLLREREDLEEKLKKVEREREEALLGLPNIVAPDVPVGDESATRPIEFWGKPKVWKGHVDAFREQTEAYGFKVDHEVIEWRPRGHADMMEEVLKLGDTLRAARVAGSRFYYLFEDLVFLDLALLMYAIDFMTSKGYVLVLPPYMLRYNVMSRVIDLETFKDAIYEIAGEDLYLIATAEHPLAALYYNSEIYDEDLPLKLVGVSPCFRKEAGAGNRDLKGIFRVHQFHKVEQFVYSLPEESSKLHEELISNAKEIFKGLEIPFRVVNIASGDLGACAVKKYDLEAWMPAQGKYREMVSASNCTDWQAYRLGIRLVRRKGMERGYVHTLNATAVASTRTITAILENFQDEEGVVAIPRALRRYLEVFKRAPTDAIHPRRRPPA

SEQ ID NO: 5822 - DNA, 1539 bp, Arabidopsis thaliana
  CDS (1)..(1539)
atgggtttacacaaattgagactcgcagcggcggttcctgtaaccttctcctctcgcctcttcctcaagccatttaccaatactcttaccctaggtttgttttcccgccatcttcaaccccgtaataagcctctccttgtcagagctttctccgcttccgccgccgtacaagatattccggccacacagacctccgattcctctgcaaggcctctgtggaaggcagcgattgatttcaaatggataagggacaataaggaagcagtcgaaatcaacatcaggaacaggaattcgaatgctaatttggaagctgtgctccagctttatgagaacatggtcaatctccaaaaggaagttgagaggcttcgtgaggaaagaaacaacgttgccaaaaagatgaaagggaagctggagccatcagaacgtgagagactcgtagaagaaggtaaaaatcttaaggaaagtcttgttactctggaagaagacctcgtgaagcttaaagatgagctccaacatgtagcacagtctataccgaatatgactcaccctgatgttcctgttggaggagaggattcatcggcaattagacaggaggttggtagtccacgtgagtttagttttccaataaaggatcatcttcagcttgggaaggatcttgatctcattgattttgactctgctgctgaggtaagtggttcaaagtttttctatctgaagaatgaggcagttctattggagatggctcttcttaattggacattatcacaagtcatgaagaagggttatacccccctaacgactcctgaaatcgtgagatcttctattgttgagaaatgcggtttccaacctcgtggggataatactcaggtctattcgatagatggaactgaccaatgtctcattggtaccgctgaaattcccgtaggaggaatacacatggattctattcttcttgaatcagcattgcctttgaaatatatagcattctctcattgcttccgtactgaagcgggtgctgctggcgctgccacaaaaggtctttaccgagttcatcagttcagcaaagcagagatgttcgtcatatgccaacctgaagatagtgaatccttccaccaagaactcattcagatcgaagaagatttattcacttctctaggattacactttaaaacattggatatggccacagccgatttaggcgctccagcatatcgcaagtttgacattgaagcatggatgcccggtttaggacgatttggcgagatatcaagcgcatcaaactgcacagattaccaaagtcgaagactgggaatccgttaccgcccatctgaaccgcctcagacgggtcctaagaaagggaaagcgaatcttccagccactaagtttgtccacactctaaacgcgactgcgtgtgccgtcccaaggatgatggtgtgtttgctggagaattaccagcaagaagatggatctgtggtgatccctgagcccctgaggcctttcatgggaggcattgaactcatcaaacccaagcacaagtag

SEQ ID NO: 5823 - protein, 512 aa, Arabidopsis thaliana
MGLHKLRLAAAVPVTFSSRLFLKPFTNTLTLGLFSRHLQPRNKPLLVRAFSASAAVQDIPATQTSDSSARPLWKAAIDFKWIRDNKEAVEINIRNRNSNANLEAVLQLYENMVNLQKEVERLREERNNVAKKMKGKLEPSERERLVEEGKNLKESLVTLEEDLVKLKDELQHVAQSIPNMTHPDVPVGGEDSSAIRQEVGSPREFSFPIKDHLQLGKDLDLIDFDSAAEVSGSKFFYLKNEAVLLEMALLNWTLSQVMKKGYTPLTTPEIVRSSIVEKCGFQPRGDNTQVYSIDGTDQCLIGTAEIPVGGIHMDSILLESALPLKYIAFSHCFRTEAGAAGAATKGLYRVHQFSKAEMFVICQPEDSESFHQELIQIEEDLFTSLGLHFKTLDMATADLGAPAYRKFDIEAWMPGLGRFGEISSASNCTDYQSRRLGIRYRPSEPPQTGPKKGKANLPATKFVHTLNATACAVPRMMVCLLENYQQEDGSVVIPEPLRPFMGGIELIKPKHK

SEQ ID NO: 5824 - DNA, 1308 bp, Agrobacterium tumefaciens str. C58
  CDS (1)..(1308): transl_table=11
atgcaacaacggtctggaacgacgatgcacgacattaaatggatacgcgaaaaccccgaagcttttgatgcggcccttgcacggcgcagcgtagagcccgctgccgcaggtctgatcgctctcgatgaaaagcgccgttccgtcatccagtccctgcaggacatgcagtcccgccgcaatgccgcctccaaggaaatcggcgccgccatggcgcagaagaacatggaactggcggaaaagctgaaagccgaagtcgctgatatcaaggaaaacatgccgcgcgccgaggaggaggaccgtcaggtctccgccgagctgaacgacgccctgtcgcgcctgccgaacatgcccttcgacgatgtgcctgacggcaaggacgagcacgacaatgtggtggcccgcgtcaccggccagaagcccggctggaaccacgcggcaaaggagcacttcgagattggcgaagcgctcggttatatggatttcgagcgggctgccaagctctccggttcgcgtttcacggtgctgaccagccagctggcgcgtctggaacgggcgctcggccagttcatgatcgacctgcacacctcggaacatggttataccgaagtctcttcgccgctgatggtgcgtgacgaggcgatgttcggcacggggcaattgccgaaattcgccgaggacctgttcaggaccaccgatggccgctggttgatcccgacggcggaagtgacgttgaccaacctcgtttccggcgaaattctcgagcaggaaaaactgccgttgcgcttcacggcgctcacaccttccttccgttcggaagcgggctctgccggacgtgatacgcgcggcatgctgcgccagcaccagttctggaaatgcgagcttgtctccatcaccgatgcggaaagtgccgttgccgagcatgagcgcatgacggcctgcgccgaagaagtgctgaagcgtctgggcttacatttccgcaccctgacgctctgcaccggcgatatgggcttcagcgcccgcaagacctatgatctggaagtgtggctgcccggccagaacacctatcgtgaaatttcttcctgctcggtctgcggcgatttccaggcgcggcgcatgaatgcgcgttatcgcggcaaggacgacaaggcgacgaagttcgtgcacacgctgaacggctccggcaccgccgtcggccgctgcctgatcgccgttctcgaaaattacctgaacgacgatggttccgtcacaattccggacgtgctgctgccgtatatgggcgggctgacgcggatcgagaaggcggcttga

SEQ ID NO: 5825 - protein, 435 aa, Agrobacterium tumefaciens str. C58
MQQRSGTTMHDIKWIRENPEAFDAALARRSVEPAAAGLIALDEKRRSVIQSLQDMQSRRNAASKEIGAAMAQKNMELAEKLKAEVADIKENMPRAEEEDRQVSAELNDALSRLPNMPFDDVPDGKDEHDNVVARVTGQKPGWNHAAKEHFEIGEALGYMDFERAAKLSGSRFTVLTSQLARLERALGQFMIDLHTSEHGYTEVSSPLMVRDEAMFGTGQLPKFAEDLFRTTDGRWLIPTAEVTLTNLVSGEILEQEKLPLRFTALTPSFRSEAGSAGRDTRGMLRQHQFWKCELVSITDAESAVAEHERMTACAEEVLKRLGLHFRTLTLCTGDMGFSARKTYDLEVWLPGQNTYREISSCSVCGDFQARRMNARYRGKDDKATKFVHTLNGSGTAVGRCLIAVLENYLNDDGSVTIPDVLLPYMGGLTRIEKAA

SEQ ID NO: 5826 - DNA, 1284 bp, Clostridium perfringens str. 13
  CDS (1)..(1284): transl_table=11
atggcaatgttagatttaaaaaagttaagaagtaatactgaagaagtgaaaaaagctttatctaatagaggagaagactttgatgtaaatgttatagacgaagttatagctttagatgaagaaagaagaaaaattttagttgatgttgaggctttaaagaaacaaagaaatgaagtatcagctgaaattccaaagagaaaaaaagctggagaagacgttacagaagtaatggctgaaatgagagaaataggagataaaataaaggctgatgatgctaaagttgctgagttaaacgataaaattaactatatcatgctaagaattcctaatataccaaacccagctgttccagaaggggaaactgatgaggacaatgttgaaataaaaagatggggagaacctactaaattcaactttgaaccaaaagcacactgggatttaggaacagatttagatcttttagacttcgaaagaggtggaaaggttgctggatcaagatttacagtttacaaaggaatgggtgctagattagagagatctataataaactacttcttagataaacacacatttgaaaatggatacactgaagtattaccaccatacatggtaaatagagatagtatgactggtactggtcaacttccaaaattcgaagaagatgctttcaaagtagaaaacaatggatatttcttaataccaacagctgaggttcctgtaactaatatgtacagaaatgaaactttagagggagataaacttccaataaaacatgctgcatatagtgcttgttttagagcggaagctggttcagcaggaagagatacaagaggtcttataagacaacaccaatttaataaagttgagttagttaagttctgtaaacctgagcaaagctatgaagaattagataaattagttcaagatgctgaatctgtattacaaggtttaggattaccatatagaatagttagaatatgtaaaggtgatttaggattcactgctgcattaaaatatgatatagaagtttggatgccaagctacaatagatatgttgaaatttcaagttgttcaaactttgaagatttccaagctagaagagctaacattaaatataaaaattctccaaaggaaaaaccacaatttgttcatacattaaatggatcaggggttgctattggaagaactgtagctgctatattagaaaactatcaacaagaagatggatcagtagttataccagaagctttaaaagaatatatgagatgtgatttactaaaataa

SEQ ID NO: 5827 - protein, 427 aa, Clostridium perfringens str. 13
MAMLDLKKLRSNTEEVKKALSNRGEDFDVNVIDEVIALDEERRKILVDVEALKKQRNEVSAEIPKRKKAGEDVTEVMAEMREIGDKIKADDAKVAELNDKINYIMLRIPNIPNPAVPEGETDEDNVEIKRWGEPTKFNFEPKAHWDLGTDLDLLDFERGGKVAGSRFTVYKGMGARLERSIINYFLDKHTFENGYTEVLPPYMVNRDSMTGTGQLPKFEEDAFKVENNGYFLIPTAEVPVTNMYRNETLEGDKLPIKHAAYSACFRAEAGSAGRDTRGLIRQHQFNKVELVKFCKPEQSYEELDKLVQDAESVLQGLGLPYRIVRICKGDLGFTAALKYDIEVWMPSYNRYVEISSCSNFEDFQARRANIKYKNSPKEKPQFVHTLNGSGVAIGRTVAAILENYQQEDGSVVIPEALKEYMRCDLLK

SEQ ID NO: 5828 - DNA, 1290 bp, Encephalitozoon cuniculi GB-M1
  CDS (1)..(1290)
atgatcgatatcaacctaatcagagatccaaagacccgtgaaaaggttgttgagagtgagaagaagcgattcagagatggactggctgtcgggaaggcctacgaactggacaggaagaggattgagatgaactttaggcttgaccagatcaacacccgaatcaatcagctgaaccgagagataaagtctgggtataggcaggggaagaataaagaagatggtgacctcagcgagaaggttgctgaaatcaaagggctttctgatgaggcaaaggggctcagagatgatgttaaggctgtcgaagatgagcttaacaaagtaatgaaggggataggaaacattatttcgccctctgttgtggtcagcaacgacgaaaaggacaatccgattgtgaggtcctacagaagcagcaggaacatgcaaaagaacccaaggcccttctgtgtgttaatgaaggacttcacccattctgtggctggggcaaaggtgatggggcaccgtggatactatctatctgggaagatggccaggcttgcacaggcccttacaagatatgcgattgactttcttgagaacaagggatatacatacatccagacgcccgtgatgcttagaagagacgtaatgagaaaaacatcgcagctgagcgactttgatgaccagctttacaaagtagaggacgacctgtatctgatagcaacatctgagcagtctcttgctgcactgtatatggatgaaagaatggttcctcaagaggttccaaagaaattctgtgggcagtcgctttgcttcaggaaagaagcaggggcgcacgggaaggacaatgcagggctgttcagggtccaccagtttgagaagattgagcagtttgtgatatgcgggcctgaagaatctcagaagtaccacgaggagatgataaaggcatgtgaggagttttatcaatcactggacataagctacaacgtcgtgggcattgtgtctggtgagctcaatgatgcggcagccatcaagtacgatcttgaagcatactttccaagtgcagagaagtatagagagttggtctcttgctccaactgcacggactaccagtctcgggagctcgagataagatatggagtggttaaggagaacaaccgcaagatctatgtccatctgctgaacggaacaatgtgtgctgtccagagggcattgtgctgcattgtggagaactaccaaactggggacggaattgctatcccggatgttctgcagggatacttcgggggagacttgattgagctgggcccctaa

SEQ ID NO: 5829 - protein, 429 aa, Encephalitozoon cuniculi GB-M1
MIDINLIRDPKTREKVVESEKKRFRDGLAVGKAYELDRKRIEMNFRLDQINTRINQLNREIKSGYRQGKNKEDGDLSEKVAEIKGLSDEAKGLRDDVKAVEDELNKVMKGIGNIISPSVVVSNDEKDNPIVRSYRSSRNMQKNPRPFCVLMKDFTHSVAGAKVMGHRGYYLSGKMARLAQALTRYAIDFLENKGYTYIQTPVMLRRDVMRKTSQLSDFDDQLYKVEDDLYLIATSEQSLAALYMDERMVPQEVPKKFCGQSLCFRKEAGAHGKDNAGLFRVHQFEKIEQFVICGPEESQKYHEEMIKACEEFYQSLDISYNVVGIVSGELNDAAAIKYDLEAYFPSAEKYRELVSCSNCTDYQSRELEIRYGVVKENNRKIYVHLLNGTMCAVQRALCCIVENYQTGDGIAIPDVLQGYFGGDLIELGP

SEQ ID NO: 5830 - DNA, 1365 bp, Schizosaccharomyces pombe 972h-
  CDS (1)..(1365)
atgagtcaattgttgtatttaaggacattttctacgcacactagttatttaagaagttcttggcaggcgattttgaattacaagtacatctatcagaatgctgaagcagtacaaagaaattgtattaatcgaaatttgcaagctatagcagagacagttcccaaaatcagatcactaattgatgaaaaggaatcattaaagaatgaattttttcccttactctctctaaaaaaggagattactctccaaattgaacgatgtagtgatccgaatgaaagagggaaactagttaatgaagctaagggtttaaaaaagaaaacggaagagtataacaaaattatttcaaaggttaccaatgatttataccagtattgtctggcagttccgaatactactttgccaacggtacctgtgggtcctgaagataaggccgttgttgtacaaaaaataggtagtcctttagtgaaaaaaacgggttctttgaaggatcatttacagattgcaaatgaagggatcaacctagaagatgctgctcaagcgagtggtcattcgttttgctatacaacgggtgacattgctctgttagaaatggctataacaaactatgcaatggattttgctatatcaaaaggatggtgtcctgtcattcctcctacgattgtccgcaccgatatagctctagcttgtgggtttcaacctcgtgatgaagaaggtcagcagatttacgagttagattcctatacttccccccttgtaagctctcctaaacagtgccttattgggactgcggaaattagtcttgcagctcttggatttaagaaaacgtttaataatttcaccgaacggaaagttgttggagtttctcgtgcctatcgaagagaagcgggagctcgtggaaaagaaaacagaggtttataccgtttacacgagttcacaaaagttgaattattcgcttggactcatccatcaaggagttctgaaatgttcaatgagattgttaattttcaaaaagagtttgtagaaactttaaaaatacccgcaagaattttgaatatgccaactgcggaattgggatcttcggcctctcaaaaatatgacatcgaagcgtggatgccagcgcgacaatcatacggggagataacttcagcatctaattgtcttgaataccaagctaggcgtctactcacacgatatcgaaatgacaaagactcgggttttgttcacacactgaacggcacagcagctgccatccctaggttaataatagctatccttgaaaatcaccaacaagaggatggcactgttaaagttccggaaacccttgtcccttacatacacaaggaatacctttttaaagcaaaataa

SEQ ID NO: 5831 - protein, 454 aa, Schizosaccharomyces pombe 972h-
MSQLLYLRTFSTHTSYLRSSWQAILNYKYIYQNAEAVQRNCINRNLQAIAETVPKIRSLIDEKESLKNEFFPLLSLKKEITLQIERCSDPNERGKLVNEAKGLKKKTEEYNKIISKVTNDLYQYCLAVPNTTLPTVPVGPEDKAVVVQKIGSPLVKKTGSLKDHLQIANEGINLEDAAQASGHSFCYTTGDIALLEMAITNYAMDFAISKGWCPVIPPTIVRTDIALACGFQPRDEEGQQIYELDSYTSPLVSSPKQCLIGTAEISLAALGFKKTFNNFTERKVVGVSRAYRREAGARGKENRGLYRLHEFTKVELFAWTHPSRSSEMFNEIVNFQKEFVETLKIPARILNMPTAELGSSASQKYDIEAWMPARQSYGEITSASNCLEYQARRLLTRYRNDKDSGFVHTLNGTAAAIPRLIIAILENHQQEDGTVKVPETLVPYIHKEYLFKAK

SEQ ID NO: 5832 - DNA, 1545 bp, Arabidopsis thaliana
  CDS (1)..(1545)
atgggtttacacaaattgagactcgcagcggcggttcctgtaaccttctcctctcgcctcttcctcaagccatttaccaatactcttaccctaggtttgttttcccgccatcttcaaccccgtaataagcctctccttgtcagagctttctccgcttccgccgccgtacaagatattccggccacacagacctccgattcctctgtagcagcaaggcctctgtggaaggcagcgattgatttcaaatggataagggacaataaggaagcagtcgaaatcaacatcaggaacaggaattcgaatgctaatttggaagctgtgctccagctttatgagaacatggtcaatctccaaaaggaagttgagaggcttcgtgaggaaagaaacaacgttgccaaaaagatgaaagggaagctggagccatcagaacgtgagagactcgtagaagaaggtaaaaatcttaaggaaagtcttgttactctggaagaagacctcgtgaagcttaaagatgagctccaacatgtagcacagtctataccgaatatgactcaccctgatgttcctgttggaggagaggattcatcggcaattagacaggaggttggtagtccacgtgagtttagttttccaataaaggatcatcttcagcttgggaaggatcttgatctcattgattttgactctgctgctgaggtaagtggttcaaagtttttctatctgaagaatgaggcagttctattggagatggctcttcttaattggacattatcacaagtcatgaagaagggttatacccccctaacgactcctgaaatcgtgagatcttctattgttgagaaatgcggtttccaacctcgtggggataatactcaggtctattcgatagatggaactgaccaatgtctcattggtaccgctgaaattcccgtaggaggaatacacatggattctattcttcttgaatcagcattgcctttgaaatatatagcattctctcattgcttccgtactgaagcgggtgctgctggcgctgccacaaaaggtctttaccgagttcatcagttcagcaaagcagagatgttcgtcatatgccaacctgaagatagtgaatccttccaccaagaactcattcagatcgaagaagatttattcacttctctaggattacactttaaaacattggatatggccacagccgatttaggcgctccagcatatcgcaagtttgacattgaagcatggatgcccggtttaggacgatttggcgagatatcaagcgcatcaaactgcacagattaccaaagtcgaagactgggaatccgttaccgcccatctgaaccgcctcagacgggtcctaagaaagggaaagcgaatcttccagccactaagtttgtccacactctaaacgcgactgcgtgtgccgtcccaaggatgatggtgtgtttgctggagaattaccagcaagaagatggatctgtggtgatccctgagcccctgaggcctttcatgggaggcattgaactcatcaaacccaagcacaagtag

SEQ ID NO: 5833 - protein, 514 aa, Arabidopsis thaliana
MGLHKLRLAAAVPVTFSSRLFLKPFTNTLTLGLFSRHLQPRNKPLLVRAFSASAAVQDIPATQTSDSSVAARPLWKAAIDFKWIRDNKEAVEINIRNRNSNANLEAVLQLYENMVNLQKEVERLREERNNVAKKMKGKLEPSERERLVEEGKNLKESLVTLEEDLVKLKDELQHVAQSIPNMTHPDVPVGGEDSSAIRQEVGSPREFSFPIKDHLQLGKDLDLIDFDSAAEVSGSKFFYLKNEAVLLEMALLNWTLSQVMKKGYTPLTTPEIVRSSIVEKCGFQPRGDNTQVYSIDGTDQCLIGTAEIPVGGIHMDSILLESALPLKYIAFSHCFRTEAGAAGAATKGLYRVHQFSKAEMFVICQPEDSESFHQELIQIEEDLFTSLGLHFKTLDMATADLGAPAYRKFDIEAWMPGLGRFGEISSASNCTDYQSRRLGIRYRPSEPPQTGPKKGKANLPATKFVHTLNATACAVPRMMVCLLENYQQEDGSVVIPEPLRPFMGGIELIKPKHK

SEQ ID NO: 5834 - DNA, 1329 bp, Rhodopirellula baltica SH 1
  CDS (1)..(1329): transl_table=11
ttgtggggcaaattgagatgtccattttcccgcaccccactgaccacgatgctcgatcgcaaattcattctgcaaaatgcccagcttgtcgctgaaaattccgccaagcgtggcgtttctgtcgacgtcgacgcgatttgccgtctggaagccgaacggatggacgcgctgaagcaggcggaggagctgaatcggcaggccaacgaagtcagcaagcagatcaaatccgcgaaagacaacgacgagcgtcaggaattgatcgccaaaggtcgcagccttcgcgagcaaaaggatgccgccggtgccgcgcaagatcgcttggaagccgaaatcctcgagctgcaaacgattcttccgaacatgacccacccggatgtgcccgagggtggtgagcacgatgcgaacgagattggccgcggcaaaacgccagtgcctgaaatggacttccaaccgctggaccatcttcagctcggcgagaagcacgatttgtttgacttcgaaggcggagcccgcgtggccgggtccggtttctatttcttgcgaaacgccgccgtgcgtttggatttggcactgcaacaattcgcgatttcgcacttggccggcaaaggcttcacgccggtttcaacacctgacctggcgctgaccagcgtgctgcaaggcaccggattcaacccgcgtggtcccgagacacaaatctacagcatcgaaaataccgaattgaacttggtcgcgacggcggagatccctctgggcggaatgctcagtggtcagattctcgccagcgaagaattgccgcttcgttattgcgggctgagtcactgctttcgaaccgaagccggtgcggccggtcgagccagcaaggggctgtaccgagtccaccagttcaccaaagtcgaaatgttcgccttcacgttgcccgatcagagcaccgcgatgcatgaagagatgcgtgaactggaatgcgaaatctttgacgcgttggaagtgccctaccgagtgatcgacaccgcgacgggagacttgggcggacctgcgtaccgcaagtacgacttggaagcttggatgcctggacgtggcgaatcgggcgactggggcgaagtcaccagcaccagcaattgcaccgactaccaagctcgccgattgaatgtgcggtcgaagtccaacacccagaagggaaccgactttgttcacacgctcaacggcaccgcgattgcaaccggacgagccatgattgccatcttggaaaaccaccaacgtgctgacggaacgatcaatgttcctgaaatcttgcggccatgggttggctgtgacgttttgaaatgtgagtga

SEQ ID NO: 5835 - protein, 442 aa, Rhodopirellula baltica SH 1
MWGKLRCPFSRTPLTTMLDRKFILQNAQLVAENSAKRGVSVDVDAICRLEAERMDALKQAEELNRQANEVSKQIKSAKDNDERQELIAKGRSLREQKDAAGAAQDRLEAEILELQTILPNMTHPDVPEGGEHDANEIGRGKTPVPEMDFQPLDHLQLGEKHDLFDFEGGARVAGSGFYFLRNAAVRLDLALQQFAISHLAGKGFTPVSTPDLALTSVLQGTGFNPRGPETQIYSIENTELNLVATAEIPLGGMLSGQILASEELPLRYCGLSHCFRTEAGAAGRASKGLYRVHQFTKVEMFAFTLPDQSTAMHEEMRELECEIFDALEVPYRVIDTATGDLGGPAYRKYDLEAWMPGRGESGDWGEVTSTSNCTDYQARRLNVRSKSNTQKGTDFVHTLNGTAIATGRAMIAILENHQRADGTINVPEILRPWVGCDVLKCE

SEQ ID NO: 5836 - DNA, 1599 bp, Magnaporthe grisea 70-15
  CDS (1)..(1599)
atgaggagactatctcgtcaagtatcgaggttgcctcgacaggcgacgaggtgtctcgtcccaaactacagactatttcacaataccagcccaatatccgcagcagctcaaccacttgaagccgccgacttaaattcccaacagcctcccgctgcgccattccgccctaccatcgcacccaaggccgttatcgacctcaagcatatccgccagaacccagcactgtatgaacaaaactgcgttgaaaggaattacaagtcccagagcacgtatccagtacgcatcaatgcccttttcgagcaatggcacgaacggcaacgtgagggtcgcaccctccgcgagcgctccaatctgctgcgccgccaactggccaacccatcagcttcccttaccgaggcaccagacccgcgattccaggatctgacgaacatgtcccgcgaggagttgctagaagaaggcaaacggctgaaggaccagctatcatccattgaagattccgaggcaaggttggaagatgagatgcatagtcttggcctggcgctgcccaacttgactagtacaagtactccacgaggcagcgaacccctcgttttgagctacatcaatgtcgagaatgatgacccgaccgcactgctggagtcgactggcaagtcagaccgagtatggcgctcacatgtccacataggttcagaactgggcataatggactttgcaggcgcggcaacggcgtcgggctggggatggtactatctggtgggcgagggcgcggctctggagcaagccttggtgcagtacgctctggcagttgccacccgccatggctggacgcaggttagcccgccatcgatagtttattcccatatcgctggtgcgtgcggcttccagccccgtgatcataacggggagactcagatctacaacttggcgcagtctgcatctgacgccgagcgaggacggcccgaactatgcttggctgccacggcagagattcctcttgccggcatgaaggccgacacacagctcgaggagtcggagctctcaatgcgtcgcgtggctgtgtctcgctgctaccgcgccgaggccggcgcacgtggtgtggataccaagggcctctatcgagtacacgagtttaccaaggtggaaatgttcgcgtggacctcacccgacgagtccgaaacgttggatgtctttgacgagatgctcgatatacaaaccgaaatcctaggggccctgggactcagctgccgcgtgctcgagatgccatctactgacctcggggcctcagcaacgcgcaagaatgacattgaggcatttttcccatcccgcaggctgttgcgggatgacggttggggtgaagttacttcggccagtatctgtaccgactatcagactcgtcggctcgctactagggtgcgcgttgccggaaagatgacttatccgtggacagtcaacggcaccgcacttgctgtgccccgcgtcttggctgctatcctggagaatggatgggatgaggactccatgacggtcaccattcctgaggtccttaggccatggatggatggcaaagagaagatcggcccaaaacatcgcaggagatga

SEQ ID NO: 5837 - protein, 532 aa, Magnaporthe grisea 70-15
MRRLSRQVSRLPRQATRCLVPNYRLFHNTSPISAAAQPLEAADLNSQQPPAAPFRPTIAPKAVIDLKHIRQNPALYEQNCVERNYKSQSTYPVRINALFEQWHERQREGRTLRERSNLLRRQLANPSASLTEAPDPRFQDLTNMSREELLEEGKRLKDQLSSIEDSEARLEDEMHSLGLALPNLTSTSTPRGSEPLVLSYINVENDDPTALLESTGKSDRVWRSHVHIGSELGIMDFAGAATASGWGWYYLVGEGAALEQALVQYALAVATRHGWTQVSPPSIVYSHIAGACGFQPRDHNGETQIYNLAQSASDAERGRPELCLAATAEIPLAGMKADTQLEESELSMRRVAVSRCYRAEAGARGVDTKGLYRVHEFTKVEMFAWTSPDESETLDVFDEMLDIQTEILGALGLSCRVLEMPSTDLGASATRKNDIEAFFPSRRLLRDDGWGEVTSASICTDYQTRRLATRVRVAGKMTYPWTVNGTALAVPRVLAAILENGWDEDSMTVTIPEVLRPWMDGKEKIGPKHRRR

SEQ ID NO: 5838 - DNA, 1509 bp, Gibberella zeae PH-1
  CDS (1)..(1509)
atgaacaggacattattgcgcacaaggtgtcgcaatgtgcagccgaggctactaccaactcatccagcattaactcgcggctttgcagatgccaagcgaccaccctcagctccaaaacccatcgtcgatatcaaacacattcgccaacatgcagaactttatcagcagacttgtgtagagcgcaattatcgcaagcaagcgcaaaacccagctaaaattctagagttgcacgcaagatggcaggatcttcagcgacaaggccgcgcgctgcgtgagcgatcaaatctattgagacgccagcttgcgaacccggctaccagcagcggcgatgaggatctcaaggaagtgcgccaattgacccgcgagcagatccaggatgaggctcggcagctcaaacaggatctttctgcgattgaaaagggagagtcgcagtcagttacgcagatggaggaacttgcgctggagttgcctaacctcactcatccggatactcccaagggaagtgagtttgaggtgatgagctatatcaacgaccctcctattttcaaggaatctcccgaggataagatctggcgctctcacgttcacattggctctgagcttggactcttcgattttgcaggtgctgctactgcgtctggatggggctggtattatcttcttggtgaagctgctcaactcgagcaagctttgattcaatttgctcttgcaacagcaacccgtcatggctggacacaggtttctcctcccagtatggtatacagccacatcggtgctgcctgtggattccagccccgtgatgtgagcggagagcaacaagtctacactatcgctcagtccgctgaggatgctgagcgtggtgtccccgagatgtgtctgacgggaacctcggaaatcgcccttgctggaatgaaggccaacaccactatcgaccctgaagatctccctctcaagcgcgttgccgtatcccgctgctatcgcgctgaagctggtgcccgtggtgctgataccaagggattgtaccgcgtacacgaattcaccaaggtcgaaatgtttgcctggacagcaccagaccaagacgccgctcaggatatctttgatgagatgctcgacatgcaaaccgagattctttcctcccttggacttcactgccgtatcctctccatgccatcccacgatctcggcgcttcagcaactcgcaaaatcgacatggaagccttcttccccagccgtcgcgacaactggggcgaggtcacatcagctagcatgtgcaccgactaccagactcgccgccttggcacaagaactcgcgttgatggaaagctcgctttcccctggaccgccaacggcactgccctggctgttcctcgtgtgatagcagctctgttggagaacggatgggatgaggaggcaaagactgtcgctgtgccagagtgcctacgaccgtggatggatggcaaggataaaattggtcttggtggacgtcgctccagtgtggatcgcgtgtaa

SEQ ID NO: 5839 - protein, 502 aa, Gibberella zeae PH-1
MNRTLLRTRCRNVQPRLLPTHPALTRGFADAKRPPSAPKPIVDIKHIRQHAELYQQTCVERNYRKQAQNPAKILELHARWQDLQRQGRALRERSNLLRRQLANPATSSGDEDLKEVRQLTREQIQDEARQLKQDLSAIEKGESQSVTQMEELALELPNLTHPDTPKGSEFEVMSYINDPPIFKESPEDKIWRSHVHIGSELGLFDFAGAATASGWGWYYLLGEAAQLEQALIQFALATATRHGWTQVSPPSMVYSHIGAACGFQPRDVSGEQQVYTIAQSAEDAERGVPEMCLTGTSEIALAGMKANTTIDPEDLPLKRVAVSRCYRAEAGARGADTKGLYRVHEFTKVEMFAWTAPDQDAAQDIFDEMLDMQTEILSSLGLHCRILSMPSHDLGASATRKIDMEAFFPSRRDNWGEVTSASMCTDYQTRRLGTRTRVDGKLAFPWTANGTALAVPRVIAALLENGWDEEAKTVAVPECLRPWMDGKDKIGLGGRRSSVDRV

SEQ ID NO: 5840 - DNA, 1356 bp, Candida glabrata CBS 138
  CDS (1)..(1356)
atgtgggcagcagtacggcattacagcagcaagacgctgtttttgaagccggcgaagtttgatgtcaagaggatcatcagggacatagggctgtataaggactctatcgctcggcgggagctagtgggtcaggagcagttggttggtgccctggatgggcagcttgccgctacttatgagaggacgaaagatatacatgccaagatttcggcggtgcaaactgagaggaaagcgctcgagttcagtattcggcaacataaagtgcatggtgatgaagtattgaaggagctgagatcactcaagtctcaattcagtgccctcgctgaacaattgcaagaagccaactctaaaattcaggatatatgcctacgattgccaaacttgatacatgagtcggcgcccgatacagcgcctgtgatagaccgatggatcaacaagggtctttatgaatcgttcgaacaacaggaaaacagagaccacgtatacattatgactaagtgcaaacaactcttggacctggccagtgcatccaatatttcaggcaattcgtggtactaccttattaacgaaggagctcaactagagactgcattggtcaattatgcattggatcaggcagagaagcacggattccagcgttgtattccacctagcattgctcgcaaagagataattgatgcatgtggatttactcccagagatatgaacaatgagaagcagatctatgagatagaagacggtaataacaaacttggacttaccgctacagctgaaataacgttggcagggatgaatgccaacaaaatattggatttggacgaaaataatccaactaaaaggttggttggtgtaagtaggagttacagagccgaggctggtgcgagagggaaagacactaagggtttatatagagttcatgagtttaccaaagtggaactgttctgttggtcattgccgcaacatagtgagaaggttttagaggatctgaaagaattccaggttaaattaataagtgatttgggtctttgtgctcaggtcctcaacatgcctgccaatgatctgggaaatccagcttataagaagtatgacattgaagtctggatgccaggtagaggtaaatttggtgaagtaagtagtacttcgaattgtactgatttccaaagcagaaggctattcacaagataccagaataaagagtcatctaaactggagtacgtgcacacactaaatggtacagctatggctgttcctagaatgattctagcaattattgaaaacttctacgatccatcaacgaatatggttacagtacctagtccattgataccgtatatgaacggaaagaccaaattttag

SEQ ID NO: 5841 - protein, 451 aa, Candida glabrata CBS 138
MWAAVRHYSSKTLFLKPAKFDVKRIIRDIGLYKDSIARRELVGQEQLVGALDGQLAATYERTKDIHAKISAVQTERKALEFSIRQHKVHGDEVLKELRSLKSQFSALAEQLQEANSKIQDICLRLPNLIHESAPDTAPVIDRWINKGLYESFEQQENRDHVYIMTKCKQLLDLASASNISGNSWYYLINEGAQLETALVNYALDQAEKHGFQRCIPPSIARKEIIDACGFTPRDMNNEKQIYEIEDGNNKLGLTATAEITLAGMNANKILDLDENNPTKRLVGVSRSYRAEAGARGKDTKGLYRVHEFTKVELFCWSLPQHSEKVLEDLKEFQVKLISDLGLCAQVLNMPANDLGNPAYKKYDIEVWMPGRGKFGEVSSTSNCTDFQSRRLFTRYQNKESSKLEYVHTLNGTAMAVPRMILAIIENFYDPSTNMVTVPSPLIPYMNGKTKF

SEQ ID NO: 5842 - DNA, 1377 bp, Candida glabrata CBS 138
  CDS (1)..(1377)
atgttggatatcaaccagtttattgaagagaaaggtggtaaccctgagctgatcagacagtctcagaaggctagatatgccagtgttgagttagttgatgagattattgctgactacaaggactgggtcaagacgaggtttgagctggatgagttgaacaagaagctgaacaagttgcagaaggacatcggtatgaagttcaaggccaaggaggatgctagcgagctcttggctgagaaggacaagctgagcgaggagaagaagcaattgatcgagaaggagcagaaggaggacaaggatctgagacagaaggtgaatcagattggtaacattgtccacccatctgtggttgtctctaatgatgaggagaacaacgagctggtccgtacttggaagccagagggcttggctgatgtcggcccagttgcctccgttactggtaagccagccgctttgtctcaccacgagatcttgctaagactggacggttacgacccagagcgtggtgttaagatctctggccacagaggttacttcttcagaaactacggtgtcttcttgaaccaggctttgatcaactacggtctgcacttcttggccagcaagggttacatcccattgcaagccccagtcatgatgaacaaagaagttatggccaagaccgcccaattgtcccaattcgacgaagaactatacaaggtcatcgatggtgaagacgagaagtacttgattgctacttctgaacagccaatctctgcttaccacagcggtgaatggtttgagaagccacaggaacaactgccaatccgttacgttggttactcctcctgtttccgtagagaagccggttctcacggtaaggacgcttggggtgttttcagagtccacgccttcgagaagattgaacagttctgtataaccgaaccagagaagtcctgggaagagttcgacagaatgatcgctaactccgaagaattctaccaatccttgaaacttccataccgtgttgttggtatcgtctccggtgaattgaacaacgccgctgccaagaagtacgatctagaggcttggttcccataccaaaaggaatacaaggaattggtttcctgctccaactgtactgactaccaatccagaaacttggaaatcagaagtggtatcaagaagatgaacgacagagagaagaagtacgtccactgtttgaactccaccttggctgctacccaaagggccctatgttgtgttcttgaaaactaccaaaccgaggatggtttgattgttccagaagtcttgagaaagtacatcccaggtgaaccagaattcttgccattcgttaaggaactaccaaagaactccacctccaacaagaagaaataa

SEQ ID NO: 5843 - protein, 458 aa, Candida glabrata CBS 138
MLDINQFIEEKGGNPELIRQSQKARYASVELVDEIIADYKDWVKTRFELDELNKKLNKLQKDIGMKFKAKEDASELLAEKDKLSEEKKQLIEKEQKEDKDLRQKVNQIGNIVHPSVVVSNDEENNELVRTWKPEGLADVGPVASVTGKPAALSHHEILLRLDGYDPERGVKISGHRGYFFRNYGVFLNQALINYGLHFLASKGYIPLQAPVMMNKEVMAKTAQLSQFDEELYKVIDGEDEKYLIATSEQPISAYHSGEWFEKPQEQLPIRYVGYSSCFRREAGSHGKDAWGVFRVHAFEKIEQFCITEPEKSWEEFDRMIANSEEFYQSLKLPYRVVGIVSGELNNAAAKKYDLEAWFPYQKEYKELVSCSNCTDYQSRNLEIRSGIKKMNDREKKYVHCLNSTLAATQRALCCVLENYQTEDGLIVPEVLRKYIPGEPEFLPFVKELPKNSTSNKKK

SEQ ID NO: 5844 - DNA, 1380 bp, Kluyveromyces lactis NRRL Y-1140
  CDS (1)..(1380)
atgttggatattactcaatttattgaagagaaaggtggtaacccagagttgattagaaagtcccaaatcgctcgtggtgctagtgttgaaatcgtcgatgagatcatcgcaggctataaagaatgggtcaagactagattccaagttgatgaattgaacaagcaactaaacaaggtccaaaaggaaattggattgaaattcaagaataaggaagatgccagtgaattgttggctgaaaaggacagaattgtcgctgagaagaaagtgttgtctgaaagggaacaagaggaagataagcagttgagatccaaggttaaccaagttggtaacattgttcacccatctgttgttgtttctaacgatgaagagaacaacgagttggtccgtagttggatgccagaaaacatcaaggaagtggcccaagtagctactgccactggtgctgaggccaagttgtctcaccatgagatcttgttgagattggatggttacgatccagaacgtggtgttaagattactggtcacagaggttacttcttcagaaactacggtgtgtttttgaaccaagctttgatcaactatggtttgtccttcttggcttccaaagggtacactcctttgcaagctccagtaatgatgaacaaggacgttatggccaagactgctcaattatctgaattcgatgaagaactatacaaggtcttggatggtgatgatgaaaaatacttgatcgctacctccgaacaacccatttctgcataccactccggtgaatggtttgaaaagcctcaagaacaattgccagttcgttatgttggttactcttcttgtttccgtagagaagctggttctcatggtaaagatgcttggggtgtctttagagttcatgctttcgaaaagattgagcaatttgtcttgactgaaccagaaaaatcttgggaagaatttgataagatgatcaattactctgaagaattctaccaatccttgggcttaccttaccgtgtcgtcggtattgtttccggtgaattgaacaacgccgccgccaagaagtacgatctagaggcttggttcccataccaaaaggaatacaaggaattggtctcttgttctaactgtaccgattatcaatctagaaacttggaaatcagatgtggtatcaagaagatgggtgacagagaaaagaaatacgtacactgtttgaactctaccttgtgtgctacacaaagagctctatgttgtgttctagaaaattaccaaaccgatgaaggtctaaaggtcccagaggtgttgagaaagtacattccaggtgaacctgaatttttgccatacgtgaaagaattgccaaagaactctacttctaacaagaagaagaactaa

SEQ ID NO: 5845 - protein, 459 aa, Kluyveromyces lactis NRRL Y-1140
MLDITQFIEEKGGNPELIRKSQIARGASVEIVDEIIAGYKEWVKTRFQVDELNKQLNKVQKEIGLKFKNKEDASELLAEKDRIVAEKKVLSEREQEEDKQLRSKVNQVGNIVHPSVVVSNDEENNELVRSWMPENIKEVAQVATATGAEAKLSHHEILLRLDGYDPERGVKITGHRGYFFRNYGVFLNQALINYGLSFLASKGYTPLQAPVMMNKDVMAKTAQLSEFDEELYKVLDGDDEKYLIATSEQPISAYHSGEWFEKPQEQLPVRYVGYSSCFRREAGSHGKDAWGVFRVHAFEKIEQFVLTEPEKSWEEFDKMINYSEEFYQSLGLPYRVVGIVSGELNNAAAKKYDLEAWFPYQKEYKELVSCSNCTDYQSRNLEIRCGIKKMGDREKKYVHCLNSTLCATQRALCCVLENYQTDEGLKVPEVLRKYIPGEPEFLPYVKELPKNSTSNKKKN

SEQ ID NO: 5846 - DNA, 1335 bp, Kluyveromyces lactis NRRL Y-1140
  CDS (1)..(1335)
atggtcacaaagagactctttcattccattggaaggcttcggaccgtgaagaaacctcaattcaatgtgaaatatatgatatcgaaactcgatgaattctctgattcaatccaagcaagagaacttgtggacggcgaggaacttcaaatatctttaaaaatgttaccggagttgtaccagaaatcgagggttgctgatcatacaatcgccaatcttcaacattcaagaaagaccatcgaagcccaagtaaaacaagataaaacaagggcaagagagctcgggtctgaactcaaatcactaaagaaacaataccaagatctattgaaaactcaaagagaagtgaaggatcagataactgaggtatgtggatccttacccaatctcattcatccttctgttccaaagacatcaagcccgatcattgatcaatggattaataaacaagcacaatacaaaccagatgaaaggtttgaacatcttaaaataatggtaaataaaggaatggttgattttgagactgcttctaatgtaacaggtacttcatggtattatttatgcaatgatggtgcgcgtctagaacatgcattggtgcaatatgctacaacgaaagcacgcaaggctaacttcaatttagtgattcctcccagtgttgtgcgtaatgaggttatagatgcgtgcgggtttagaccacgagacactaataatgaacaacaaatttatcggttatcagataccgatttaggattaaccgctactgcggaaatcgccttggcagggatgggcttagattctatattggatctaagttcaggacctaagaagatttgtggtgtgaacagagcatatagagcggaggcaggcgcaagtggtaaagatactaaaggtttatatcgggttcatgaattcactaaagttgagttattcgtttgggccaaacctgaacaaagtgatcaaatactggaagaattgaaacaatttcaaatagatatcgttagagaactaggattgagcgctcaggtattgaacatgccatcaaatgatctcggatctcctgcgtacaaaaaatatgatattgaagcatggatgccaggtagaggctcattcggcgaaattacaagtacatcaaattgcactgatttccaaagtagaaggatgcataccagatttagaaacgaagagggtgaattggaatatgcccataccctcaacggtactgcaatggcagtgcccagagtcattgtagcgttagttgaaaacaattatgacccagtgagtgatactatttcaattccccaagcattgcaaccatatttggatggtatggaatttatgtaa

SEQ ID NO: 5847 - protein, 444 aa, Kluyveromyces lactis NRRL Y-1140
MVTKRLFHSIGRLRTVKKPQFNVKYMISKLDEFSDSIQARELVDGEELQISLKMLPELYQKSRVADHTIANLQHSRKTIEAQVKQDKTRARELGSELKSLKKQYQDLLKTQREVKDQITEVCGSLPNLIHPSVPKTSSPIIDQWINKQAQYKPDERFEHLKIMVNKGMVDFETASNVTGTSWYYLCNDGARLEHALVQYATTKARKANFNLVIPPSVVRNEVIDACGFRPRDTNNEQQIYRLSDTDLGLTATAEIALAGMGLDSILDLSSGPKKICGVNRAYRAEAGASGKDTKGLYRVHEFTKVELFVWAKPEQSDQILEELKQFQIDIVRELGLSAQVLNMPSNDLGSPAYKKYDIEAWMPGRGSFGEITSTSNCTDFQSRRMHTRFRNEEGELEYAHTLNGTAMAVPRVIVALVENNYDPVSDTISIPQALQPYLDGMEFM

SEQ ID NO: 5848 - DNA, 1389 bp, Debaryomyces hansenii CBS767
  CDS (1)..(1389)
atgctacgtcatagacccttaaatgtatctttccgtagatactcaagctcattcaaaaacacaactgtccttaggaaaccaaactttgatttgaagaatattataaataatagcgaaaaatataaagatgcaataattcgaagaaaaactccagagttgattcaaagtcttgaatatgtagtcaccaatagaccaattgaaattgaactaactaatagaatcaatactaaaaagcatgagaggtcaaaattaagtgaggttatgaaggaactaaagaacaaagcacctatagaggttaaggaagaattagctaaagcaaaaagtgagttgaaaacattggaagctgaaagagacgaattatcgcaaaaaatacacagatatgctgagtctcttccaaacttactcgatacaacagtacctaaagatacattgcagggggatatagtgaagtttattaattgtgcatcggaacaagacgcagtaaactccatgcccacatctaaatttgaccataagactattggtgaaaaattaaatattatgaattttaatatcgccgcaagaatctctgggtcctcgtggtactatctcgttggagatggtgctttattagagcaagcattgattcagtatggtctttcaaaagctcgtgtaaatggatatactatgattatacctccttcaattgtgaagaatgaaattatcagtgcatgtggtttcaaacctaacgaccaaaacggagaacaacaggtctatcaattaaccaatgatgacttatctttaataggtactgcggaaatcccattaggtgcttaccattcgtcctcgacgtttccttcatcacagaattaccctataaagtatgtaggtatctccagatcatatagagcagaggctggagctcgtgggtcggatactaaagggttatacagagttcacgaatttacaaaggttgagttattccattttacaacccctgacaaggctgcacaagaattagaagaccttaaaaacttacaaattagcataattgaagacttaggtttaagtgcaaaaatgataaatatgccaagttcggatcttggagcaccggccttgaagaagtttgattgtgaagcttggatgcctgggagagaaggctggggtgaattaacaagctgttccaattgtagcgattatcagtcgaggagattaggtattagatatgaggatggcaaagatgaaaataaattaaaatacattcacacattaaatggaacttgcgttgccatacctagagtaattgttgcaataatggagcaattttatgatccagccactgaatcgattattattccaaaggtcttaaggccatatatggatgataaagagagaatttatcaaaattag

SEQ ID NO: 5849 - protein, 462 aa, Debaryomyces hansenii CBS767
MLRHRPLNVSFRRYSSSFKNTTVLRKPNFDLKNIINNSEKYKDAIIRRKTPELIQSLEYVVTNRPIEIELTNRINTKKHERSKLSEVMKELKNKAPIEVKEELAKAKSELKTLEAERDELSQKIHRYAESLPNLLDTTVPKDTLQGDIVKFINCASEQDAVNSMPTSKFDHKTIGEKLNIMNFNIAARISGSSWYYLVGDGALLEQALIQYGLSKARVNGYTMIIPPSIVKNEIISACGFKPNDQNGEQQVYQLTNDDLSLIGTAEIPLGAYHSSSTFPSSQNYPIKYVGISRSYRAEAGARGSDTKGLYRVHEFTKVELFHFTTPDKAAQELEDLKNLQISIIEDLGLSAKMINMPSSDLGAPALKKFDCEAWMPGREGWGELTSCSNCSDYQSRRLGIRYEDGKDENKLKYIHTLNGTCVAIPRVIVAIMEQFYDPATESIIIPKVLRPYMDDKERIYQN

SEQ ID NO: 5850 - DNA, 1413 bp, Yarrowia lipolytica CLIB122
  CDS (1)..(1413)
atgttaaggcgaattactcgtgcggtccccagggtaaacgctcgtctcttctccagcacatctgtgtcactacaggctgacgagtggaaaaacctcaaggccccgaaacacgattacaagggcaaaatcactggaatcggccaagaaaccatcattcgagaagccattcagcgacagcttcctgaagacaccatttcgcagctcgagcggcttgaatcagcctaccaacagtatcgagaatgcacccagaagtacgatgaggctcgacacaagcagagaaaggtgtctgatgcgatcaaggtggccacggacaagaaggcgctcgcacaggaagcttccgaggcgaaaaagcatatgaaagctatggatctgaaccagagagaggccatcgcaaccctcaattctctcatggagctggtccccaacgtcattcactccaccgtgccccagggagacgacgtggaggtgttggagatcctcaaccccgacagacagtacaagtccgacgtaggacattacgaaattggccatagtctcaatctgctcgacacaaagacgtcggccaacacctcgggatatggatggtactacttgctgggtcagggggctcagcttgaacaggctcttgtggcctatgttctggataaggcccgtgtcagtggatggatgactgtagcccctcccaccatcatccgaaagtcggttgcacatgcatgtggcttcaagccccgagatgtcggaggagagaagcagatttacgctattgaggaccaggaccattgtctggctggcactgctgaaatcccgctggctgcatgggctgctgacaagtctttcaagtacacaagcgaccccgttaaggtgtctggagtcagtcggtcgtaccgagctgaagcgggagctcgaggagcagataccaagggtctgtatcgagtgcatgagttcaccaaggtagagctgtttgcatggaccatttctcctgaatcagcagatgccattctcgaagacatgcttgcattccaaaagtctgtggttgtggatctcggtctcaaggctcgggttctcaatatgccagctttcgagctcggttaccccgccgctaagaagtacgatattgaggcctggcttcctggccgaggagactggggtgaaatcacctccacctccaactgtctcgactaccagagtcgacgtttgcataccactttcaagctgagagacgccaagaaggtgtatgcccagactctcaacggtacggctttggctgtgcccagagtaattgctgccatctgtgagagcaactacgacccggagacaaagaccattgctgttcccgaggtgctacagaagtacatgggaggagttacctccatcggatcccaggacaactgcgacgtctttgccaccacctag

SEQ ID NO: 5851 - protein, 470 aa, Yarrowia lipolytica CLIB122
MLRRITRAVPRVNARLFSSTSVSLQADEWKNLKAPKHDYKGKITGIGQETIIREAIQRQLPEDTISQLERLESAYQQYRECTQKYDEARHKQRKVSDAIKVATDKKALAQEASEAKKHMKAMDLNQREAIATLNSLMELVPNVIHSTVPQGDDVEVLEILNPDRQYKSDVGHYEIGHSLNLLDTKTSANTSGYGWYYLLGQGAQLEQALVAYVLDKARVSGWMTVAPPTIIRKSVAHACGFKPRDVGGEKQIYAIEDQDHCLAGTAEIPLAAWAADKSFKYTSDPVKVSGVSRSYRAEAGARGADTKGLYRVHEFTKVELFAWTISPESADAILEDMLAFQKSVVVDLGLKARVLNMPAFELGYPAAKKYDIEAWLPGRGDWGEITSTSNCLDYQSRRLHTTFKLRDAKKVYAQTLNGTALAVPRVIAAICESNYDPETKTIAVPEVLQKYMGGVTSIGSQDNCDVFATT

SEQ ID NO: 5852 - DNA, 1491 bp, Candida albicans SC5314
  CDS (1)..(1491): transl_table=12
atgttgtgtacaggaaacagaataattcttgttcaattctctactgtgagtgcacgaaagaaaatgacctacaccttacattattctaccaatcgaagtaacatcaaggctaggttatcaagcatgcttaacactatacgtagatacattagcactggcaaaaactcatcaacgttattaagagcacaaatcgacattaatgatattttgagtcgtccaaaagagtatgaatcttcaattcaccgaagacaactaccacaagagttgattgaaaacatcaatttcatcacatcaaatcgaccattacaagcacaattgttttctcaaatcaatgacatgaaaaaagaaagaactatcctagcagagcgtttaaagtcaaacgtgggtgatctacaacaattcaaagaaagattgaagcaactcaaatctgaactaaaaccgttggaaaaacaagtgaaaaccatccaagaaaaaatatacgccaaagccgaatctttgcccaatcttatagacgtaacagtccctacggatcctttgaaagaagaagttgtccaatttataaattgccagtctgaagaagatgctaaagtttcaaattcgtcagcagttcatgatcacaaggaaataggagtcaactttaatattttggatttcagtgtggcatctagagtatctggaccgtcttggtactatttaattggagatggtgctttgcttgaacaagcgttaattcaatatgcgctctcaaaagctcgcaggcgtgggtatttgatgcttactccaccttcgattgttaagtcagaaattgttggagcctgtggattcaaaccaaatgatcaaaataatgaaaagcaaatctatgaacttaaaggcgaacacaagtccttgacaggtacagcagagataccattggctgcattccattcttctactgtattcccgagtggcactcaattccccataaaatatgttggtgtatcaagagcataccgcgctgaagcaggggccagtggaaaagatactaagggattgtatagagtgcatgagtttactaaagtcgagttattccattttacaacagaagagaaggccgcacaagaattagaagatctaaaggatatgcaagtggaaattgtcacggaattgggtctatccgctaaattgttaaatatgccatcatccgatttaggtgcaccagcaatgaaaaaatatgacatcgaagcgtggatgccaggaagaggttcctggggagagctcacaagctgttctaattgtggcgattaccaatctcgaagattaggtatacgttataatgatgatcaagaaggtcgtctcaaacacgtttcaacacttaacggtacatgtatggccgtccctagagtaattgttgcattaattgaacaaaactttaacgcagaaaagaatgaaatttcaataccagaagttttgcagccattcatggatggcaaagataaaatcgttcctaattaa

SEQ ID NO: 5853 - protein, 496 aa, Candida albicans SC5314
MLCTGNRIILVQFSTVSARKKMTYTLHYSTNRSNIKARLSSMLNTIRRYISTGKNSSTLLRAQIDINDILSRPKEYESSIHRRQLPQELIENINFITSNRPLQAQLFSQINDMKKERTILAERLKSNVGDLQQFKERLKQLKSELKPLEKQVKTIQEKIYAKAESLPNLIDVTVPTDPLKEEVVQFINCQSEEDAKVSNSSAVHDHKEIGVNFNILDFSVASRVSGPSWYYLIGDGALLEQALIQYALSKARRRGYLMLTPPSIVKSEIVGACGFKPNDQNNEKQIYELKGEHKSLTGTAEIPLAAFHSSTVFPSGTQFPIKYVGVSRAYRAEAGASGKDTKGLYRVHEFTKVELFHFTTEEKAAQELEDLKDMQVEIVTELGLSAKLLNMPSSDLGAPAMKKYDIEAWMPGRGSWGELTSCSNCGDYQSRRLGIRYNDDQEGRLKHVSTLNGTCMAVPRVIVALIEQNFNAEKNEISIPEVLQPFMDGKDKIVPN

SEQ ID NO: 5854 - DNA, 1377 bp, Candida albicans SC5314
  CDS (1)..(1377): transl_table=12
atgcatttctcgttgaaaaggggaggtgacccagaaattattaaagcatcccaaaagaaaagaggtgactccgtcgaattagttgatgaaatcatcgccgaatataaagaatgggttaaattaagattcgatttagatgaacacaacaagaaattgaattcagtacaaaaagaaattggtaaaagattcaaagctaaagaagatgctaaagatttaattgctgaaaaggaaaaattgagtaatgaaaaaaaggaaattattgaaaaagaagctgaagcagataagaatttacgtagtaaaatcaatcaagttggtaacatcgttcatgaatcagttgttgattctcaagatgaagaaaacaatgaattggttagaacctggactccagaaaattacaaaaaaccagaacaaattgctgcagctactggtgcaccagccaaattatctcatcatgaagtattgttaagattagatggttacgatccagaaagaggggttagaattgttggtcatcgtggttatttcttaagaaactatggggtatttttgaaccaagctttgatcaactacggtttactgtttttgagtagcaaaggatacgttccattgcaagcaccagttatgatgaataaagaagtcatggctaaaaccgcacaattgtctcaatttgacgaagaattgtataaagtcattgatggtgaagatgaaaaatatttaattgccacttcagaacaaccaattagtgcttaccatgccggtgaatggtttgaatcaccagcagaacaattgccagttcgttatgctggttattcatcatgtttcagaagagaagctggatcacacggtaaagatgcttggggtattttccgtgtccatgcttttgaaaagattgaacaatttgttttgactgaaccagaaaaatcatgggaagaatttgatagaatgattggatgttcagaagaattttatcaatcattaggattgccatacagagttgttggtattgtttcaggtgaattgaacaatgctgctgctaagaaatacgatttggaagcttggttcccattccaacaagaatacaaagaattggtttcatgttcaaactgtactgattatcaatcaagaaatttggaaatcagatgtggtataaaacaacaaaaccaacaagaaaagaaatacgtccattgtttgaactcaactttaagtgctactgaaagaactatctgttgtattttagaaaactaccaaaaggaagatgggttggttattcctgaagtattgagaaaatacattcctggtgaaccagaatttattccatacattaaggaattgccaaaaaacaccacttctgttaaaaaagctaaaggtaagaattag

SEQ ID NO: 5855 - protein, 458 aa, Candida albicans SC5314
MHFSLKRGGDPEIIKASQKKRGDSVELVDEIIAEYKEWVKLRFDLDEHNKKLNSVQKEIGKRFKAKEDAKDLIAEKEKLSNEKKEIIEKEAEADKNLRSKINQVGNIVHESVVDSQDEENNELVRTWTPENYKKPEQIAAATGAPAKLSHHEVLLRLDGYDPERGVRIVGHRGYFLRNYGVFLNQALINYGLSFLSSKGYVPLQAPVMMNKEVMAKTAQLSQFDEELYKVIDGEDEKYLIATSEQPISAYHAGEWFESPAEQLPVRYAGYSSCFRREAGSHGKDAWGIFRVHAFEKIEQFVLTEPEKSWEEFDRMIGCSEEFYQSLGLPYRVVGIVSGELNNAAAKKYDLEAWFPFQQEYKELVSCSNCTDYQSRNLEIRCGIKQQNQQEKKYVHCLNSTLSATERTICCILENYQKEDGLVIPEVLRKYIPGEPEFIPYIKELPKNTTSVKKAKGKN

SEQ ID NO: 5856 - DNA, 1386 bp, Cryptococcus neoformans var. neoformans B-3501A
  CDS (1)..(1386)
atgatcgacctcattcatctccaagccgacaaaggcggtaaccctgacatcgttcgggagtctcagaagaagcgaggcgccagcgtcgagctcgttgatgaggttatcgcaatttttgccgagcacaagaatgccaactatgaaatggagaatgccaagcgagaactcaacctcctccaaaaagaaatcggtcaaataaaaaaagcaaagggtgatgctaccgagttgcttgccaagaaagcagacatggacaagaagattgcggagatgaccactcgagtagccgatcttatcaagaagagagaccaaaaggctggacagattgggaacattgttgaccctcagaaccacgtttctttgactgaggacgacaaccctgtccttcgtttatggcaccctgagcctaaccacaagggcaattctcaacttctcgaccaatctgacaagcccgagggtattatttcccaccatgaagtcctcgctcgtcttgaggcctacgacactgatcgcggtgtcaaggtcttcggccaccgtggtttctatctcaccaacgacggcgtcgaccttaaccaggctttgatcaactacggtctcgatttcttaaggaagaagggattcaaaaaggttcagcccccgttcatgatcaagaaggagattatgggtgcgactgcgcaacttgaagactttgatgaggctctttacaaggtttctggaggtgctgaggacatgtacttgattgccaccagtgagcagcctatctctgcctaccacatggacgaaaacctcgatcccaagaacttgcccctccactatgccggttactctacatgtttccgaaaggaggccggttctcacggtagggacacttggggtatcttccgagttcaccaattcgagaaggttgagcaatttgtcgtctgcgagcccgaggcttccccagccgagcttgacgccatggtcgccaactctcgcgagttctacgagtctctcggtatcccgtatcgtctggtcaacatcgtctctggtggtctcaacaatgccgccgctatcaaatatgacttggaggcttggttcccttatcagggagagtacaaggagttggtctcttgctctaactgtaccgactaccagtcaaggtctttgaacgtccgactgggtttcaaggaaaaggacaagaagaccggttttgtgcacatgcttaacggtacactttgcgccactgaacgagccctctgttgtctcgttgaaaactaccaaacccccgagggtctccgtatacccaaggttcttcaaccttacatgcaggggcgggacttcttgccctataccgccgagttgccaaagacttctaccagcaagggccccagcaccaagagtaaaaagtaa

SEQ ID NO: 5857 - protein, 461 aa, Cryptococcus neoformans var. neoformans B-3501A
MIDLIHLQADKGGNPDIVRESQKKRGASVELVDEVIAIFAEHKNANYEMENAKRELNLLQKEIGQIKKAKGDATELLAKKADMDKKIAEMTTRVADLIKKRDQKAGQIGNIVDPQNHVSLTEDDNPVLRLWHPEPNHKGNSQLLDQSDKPEGIISHHEVLARLEAYDTDRGVKVFGHRGFYLTNDGVDLNQALINYGLDFLRKKGFKKVQPPFMIKKEIMGATAQLEDFDEALYKVSGGAEDMYLIATSEQPISAYHMDENLDPKNLPLHYAGYSTCFRKEAGSHGRDTWGIFRVHQFEKVEQFVVCEPEASPAELDAMVANSREFYESLGIPYRLVNIVSGGLNNAAAIKYDLEAWFPYQGEYKELVSCSNCTDYQSRSLNVRLGFKEKDKKTGFVHMLNGTLCATERALCCLVENYQTPEGLRIPKVLQPYMQGRDFLPYTAELPKTSTSKGPSTKSKK

SEQ ID NO: 5858 - DNA, 1521 bp, Cryptococcus neoformans var. neoformans B-3501A
  CDS (1)..(1521)
atgtacactgcagcaagggaaatgtctcggacgaaacaaattggcattgctgcgaggagattctccacttgcccacccctttttgcgcctgttcttccacagacaacactccccaaaccccgttttgactatacgaaactgctttcagacccatccttaacactacaaaacgcccaactacgggcattccctctggttaccaaccacctatccgaactttcgtctctgcgcgatactcagcgagagcttcttcagaagctcaacgctaccagagctcgtcaaaaggaactcggtaattcgatcaagaaattaaaaggtctcgaagtcgaagaagcgaagaagcaagctaaagagcttaaatcgttgattaaagagttcgaagtatcgttatcaacagccgaatcatctcttctcgacctcgcactttcgctccccaatttctctcacccttccacccctattggtcccgaagaaaacgctcgcacacttgagacgtttggtcctacgcccataccctccgacccagcaagggaccacgtcgctttcgcccaatacttctccctgctcgatacttcagcttctgccaaaacaacgggctcatcatggccttaccttcgaggttccctcgctttccttgaacaagcactgatcagctatgcattaaacattgctaataaacatggattcacaccagttataccccctgatgtggtcaagaccgatatcgcctggcgatgcggtttccaaccccgcgaccaagcgacaaacgccgctgcctcccagacgtaccacctccaacccacttcaaattcggctcagtcgctctgtcttgccggtacttccgaaattccgttggcggggatgtttgcagatatgattatacccgaagaaaacctcccccaacgggttgtcggtgtcggtcgggccttccgagctgaagcgggtgcaagaggcgcagatacgagaggattgtatagggtgcatcagtttacgaaagttgagttgtttgtggtgagcggggagaaggagagcgaatcgatgatggaggagatgagagaggtacagaaggaaattgtgcaaggtttggggttgagcgtgagggtgttggatatgccaacggaagagctgggagctagcgcgcacagaaaatatgatatggaagcatggatgcccggccgagggaaatggggcgagatcacatcgacatccaactgcacggactaccaatctcgtcgtctatccatcacttaccgtccccaacccacatcacctacccatgccatcgacccttcctcaggaccattaccgtttgcccatacgctaaatggtacagctgccgccatacccagattacttgtggcgttactagagaacggattgcagtacgataagacgggcgagggtgatagtgagcaggtgatctatacgggattagaattgccaaaggcattacagagattttatgtaggaagcgatgagattggcgggagagggagaaaggggttaatccattgggtttga

SEQ ID NO: 5859 - protein, 506 aa, Cryptococcus neoformans var. neoformans B-3501A
MYTAAREMSRTKQIGIAARRFSTCPPLFAPVLPQTTLPKPRFDYTKLLSDPSLTLQNAQLRAFPLVTNHLSELSSLRDTQRELLQKLNATRARQKELGNSIKKLKGLEVEEAKKQAKELKSLIKEFEVSLSTAESSLLDLALSLPNFSHPSTPIGPEENARTLETFGPTPIPSDPARDHVAFAQYFSLLDTSASAKTTGSSWPYLRGSLAFLEQALISYALNIANKHGFTPVIPPDVVKTDIAWRCGFQPRDQATNAAASQTYHLQPTSNSAQSLCLAGTSEIPLAGMFADMIIPEENLPQRVVGVGRAFRAEAGARGADTRGLYRVHQFTKVELFVVSGEKESESMMEEMREVQKEIVQGLGLSVRVLDMPTEELGASAHRKYDMEAWMPGRGKWGEITSTSNCTDYQSRRLSITYRPQPTSPTHAIDPSSGPLPFAHTLNGTAAAIPRLLVALLENGLQYDKTGEGDSEQVIYTGLELPKALQRFYVGSDEIGGRGRKGLIHWV

SEQ ID NO: 5860 - DNA, 1272 bp, Clostridium difficile 630
  CDS (1)..(1272): transl_table=11
atgttagatattaaaagaataagagaaaatctagatgatatcaaaaaagctatggaaagaagaggtgaaagagaatttgaccttgatgctgtagtggaattagataataaaagaagagaaatacttcaagaagttgaagttatgaaaaatgagttaaatgtaaattctaaaaaaatacctcaattaataaaagaaggaaaagatgtaacagaagaaaaggcaagattgaaagagttatcagataagataaaaggtattgatgagaaagtaaaagaagtagaagcaaaaatggaatatacattaatgagaataccaaatgttcctcatccagaggtaccacaaggtgaaacagatgaagacaatgttcaaataagaacttggggagaacctactaaatttgattttgagcataaagcgcattgggatataggtacaggtctaggtattttagattttgaaagagcagggaaaataactgggtcaaggtttactttatataggggattaggagctagattagaaagatctttaatgaatttctttttaaatactcatacagctaagcatggctatacggaagtcttacctccatttatggccaatagaaatagttttatagggactggtcaacttcctaaatttgaagaagatatgtttaaaatagaaggattagagtatttcttaataccaacagctgaagttcctgttactaatatacatgctaatgaaatattagatgttgcagagcttccaattaaatactgtgcatatactccttgttttagatctgaagcaggttcagcaggaagagatacaagaggtttagttagacaacatcaatttaataaagttgaattagttaaatttgttaaaccagaagattcttataatgaattagaatcattaactcatgatgctgaaactatgttacaaatgttaggtcttccatatagagttgtaaaaatatgtacaggagatttgggatttacagctgcatttaaatatgatttagaagtttggatgccaagctacaatagatatgtagaaatatcttcttgttcaaattttgaagatttccaagcaagaagagcaggaataagatttaaaagggataaaaaatcaaaagcagaatatgttcatacattaaatggttctggattagcgataggaagatgtttggctgctatattagaaaattatcagcaggcagatggttctgtagtagttccagaagaattaagaccttatatgggtgttgatgttataaaataa

SEQ ID NO: 5861 - protein, 423 aa, Clostridium difficile 630
MLDIKRIRENLDDIKKAMERRGEREFDLDAVVELDNKRREILQEVEVMKNELNVNSKKIPQLIKEGKDVTEEKARLKELSDKIKGIDEKVKEVEAKMEYTLMRIPNVPHPEVPQGETDEDNVQIRTWGEPTKFDFEHKAHWDIGTGLGILDFERAGKITGSRFTLYRGLGARLERSLMNFFLNTHTAKHGYTEVLPPFMANRNSFIGTGQLPKFEEDMFKIEGLEYFLIPTAEVPVTNIHANEILDVAELPIKYCAYTPCFRSEAGSAGRDTRGLVRQHQFNKVELVKFVKPEDSYNELESLTHDAETMLQMLGLPYRVVKICTGDLGFTAAFKYDLEVWMPSYNRYVEISSCSNFEDFQARRAGIRFKRDKKSKAEYVHTLNGSGLAIGRCLAAILENYQQADGSVVVPEELRPYMGVDVIK

SEQ ID NO: 5862 - DNA, 1272 bp, Clostridium difficile 630
  CDS (1)..(1272): transl_table=11
atgcttgatataaaaagaataagagaaaatttagattgtataaaaaaagcaatggaaagaaggggcgaaaaagactttaaccttgatgaagtagttaagttagatgatgaaagaagaaagattcttcaagaagttgaagttatgaaaaatgaattaaatacagcatctaaaaatataccaaatcttataaaagaaggtaaagatgtagaaaatgaaaagattaaactaaaagagttatctgataaaattaaggtaatagaccaaaatcttaaagaagtagaagataagatggaatacctattaatgagaataccaaatgtaccacatccagaagtaccacaaggtgaaactgatgaagataatgttgaagtaagaacttggggaaagactactacctttgattttgaatctaaggctcattgggaaattggaacagaattaggtatacttgattttgaaacagctagtaaaataactggttcaagatttactctttacaaaggattaggtgctagattagagagagcattattaaatttttacttagacacgaatacaaaagtaaatggatatacagaagttattccaccatttatggcaaatagaaatagttttttaggtacaggacagttacctaagtttgaagaagatatgtttaaaatagaaggtctggactattttatgattccaacatcagaagttcctttaactaatatacatgctaatgaaatacttaaatttgaacaattaccaataaattatacagcttatactccatgttttaggtcagaagctggttctgctggaagagatacaagaggtttagtaagacagcatcagtttaacaaagtagaaatggttaaaatagttgcaccagaagaatcttacaatgagttagaaaagcttactaacaatgcggaaactatgctacaattattgaatctgccttatagagtagtaaagatatgtacaggtgatttaggatttacggcttcttttaaatatgatgtagaagtttggatgccaagttacaataggtatgttgagatttcatcttgttcaaactgcgaagatttccaagctagaagagcaggaataagatttaaaagagataaagattctaaaactgaatatgtacacacattaaatggctctgggttagctattggaagaagtgttgcagttatattagaaaattatcaacaagaagatggttctgtggttgttcctgaagttttaagagcatatatgggagtttctgttattaaataa

SEQ ID NO: 5863 - protein, 423 aa, Clostridium difficile 630
MLDIKRIRENLDCIKKAMERRGEKDFNLDEVVKLDDERRKILQEVEVMKNELNTASKNIPNLIKEGKDVENEKIKLKELSDKIKVIDQNLKEVEDKMEYLLMRIPNVPHPEVPQGETDEDNVEVRTWGKTTTFDFESKAHWEIGTELGILDFETASKITGSRFTLYKGLGARLERALLNFYLDTNTKVNGYTEVIPPFMANRNSFLGTGQLPKFEEDMFKIEGLDYFMIPTSEVPLTNIHANEILKFEQLPINYTAYTPCFRSEAGSAGRDTRGLVRQHQFNKVEMVKIVAPEESYNELEKLTNNAETMLQLLNLPYRVVKICTGDLGFTASFKYDVEVWMPSYNRYVEISSCSNCEDFQARRAGIRFKRDKDSKTEYVHTLNGSGLAIGRSVAVILENYQQEDGSVVVPEVLRAYMGVSVIK

SEQ ID NO: 5864 - DNA, 1362 bp, Candidatus Protochlamydia amoebophila UWE25
  CDS (1)..(1362): transl_table=11
ttgtcatctatagaaatccttccttttaagaagggagttttttatactctttttattatcattttgagtaaaggacatgccatgattgatattcgcttaatccgtaaagatcgttttgcagttgagaaacagttaaaaacgaaagatccgcaaattgatcttactaatatttgtcacctcgatcattctattcgcgaagctaaaacaaaagttgaaactctcaaggcaaaacgtaatgagatttctcagaaaatcggagaaatgaaacgggctaaccaagatactttttctttaatgaatgaagtagcaggatttggaacagaaattcattttttggataaccaaattaaagaatgggaagaacaatttaattatgagttatctagcttacctaatcttcccatggaagatattaaaatctctcaagatcctaaagaaaatgttgttatcaaagagtttggacaaaaacctattttttcttttccattcaaaaatcacgtagaacttaatgaaaaattaaatttatttgattttaagcgtggagctaaaatttctggaacaggctggcccgtttatcgagccatgggagcacgtctagaatgggccctcatccaatatatgatcgaaattcacgtcaaaaatggatttacacaatggatccctccccttcttgttagaaaaaatactgtgtttggatctggacaattacctaaatttgaaagtcaacaatttaaaattcaagatgaggattatcatctttatttaattcctacagccgaagttcctcttaatggattgcatatggatgagattattcctcaagaagagctcagtctaaaatatgtagcctacaccccttgttttaggcgtgaagcaggagcagcaggatcgcaagaacgtggtctaattagaatgcatcaatttaataaagtcgaaatgttttgctttacaaaaccggaggaaagcgcacaagtattcaatcaaatgatggatagcgcagaggaaattttgcaaggcttagaactccattatcgtaatgctttactagtaactggggacatgtctttcgctgcagcgcgcacaatagacattgaagtttggttacccggacaaaacagatattatgaagtctcttctgtatctaattgtacagattatcaatcccgtcgttctaatacacgttttagacgcgaagacggaaagttagattttgttcatacccttaatggttctggattagcgacttctcgattaatggttgctttattagaaaataatcagcgggaagatggctctgtttgtattcctaatgtcttacaacgctatttaaacggacaaagcacattgaatcccacaatttga

SEQ ID NO: 5865 - protein, 453 aa, Candidatus Protochlamydia amoebophila UWE25
MSSIEILPFKKGVFYTLFIIILSKGHAMIDIRLIRKDRFAVEKQLKTKDPQIDLTNICHLDHSIREAKTKVETLKAKRNEISQKIGEMKRANQDTFSLMNEVAGFGTEIHFLDNQIKEWEEQFNYELSSLPNLPMEDIKISQDPKENVVIKEFGQKPIFSFPFKNHVELNEKLNLFDFKRGAKISGTGWPVYRAMGARLEWALIQYMIEIHVKNGFTQWIPPLLVRKNTVFGSGQLPKFESQQFKIQDEDYHLYLIPTAEVPLNGLHMDEIIPQEELSLKYVAYTPCFRREAGAAGSQERGLIRMHQFNKVEMFCFTKPEESAQVFNQMMDSAEEILQGLELHYRNALLVTGDMSFAAARTIDIEVWLPGQNRYYEVSSVSNCTDYQSRRSNTRFRREDGKLDFVHTLNGSGLATSRLMVALLENNQREDGSVCIPNVLQRYLNGQSTLNPTI

SEQ ID NO: 5866 - DNA, 1299 bp, Corynebacterium glutamicum ATCC 13032
  CDS (1)..(1299): transl_table=11
atgtctaccgatcacggtagattgttctttatgatcgatctgaaattcctccgtgataacccggacgttgttcgtgcctcccagatcactcgcggcgaagaccccgcgcttgtggacgaactgattagtgctgatgaatctcgtcgcgaagcaatcaaggctgccgacgatttgcgcgctgagcagaaggcttttggaaagaagatcggacaggcctctccggaggaccgccctgcacttctggagggttccaacgaactcaaagccaaggtgaaggatgctgaggctgcacaggaagctgctgaggcgaaagtcaatgagctgcagatgaagctctccaacgtggtttccggcgcgcctgctggtggcgaagatgatttcgtcgtcctggagaccatcggcgagcctcgcacttttgatttcgagccaaaggatcacctggagctcggtgaatccctcggacttatcgatatgaagcgcggcaccaaggtttccggtgcacgtttctactacctcaccggtgacggcgcaatgctgcagttgggcatgctcatgttggctgctcagaaggcgcgcgaagctggatttagcatgatgatccctccagttttggtgcgccctgaaatcatggcgggcactggattcttgggtgatcactccgaggagatctactacctcgaacgcgatgacatgtacttggtgggtacctctgaggtggctcttgcgggttaccacaaggacgaaatcattgatctcaacgaaggcccagtgaagtacgccggttggagctcctgcttccgccgtgaggctggttcctacggcaaggacacccgaggcattttgcgtgtgcaccagttcgacaaggttgagatgtttgtctactgcaagcctgaagatgctgaagatgtacaccagcagctgctcggcatggaaaaggaaatgctcgcagccatcgaggttccttaccgcgtcatcgacgttgccggtggagacttgggtgcatctgctgcccgcaagttcgacaccgaggcatgggtgccaacccaggacacctaccgtgaactcacctcgacctctaactgcaccactttccaggctcgtcgcctgcagactcgttaccgcgatgaaaacggcaagccacagatcgccgcaaccctgaacggtacgttggctaccactcgttggcttgtcgcgatcctggagaacaaccagcaggccgatggctctgttgttgttcctgaggcgcttcgtccattcgtgggcaaagacgtgctcaagccagtgaaacaagccggttaa

SEQ ID NO: 5867 - protein, 432 aa, Corynebacterium glutamicum ATCC 13032
MSTDHGRLFFMIDLKFLRDNPDVVRASQITRGEDPALVDELISADESRREAIKAADDLRAEQKAFGKKIGQASPEDRPALLEGSNELKAKVKDAEAAQEAAEAKVNELQMKLSNVVSGAPAGGEDDFVVLETIGEPRTFDFEPKDHLELGESLGLIDMKRGTKVSGARFYYLTGDGAMLQLGMLMLAAQKAREAGFSMMIPPVLVRPEIMAGTGFLGDHSEEIYYLERDDMYLVGTSEVALAGYHKDEIIDLNEGPVKYAGWSSCFRREAGSYGKDTRGILRVHQFDKVEMFVYCKPEDAEDVHQQLLGMEKEMLAAIEVPYRVIDVAGGDLGASAARKFDTEAWVPTQDTYRELTSTSNCTTFQARRLQTRYRDENGKPQIAATLNGTLATTRWLVAILENNQQADGSVVVPEALRPFVGKDVLKPVKQAG

SEQ ID NO: 5868 - DNA, 1281 bp, Pseudomonas syringae pv. syringae B728a
  CDS (1)..(1281): transl_table=11
atgctcgattccaaactgttacgtactcaacttcaggacgtagcggatcgcctggcttcccgtggcttcactctggatgtggcgcgcattgaatcgctggaagcccagcgcaaggtagtgcagacccgcaccgaacagctgcaggccgagcgcaatgcccgttccaaatccattggtcaggccaagcagcgcggtgaggatattgcgccgttgatggctgatgtcgagcgcatgggcaacgagctgagcgaaggcaaggtcgagctggacggcattcaggccgaactggatgcgctggtgctgagcattccgaacctgcctcatgagtccgtgccggtcggtgccgacgaagaaggcaacgtcgaagtacgtcgctggggtacgccgacgtcattcgatttcgaggtcaaggatcacgttgcgctgggcgagaagttcggctggctggatttcgagactgccgccaagctgtccggcgcgcgctttgcgctgctgcgtggcccgatcgcacgtctgcaccgtgccctcgcacaattcatgatcaatctgcacatcaacgagcacggctacgaagagacctacacgccctatctggtgcaggctccagcgttgcagggcacaggtcagctgcccaagttcgaggaagacctgttcaagatctcccgcgaaggtgaagccgacctgtacctgattccgactgccgaagtgtcgctgaccaatatcgtgtcgggtgaaatcctcgacgccaaacagctgcctctcaagtttgtcgcccataccccttgcttccgcagtgaagcgggcgcgtccgggcgtgatacccgcggcatgatccgccagcaccagttcgacaaggtcgagatggtccagatcgttgcgcctgacgactccatggccgcgctcgagtcgctgaccggcaacgccgaacgcgtgctgcaactgcttgaactgccttatcgcacgctggcgctgtgcaccggcgacatgggtttcagcgcggtgaagacctacgacctggaagtctggattccgagccaggacaaatatcgcgaaatctcttcctgctccaactgcggtgatttccaggcgcgccgcatgcaggctcgctggcgcaacccggaaaccggcaagccggagctggtccacaccctcaacgggtcgggcctggcggtaggccgcacactggtggcggtgctggaaaactatcagcaggcggacggttcgattcgtgtgcctgaggtgctcaagccttacatgggcggccttgaggtcatcggttaa

SEQ ID NO: 5869 - protein, 426 aa, Pseudomonas syringae pv. syringae B728a
MLDSKLLRTQLQDVADRLASRGFTLDVARIESLEAQRKVVQTRTEQLQAERNARSKSIGQAKQRGEDIAPLMADVERMGNELSEGKVELDGIQAELDALVLSIPNLPHESVPVGADEEGNVEVRRWGTPTSFDFEVKDHVALGEKFGWLDFETAAKLSGARFALLRGPIARLHRALAQFMINLHINEHGYEETYTPYLVQAPALQGTGQLPKFEEDLFKISREGEADLYLIPTAEVSLTNIVSGEILDAKQLPLKFVAHTPCFRSEAGASGRDTRGMIRQHQFDKVEMVQIVAPDDSMAALESLTGNAERVLQLLELPYRTLALCTGDMGFSAVKTYDLEVWIPSQDKYREISSCSNCGDFQARRMQARWRNPETGKPELVHTLNGSGLAVGRTLVAVLENYQQADGSIRVPEVLKPYMGGLEVIG

SEQ ID NO: 5870 - DNA, 1281 bp, Pseudomonas syringae pv. phaseolicola 1448A
  CDS (1)..(1281): transl_table=11
atgctcgattccaaactgttacgtactcaacttcaggacgtagcggatcgcctggcttcccgtggctttacactggatgtggcgcgcattgaatcgctggaagcccagcgcaaggtggtgcagacccgcaccgaacagctgcaggccgagcgcaatgcacgttccaaatccatcggtcaggccaagcagcgcggcgaagacattgcgccgttgatggctgacgtcgagcgcatgggcaacgagctgagcgaaggcaaggtcgagctggacggcattcaggccgagctggatgcgctggtgctgagcattccgaacctgcctcacgaatcggtgccggtcggtgctgacgaagaaggcaacgtcgaagtgcgtcgctggggtacgccgactgccttcgatttcgaggtcaaggatcacgtcgctctgggcgagaagttcggctggctcgacttcgagaccgctgccaagctgtccggtgcgcgttttgcgttgctgcgtggcccaatcgcgcgcctgcaccgtgcgctggcgcagttcatgatcaatctgcatatcaacgaacacggctacgaagagacctacacgccttacctggtgcaggcacctgcgttgcagggtacgggccagttgcccaagttcgaggaagacctgttcaagataacccgcgaaggcgaagctgatctgtacctgattccgaccgcggaagtatcgttgaccaacatcgtgtcgggtgaaattcttgatgccaaacagctgcctctcaagtttgttgcccataccccttgcttccgcagcgaagcgggcgcgtcgggtcgtgacacgcggggcatgatccgccaacaccagttcgacaaggtcgagatggttcagattgttgcgcctgaggactccatggctgcgcttgaatcgctgaccggcaacgccgagcgcgttctgcagttgctggaactgccgtaccgtacgctggcgctgtgcaccggcgacatgggtttcagtgccgtgaagacgtacgacctggaagtgtggattccaagccaggacaagtaccgcgaaatctcttcgtgctccaactgcggtgatttccaggcgcgccgcatgcaggcccgctggcgcaatccggaaaccggcaagccggaactggtccacaccctcaatgggtcggggctggcggtgggtcgtacactggtcgcggtgctggaaaactaccagcaggcggatgggtcgattcgtgtgcccgaggtgctcaagccttacatgggcggccttgaggtcatcggttaa

SEQ ID NO: 5871 - protein, 426 aa, Pseudomonas syringae pv. phaseolicola 1448A
MLDSKLLRTQLQDVADRLASRGFTLDVARIESLEAQRKVVQTRTEQLQAERNARSKSIGQAKQRGEDIAPLMADVERMGNELSEGKVELDGIQAELDALVLSIPNLPHESVPVGADEEGNVEVRRWGTPTAFDFEVKDHVALGEKFGWLDFETAAKLSGARFALLRGPIARLHRALAQFMINLHINEHGYEETYTPYLVQAPALQGTGQLPKFEEDLFKITREGEADLYLIPTAEVSLTNIVSGEILDAKQLPLKFVAHTPCFRSEAGASGRDTRGMIRQHQFDKVEMVQIVAPEDSMAALESLTGNAERVLQLLELPYRTLALCTGDMGFSAVKTYDLEVWIPSQDKYREISSCSNCGDFQARRMQARWRNPETGKPELVHTLNGSGLAVGRTLVAVLENYQQADGSIRVPEVLKPYMGGLEVIG

SEQ ID NO: 5872 - DNA, 1272 bp, Ehrlichia canis str. Jake
  CDS (1)..(1272): transl_table=11
atgcatgatgtagattttataaaacgtaatccagaattgtttgattacgcaatgcaaaatagaaattatgaaaaggttgctcaaaaaattatagagctggatataaagaaaaaacaactattaacacagttatattctttacagaaggagcgtaatcagattactcgagaaattgaaaaattaaagaaagatggtgttaaatgtgatactcaaatagaatcttcaaagaatataacagagaaaataaatgatattaacaatatgataaaagaagattctcaattaattgaccttcttaatgtgttaccaaatgtaccagatgatatagttcctgttggaaaagatgagagtagtaatgttgagataagaaaacatgggtataaaagaaattttgattttcaagtgaaaactcattatgagttaggagaaaagttaaatttaatggattttaagcaagctgcaaaactttctggatcaagatttgtaatacttaaaaatcaacttgcacaattagatcgtgctctggctaattttatgttagacattcatactaaggaatttggctattctgagatatctcatccaatattagtgcatgaatctgcaatgtacggtgtaggacaattaccgaaatttgctgatgattcatttaaaacaacagaaaattttcggcttgtcccaacaagtgaagtagcactgactaatttagtatcaggcatgaatattaattcatgtgacttacctattagattgactgcttgttcaccatgttttagattagaagcaggaagtgctggtaaagatacaagaggtatgatgcggcaacaccaatttaataaagtagagttagttagtattgttactgaagaacagtcagcatcagaattagaaaggatggtacaagttgctgaagaagttttaaaacgtttagagttaccatacagagtaatgatgttgtgtactggagatatgggtttttcagcaagcataacatatgatattgaagtgtgggtaccaagtcaaaatcggtaccgagaaatttcaagttgttcaaattgtaaagattttcaggcacgtagaatgaatactaagtatactactataactaataatgttaaagttagtaaatttgcacatacattaaatggttctgctctagcaataggaagaactattattgcgatcttagaaaattatcaaaatatggatggttctataacaataccacttgctttaagaaagtatatgaatgatcaagaatttataaaataa

SEQ ID NO: 5873 - protein, 423 aa, Ehrlichia canis str. Jake
MHDVDFIKRNPELFDYAMQNRNYEKVAQKIIELDIKKKQLLTQLYSLQKERNQITREIEKLKKDGVKCDTQIESSKNITEKINDINNMIKEDSQLIDLLNVLPNVPDDIVPVGKDESSNVEIRKHGYKRNFDFQVKTHYELGEKLNLMDFKQAAKLSGSRFVILKNQLAQLDRALANFMLDIHTKEFGYSEISHPILVHESAMYGVGQLPKFADDSFKTTENFRLVPTSEVALTNLVSGMNINSCDLPIRLTACSPCFRLEAGSAGKDTRGMMRQHQFNKVELVSIVTEEQSASELERMVQVAEEVLKRLELPYRVMMLCTGDMGFSASITYDIEVWVPSQNRYREISSCSNCKDFQARRMNTKYTTITNNVKVSKFAHTLNGSALAIGRTIIAILENYQNMDGSITIPLALRKYMNDQEFIK

SEQ ID NO: 5874 - DNA, 1275 bp, Carboxydothermus hydrogenoformans Z-2901
  CDS (1)..(1275): transl_table=11
atgctcgatattaaaaaagtacggcaaaacccggaaatagtggtggaagcattaaaaaagcggggggcaaacttaaacctcgatgagtttttgcgcttggatgaagagcgaagaaagcttttggtggatgttgagcaaaaaaaatataagagaaacaccgtttccgaagaaattggcaggcttaaaaaacaggggctcccggcggatgatttaatcttagaaatgcgggcgttatccgatgaaattaagaaacttgatgatgaagtggcccaaattgaagaaaagttacatgccatccttcttactattcccaatatcccccacgagtcggtgccggttggtaaagacagcagcgaaaatgtagaagtgcggcggtggggtgaaccgcgaaagtttacctttaccccaaaggcccactgggaaataggggaagagttagatatcctggattttgcccgggggagtaaggtaaccggggcccgctttactttctacaaaggtttaggggcgatgttggagcgggcggttattaactttatgcttgacctccacacccgggaacacggctacgtcgaggtatttccaccgtttatcgtcaatgccgattcgatgatgggtaccgggcagctgccaaagtttgctgaagatatgtttaaacttgaagggttaaattattaccttattcccacggcggaagtaccggtaactaacctttaccgggaagaaattttagacggggataagcttcccatataccactgtgcttacagcgcatgctttagagcggaagcgggagcggccggacgggatacccggggcttaatccgccagcaccagtttaataaagtagagttagttaagtttgtcaaaccggaaaactcgtatgaggagctggaaaaactcacccgggatgcggaaagggtcctgcaacttttgggactaccttaccgggtggtggtgctttgcaccggggacctgggctttagtgctgccaaaacttacgacatagaagtatggcttcccagttacaatgattataaagaaatatcttcctgcagtaattttgaagatttccaggcccggcgggctaagatccgctacaaagagcatcccaaggccaagccggagtttgtccacaccttaaacggctcgggcctggcggtgggccggacggtggcggctattttagaaaattatcagaatgaagatggttcggttacggtaccggaagttttacggccttatatgggagtggaccggatttataaaaaataa

SEQ ID NO: 5875 - protein, 424 aa, Carboxydothermus hydrogenoformans Z-2901
MLDIKKVRQNPEIVVEALKKRGANLNLDEFLRLDEERRKLLVDVEQKKYKRNTVSEEIGRLKKQGLPADDLILEMRALSDEIKKLDDEVAQIEEKLHAILLTIPNIPHESVPVGKDSSENVEVRRWGEPRKFTFTPKAHWEIGEELDILDFARGSKVTGARFTFYKGLGAMLERAVINFMLDLHTREHGYVEVFPPFIVNADSMMGTGQLPKFAEDMFKLEGLNYYLIPTAEVPVTNLYREEILDGDKLPIYHCAYSACFRAEAGAAGRDTRGLIRQHQFNKVELVKFVKPENSYEELEKLTRDAERVLQLLGLPYRVVVLCTGDLGFSAAKTYDIEVWLPSYNDYKEISSCSNFEDFQARRAKIRYKEHPKAKPEFVHTLNGSGLAVGRTVAAILENYQNEDGSVTVPEVLRPYMGVDRIYKK

SEQ ID NO: 5876 - DNA, 1278 bp, Clostridium perfringens ATCC 13124
  CDS (1)..(1278): transl_table=11
atgttagatttaaaaaagttaagaagtaatactgaagaagtgaaaaaagctttatctaatagaggagaagactttgatgtaaatgttatagacgaagttatagctttagatgaagaaagaagaaaaattttagttgatgttgaggctttaaagaaacaaagaaacgaagtatcagctgaaattccaaagagaaaaaaagctggagaagacgttacagaagtaatggctgaaatgagagaaatagggggtaaaataaaggctgatgatgctaaagttgctgagttaaacgataaaattaactacatcatgctaagaattcctaatataccaaacccagctgttccagaaggggaaactgatgaggacaatgttgaaataaaaagatggggagaacctactaaattcaactttgaaccaaaagcacactgggatttaggaacagatttagatcttttagacttcgaaagaggtggaaaggttgctggatcaagatttacagtttacaaaggaatgggtgctagattagagagatctataataaactacttcttagataaacacacatttgaaaatggatacactgaagtattaccaccatacatggtaaatagagatagtatgactggtactggtcaacttccaaaattcgaagaagatgctttcaaagtagaaaacaatggatatttcttaataccaacagctgaggttcctgtaactaatatgtacagaaatgaaactttagagggagataaacttccaataaaacatgctgcatatagtgcttgtttcagagcagaagctggttcagcaggaagagatacaagagggcttataagacaacaccaatttaataaagttgagttagttaagttctgtaaacctgagcaaagctatgaagaattagataaattagttcaagatgctgaatctgtattacaaggtttaggattaccatatagaatagttagaatatgtaaaggtgatttaggattcactgctgcattaaaatatgatatagaagtttggatgccaagctacaatagatatgttgaaatttcaagttgttcaaactttgaagatttccaagctagaagagctaacattaaatataaaaattctccaaaggaaaaaccacaatttgttcatacattaaatggatcaggggttgctattggaagaactgtagctgctatattagaaaactatcaacaagaagatggatcagtagttataccagaagctttaaaagaatatatgagatgtgatttactaaaataa

SEQ ID NO: 5877 - protein, 425 aa, Clostridium perfringens ATCC 13124
MLDLKKLRSNTEEVKKALSNRGEDFDVNVIDEVIALDEERRKILVDVEALKKQRNEVSAEIPKRKKAGEDVTEVMAEMREIGGKIKADDAKVAELNDKINYIMLRIPNIPNPAVPEGETDEDNVEIKRWGEPTKFNFEPKAHWDLGTDLDLLDFERGGKVAGSRFTVYKGMGARLERSIINYFLDKHTFENGYTEVLPPYMVNRDSMTGTGQLPKFEEDAFKVENNGYFLIPTAEVPVTNMYRNETLEGDKLPIKHAAYSACFRAEAGSAGRDTRGLIRQHQFNKVELVKFCKPEQSYEELDKLVQDAESVLQGLGLPYRIVRICKGDLGFTAALKYDIEVWMPSYNRYVEISSCSNFEDFQARRANIKYKNSPKEKPQFVHTLNGSGVAIGRTVAAILENYQQEDGSVVIPEALKEYMRCDLLK

SEQ ID NO: 5878 - DNA, 1308 bp, Leuconostoc mesenteroides subsp. mesenteroides ATCC 8293
  CDS (1)..(1308): transl_table=11
atgttagatatacgttatatgcgtaaaaacagcgcagaagtcaagcaacgtttagaataccgtggcgttaacccagaaacaattgacgagttattggaacttgaccaaaaacgacgggatttgatccaaaaagttgagtctcttaaagcacaacgtaatgatgtatcagataaaattgcttttgctaagcgtcaaaaagaagatgctagtgaagcaattttgcaaatgaagcaagtcggggcagatattaagagtcttgataatgagcaaacattgctggatgaacaggttcgagaaatcgctgctcatttgccaaacatggctgcttttgatgtaccagttgggccagatgaatctgctaacgtagaacaacgaaagtgggccccagaggaatatggatcacgtccgcatgccttagaagaagcatcgtgggttaaagctcattatgaaattggagagaatctggggatacttgactttgagagaggcgcaaaagtttctggtgcccgcttcttatactacgttggtgatggggcaaggcttgaacgtgctgtctataactttatgttagatgagcataggcaagaaggttacactgaaatgatcacgccgattgtggtgaatgattcagcaatgtttggaacaggacaatatccaaagtttcaagatgatgcttatcgtgtagaaggattgaatcaaacatatattccaacagcggaagtccctttgactaactattattcaggtgaagaattgccaagtgaggacttaccaatcaagttcactgcgctgtcaccttctttccgtaaagaagcgggatcggcaggtaaagatacgcgtggattaatccgtttgcatcaatttaataaggttgaaatggttaaatttaccaaaccagaagattcttacgaagaattagaaaagatgacactagatgcggaaaacattttacaaaaattgaatttgccttatcatgtgattgtattgtcaacaggcgacatgggattctcagcagcaaaaacatatgatattgaggtctggatgccacagcagaacgtttatcgagaaatttcttcagtatcaaacactgaagatttccaagcccgtcgaatgcacattacctatcgtgatgcagataataagttacagcttgtgcatacattaaatggttctggtctagcagtagggcgaacagtagcggctattttagaaaactatcaaaatgaggatggttcagtaactattccagaagttttgcgaccttatttagccggacaagagaagcttgaaccaacaacacaccattaa

SEQ ID NO: 5879 - protein, 435 aa, Leuconostoc mesenteroides subsp. mesenteroides ATCC 8293
MLDIRYMRKNSAEVKQRLEYRGVNPETIDELLELDQKRRDLIQKVESLKAQRNDVSDKIAFAKRQKEDASEAILQMKQVGADIKSLDNEQTLLDEQVREIAAHLPNMAAFDVPVGPDESANVEQRKWAPEEYGSRPHALEEASWVKAHYEIGENLGILDFERGAKVSGARFLYYVGDGARLERAVYNFMLDEHRQEGYTEMITPIVVNDSAMFGTGQYPKFQDDAYRVEGLNQTYIPTAEVPLTNYYSGEELPSEDLPIKFTALSPSFRKEAGSAGKDTRGLIRLHQFNKVEMVKFTKPEDSYEELEKMTLDAENILQKLNLPYHVIVLSTGDMGFSAAKTYDIEVWMPQQNVYREISSVSNTEDFQARRMHITYRDADNKLQLVHTLNGSGLAVGRTVAAILENYQNEDGSVTIPEVLRPYLAGQEKLEPTTHH

SEQ ID NO: 5880 - DNA, 1293 bp, Magnetococcus sp. MC-1
  CDS (1)..(1293): transl_table=11
gtgctggatatcaaacgcattcgtactgaaaccgatgctgttgaggcagcattgcaacgtcgtggtggtgcggtggacctaaacgcctttcgtgcgttggaggggcgtaagcgcaccattcaaacagaggtggagcagttgcagtcccagcgcaacacgctgtctaaggagattggtcagcgcaaggcggccagagaggatgccagcgatctgtttgagcagatgcagcgtgtggggccgcgtctcaaagagctagagagcgtgttggccgagttggaagggcaggtggaggccattattgtggcgctgcccaacacgccccacagctcggtgcccgatggcctgggtgagcaggataatgtcgaggtacggcgttggtcccccagcgggggtgaggggggtgatccccaggtgctgggctttgaggcgaagaatcactgggagattggtgaggcgctggggattttggattttgaggctggcgcggcggtagcgggttcgcgttttacggtctttaagggggtgggggcacggctttcgcgggccttagccaactatatgttggatttgcacaccggttcccatggttatcaagagattttgccgccggttttgaccaatgcggagtgtctgtttggtacggggcagttgcccaaatttgaagaggatctgtttcgcacccgggatgatgcctattatatgattcccactgccgaggtgccggttacaaacctggtgcgggagcagattttggaagatagccaactgcccatgcgcatgacggcgtggaccaactgttttcgtcgcgaggcgggttcggcgggcaaggatacgcggggtttgatccggcaacaccagtttgacaaggtagagttggtgcagattcgccgcccagaggagagctatgcggcgttggaggagttgaccggccacgcggagcaggtattaaaggggctgggtttaccgtttcgcacggtggtgttgtgtagtggggatatggggtttggtgccagcaagacctatgatattgaggtgtggctgccggggcagggtaaatatcgtgagatctcatcctgttcgaatacggaggattttcaagcgcggcgcatgaaagcgcgttttcggcgcgaggccaagggcaagccggagttggtgcacaccttaaatggttcgggtgtggcggtgggtcgggcgttggtagcggttttggagaactaccaacaggccgatggccgtgtggtggtaccagaggtgttgcgtccttatatgggtgggctagagatcattggctag

SEQ ID NO: 5881 - protein, 430 aa, Magnetococcus sp. MC-1
MLDIKRIRTETDAVEAALQRRGGAVDLNAFRALEGRKRTIQTEVEQLQSQRNTLSKEIGQRKAAREDASDLFEQMQRVGPRLKELESVLAELEGQVEAIIVALPNTPHSSVPDGLGEQDNVEVRRWSPSGGEGGDPQVLGFEAKNHWEIGEALGILDFEAGAAVAGSRFTVFKGVGARLSRALANYMLDLHTGSHGYQEILPPVLTNAECLFGTGQLPKFEEDLFRTRDDAYYMIPTAEVPVTNLVREQILEDSQLPMRMTAWTNCFRREAGSAGKDTRGLIRQHQFDKVELVQIRRPEESYAALEELTGHAEQVLKGLGLPFRTVVLCSGDMGFGASKTYDIEVWLPGQGKYREISSCSNTEDFQARRMKARFRREAKGKPELVHTLNGSGVAVGRALVAVLENYQQADGRVVVPEVLRPYMGGLEIIG

SEQ ID NO: 5882 - DNA, 1278 bp, Exiguobacterium sibiricum 255-15
  CDS (1)..(1278): transl_table=11
atgattgatattaaacgactgcgtcaggattttgacgcgattcaagaaaaactggctcaccggggagaagatttaacggatatgaaccggttcatcgcccttgatgaaaaacgccgggaattgattgccaaaacagaagtcctgaaagcggaacgaaatgaagcgacaaaaaaaatcgcggaactaaaacgcaacaaagaaaatgcggatgaagcaattgctgcgatgcgccaagtcggggatgaagtcaaagccctcgatgaagaactgcgtgaagtcgaagcgacgctgaatctgttgttactcggtattccgaacattccccatgacagcgttccgatcggttctacggaagatgataatgtcgtcatccgcgaagtcggtgacaagccggcgtttgattttgaagctgtaccccactgggatttgatggaacagttgaaaatcgttgacgtcgaacgggccggaaaagtaacgggaagccgtttcgtcttttaccgcggtgccggtgcacgtcttgagcgggcattgatcaacttcatgatggatttacaccaggacaaaaacggatatacggaaatcctgccgccgctcatggtcaaccgggattctatgacaggaacaggacagcttccgaaattcgaagaagatgcgttcaaagtcgaagatacgaactacttccttgttccgacagcagaagtaccggtgacgaacatgcaccgggatgaaattttgtcagcggatcaattgccgatcggttatgccgcctacagccaatgtttccggtctgaagcaggttctgccggccgtgatacgcgcggtttaatccgtcagcaccaattcaacaaagtcgaactcgtccgtttcgtcaaaccggaagaatcatacgaacagcttgaattgctgacagggcaagcggaggaagttttgaaattacttaaacttccgtatcaggtcctcagcatgtgtacagcggatcttggtttcacagctgcaaagaaatatgacatcgaggtctggatgccgagccaaggggtgtaccgtgagatttcttcttgctcaaactttgaagatttccaagcacgccgggcacaaatccgtttccgtcgggaagcgaatgctaaaccggaattcgttcatacattaaacggatcagcacttgcagtcggtcggacagtcgctgccattcttgagaactaccagcaagcagatggatcagttgttattccagaagtacttcgtccttatatgggcggtcttgaagtcattcaaggataa

SEQ ID NO: 5883 - protein, 425 aa, Exiguobacterium sibiricum 255-15
MIDIKRLRQDFDAIQEKLAHRGEDLTDMNRFIALDEKRRELIAKTEVLKAERNEATKKIAELKRNKENADEAIAAMRQVGDEVKALDEELREVEATLNLLLLGIPNIPHDSVPIGSTEDDNVVIREVGDKPAFDFEAVPHWDLMEQLKIVDVERAGKVTGSRFVFYRGAGARLERALINFMMDLHQDKNGYTEILPPLMVNRDSMTGTGQLPKFEEDAFKVEDTNYFLVPTAEVPVTNMHRDEILSADQLPIGYAAYSQCFRSEAGSAGRDTRGLIRQHQFNKVELVRFVKPEESYEQLELLTGQAEEVLKLLKLPYQVLSMCTADLGFTAAKKYDIEVWMPSQGVYREISSCSNFEDFQARRAQIRFRREANAKPEFVHTLNGSALAVGRTVAAILENYQQADGSVVIPEVLRPYMGGLEVIQG

SEQ ID NO: 5884 - DNA, 1296 bp, Prosthecochloris aestuarii DSM 271
  CDS (1)..(1296): transl_table=11
atgcttgacatcaatttcatccgtcaaaaccccgaaaaggtaagccgcatgctggaacagcgccagcagcgggaagatattgccaaactcaatcagcttctcgacttcgatgtccgcagaagaacaatggttcagagaaccgatgaactcaaagccctccgcaataaagtctctaaagatattgccgtcattaagcgctccggacagggttcggccgacgatcttatcgtgcagatgaaagctgtcgctgatgaaatttcaggcatggacgacacccttaaatcactcgaagcccaaatagaggagcttcttctttcactgcctaacaagctgcatgaggatgttcctgaaggccgttgtgctgatgacaaccacatttatcgcgaaaagctctctttcgaccataagctcgacttccctcttgacaatcatcttgacctcggcaaacgccttgggatactcgattttgaacgaggagcaaaaattaccggcgcgggctttccggtctataccgcaaaaggggctcgactggaaagagcactgattaacttcatgcttgatcagcatacctccgtaaacggatacaccgaagtcctcccgcctctgttcgttaaccgtgaatcgcttcgtggaaccggacagtggccgaaatttgccgaccaggtctattacatgaatgaggacaatctgtatgctattcctacagccgaggtaccgctcaccaacatgcaccgcgatgagatccttgacgcatcagatatcccgcttgcctatgcggcctataccccctgtttccgaagagaagcaggaagttatggaaaagacacaagaggatttctcagagtgcatcagttcaacaaagtagaactggttcgatacgccaccccgacaacatcatatgacgcccttcaggaaattctctcccatgcagaaggaatccttcaggcgctgaaaatcccctatcgggttcttcttctctgcagcggcgatatcagtgccaatgcaaccaaatgctatgacattgaagtgtgggcgccgggtgaaggaaaatttctcgaagcatcgagctgctctaactttgaagactatcaggcaagaagggcaaatatccgctacaggccggaagatgggggcaaaccgacctatgttcacacgctcaacggatcagggcttgcaacatcgagactcatggttgcgctgctggaaaactaccagacgcctgaaggcagtatcagaatcccggatgtgctccagccatacaccggtttcagcagcatcgatcaggcagctgaatga

SEQ ID NO: 5885 - protein, 431 aa, Prosthecochloris aestuarii DSM 271
MLDINFIRQNPEKVSRMLEQRQQREDIAKLNQLLDFDVRRRTMVQRTDELKALRNKVSKDIAVIKRSGQGSADDLIVQMKAVADEISGMDDTLKSLEAQIEELLLSLPNKLHEDVPEGRCADDNHIYREKLSFDHKLDFPLDNHLDLGKRLGILDFERGAKITGAGFPVYTAKGARLERALINFMLDQHTSVNGYTEVLPPLFVNRESLRGTGQWPKFADQVYYMNEDNLYAIPTAEVPLTNMHRDEILDASDIPLAYAAYTPCFRREAGSYGKDTRGFLRVHQFNKVELVRYATPTTSYDALQEILSHAEGILQALKIPYRVLLLCSGDISANATKCYDIEVWAPGEGKFLEASSCSNFEDYQARRANIRYRPEDGGKPTYVHTLNGSGLATSRLMVALLENYQTPEGSIRIPDVLQPYTGFSSIDQAAE

SEQ ID NO: 5886 - DNA, 1290 bp, marine gamma proteobacterium HTCC2143
  CDS (1)..(1290): transl_table=11
atgctggatatcaaactgatccgacagaacccggatttggttgcggagcaactgcagaagaaaaaattcacgctcaacaccgcggaatttctaacgcttgatgcagctcgcaaacaagccgaagctgatagccagagtttgcaggccgagcgaaaacaggcatcaaaaaaaattggtgaattggtgaagcagggcaccccggttgaggaagcgaaaaagaccgtcaacgaaacattagcgaaaatcgaaacacagctggaagcacttaagcaaaaagcgcaacaagccagcgatgcgcttcataacttaatgatggaaatccccaatatccctgacgatgacgttcctgcgggcgatgacgaaaacgcaaacaaagaaatactatcgtggggaaaacccaaaaaaatcgattttgaagtcagagatcacgtcgatattgggaccgagttgggcgggctcgattttgacttagccagcaaactaactggatctaggtttgcagttatgagcggtggaatggccagacttcatcgtgcactgacccagtttatgctcaatacgcacattgtcgatcatggctacagtgaaatccacgttccatttatagtgaatgcagaatctcttcgcggaacagggcagttacctaagttcgcagatgatttgtttaaattggaaggggagcaaaactattacctgatacccactgctgaagttccagtaacaaacattgccagagaccgtatctttgaagccaaagaatttgccgatggattgcattttgtgtgccacacaccttgctttagaagcgaggctggcagttatgggagagatacccgcggtatgattcgacagcatcagttcgaaaaagttgaattggtgaaaatggttcgccccgaccaatcgagcgacgagctagagaaattgactctccatgctgaggcaattctgcagcagttggagttgccctatcgcaaagttatcctatgtggcggagatcttggattttctgcccttaaaacttacgacttggaagtctggctgccgggtcaacaaaaataccgtgaaatttcctcatgtagcaatatgggcgacttccaagcacgaagaatgatggctcggtggcgcaatcctgaaaccaacaagccagagttattgcataccatcaatggctctggtttagccgtaggtaggacccttgttgccgtattagagaattaccaaacagctgacggccgtgttgaagtacccgaggtattaaagccctacatgggtggaatttcagtgttgtaa

SEQ ID NO: 5887 - protein, 429 aa, marine gamma proteobacterium HTCC2143
MLDIKLIRQNPDLVAEQLQKKKFTLNTAEFLTLDAARKQAEADSQSLQAERKQASKKIGELVKQGTPVEEAKKTVNETLAKIETQLEALKQKAQQASDALHNLMMEIPNIPDDDVPAGDDENANKEILSWGKPKKIDFEVRDHVDIGTELGGLDFDLASKLTGSRFAVMSGGMARLHRALTQFMLNTHIVDHGYSEIHVPFIVNAESLRGTGQLPKFADDLFKLEGEQNYYLIPTAEVPVTNIARDRIFEAKEFADGLHFVCHTPCFRSEAGSYGRDTRGMIRQHQFEKVELVKMVRPDQSSDELEKLTLHAEAILQQLELPYRKVILCGGDLGFSALKTYDLEVWLPGQQKYREISSCSNMGDFQARRMMARWRNPETNKPELLHTINGSGLAVGRTLVAVLENYQTADGRVEVPEVLKPYMGGISVL

SEQ ID NO: 5888 - DNA, 1281 bp, Pseudomonas putida GB-1
  CDS (1)..(1281): transl_table=11
atgctcgattccaaactgttacgcggccaacttcaggaagtggcggatcgcctggcctcccgtggcttcagcctggatgtcgcgcgcatcgaatcactggaagaacgccgcaaggcggtgcagacccgcaccgagcagctgcaggccgagcgtaacgcccgctccaagtccatcggtcaggccaaggccaagggcgaagacatcgcgccgctgatggccgacgtcgagcgcatggccaatgaactggccgccggcaagcttgagctggacggtatccaggccgagctggacggcattctgctgaccatccccaacctgccggacgccagcgtaccggtcggtgccagcgaagacgacaacgtcgaagtacgccgttggggcacgccgaaggcgttcgacttcgaaatcaaggaccacgtcgcccttggtgaagtcagcggtggcctggacttcgaagcggctgccaagctgtccggcgcccgtttcgctgtgctgcgtggcccgatcgcccgcctgcaccgcgccctggcgcagttcatgatcaacctgcacaccggcgagcacggctacgaggaacactacaccccttacctggtgcaggctccggccctacagggcaccggccagttgcccaagttcgaggaagacctgttcaagatcacccgcgaaggcgaggctgacttctacctgatcccgaccgccgaagtgtcgctgaccaacctggtagcgggtgaaatcctcgacgccaagcaactgccgctgaaactggttgcccacaccccatgcttccgcagcgaagccggtgcttccggccgcgacacccgcggcatgatccgccagcaccagttcgacaaggtcgagatggtccaggtggtagagccggccaaatcgatggaagccttggaaggcctgactgccaacgctgagcgcgtgctgcagttgctggagctgccgtaccgcgtgctggccctgtgcaccggcgacatgggctttggtgcagtgaaaacctacgacctggaagtgtgggtgccgagccaggacaagtaccgcgaaatcagctcgtgctccaactgcggcgacttccaggcacgccgcatgcaggcccgctggcgtaacccggaaaccggcaagccagaactggtgcacaccctcaacggctctggcctggccgtaggccgtactttggttgccgtactggaaaactaccagcaggccgacggctcgatcctggtgccggaagtgctgaagccgtacatgggcggcgtcgaggtcatccgctaa

SEQ ID NO: 5889 - protein, 426 aa, Pseudomonas putida GB-1
MLDSKLLRGQLQEVADRLASRGFSLDVARIESLEERRKAVQTRTEQLQAERNARSKSIGQAKAKGEDIAPLMADVERMANELAAGKLELDGIQAELDGILLTIPNLPDASVPVGASEDDNVEVRRWGTPKAFDFEIKDHVALGEVSGGLDFEAAAKLSGARFAVLRGPIARLHRALAQFMINLHTGEHGYEEHYTPYLVQAPALQGTGQLPKFEEDLFKITREGEADFYLIPTAEVSLTNLVAGEILDAKQLPLKLVAHTPCFRSEAGASGRDTRGMIRQHQFDKVEMVQVVEPAKSMEALEGLTANAERVLQLLELPYRVLALCTGDMGFGAVKTYDLEVWVPSQDKYREISSCSNCGDFQARRMQARWRNPETGKPELVHTLNGSGLAVGRTLVAVLENYQQADGSILVPEVLKPYMGGVEVIR

SEQ ID NO: 5890 - DNA, 1907 bp, Zea mays
  CDS (49)..(1422)
ttgctcgccttcaccccatcgccgccgccgccgccgtcgcaagcgacgatgctcgacatcaacttgttccgcaccgacaagggcggcaacccagaccttattcgcgagtcccagcgcagtcggttcgcctccgtcgagctcgtcgacgaggtcatcgccctcgacaaggcatggcgcgaaaggcagttcgagctggacaagatccggcaagctcaacgtaccagcaagaagatcggcaagctcaaagccagcaagcaagaagaggaagcgaagaagctcatggagagcacagacgaaattaagaaaaggttggcagccaaagaagttgaggtgcaggaggccaagagcaccctcgacgccaaggtcacgacgattggcaacatcgtgcatgagtccgtgccagtcagcgacgacgaggcaaacaataaaattgtacggacatttggagagaagagagtagaggataatttgaagaaccacgtggacctttgcaggatgcttgatattgtcgcattggaaaagggtgctgatgtggctggtggtaggggtttctatttaaaggacgaaggtgtcctccttaacctggcattgataaattttgggctagcttttctgagaaaacggggatttaaaccaatgcaaactccttttttcatgagaaaggaaactatggcaaaatgtgcccagttggcccagtttgatgaggagctttacaaggttacaggtgatggcgaggacaaatatctcatagctacatcagagcagcctttatgtgcttatcacttaggtgatcgaatctaccctgctgaacttccaatcaaatatgctgggtactccacatgcttccggaaggaagctggttctcatggaagggacacagctggtatcttcagagtccaccagtttgaaaaaattgaacaattctgcattacaagcccaaatggcaatgattcctgggagatccatgaagagatgctaaaaaattcagaagatttctacaaggagattgggctaccataccaagttgtttccattgtctccggcgctcttaacgatgctgctgctaagaaatacgatttggaagcatggttccctgcatcaaagaccttccgagagttagtatcctgttcaaactgcactgacttcagtcaaaggagacttggaattgggtatggccagaaaaagaatgatgagcagtccaagcagtttgttcatatgctgaactctaccttgactgccactgagaggaccctctgttgtattctggagaatttccaaaaggaggacggacgtcgagtcaaaggcactctgcaaccttatatgggtggaatagagtttcttcctttcaagcaacctttggatgtcaaacaagcttctgactccaaatcaaacaagtccaaatcaaagggaaatgctgcttgagttggacgaggaacagactggaatgcaaatgcacgtgcaggttttggtttttacccgttttggtttcctggttgccgcattctctgacgacccacttggcacacttgtattgcaatagcatttcttgaaatccggaatgcttggccaccaccgccagctcaaccgggactgtgtttatcgcgttgccacagaacgcctgcttgtctgtctccgaaaccaccaggtgttctttgtagcaagcacattagaaacggcttgctggcggattggttttttatccttttttttttccaatgacggtggattggtgtacttctgatcggtaatgaaaaaaaaggcatcttgtgttagtggaatctagtgctgttgtggctggaacctggaaatcctcagtcctcacaagcatgttcttggattctcgcatcgcatgcattgtatggaaacaccggtacctacagcgaaaaaaaaaaaaaaaaaaaaaaaaa

SEQ ID NO: 5891 - protein, 457 aa, Zea mays
MLDINLFRTDKGGNPDLIRESQRSRFASVELVDEVIALDKAWRERQFELDKIRQAQRTSKKIGKLKASKQEEEAKKLMESTDEIKKRLAAKEVEVQEAKSTLDAKVTTIGNIVHESVPVSDDEANNKIVRTFGEKRVEDNLKNHVDLCRMLDIVALEKGADVAGGRGFYLKDEGVLLNLALINFGLAFLRKRGFKPMQTPFFMRKETMAKCAQLAQFDEELYKVTGDGEDKYLIATSEQPLCAYHLGDRIYPAELPIKYAGYSTCFRKEAGSHGRDTAGIFRVHQFEKIEQFCITSPNGNDSWEIHEEMLKNSEDFYKEIGLPYQVVSIVSGALNDAAAKKYDLEAWFPASKTFRELVSCSNCTDFSQRRLGIGYGQKKNDEQSKQFVHMLNSTLTATERTLCCILENFQKEDGRRVKGTLQPYMGGIEFLPFKQPLDVKQASDSKSNKSKSKGNAA

SEQ ID NO: 5892 - DNA, 1548 bp, Aspergillus oryzae
  CDS (1)..(1548)
atggcgtctacaaggacaccatacgtctgcctcaattgcaggctgacaaggccattgacgcgacgcgccttttccgcctccacgcaccgcgccgaagctctccgtcctgcgactgcgccaaagccaaccccagacgtcaagcacatccgccagaacgcggagctctactccaaaaacagcgtcgaccgcaattacccaacccacgccgactacccattccagatccaaaacctgtcagaagaagcccgccgcctcgaccaagatctcaagaccccccgctcccgcatcaaacagctcgaaaaagctatcggcaagctcgcagcttccgcccgccaggaaggaggcaatggcgaaaacaccgcatcccaagaagagctcacggctctgcgattagaggcccaaaagctcaaggatgattcacaagagatgaccacgcgcaagaccgcctgcacggaagaaatcaaccgcctcgcactatcccttcctaacctttcctcctccgagacaccggtcggagacgatcccagactggtcgaatacctcaatttcgacccccagtcgccgcccgaatggatcgccaatccggaccccagtcgctcgcatgtcgcgatcggcacatccctcggcctcatcgatttcactagctccgcaactaccacgggctggggatggtacttcctcaccaacgagggcgccctcctggagcaagcactgattcagtacgcattgagcgtggctcgaaaacgcggctggaagcccgtgtcccctccgtcgatcgtctactcctacatcgccgaagcgtgcggtttccagccccgcgaccagcacaacgagcagcagatctgggccatcgagcagagcgaaaaggacaagagcaaaccgcagcgatctctggccggaaccgccgagatccccctcgcggcgatgtacgccggccgcgacatcgacgcagcgaatctccccgtcaaactggtcggacctagccggtgctatcgtgccgaggccgggtcccgcggtgtcgatacgaagggtttatacagagtccatgagttcacaaaggtggagatgttcgcgtgggccgataatttcccagaagcagctgggaagggattaccgacgtcagacgatctcttcaacgagctcctctccatccagaccgagattctgacctccctgaaccttccctgccgggtgctggaaatgccgaccacggatctgggcgccagtgcaagccgtaaacgtgatatcgaagccctcttcccctcccgtctccgtgccggtgcggatctcgagtcggcatggggcgaggtgacctccgcttctatctgtacggactatcaaagccgtcggttgggaacccgggtgcgcggcggagcaactaaggattctcggttcccccatacggtcaatggtactgccatggctgtgcccagggtgttggccgccattctggagaacggatgggatgagaagcggaaggttgtggttgtaccggaggtgctgaggaactggatgggtggcttagaggtgattggggaatcttcatga

SEQ ID NO: 5893 - protein, 515 aa, Aspergillus oryzae
MASTRTPYVCLNCRLTRPLTRRAFSASTHRAEALRPATAPKPTPDVKHIRQNAELYSKNSVDRNYPTHADYPFQIQNLSEEARRLDQDLKTPRSRIKQLEKAIGKLAASARQEGGNGENTASQEELTALRLEAQKLKDDSQEMTTRKTACTEEINRLALSLPNLSSSETPVGDDPRLVEYLNFDPQSPPEWIANPDPSRSHVAIGTSLGLIDFTSSATTTGWGWYFLTNEGALLEQALIQYALSVARKRGWKPVSPPSIVYSYIAEACGFQPRDQHNEQQIWAIEQSEKDKSKPQRSLAGTAEIPLAAMYAGRDIDAANLPVKLVGPSRCYRAEAGSRGVDTKGLYRVHEFTKVEMFAWADNFPEAAGKGLPTSDDLFNELLSIQTEILTSLNLPCRVLEMPTTDLGASASRKRDIEALFPSRLRAGADLESAWGEVTSASICTDYQSRRLGTRVRGGATKDSRFPHTVNGTAMAVPRVLAAILENGWDEKRKVVVVPEVLRNWMGGLEVIGESS

SEQ ID NO: 5894 - DNA, 1278 bp, Bacillus amyloliquefaciens
  CDS (1)..(1278): transl_table=11
atgattgatacgaaggtgctgagagccaattttcaagaggtgaaagcgaagctcattccaaaaggcgaagacttatctgactttgacaagtttgaagagctggacgaaaagagaagagagcttatcggtaaagtagaagaactgaagggaaaacgcaatgaagtatctcagcaggtcgccgttttgaaacgggagaaaaaagacgctgatcatattattaaagagatgcgcgaagtgggcgaagaaattaagaagcttgatgaagagcttcgtactgtcgaaacgacgctcgaaaccatccttctgtctattccgaacatcccgcacgattcagtgcccgttggggaaacggaagatgataacattgaaatccgcaagtggggagaggcgccggcattttcatatgagccgaaaccgcattgggatatcgcagaccatttaaacattcttgatttcgaacgcgcttcaaaagtaacaggcagccggtttgtgttttataaaggattaggcgcccgcctcgaacgcgcgctctacaactttatgctggatcttcacgttgatgaatatgattacacggaagtcattcctccttatatggtaaaccgtacgagcatgacaggtacgggacagcttcctaaatttgaagaggatgcttttaaaatcagagaagaagattatttcttaattccgacggcggaagtgccgattacaaatatgcaccgcgatgaaatcttatccggtgagaacctgccgatcaattatgccgcattcagcgcttgcttccgttcagaagcgggatctgccggccgtgatacacgcggtttgatccgccagcatcagttcaacaaggttgagcttgtgaaattcgtgaagccggaagattcttatgaagagcttgaaaaactgacgaatcaagctgagcgggtgcttcagctgcttgaactgccgtatcgtgtcatgagcatgtgtaccggtgatctcggctttacagccgcgaaaaagtacgatattgaggtatggattccaagccaagacacataccgtgaaatttcttcttgcagtaactttgaggccttccaggcgagacgcgcaaacattcgattcagacgcgaagcgaaaggcaagccggagcatgtgcatacattaaacggttcaggtcttgcagtcggcagaacagtagctgccatcttagaaaactatcagcaggaagacggaagtgtcatcattccgaaagtgcttcgtccttatatgggaaataaagaagtcatcaaaccgtaa

SEQ ID NO: 5895 - protein, 425 aa, Bacillus amyloliquefaciens
MIDTKVLRANFQEVKAKLIPKGEDLSDFDKFEELDEKRRELIGKVEELKGKRNEVSQQVAVLKREKKDADHIIKEMREVGEEIKKLDEELRTVETTLETILLSIPNIPHDSVPVGETEDDNIEIRKWGEAPAFSYEPKPHWDIADHLNILDFERASKVTGSRFVFYKGLGARLERALYNFMLDLHVDEYDYTEVIPPYMVNRTSMTGTGQLPKFEEDAFKIREEDYFLIPTAEVPITNMHRDEILSGENLPINYAAFSACFRSEAGSAGRDTRGLIRQHQFNKVELVKFVKPEDSYEELEKLTNQAERVLQLLELPYRVMSMCTGDLGFTAAKKYDIEVWIPSQDTYREISSCSNFEAFQARRANIRFRREAKGKPEHVHTLNGSGLAVGRTVAAILENYQQEDGSVIIPKVLRPYMGNKEVIKP

SEQ ID NO: 5896 - DNA, 1635 bp, Neurospora crassa
  CDS (1)..(1635)
atgcggccctacacctgtcttcaatgcctcacccggacacgccccgtcttccgtcgacctactactactacctctatacaaacaccgcgcatcgcttccctccataacagctcccgcttccttcaacagcaacaacaacaacaatcctcagactccccagctgctgcttctcgaccaagcatagcccccaagcccgtcgtcgatatcaagcacatccgccaaaacccagacctctacgcccaaaactgcatcgaccgcaactatcaccaacaagcctcctacccacaacgcatcaacgacctccacgcccaatggcaagcgaagcagcgtgaggctcgctctctgcgtgaacgctccaatatcctgcgccgccagctcaccgaccccggttccatccgcgacgaaaatgccgacaccatcgccgcgggcaccaagttcctgacgagggacgaactcattgccgaagcccgcaagctcaagtccctcctctcgaccatcgaagccgaagaaacacgtattctatccgagatcgagtccctcgccctggccatccccaacctcacctcggaagaatccccccggggccccgaacccaaacttctgtccttgatcaacgaacaccccgaacccgtcccttcggcctccgaccgcgtctggcgttcccacgttcacattggcaacgagctgggtcttctcgacttcgcctccgccggtaccacctccggctggggttggtacttcctccttgacgaagctgcccagctcgagcaagcactcatcgcctacgccctcgacctcgccgtgcgctccggctggcgccaagtcagcccgccctccatggtctactcgcacatcgcctcggcctgcggtttccagccgcgcgaccagaacggcgaaacgcagatctatgccctcgcccaatctgccgacgacgccgcccgcggcaagcccgagctctccatggccggcacctcagagatcccgctcgcgggcatgcacgcctccaaaatgcttctctgccccggcgacatctccgagttttctcccctgaaatacgtcgccgtctcgcgctgctaccgtgccgaagccggctcccgcggcctcgagaccaagggcttgtatcgcgtgcacgagttcaccaaagtcgagctctttgggtggacgtacccctctctcgactcggcgaccgacgtgttcaacgagatcgtcgacttgcaaaccgacctcttgtcttccctcggtctgcactgccgcgtgctagagatgcccacgcacgacctcggcgcttcggccacgcgcaagattgacattgaggcctttttccccagcaggagggaacgcaacgaagggtggggcgaggtcacgagcgcgagcatatgcactgattatcaggctagaaggctggcgacgaggctaaagggcgaggatggcaagatgattgagggcggttatccgtttacggtgaacgggacggccatggcggtgccgagagtgctggccgcgttgttggagaatggctgggacgaggagactggcacggtggtcatccccgaggtgttgagggggtggatgggtgggaaggagagaattgggcccaagccgccgactaagaaggggttaggagttggtgtttag

SEQ ID NO: 5897 - protein, 544 aa, Neurospora crassa
MRPYTCLQCLTRTRPVFRRPTTTTSIQTPRIASLHNSSRFLQQQQQQQSSDSPAAASRPSIAPKPVVDIKHIRQNPDLYAQNCIDRNYHQQASYPQRINDLHAQWQAKQREARSLRERSNILRRQLTDPGSIRDENADTIAAGTKFLTRDELIAEARKLKSLLSTIEAEETRILSEIESLALAIPNLTSEESPRGPEPKLLSLINEHPEPVPSASDRVWRSHVHIGNELGLLDFASAGTTSGWGWYFLLDEAAQLEQALIAYALDLAVRSGWRQVSPPSMVYSHIASACGFQPRDQNGETQIYALAQSADDAARGKPELSMAGTSEIPLAGMHASKMLLCPGDISEFSPLKYVAVSRCYRAEAGSRGLETKGLYRVHEFTKVELFGWTYPSLDSATDVFNEIVDLQTDLLSSLGLHCRVLEMPTHDLGASATRKIDIEAFFPSRRERNEGWGEVTSASICTDYQARRLATRLKGEDGKMIEGGYPFTVNGTAMAVPRVLAALLENGWDEETGTVVIPEVLRGWMGGKERIGPKPPTKKGLGVGV

SEQ ID NO: 5898 - DNA, 1712 bp, Arabidopsis thaliana
  CDS (19)..(1557)
agcagagaagctccggcgatgggtttacacaaattgagactcgcagcggcggttcctgtaaccttctcctctcgcctcttcctcaagccatttaccaatactcttaccctaggtttgttttcccgccatcttcaaccccgtaataagcctctccttgtcagagctttctccgcttccgccgccgtacaagatattccggccacacagacctccgattcctctgcaaggcctctgtggaaggcagcgattgatttcaaatggataagggacaataaggaagcagtcgaaatcaacatcaggaacaggaattcgaatgctaatttggaagctgtgctccagctttatgagaacatggtcaatctccaaaaggaagttgagaggcttcgtgaggaaagaaacaacgttgccaaaaagatgaaagggaagctggagccatcagaacgtgagagactcgtagaagaaggtaaaaatcttaaggaaagtcttgttactctggaagaagacctcgtgaagcttaaagatgagctccaacatgtagcacagtctataccgaatatgactcaccctgatgttcctgttggaggagaggattcatcggcaattagacaggaggttggtagtccacgtgagtttagttttccaataaaggatcatcttcagcttgggaaggatcttgatctcattgattttgactctgctgctgaggtaagtggttcaaagtttttctatctgaagaatgaggcagttctattggagatggctcttcttaattggacattatcacaagtcatgaagaagggttatacccccctaacgactcctgaaatcgtgagatcttctattgttgagaaatgcggtttccaacctcgtggggataatactcaggtctattcgatagatggaactgaccaatgtctcattggtaccgctgaaattcccgtaggaggaatacacatggattctattcttcttgaatcagcattgcctttgaaatatatagcattctctcattgcttccgtactgaagcgggtgctgctggcgctgccacaaaaggtctttaccgagttcatcagttcagcaaagcagagatgttcgtcatatgccaacctgaagatagtgaatccttccaccaagaactcattcagatcgaagaagatttattcacttctctaggattacactttaaaacattggatatggccacagccgatttaggcgctccagcatatcgcaagtttgacattgaagcatggatgcccggtttaggacgatttggcgagatatcaagcgcatcaaactgcacagattgccaaagtcgaagactgggaatccgttaccgcccatctgaaccgcctcagacgggtcctaagaaagggaaagcgaatcttccagccactaagtttgtccacactctaaacgcgactgcgtgtgccgtcccaaggatgatggtgtgtttgctggagaattaccagcaagaagatggatctgtggtgatccctgagcccctgaggcctttcatgggaggcattgaactcatcaaacccaagcacaagtagtttttaatggttagctctttgcaattcttgctgtgattcctcttgtacttgaggttttgttcattatacttttcacaggcgctgagttttttgtgttcttgtctcagaacataccatttatagtttatatcatcataaccgatgttctttgatcc

SEQ ID NO: 5899 - protein, 512 aa, Arabidopsis thaliana
MGLHKLRLAAAVPVTFSSRLFLKPFTNTLTLGLFSRHLQPRNKPLLVRAFSASAAVQDIPATQTSDSSARPLWKAAIDFKWIRDNKEAVEINIRNRNSNANLEAVLQLYENMVNLQKEVERLREERNNVAKKMKGKLEPSERERLVEEGKNLKESLVTLEEDLVKLKDELQHVAQSIPNMTHPDVPVGGEDSSAIRQEVGSPREFSFPIKDHLQLGKDLDLIDFDSAAEVSGSKFFYLKNEAVLLEMALLNWTLSQVMKKGYTPLTTPEIVRSSIVEKCGFQPRGDNTQVYSIDGTDQCLIGTAEIPVGGIHMDSILLESALPLKYIAFSHCFRTEAGAAGAATKGLYRVHQFSKAEMFVICQPEDSESFHQELIQIEEDLFTSLGLHFKTLDMATADLGAPAYRKFDIEAWMPGLGRFGEISSASNCTDCQSRRLGIRYRPSEPPQTGPKKGKANLPATKFVHTLNATACAVPRMMVCLLENYQQEDGSVVIPEPLRPFMGGIELIKPKHK

SEQ ID NO: 5900 - DNA, 1275 bp, Clostridium acetobutylicum
  CDS (1)..(1275): transl_table=11
atgttagatttaaaaagaataagaactaatccagaagaaataaaaaaggcactaacaaacagaggagaagatttcgatatttctgtcatagatgagcttgtatctcttgacgaagaaagaagaaaaaatcttgtagaggtagaaaatttaaaaagtaaaagaaataaagattctggcgagatagctaagcttaaaaagtcaggacaaaatgcggatgaattacttgctgaaatgaagaagatttcagatgatataaaaggaatagatgctaaggtatcagaaatagatgaaaaaatgcagtacataatgcttagaatacctaatataccacatcctagcgttccagaaggtaagtcagatgaggaaaatgtagaaataagaaaatggggagagcctagaaaattcgactttgagtttaaagcacactgggatataggaacagatttagggcttcttgattttgaaagaggaggaaaagtcgcaggttctagatttacattctataagggacttggtgcaagacttgaaagagcagttataaactatttccttgatactcatgtagaaaaacacggatatactgaaatcctcccaccatacatggttaatagagttagtatgactggtactggacagttgcctaaatttgaagaggatgcttttaaagtagataatggattctttttaattcctacagctgaagttcctgttactaatatgttcagagacgaaatattaaaagcagaagatttaccatataagtttgctgcatacagtgcatgctttagatcagaagcaggctcagcaggaagagatacaagaggacttgttcgtcagcatcaatttaataaggtagagcttgttaagtttgccaaaccagaagaatcttatgatgaacttgaaaaattaactcatgatgcagaggaaattttacaaatattaaatattccttatagagtggttagaatatgtaagggagatttaggctttacagcagctttaaagtacgatatagaagtatggatgcctagctacggaagatatgttgaaatttcaagctgtagtaacttcgaggatttccaagcaagacgtgcaaacattaaatttagaagagatccaaaggctaaacctgaatttgttcacactcttaatggatcaggtcttgctgttggaagaacagttgcagcaatactagaaaattatcaaaatgaagatggaagtgtaaatgttccagaagcgttaaagaaatatataggaaaagacgttataagataa

SEQ ID NO: 5901 - protein, 424 aa, Clostridium acetobutylicum
MLDLKRIRTNPEEIKKALTNRGEDFDISVIDELVSLDEERRKNLVEVENLKSKRNKDSGEIAKLKKSGQNADELLAEMKKISDDIKGIDAKVSEIDEKMQYIMLRIPNIPHPSVPEGKSDEENVEIRKWGEPRKFDFEFKAHWDIGTDLGLLDFERGGKVAGSRFTFYKGLGARLERAVINYFLDTHVEKHGYTEILPPYMVNRVSMTGTGQLPKFEEDAFKVDNGFFLIPTAEVPVTNMFRDEILKAEDLPYKFAAYSACFRSEAGSAGRDTRGLVRQHQFNKVELVKFAKPEESYDELEKLTHDAEEILQILNIPYRVVRICKGDLGFTAALKYDIEVWMPSYGRYVEISSCSNFEDFQARRANIKFRRDPKAKPEFVHTLNGSGLAVGRTVAAILENYQNEDGSVNVPEALKKYIGKDVIR

SEQ ID NO: 5902 - DNA, 1389 bp, Saccharomyces cerevisiae
  CDS (1)..(1389)
atgttggacatcaaccaatttatcgaagataagggtggtaacccagagctaatcagacaatctcagaaagcaagaaatgccagtgttgaaatcgtcgatgaaattatttccgactacaaagattgggtcaaaacaagattcgaattagatgaattgaacaagaaattcaacaagcttcaaaaggatattggtttgaagtttaaaaacaaggaagacgcttccggattattagccgaaaaagagaagttaacccaacaaaagaaggaattgactgaaaaggagcaacaggaagataaggacttgaagaaaaaagtttttcaagtaggaaatatcgttcatccatctgttgttgtttccaacgatgaagaaaacaatgaattggtccgtacttggaaaccagaggatttagaagcggttggccccattgcttctgtgactggtaaaccagctagtttatcccatcatgaaatcttgctaagattagatggatatgatccagaccgtggtgtaaagatttgtggtcatagaggttatttcttcagaaattatggtgttttcttgaaccaagctttgattaactatggtttacagttcttagctgccaagggttatattcctttacaagctccagtcatgatgaataaagaacttatgtcaaaaactgctcaactatctgaattcgatgaagagttatacaaagttatcgatggtgaagatgaaaaatacctaattgctacctcagaacaacctatctccgcttaccacagcggtgaatggtttgaaaagccacaagagcaattgccaattcactatgtcggttactcctcttgtttccgtagagaagccggttctcacggtaaggatgcttggggtgtcttcagagttcatgctttcgaaaaaattgaacaattcgtcatcactgaacctgaaaaatcttgggaggagtttgaaaagatgatctcttactctgaggaattttataagtctttgaaattaccataccgtatcgttggtatcgtttccggtgaattaaacaatgctgccgctaaaaagtacgatttagaagcctggttcccataccaaaaggagtacaaagaactcgtctcttgctccaattgtactgattatcagtcaagaaacttagaaattagatgcggtataaagaaaatgggcgacagagaaaagaaatacgtacactgtttgaattccactttggctgctacccaaagagctttgtgctgtatcttggagaactaccaaacggaagatggtttggttgtaccagaagttttgaggaaatacattccaggtgaaccagaatttttaccattcgttaatgaattaccaaagaattccacctctagtaaagacaagaaaaagaagaattaa

SEQ ID NO: 5903 - protein, 462 aa, Saccharomyces cerevisiae
MLDINQFIEDKGGNPELIRQSQKARNASVEIVDEIISDYKDWVKTRFELDELNKKFNKLQKDIGLKFKNKEDASGLLAEKEKLTQQKKELTEKEQQEDKDLKKKVFQVGNIVHPSVVVSNDEENNELVRTWKPEDLEAVGPIASVTGKPASLSHHEILLRLDGYDPDRGVKICGHRGYFFRNYGVFLNQALINYGLQFLAAKGYIPLQAPVMMNKELMSKTAQLSEFDEELYKVIDGEDEKYLIATSEQPISAYHSGEWFEKPQEQLPIHYVGYSSCFRREAGSHGKDAWGVFRVHAFEKIEQFVITEPEKSWEEFEKMISYSEEFYKSLKLPYRIVGIVSGELNNAAAKKYDLEAWFPYQKEYKELVSCSNCTDYQSRNLEIRCGIKKMGDREKKYVHCLNSTLAATQRALCCILENYQTEDGLVVPEVLRKYIPGEPEFLPFVNELPKNSTSSKDKKKKN

SEQ ID NO: 5904 - DNA, 1278 bp, Aquifex aeolicus
  CDS (1)..(1278): transl_table=11
atgatagatataaacctcattagggaaaaacccgattacgtgaaggaaagactcgcaacgagggataaagaactcgtttccttagttgacaaagttcttgaacttgacaaaaggagaagggaaataataaaaagacttgaagccttaaggagtgagaggaataaactgagcaaggaaataggaaaactaaagagggaaggcaaggacaccacggaaatacaaaacagagtaaaggaattgaaagaggaaatagacagacttgaggaagagttaaggaaagtggaagaggagttaaagaacacgctcctctggatacctaacctcccccacccgagtgttccagtgggagaggacgaaaaggacaacgtggaagtaaggagatggggagagccgaggaagtttgattttgaaccaaaacctcactgggaaataggggaaagattgggaattctcgacttcaagaggggtgcaaagctctctggaagcaggtttaccgtaatagccggctggggtgcgagattagaaagggcgcttataaactttatgctggacctccacaccaaaaagggctacaaggaaatatgtcctccccatttggtaaagccggaaatcttaataggaactggacagctaccgaagtttgaagaggacctctacaagtgtgaaagggataacctctacctgatacccaccgcggaagttcccctgacaaacctctacagagaagagatactcaaggaagagaaccttcccatatatctcactgcgtacacgccctgttacagaagggaagcgggagcatacggaaaagacataagggggataataagacagcaccagtttgacaaagtagaacttgtgaagatagtccacccggacacttcttacgatgagcttgagaaacttgtaaaagacgctgaagaagttctccagcttctcggacttccatacagggtggtggaactctgcacgggtgacctcggtttttccgccgcaaagacctacgacatagaagtgtggtttccctctcaaaacaagtacagggaaatctcctcctgctccaactgcgaggactttcaagcgaggaggatgaacacgcgctttaaggactcaaaaactggtaaaaataggttcgtacacactctgaacggctccggacttgcggtgggaaggactctggcggctatattggaaaactaccaacaggaagacggtagcgtagtagttccggaagttctcagagattacgtgggaacggacgtgattagacccgagtaa

SEQ ID NO: 5905 - protein, 425 aa, Aquifex aeolicus
MIDINLIREKPDYVKERLATRDKELVSLVDKVLELDKRRREIIKRLEALRSERNKLSKEIGKLKREGKDTTEIQNRVKELKEEIDRLEEELRKVEEELKNTLLWIPNLPHPSVPVGEDEKDNVEVRRWGEPRKFDFEPKPHWEIGERLGILDFKRGAKLSGSRFTVIAGWGARLERALINFMLDLHTKKGYKEICPPHLVKPEILIGTGQLPKFEEDLYKCERDNLYLIPTAEVPLTNLYREEILKEENLPIYLTAYTPCYRREAGAYGKDIRGIIRQHQFDKVELVKIVHPDTSYDELEKLVKDAEEVLQLLGLPYRVVELCTGDLGFSAAKTYDIEVWFPSQNKYREISSCSNCEDFQARRMNTRFKDSKTGKNRFVHTLNGSGLAVGRTLAAILENYQQEDGSVVVPEVLRDYVGTDVIRPE

SEQ ID NO: 5906 - DNA, 1362 bp, Archaeoglobus fulgidus
  CDS (1)..(1362): transl_table=11
atgtggagcattcttaaagctgttcgcgaaaacccggaaattctttacgagtctcagagaagaaggggtttgagcgttgatattgttgatagagctattgagctggacagaaagtggagagaagagcttaagagggtaaaccagctgagaaagcggagaaacgagctggcgagggctgtgaaggaggcaaagggggaagagagggcaaaggtcatcgaggaagcaaaggctgtatctgaagaggttaaaagggctgaggaggagctgaagaggcttgaggcggagcttgaggaagttctgctttcaattccaaacatcatccacgagtccgtgccagttggaaaggacgacagtgaaaacgttccgataaagtactgggggaaggcgaaggtctacttcgaggatgttgatgcctttgttgagatgacgcagggaatggcggagtatgaagttacggacgtcaaacctatcggtcatgctgatgccgttgagattttcggctgggctgatctggagagggcggcaaaggttgcgggggcgaggttctactacctgctgaacgacctcgtctggctggacttcgctttaacaatgtacgcccttgactttctgagaaaggaggacttcacaatagtctctcctccctacatgatgcgcagagaggcttacagcggagtcacggccttcagcgactttgaggaggtcatatacaaggttgaagatgaagacctctatcttatagccacaagcgagcatccaatagctgcgatgcacatgagggaggttctggaggagagagagcttccattgctctatgcaggagtctcgccctgcttcagaaaggaggccggggcgcatggcaaggacacgaaggggattttcagagttcatcagttcaacaaggtggagcagttcgttttctgccttcctgagcagagctgggagtggcatgagaagctgatagagaatgtggagaagctgtggcagggcttgggcatcccctacagaatcgttaacatctgcacaggcgatttaggcattgtagcggcaaagaagtacgacctcgaagcgtggatgcccgctcaggcaaaatacagggaaatggtttcctgcagcaactgcacggactggcagagctacaggctggacataaggtttgcggaggagagggggaagccgagcaagggattcgtacacactctcaactccaccgcaatcgccactacaagagccatcacagccataatcgagaacttccagcttgaggatgggagggtggagattcccagagtgctgaggaagtaccttgagcccatcgaatcagcaccaaaggatttcattatgccggcaaagagtcagtag

SEQ ID NO: 5907 - protein, 453 aa, Archaeoglobus fulgidus
MWSILKAVRENPEILYESQRRRGLSVDIVDRAIELDRKWREELKRVNQLRKRRNELARAVKEAKGEERAKVIEEAKAVSEEVKRAEEELKRLEAELEEVLLSIPNIIHESVPVGKDDSENVPIKYWGKAKVYFEDVDAFVEMTQGMAEYEVTDVKPIGHADAVEIFGWADLERAAKVAGARFYYLLNDLVWLDFALTMYALDFLRKEDFTIVSPPYMMRREAYSGVTAFSDFEEVIYKVEDEDLYLIATSEHPIAAMHMREVLEERELPLLYAGVSPCFRKEAGAHGKDTKGIFRVHQFNKVEQFVFCLPEQSWEWHEKLIENVEKLWQGLGIPYRIVNICTGDLGIVAAKKYDLEAWMPAQAKYREMVSCSNCTDWQSYRLDIRFAEERGKPSKGFVHTLNSTAIATTRAITAIIENFQLEDGRVEIPRVLRKYLEPIESAPKDFIMPAKSQ

SEQ ID NO: 5908 - DNA, 1278 bp, Borrelia burgdorferi
  CDS (1)..(1278): transl_table=11
atgcttgatctgaaatttattagagataaccttgatcttgttaagagaagtattaaagcaagaggccttgttttagatattgataagttaatttatcttgatgataagagaaaaaaactaattaccaaaattggtgagcttaatgcaaaaagaaatgaaaattcttctaaaatgcaagaaaatcttgataaagttttaaaaatctctttaatagaaaccggaaagattttgaaaaaacagcttattgatctagaagaagagcttgaaagagtatctgttgattttgaccttgaaaataagaaagtgcccaatattttgtcacctgatgtgcctattggcagtagtgaagaagataattttgaaataaaaagggttggagttgttccacagtttgattttaagccaaaagatcatttagagcttggcagagatttagatcttctagattttgacagagcacgtgagattagcgggagtaaattttattatcttaaaaatgaagcagtttttttagaaattgctcttattaatttctctttaaataaattaagagataaaggttttgatgtttttattactcctgatgttgcaagagagtttatagttgatggaataggttttaatcctcgtggcaacgaaagcaatatttataagattgaagatacagataaatatcttgtgggcacttctgaaattacgcttggcggttattattataataaaataatagatctcactttgccaataagaatggcagggttttcacattgttttcgaaaagaagctggagcatatggtcagctttcaaaaggtctttatagagttcatcagtttagcaaggtggagatgttttgtttttgcaaagcagaagaatctggagttattcatgatgaatttttaagtattcaagagcaaatttttactgagcttgaaattccttatagggttttaaatatttgttcttttgatcttggttctccagcttataaaaaatatgatattgaagcttggatgcctggaagagacggaaaaggtggttatggggaggttacttcaacttcaaattgtacagattatcagtcaagaaggcttaagattagatacaaagatcaagatggacaaaataaatttgcacacatggtaaatggaacagcaatagctacaacaagggttattatttctatacttgaaaactttcaggatcaaaagggaggagttagaattcctaaaagtttggttaagtatacaggctttgattatattccttttaagaattag

SEQ ID NO: 5909 - protein, 425 aa, Borrelia burgdorferi
MLDLKFIRDNLDLVKRSIKARGLVLDIDKLIYLDDKRKKLITKIGELNAKRNENSSKMQENLDKVLKISLIETGKILKKQLIDLEEELERVSVDFDLENKKVPNILSPDVPIGSSEEDNFEIKRVGVVPQFDFKPKDHLELGRDLDLLDFDRAREISGSKFYYLKNEAVFLEIALINFSLNKLRDKGFDVFITPDVAREFIVDGIGFNPRGNESNIYKIEDTDKYLVGTSEITLGGYYYNKIIDLTLPIRMAGFSHCFRKEAGAYGQLSKGLYRVHQFSKVEMFCFCKAEESGVIHDEFLSIQEQIFTELEIPYRVLNICSFDLGSPAYKKYDIEAWMPGRDGKGGYGEVTSTSNCTDYQSRRLKIRYKDQDGQNKFAHMVNGTAIATTRVIISILENFQDQKGGVRIPKSLVKYTGFDYIPFKN

SEQ ID NO: 5910 - DNA, 1278 bp, Borrelia garinii
  CDS (1)..(1278): transl_table=11
atgcttgatcttaaatttattagagataatcttgatcttgttaagaaaagtattaaagcaagaggccttgttttagatattgataaattagtttatcttgatgataagagaaaaaaaataattacccaaattggtgagcttaatgcaaaaagaaatgaaaattcctctaaaatgcgagaaaatcttgataatgtttttaaaagctctttaatggaaaccgggaaaattttaaaaaaacagcttattgatttagaagaagagcttaaaaaaatatcttttgattttgatcttgaaaataagcgagtgcctaatattttgtcacccgatgtgcctattggcaatagtgaggaagacaattttgagataaaaaaagtgggtgttgttccaaaatttgactttaagccaaaagaccatttagagcttggcagagatttagatcttttagattttgacagagcacgtgaggttagtgggagtaaattttattatcttaaaaatgaagcagtttttttagaaattgctctaattaatttttctttaaataaattaagagaaaaaggttttgatgtttttattacccctgatgttgcaagagagtttatagttgatgggattggtttcaatcctcgtggggacgaaagcaatatttacaagattgaaagtacagataaataccttgtaggcacttctgaaattacgcttggtggttattattataataaaataatagatctcactttgccaataaaaatggcaggattttcacattgtttccgaaaagaagctggagcatatgggcagctttcaaaaggtctttatagagttcatcagtttagtaaggtggagatgttttgtttttgtaaggcagaagaatctcaggttattcatgacgaatttttaagtattcaagagcaaatttttactgagcttgagattccttacagagttttgaatatttgttcttttgatcttggctcgccagcttataaaaaatatgatattgaagcatggatgcctggaagagatggtaagggtagctatggagaggttacctcaacgtcaaattgtacagattatcagtcaagaagacttaagattagatataaagatcaagatgggcaaaataaatttgcgcacatggtaaatggaacagcaatagctacaactagagttattatttctatacttgaaaattttcaagatgaaaagggaggagttagaattcctaaaagtttggttaagtatacaggttttggttacattccttttaagaattag

SEQ ID NO: 5911 - protein, 425 aa, Borrelia garinii
MLDLKFIRDNLDLVKKSIKARGLVLDIDKLVYLDDKRKKIITQIGELNAKRNENSSKMRENLDNVFKSSLMETGKILKKQLIDLEEELKKISFDFDLENKRVPNILSPDVPIGNSEEDNFEIKKVGVVPKFDFKPKDHLELGRDLDLLDFDRAREVSGSKFYYLKNEAVFLEIALINFSLNKLREKGFDVFITPDVAREFIVDGIGFNPRGDESNIYKIESTDKYLVGTSEITLGGYYYNKIIDLTLPIKMAGFSHCFRKEAGAYGQLSKGLYRVHQFSKVEMFCFCKAEESQVIHDEFLSIQEQIFTELEIPYRVLNICSFDLGSPAYKKYDIEAWMPGRDGKGSYGEVTSTSNCTDYQSRRLKIRYKDQDGQNKFAHMVNGTAIATTRVIISILENFQDEKGGVRIPKSLVKYTGFGYIPFKN

SEQ ID NO: 5912 - DNA, 1278 bp, Clostridium perfringens
  CDS (1)..(1278): transl_table=11
atgttagatttaaaaaagttaagaagtaatactgaagaagtgaaaaaagctttatctaatagaggagaagactttgatgtaaatgttatagacgaagttatagctttagatgaagaaagaagaaaaattttagttgatgttgaggctttaaagaaacaaagaaatgaagtatcagctgaaattccaaagagaaaaaaagctggagaagacgttacagaagtaatggctgaaatgagagaaataggagataaaataaaggctgatgatgctaaagttgctgagttaaacgataaaattaactatatcatgctaagaattcctaatataccaaacccagctgttccagaaggggaaactgatgaggacaatgttgaaataaaaagatggggagaacctactaaattcaactttgaaccaaaagcacactgggatttaggaacagatttagatcttttagacttcgaaagaggtggaaaggttgctggatcaagatttacagtttacaaaggaatgggtgctagattagagagatctataataaactacttcttagataaacacacatttgaaaatggatacactgaagtattaccaccatacatggtaaatagagatagtatgactggtactggtcaacttccaaaattcgaagaagatgctttcaaagtagaaaacaatggatatttcttaataccaacagctgaggttcctgtaactaatatgtacagaaatgaaactttagagggagataaacttccaataaaacatgctgcatatagtgcttgttttagagcggaagctggttcagcaggaagagatacaagaggtcttataagacaacaccaatttaataaagttgagttagttaagttctgtaaacctgagcaaagctatgaagaattagataaattagttcaagatgctgaatctgtattacaaggtttaggattaccatatagaatagttagaatatgtaaaggtgatttaggattcactgctgcattaaaatatgatatagaagtttggatgccaagctacaatagatatgttgaaatttcaagttgttcaaactttgaagatttccaagctagaagagctaacattaaatataaaaattctccaaaggaaaaaccacaatttgttcatacattaaatggatcaggggttgctattggaagaactgtagctgctatattagaaaactatcaacaagaagatggatcagtagttataccagaagctttaaaagaatatatgagatgtgatttactaaaataa

SEQ ID NO: 5913 - protein, 425 aa, Clostridium perfringens
MLDLKKLRSNTEEVKKALSNRGEDFDVNVIDEVIALDEERRKILVDVEALKKQRNEVSAEIPKRKKAGEDVTEVMAEMREIGDKIKADDAKVAELNDKINYIMLRIPNIPNPAVPEGETDEDNVEIKRWGEPTKFNFEPKAHWDLGTDLDLLDFERGGKVAGSRFTVYKGMGARLERSIINYFLDKHTFENGYTEVLPPYMVNRDSMTGTGQLPKFEEDAFKVENNGYFLIPTAEVPVTNMYRNETLEGDKLPIKHAAYSACFRAEAGSAGRDTRGLIRQHQFNKVELVKFCKPEQSYEELDKLVQDAESVLQGLGLPYRIVRICKGDLGFTAALKYDIEVWMPSYNRYVEISSCSNFEDFQARRANIKYKNSPKEKPQFVHTLNGSGVAIGRTVAAILENYQQEDGSVVIPEALKEYMRCDLLK

SEQ ID NO: 5914 - DNA, 1281 bp, Clostridium tetani
  CDS (1)..(1281): transl_table=11
atgctagatttaaaaagaataagaagtaatccagaagaaataaaaaaggcattggcaggtagaggtgaagattttgatgtatctgttatagataaagtactacaattagatgaagaaagaagaaatatattagtagaagttgaatcattaaaaaataagagaaagcaagaatcagctaaaatacctcaatttaaaaaagaaggtaaaaatgtagatgacataatggctgaaatgaaagaacttgcggggaaaataaaaaaattagatgaaagattatcagaaattgatggaagtatagaatatataatgttaagaatacctaatataccaaatccaaatgttcctaatggggattcagatgaagataatgtggaaattagaagatggggcgaggctacaacatttgaatttgagcctaaagcccattgggatttaggtgtaaatttagatatattagattttgaaagagctggtaaagtaacaggctcaagatttactttctataagggattaggtgctagacttgaaagagcggtaataaattattatttagatactcatatagatgagcatgggtatacagaaattcttccaccatacatggtaaatagaaagagtatgacaggaacaggtcaacttcctaaatttgaagaagatgcttttagacttgaagaacaagactattttttaatacctacagcagaagttccagtgacaaatttatatagagatgaaatattaaatggatcagacttaccaatgaaacatgttgcatatagtgcatgctttagatcagaagcaggatcagcaggaagggatacaagaggtcttgtaagacagcatcaatttaataaagtagaacttgttaaatttactaaaccagagcaatcctatgaagaattagaaaagttaacaaaagatgcagaagatgttttacaaggattaggaattccttatagagttgtaaggatatgcaaaggcgatttaggttttactgctgcattaaaatatgatatagaagtttggatgccaagttataataggtatgtagaaatatcaagctgtagtaacttcgaagatttccaatcaagacgtgctaatataaaatatagagaaaatccaaaagataaacctaattttgtgcatacattgaatggttctggggtagcagtaggaagaacagttgcagctataatagaaaatttccaacaggctgatggaactattattataccagaaaaattaagaccttatatgggcggaaaagatgtaataaaataa

SEQ ID NO: 5915 - protein, 426 aa, Clostridium tetani
MLDLKRIRSNPEEIKKALAGRGEDFDVSVIDKVLQLDEERRNILVEVESLKNKRKQESAKIPQFKKEGKNVDDIMAEMKELAGKIKKLDERLSEIDGSIEYIMLRIPNIPNPNVPNGDSDEDNVEIRRWGEATTFEFEPKAHWDLGVNLDILDFERAGKVTGSRFTFYKGLGARLERAVINYYLDTHIDEHGYTEILPPYMVNRKSMTGTGQLPKFEEDAFRLEEQDYFLIPTAEVPVTNLYRDEILNGSDLPMKHVAYSACFRSEAGSAGRDTRGLVRQHQFNKVELVKFTKPEQSYEELEKLTKDAEDVLQGLGIPYRVVRICKGDLGFTAALKYDIEVWMPSYNRYVEISSCSNFEDFQSRRANIKYRENPKDKPNFVHTLNGSGVAVGRTVAAIIENFQQADGTIIIPEKLRPYMGGKDVIK

SEQ ID NO: 5916 - DNA, 1620 bp, Helianthus annuus
  CDS (110)..(1426)
cttgcctcctccttcctcagcgaccacctccgctccggccgtcctcctccagccgacaaccgtcttcctccggccgttattcacagaaagcaagaaagaaagaggaagcatgttggacattaatctatttcgggaggaaaaggggggaaatccggaaattgtacgcgaatctcagcgtcgtcgtggtgcaagtgtagaaattgtcgatgaaattattaaacttgacaaagagtggcgacaacgtcaattcgagctggagcagttgcgaaaagactttaacaggattaacaaagaagtggctaaacttaggatttctggcggagacgcgagttcgctaataaaaaacacagaggaaaacaaggattcaaccgcaaagaagcaagcggaggttcaggaggcccgtacagcattatattcaaaactagagacagttggaaatctcgtgcatgattcggttcccgttagcaatgatgaggcggacaatgctgttgtccggacctggggagagagaagagaagagacaaatctgaaaaatcacgttgagcttgtggaacttctcggtatcgcggatctgaaaaaaggtgctaatgttgctggtggcagagggtattatttgaaaggagacggtgtgcgtttaaatcaagctcttataaattttggtctcgactttttggagaaaaggaaatacacagcactgcagacaccattctttatgaggaaagatataatgggaaaatgtgctcagttagcacaatttgatgaagaactttacaaggtaacaggtgagggagatgacaagtatctgattgcaactgctgaacaaccgctatgtgcttaccatatagatgattggattcatccaaatgagctaccattaagatatgctggatattcgtcgtgctttcgtaaggaagctggctcacacgggagagacactctcggcattttccgtgttcatcagtttgagaaggttgaacagttttgcttgaccaaaccaagtggcaatgattcttgggaaatgcatgaagagatgattaaaaattctgaggagttttatcagatgttgaaattgccgtatcaagtagtgtctatagtttctggtgcgctaaacgatgctgcagcaaagaagtatgacttggaagcatggtttcctgcatccaaaacttacagagaacttgtttcatgttctaattgcacagattaccagtcgagaaaattggaaatcagatgtggacaaaagaagggaaatgaacaggcgaagcaatactgccatctgttaaactctacgctgacagcaacagagaggactctttgctgcattctcgaaaactaccaaacggaaaaaggtgttgcgataccagaagttttgcagccatttatgggtggcaagactttcttggatttcctaaagaaaatcaagaaatgaaaatgaaatgcctagtctcttttcattataaaaaacgcccgattctaacgggtttcgtgatgttacaagtcggttatagatatttctgttggttattttgttgaaactgtttgtttaaaattattattgttacttgctttgaacatattctgatgacccagaatgatacgttattctctgaaagttttttgatc

SEQ ID NO: 5917 - protein, 438 aa, Helianthus annuus
MLDINLFREEKGGNPEIVRESQRRRGASVEIVDEIIKLDKEWRQRQFELEQLRKDFNRINKEVAKLRISGGDASSLIKNTEENKDSTAKKQAEVQEARTALYSKLETVGNLVHDSVPVSNDEADNAVVRTWGERREETNLKNHVELVELLGIADLKKGANVAGGRGYYLKGDGVRLNQALINFGLDFLEKRKYTALQTPFFMRKDIMGKCAQLAQFDEELYKVTGEGDDKYLIATAEQPLCAYHIDDWIHPNELPLRYAGYSSCFRKEAGSHGRDTLGIFRVHQFEKVEQFCLTKPSGNDSWEMHEEMIKNSEEFYQMLKLPYQVVSIVSGALNDAAAKKYDLEAWFPASKTYRELVSCSNCTDYQSRKLEIRCGQKKGNEQAKQYCHLLNSTLTATERTLCCILENYQTEKGVAIPEVLQPFMGGKTFLDFLKKIKK

SEQ ID NO: 5918 - DNA, 1275 bp, Oceanobacillus iheyensis
  CDS (1)..(1275): transl_table=11
atgttagatatgaaatatctacgccaaaattttgaagaagtacagcaacgtttacagcatcgtggagaagatttagcagatttagataaatttggtgaactagatacgaatcgtcgtcaattaattgcagaaacagagaagttaaaggctcaacgaaatgaagctacaaagaaaatatctgaacttaaaagagagaaaaaagatgctgaacctgcaattaaagagatgcgagaagttggccaagaaattgctacactggataaacaattgaaggatattgaagaaaaactagaacaaatcatgctgtcgattccaaatttgcctcatgagagcgttcctgttggtgaagatgaagaagataatattgaagcaagaaaatggggagaggcgcctaattttgcttttgaagcactacctcattgggatgttgcgacaaatctagacattatagattttgagcgtgcgggtaaagtaacaggaagtcgttttgttttttataaaggcttaggtgcaagactagagagagcattatggaactttatgatggatttacatgcagatgagcatggctatcaagaaatgcttccaccatacattgtaaatcgttcaagtatgactggaacagggcagcttcctaaatttgaagaggatgcgtttaaattagaagaatgggattattttatggttccaacagcagaagtaccagtgactaactatcatcgagaagaaatacttggaatcgatgacctccctaaaaagtatgtagcattcagtgctagctttcgttctgaagctggatctgctggacgcgatacacgtggattaattcgccaacatcagtttaataaagtagaactagttaatttcgtaaaaccagaggactcttatgacgtattagaaaggttaacaggggaagcagaaaaagtattacaactgttaaaacttccataccgcgtaatgagtatgtgtacaggagatttaggatttaccgctgcgaagaaatacgatattgaagtatggattccaagtcaagaaacttaccgagaaatttcttcttgctctaattttgaggatttccaagcacgacgtgcaggtattcgtttccgacgtgaagcaaatgggaaaccggaatttgtgcatacattaaatggttctggtttagcgattggacgtacagtagcagcaatcttagaaaattatcagcaagaagatggtactgtcgtcgtacctgaagttttacgtccatacatgggtggaaaagaaattattgggtaa

SEQ ID NO: 5919 - protein, 424 aa, Oceanobacillus iheyensis
MLDMKYLRQNFEEVQQRLQHRGEDLADLDKFGELDTNRRQLIAETEKLKAQRNEATKKISELKREKKDAEPAIKEMREVGQEIATLDKQLKDIEEKLEQIMLSIPNLPHESVPVGEDEEDNIEARKWGEAPNFAFEALPHWDVATNLDIIDFERAGKVTGSRFVFYKGLGARLERALWNFMMDLHADEHGYQEMLPPYIVNRSSMTGTGQLPKFEEDAFKLEEWDYFMVPTAEVPVTNYHREEILGIDDLPKKYVAFSASFRSEAGSAGRDTRGLIRQHQFNKVELVNFVKPEDSYDVLERLTGEAEKVLQLLKLPYRVMSMCTGDLGFTAAKKYDIEVWIPSQETYREISSCSNFEDFQARRAGIRFRREANGKPEFVHTLNGSGLAIGRTVAAILENYQQEDGTVVVPEVLRPYMGGKEIIG

SEQ ID NO: 5920 - DNA, 1335 bp, Picrophilus torridus
  CDS (1)..(1335): transl_table=11
atgattgatataaagcttttgaggcttaacagcgaaatattttataaatcgtgcagggatcgcggatttgataccaggatccttgatgagttctttgagcttgataatgaatggaaggaaaatttaaagcaattgaacaatataaagcacgataaaaacagcataacaatggaaatatcaaggagaataaagtccggggatgatataaatgatttaaagttaaaggttgaatcattgaacattgatatacaaaggcttgagggcaggcagaatgaaatagatgtaaaaagaaacgagattttaaggttgataccaaacctgcttgcagatgatgtgccgagatgctttggcgatgagaacaacaggcttgtaagatattatggaagggccagggtgttttctgatgatgtaaaatacttcattgaaaacagcggctccggagattacgaggagattgattacaggccaaaaagccacgttgatttaatatcagagcttaatcttgctgatatagaaagggccggcaagatagcaggtgcaagattctattttctaaagaacaggctcttcaaacttgagcttgcattgataaattacgctgttgactttttatcgcagcgtggctacacagtacttgagccaccattcatgataaattacaaatcaatgtccggagcaacagacatagagacctttaaggatacactttataaaatagagggggacgacctttatttaatagcaacagcagagcatccaattgcatccatgcttcaggatgagatattaatggaggatgagctgccaataagggtcagcggtgtatcaccgtgctttaggcgtgaggcgggtgcacatggcaaggatacaaagggcatattcagggtgcaccagttcaataaaatagagcagtttgtattttgcaagcccgaggattcatgggatttctttgatgagcttgtaaggaattcagaggatatatacaaaagccttaagataccatacagggttgtaaacgtatgctctggtgagcttggcaaccttgcagcaaaaaagtatgatatcgaggcatggtttccggcacagggcaaattcagggagattgtttcagcatcaaacgatacagattaccaggcaaggtcccttaacataaaatacaggtcaagggatggtaacaggtttgttcacacattaaacagcacggcgatagccaccgagaggatacttgttgcaattatggaaaatttccaggatcgtaatggaaaggtaataaaaataccagaggtccttattccgtatactggtttttccgagataggtggtgatgacaattaa

SEQ ID NO: 5921 - protein, 444 aa, Picrophilus torridus
MIDIKLLRLNSEIFYKSCRDRGFDTRILDEFFELDNEWKENLKQLNNIKHDKNSITMEISRRIKSGDDINDLKLKVESLNIDIQRLEGRQNEIDVKRNEILRLIPNLLADDVPRCFGDENNRLVRYYGRARVFSDDVKYFIENSGSGDYEEIDYRPKSHVDLISELNLADIERAGKIAGARFYFLKNRLFKLELALINYAVDFLSQRGYTVLEPPFMINYKSMSGATDIETFKDTLYKIEGDDLYLIATAEHPIASMLQDEILMEDELPIRVSGVSPCFRREAGAHGKDTKGIFRVHQFNKIEQFVFCKPEDSWDFFDELVRNSEDIYKSLKIPYRVVNVCSGELGNLAAKKYDIEAWFPAQGKFREIVSASNDTDYQARSLNIKYRSRDGNRFVHTLNSTAIATERILVAIMENFQDRNGKVIKIPEVLIPYTGFSEIGGDDN

SEQ ID NO: 5922 - DNA, 1281 bp, Pseudomonas aeruginosa
  CDS (1)..(1281): transl_table=11
atgctcgatcccaaactggtacgcacccagccgcaagaagtggctgcccgcctggccacccgtggcttccaactggatgtcgcacgcatcgaagcgctggaagagcagcgcaagtcggtacagacccgtaccgagcagctgcaagccgagcgcaacgcgcgttccaaggcgatcggccaggccaagcagcgtggcgaggacatcgcgccgctgctggccgatgtcgaccgcatgggctccgagctggaggaaggcaagcgccagctggacgccatccagggcgaactggatgccatgctgctgggcattcccaacctgccacacgagtcggtgccggtcggtgccgacgaggacgccaacgtcgaagtgcgtcgctggggcacgccgaagaccttcgatttcgaggtcaaggaccatgtcgccctcggtgaacggcacggctggctggatttcgagaccgctgccaagctttccggcgcgcgcttcgccctcatgcgcggcccgatcgcccgcctgcatcgcgccctggcgcagttcatgatcaacctgcataccgccgagcatggctacgaggaggcctacaccccctatctcgtccaggctccggcgctgcaaggcaccggccagttgccgaagttcgaggaggacctgttcaagatcggccgcgacggcgaagccgacctctacctgatcccgaccgccgaggtttcgctgaccaacatcgtctccgggcagatcctcgacgccaagcagttgccgctgaagttcgtcgcccataccccgtgcttccgcagcgaggccggtgcctccgggcgcgatacccgcgggatgatccgccagcaccagttcgacaaggtggagatggtgcagatcgtcgatccggccacctcctacgaagcgctggaaggcctgaccgccaacgccgagcgcgtcctgcaactgctcgagctgccgtatcgggtgctggcgctgtgcaccggcgacatgggcttcggtgcgaccaagacctacgacctggaagtctgggttcccagccaggacaagtaccgcgagatttcctcctgctccaactgcggcgacttccaggcccggcgcatgcaggcccgctaccgcaatccggaaaccggcaagcccgagctggtgcacaccctcaacggctccggcctggccgtcggccgtaccctggtggcggtactggagaactaccagcaggcggacggctcgatccgtgtgccggaagtcctcaagccctacatggctggcatcgaggtgatcggctga

SEQ ID NO: 5923 - protein, 426 aa, Pseudomonas aeruginosa
MLDPKLVRTQPQEVAARLATRGFQLDVARIEALEEQRKSVQTRTEQLQAERNARSKAIGQAKQRGEDIAPLLADVDRMGSELEEGKRQLDAIQGELDAMLLGIPNLPHESVPVGADEDANVEVRRWGTPKTFDFEVKDHVALGERHGWLDFETAAKLSGARFALMRGPIARLHRALAQFMINLHTAEHGYEEAYTPYLVQAPALQGTGQLPKFEEDLFKIGRDGEADLYLIPTAEVSLTNIVSGQILDAKQLPLKFVAHTPCFRSEAGASGRDTRGMIRQHQFDKVEMVQIVDPATSYEALEGLTANAERVLQLLELPYRVLALCTGDMGFGATKTYDLEVWVPSQDKYREISSCSNCGDFQARRMQARYRNPETGKPELVHTLNGSGLAVGRTLVAVLENYQQADGSIRVPEVLKPYMAGIEVIG

SEQ ID NO: 5924 - DNA, 1368 bp, Pyrococcus abyssi
  CDS (1)..(1368): transl_table=11
atgctggacataaagctcatacgtgaaaatcccgagctcgtgaagaacgatctaaaaaagaggggagaacttgaaaagataaagtggatagacgagattctaaagttggacgctgagtggagggccaagctaaaggaaataaacaaactcaggcatgagaggaataaaatagccatagaaataggaaagaggagaaagaaaggagagccagtcgaagagcttctagctaagagcaaagagatagtgaaaaggatagaaagtctggaaaaggaagttgaagagctcaagaagaagattgactattacttatggaggcttcccaacataacacatccaagcgttcccataggagaaagcgaagaggataacgtcccaattagattctgggggaaagctagggtctgggaaggtcacctagagagattcctggagcagagccaggggaaaatggagtacgaggttctcgagtggaggccgaagttgcacgttgacctgctcgaaatcctaggaggagcggactttgcaagggcagccaaggttagcggctcgaggttctactacctcctaaacgagatagttatactggacttagcgttaattaggttcgccctcgatgagctcataaagaagggcttcactccagtaatcccaccttacatggttagaagattcgtggaggagggctcaaccaccttcgaggatttcgaggatgtcatatacaaggttgaaggtgaggacctatacttaatcccgaccgctgagcatcctttagctggaatgcacgcaaatgagatcttagatggaaaggatttaccgctcctctacgttggaatatcgccttgcttcaggaaagaggcgggaactgcaggaaaggataccaagggaatattcagggttcaccaattccacaaggttgagcagttcgtgtactctaggcctgaggagagctgggagtggcacgagaggataataaggaacgccgaggaactcttccagaagctcgagataccgtatagggtagtgaacatatgcactggagaccttggctacgtggcggctaagaagtacgatatagaagcttggatgcctggtcaaggaagatttagggaagtagtttcggcaagcaactgtaccgattggcaagctagaaggctcaacataagatttagggatagaacagatgaaaagccacgctacgttcacaccttaaattcaacggccatagcaacttctagagcgatagttgcgatacttgagaaccatcaagaggaagatggaaccgtgaagattccgaaggttctctggaagtacaccggcttcaaggaaatagttcccgtagagaagaaggagaggtgttgctcaagttga

SEQ ID NO: 5925 - protein, 455 aa, Pyrococcus abyssi
MLDIKLIRENPELVKNDLKKRGELEKIKWIDEILKLDAEWRAKLKEINKLRHERNKIAIEIGKRRKKGEPVEELLAKSKEIVKRIESLEKEVEELKKKIDYYLWRLPNITHPSVPIGESEEDNVPIRFWGKARVWEGHLERFLEQSQGKMEYEVLEWRPKLHVDLLEILGGADFARAAKVSGSRFYYLLNEIVILDLALIRFALDELIKKGFTPVIPPYMVRRFVEEGSTTFEDFEDVIYKVEGEDLYLIPTAEHPLAGMHANEILDGKDLPLLYVGISPCFRKEAGTAGKDTKGIFRVHQFHKVEQFVYSRPEESWEWHERIIRNAEELFQKLEIPYRVVNICTGDLGYVAAKKYDIEAWMPGQGRFREVVSASNCTDWQARRLNIRFRDRTDEKPRYVHTLNSTAIATSRAIVAILENHQEEDGTVKIPKVLWKYTGFKEIVPVEKKERCCSS

SEQ ID NO: 5926 - DNA, 1356 bp, Pyrobaculum aerophilum
  CDS (1)..(1356): transl_table=11
atgtcttacagcgtattggaggctcttagaaacagcccagacgtagttagaaaagtcttaaccgctaggaggatggacgcttctctcgtggacaagttcttagaattagacgagaagtggaggcggttgaaaaaagaagttgacgagttgaggcacgagtataataagctttcaaaagagggggcaaaggctcctccggagaggcggagggaaattgcggataaggctagggagctggcggctaggcttgagagggctgagaaagaattggaagagacggagagggctagggaggaggttttgtggagttttcctaatcttattcacgagtccgtccccatatgcccagagggagtcgattcaatccccgtaagacactggggcgttgtaaaaacaactaaggatgtagtagataaattggacaaaggcgttgactacttagttgtagaaaaggcgccggtgggtcacgccgacatggccgaggttgttttaaaaatggccgacacgttgaaggcaggggaggtggctgggagccgtttctactacttgtttgacgatttagtgtggctcgacttcgccctcgccatgtacgcattagactacctagcccagaaggggtttaggcctgtgatcccgccgtatatgttgaaatacgacctcattaggagggttttggacttcgacacttttaaagacgctatatacaaaattgacggcgaggacttatacctaatcgccacggcggagcacggaatagcggcgtatctctacaaacgcgaattattagaggaggagttgccgcaactttacgtggggtggtctccatgttttagaaaagaggctggcgccggcagtagggacataaagggtattttcagagttcatatattccacaaagtggagcagttcgtcttctccctgccagaggactcttggaagtggcatgaggaaataactaaaaacaccgaggagctcataagaggcctcggcctgccttacagagttgtcaacatatgcgcccacgacctcggggccccggccgctaagaaatacgacatagaagtgtggtatccatcgcaggggatgtatagagaattggcgagttgttcaaacgtaaccgactggcagtcgtataggcttggcataagagtaactagaaagggcatgaagagggagtacgtccacacgcttaactgcacaggtctggcgaccacgaggacaataactgccattttggagaacttccagagagaagacggcgctgtggagataccaaaagttttaagacaatatttagagccgataaaagccgcgcctaaagattatatacttccaaaagcggctaaaagcccttag

SEQ ID NO: 5927 - protein, 451 aa, Pyrobaculum aerophilum
MSYSVLEALRNSPDVVRKVLTARRMDASLVDKFLELDEKWRRLKKEVDELRHEYNKLSKEGAKAPPERRREIADKARELAARLERAEKELEETERAREEVLWSFPNLIHESVPICPEGVDSIPVRHWGVVKTTKDVVDKLDKGVDYLVVEKAPVGHADMAEVVLKMADTLKAGEVAGSRFYYLFDDLVWLDFALAMYALDYLAQKGFRPVIPPYMLKYDLIRRVLDFDTFKDAIYKIDGEDLYLIATAEHGIAAYLYKRELLEEELPQLYVGWSPCFRKEAGAGSRDIKGIFRVHIFHKVEQFVFSLPEDSWKWHEEITKNTEELIRGLGLPYRVVNICAHDLGAPAAKKYDIEVWYPSQGMYRELASCSNVTDWQSYRLGIRVTRKGMKREYVHTLNCTGLATTRTITAILENFQREDGAVEIPKVLRQYLEPIKAAPKDYILPKAAKSP

SEQ ID NO: 5928 - DNA, 1368 bp, Pyrococcus furiosus
  CDS (1)..(1368): transl_table=11
atgctcgacataaatttaatcagaaataatccagagctcgtcaagaacgatcttaagaagaggggagagctagacaaaattgcatggattgacgagatacttaggttagatgaagagtggaggaagaagctaaaagagataaacaggcttaggcacgagagaaataaaatcgcaatagagatagggaagaggaagaaggctggagagccagtagaggatcttctggcaaaaagcaaagagatagttaagaggatagaagaattagagaaggaagttgaggagttaagaaagagaatagactactacctatggaggcttccaaacataacccatccaagcgttcccgttgggaaggatgagaatgacaacgtccccataaggttctgggggaaggctaaggtttggaaaggacacttagagagcttccttgagcagagccaaggaaagatggagtatgaagttctagagtggagaccaaaacttcacgtcgaccttttggagatcctcggtggggctgactttgctagagcagcaaaggttagcggttctagattctattacctcctaaacgaaatagtcatacttgacttggcattgataaggtttgctttggataggctaatagagaagggcttcaccccagttatccctccctacatggttagaagatttgtcgaagaagggtcgactacattcgaggactttgaagatgttatatacaaggttgaaggggaagacctctacttaatccccacggccgagcacccattggctggcatgcacgcaaacgagattctcgatggaaaggatttacctttactatatgtagctttcagcccgtgctttagaaaagaggcagggaccgccggaaaggataccaagggaatctttagggttcaccagttccacaaggttgagcagttcgtctattctagacctgaagagagctgggagtggcatgaaaggctagttaggaacgctgaagagctcttccaagagcttgagattccctacagagtagttaacatctgtactggagatctgggttacgtagccgcaaagaagtacgacatagaggcttggatgcctgggcaggggaggtttagagaagttgtttcggcaagcaactgtacagactggcaggctaggaggttgaacattaggtttagagatagaactgacgaaaagcccaggtacgtgcacactttaaactccactgcaatagcaacttctagagcaatagtggcaattctagagaaccaccagcaggaggatggaactgtaaagatacccagggcgctctggaagtacactggattcaaggagatagtcccggttgagaagaaggaagggtgctgcaaggcatga

SEQ ID NO: 5929 - protein, 455 aa, Pyrococcus furiosus
MLDINLIRNNPELVKNDLKKRGELDKIAWIDEILRLDEEWRKKLKEINRLRHERNKIAIEIGKRKKAGEPVEDLLAKSKEIVKRIEELEKEVEELRKRIDYYLWRLPNITHPSVPVGKDENDNVPIRFWGKAKVWKGHLESFLEQSQGKMEYEVLEWRPKLHVDLLEILGGADFARAAKVSGSRFYYLLNEIVILDLALIRFALDRLIEKGFTPVIPPYMVRRFVEEGSTTFEDFEDVIYKVEGEDLYLIPTAEHPLAGMHANEILDGKDLPLLYVAFSPCFRKEAGTAGKDTKGIFRVHQFHKVEQFVYSRPEESWEWHERLVRNAEELFQELEIPYRVVNICTGDLGYVAAKKYDIEAWMPGQGRFREVVSASNCTDWQARRLNIRFRDRTDEKPRYVHTLNSTAIATSRAIVAILENHQQEDGTVKIPRALWKYTGFKEIVPVEKKEGCCKA

SEQ ID NO: 5930 - DNA, 1368 bp, Pyrococcus horikoshii
  CDS (1)..(1368): transl_table=11
atgctggatataaagctgatccgtgaaaaccccgaattagttaaaaacgacttgataaaaaggggagagctagagaaagttaagtgggtagatgagattctaaagctcgacacagaatggaggactaagcttaaggagataaacagacttaggcatgagagaaacaagatcgcagtagaaattggaaagagaagaaaaaaaggagaacccgttgatgaacttttagcaaaaagcagagagatcgtcaaaagaataggagaactcgaaaatgaagttgaggaactaaagaaaaagatcgattattacctatggagacttccaaacattacccatccaagcgtcccagttgggaaggatgaaaatgataacgtccccataagattctggggaaaagccagagtttggaaaggccaccttgaaagattcctggagcagagccaagggaagatggagtatgaaattcttgaatggaaaccaaaactgcacgttgacctcttagaaatcctaggaggagcagacttcgcaagggccgcgaaggtcagcggttccaggttctattacctcctcaacgagatagtgatacttgatctagccctaattaggttcgcccttgacaggctcatagagaagggctttacgccggtaattcctccttatatggttagaaggttcgttgaggaaggatctactagctttgaggactttgaggatgttatatacaaggttgaagatgaggatctatatctaattccgaccgctgaacaccccttagctggaatgcacgcgaacgagatattagatggaaaagatttacccctcctctacgtcggtgtttcaccatgctttagaaaagaagcaggaacagctggaaaggatactaagggaatatttagggttcaccaattccataaggtagaacagttcgtctactcaagacctgaagaaagctgggagtggcatgagaaaataataaggaacgctgaagagctattccaggagttagagataccatacagagttgtaaacatctgtaccggagatttaggttacgtcgcagctaagaagtacgacatagaagcctggatgccaggacaaggtaaatttagggaagtagtctcagcaagcaattgtactgattggcaggctaggaggcttaacataaggtttagggataggactgatgaaaagcccaggtacgttcacactctaaattcaacggcaatagctacttctagagcgatagttgcaatcctggaaaaccatcaggaggaagatggaaccgttaggatcccaaaggttctgtggaaatacacagggtttaaggagatagttccagtagaaaagaaggagaggtgttgcgcaacttga

SEQ ID NO: 5931 - protein, 455 aa, Pyrococcus horikoshii
MLDIKLIRENPELVKNDLIKRGELEKVKWVDEILKLDTEWRTKLKEINRLRHERNKIAVEIGKRRKKGEPVDELLAKSREIVKRIGELENEVEELKKKIDYYLWRLPNITHPSVPVGKDENDNVPIRFWGKARVWKGHLERFLEQSQGKMEYEILEWKPKLHVDLLEILGGADFARAAKVSGSRFYYLLNEIVILDLALIRFALDRLIEKGFTPVIPPYMVRRFVEEGSTSFEDFEDVIYKVEDEDLYLIPTAEHPLAGMHANEILDGKDLPLLYVGVSPCFRKEAGTAGKDTKGIFRVHQFHKVEQFVYSRPEESWEWHEKIIRNAEELFQELEIPYRVVNICTGDLGYVAAKKYDIEAWMPGQGKFREVVSASNCTDWQARRLNIRFRDRTDEKPRYVHTLNSTAIATSRAIVAILENHQEEDGTVRIPKVLWKYTGFKEIVPVEKKERCCAT

SEQ ID NO: 5932 - DNA, 1368 bp, Pyrococcus kodakaraensis
  CDS (1)..(1368): transl_table=11
atgcttgacataaagctcatccgcgaaaacccagagatagtaaagagggatttgataaagcgcggtgaaaccgaaaagctgaagtggatagatgaaatcctcgaactcgacaagaagtggcgcgagaacctgaagaagatcaaccagctcaggaaggagcgcaaccagctggcggtgcagataggcaagaggaagaaggccggagagccgatagacgacctcctgaagaggagcaacgagatagtgaagcagatagaggagctggagaaggagaacgaggagctgaagaagaagatcgactactacctctggcgcttgcccaacatcacccacgagagcgtccccgttggtgagagcgacgaggacaacgtcccgataaggttctggggcaaggccaaggtctgggagggcttcctcgaaaccttcaaggagcagagccttgggaagatggaatacgaggttctcagctggagaccgaggctccacgttgacatgctcgaactcctccgcggtgctgacctcgagagggccgctaaggtgagcggtgccaggttctactacctcctcaacgagctcgttatccttgaccttgccttgatacgcttcgctctggataagctcatcgagaagggctttactccagtaatccccccatacatggttaggcgtttcgttgaagaaggtgcaaccaccttcgatgacttcgaagacgttatctacaaggtcgagggtgaggacctttacctcatcccgaccgctgagcacccgctcgctggcatgcacgccaacgaaatccttgacggaaaggacttaccgctcctctacgtcggcgtaagcccgtgcttcaggaaggaggcaggaactgcaggaaaggacacgaagggaatcttccgcgtacatcagttccacaaggtcgagcagttcgtttattcaaggccggaggagagctgggagtggcatgaaaggatcattgccaacgccgaggagatattccaggcacttgagattccctaccgcgtcgtgaacatttgtactggagatctaggctacgtagcagccaagaagtacgacatagaggcctggatggctggccagggcaagttcagggaagtggtttcggcgagcaactgtaccgactggcaggcgagaaggcttaacatccgcttccgcgacaagacccacgagaagcccaggttcgtccacacgctcaactcaactgccatagcaacctcaagagccatcgttgctatcctcgaaaaccaccagacggaagaaggtgtagtaaagctcccgaaggccctctggaagtacactggcttcaaggagatactgccagcacacatgaaagagaaatgttgtcaggactga

SEQ ID NO: 5933 - protein, 455 aa, Pyrococcus kodakaraensis
MLDIKLIRENPEIVKRDLIKRGETEKLKWIDEILELDKKWRENLKKINQLRKERNQLAVQIGKRKKAGEPIDDLLKRSNEIVKQIEELEKENEELKKKIDYYLWRLPNITHESVPVGESDEDNVPIRFWGKAKVWEGFLETFKEQSLGKMEYEVLSWRPRLHVDMLELLRGADLERAAKVSGARFYYLLNELVILDLALIRFALDKLIEKGFTPVIPPYMVRRFVEEGATTFDDFEDVIYKVEGEDLYLIPTAEHPLAGMHANEILDGKDLPLLYVGVSPCFRKEAGTAGKDTKGIFRVHQFHKVEQFVYSRPEESWEWHERIIANAEEIFQALEIPYRVVNICTGDLGYVAAKKYDIEAWMAGQGKFREVVSASNCTDWQARRLNIRFRDKTHEKPRFVHTLNSTAIATSRAIVAILENHQTEEGVVKLPKALWKYTGFKEILPAHMKEKCCQD

SEQ ID NO: 5934 - DNA, 1284 bp, Rhizobium meliloti
  CDS (1)..(1284): transl_table=11
atgctcgatatcaaatggatccgtgagaatgcagacgcgctcgatgaagccctggcgaaacggggtgcggagccattgtcggcgtccctgatcgcacttgacgaacgccgccgcgcagtcctccagtcgttgcaggacatgcagtcgcggcgcaatgctgcgtcgaaggagatcggcgcggcgatggcccagaagaacagcgagctggccgacaggctcaaggccgaagtcgccgacctcaagaatgcgttgccggcggccgaagaggaaagccgccggatcgaggccgagctctcggatgcgctgtcgcgcatccccaacacgccgctcgccgacgtgcccgtcggtgcggacgaaagcgcaaatgtcgtgacccgggtcgtcggcgccaagcccggctggaaccacaagcctctcgagcatttcgagatcggcgaggcgctgggactgatggacttcgaaggagcggcccggattgccggctcgcgcttcaccatcctgaagggccagcttgcacgcctcgagcgggcactcggccagttcatgcttgatctgcataccggggagcatggctacatcgaggttcagcctccattgctcgtccgcgacgatgcgatgtacggcaccggacagttgccgaaattctccgacgatctcttccgtacgaccgacgggcgctggctgatcccgaccgcggaagtcccgctgacgaacatggtgcgggagcagattctcgacggtgaaaaactaccgttgcgcttcactgcgctgaccccgtgcttccgctccgaggccggttccgcaggtcgtgacacccgcggcatgttgcgccagcatcagttcaacaaggtcgaactggtgtcgatcaccgacgccgaaagttcgatagacgagcacgagcggatgaccgcttgtgccgaggaggtgctgaagcgcctcggcctgcactaccgcgtcatgacgctctgcaccggcgatatggggttcggcgcgcgcaagacctatgatctcgaggtctggctgccgggccaggacgcctatcgcgaaatttcctcctgctccgtctgcggcgatttccaggcccgccggatgaacgcacgttaccgcgggaaagaagagaaggggacgaagttcgtccacacgctcaacggatccggcgtcgccctcggccgggcgctgattgccgtgatcgagaattacctgaatgatgacggctcgatcacggtgccggacgtccttgtgccctatatgggcggcctgcggcggatcgagaaatcggcctaa

SEQ ID NO: 5935 - protein, 427 aa, Rhizobium meliloti
MLDIKWIRENADALDEALAKRGAEPLSASLIALDERRRAVLQSLQDMQSRRNAASKEIGAAMAQKNSELADRLKAEVADLKNALPAAEEESRRIEAELSDALSRIPNTPLADVPVGADESANVVTRVVGAKPGWNHKPLEHFEIGEALGLMDFEGAARIAGSRFTILKGQLARLERALGQFMLDLHTGEHGYIEVQPPLLVRDDAMYGTGQLPKFSDDLFRTTDGRWLIPTAEVPLTNMVREQILDGEKLPLRFTALTPCFRSEAGSAGRDTRGMLRQHQFNKVELVSITDAESSIDEHERMTACAEEVLKRLGLHYRVMTLCTGDMGFGARKTYDLEVWLPGQDAYREISSCSVCGDFQARRMNARYRGKEEKGTKFVHTLNGSGVALGRALIAVIENYLNDDGSITVPDVLVPYMGGLRRIEKSA

SEQ ID NO: 5936 - DNA, 1281 bp, Rhodopirellula baltica
  CDS (1)..(1281): transl_table=11
atgctcgatcgcaaattcattctgcaaaatgcccagcttgtcgctgaaaattccgccaagcgtggcgtttctgtcgacgtcgacgcgatttgccgtctggaagccgaacggatggacgcgctgaagcaggcggaggagctgaatcggcaggccaacgaagtcagcaagcagatcaaatccgcgaaagacaacgacgagcgtcaggaattgatcgccaaaggtcgcagccttcgcgagcaaaaggatgccgccggtgccgcgcaagatcgcttggaagccgaaatcctcgagctgcaaacgattcttccgaacatgacccacccggatgtgcccgagggtggtgagcacgatgcgaacgagattggccgcggcaaaacgccagtgcctgaaatggacttccaaccgctggaccatcttcagctcggcgagaagcacgatttgtttgacttcgaaggcggagcccgcgtggccgggtccggtttctatttcttgcgaaacgccgccgtgcgtttggatttggcactgcaacaattcgcgatttcgcacttggccggcaaaggcttcacgccggtttcaacacctgacctggcgctgaccagcgtgctgcaaggcaccggattcaacccgcgtggtcccgagacacaaatctacagcatcgaaaataccgaattgaacttggtcgcgacggcggagatccctctgggcggaatgctcagtggtcagattctcgccagcgaagaattgccgcttcgttattgcgggctgagtcactgctttcgaaccgaagccggtgcggccggtcgagccagcaaggggctgtaccgagtccaccagttcaccaaagtcgaaatgttcgccttcacgttgcccgatcagagcaccgcgatgcatgaagagatgcgtgaactggaatgcgaaatctttgacgcgttggaagtgccctaccgagtgatcgacaccgcgacgggagacttgggcggacctgcgtaccgcaagtacgacttggaagcttggatgcctggacgtggcgaatcgggcgactggggcgaagtcaccagcaccagcaattgcaccgactaccaagctcgccgattgaatgtgcggtcgaagtccaacacccagaagggaaccgactttgttcacacgctcaacggcaccgcgattgcaaccggacgagccatgattgccatcttggaaaaccaccaacgtgctgacggaacgatcaatgttcctgaaatcttgcggccatgggttggctgtgacgttttgaaatgtgagtga

SEQ ID NO: 5937 - protein, 426 aa, Rhodopirellula baltica
MLDRKFILQNAQLVAENSAKRGVSVDVDAICRLEAERMDALKQAEELNRQANEVSKQIKSAKDNDERQELIAKGRSLREQKDAAGAAQDRLEAEILELQTILPNMTHPDVPEGGEHDANEIGRGKTPVPEMDFQPLDHLQLGEKHDLFDFEGGARVAGSGFYFLRNAAVRLDLALQQFAISHLAGKGFTPVSTPDLALTSVLQGTGFNPRGPETQIYSIENTELNLVATAEIPLGGMLSGQILASEELPLRYCGLSHCFRTEAGAAGRASKGLYRVHQFTKVEMFAFTLPDQSTAMHEEMRELECEIFDALEVPYRVIDTATGDLGGPAYRKYDLEAWMPGRGESGDWGEVTSTSNCTDYQARRLNVRSKSNTQKGTDFVHTLNGTAIATGRAMIAILENHQRADGTINVPEILRPWVGCDVLKCE

SEQ ID NO: 5938 - DNA, 1287 bp, Staphylococcus aureus
  CDS (1)..(1287): transl_table=11
atgttagacattagattattcagaaatgagcctgacacagttaagagcaaaattgaattacgtggagatgatccaaaagttgtagatgaaattttagaattggatgagcaacgacgtaaattaattagtgcaacagaagaaatgaaagcacgtcgtaataaagtaagcgaagaaatcgcattaaaaaaacgtaataaagaaaatgctgatgatgtgattgctgaaatgcgcacattaggtgacgatattaaagaaaaagatagtcaattaaatgaaattgataataaaatgacaggtatcctttgtcgtattccaaatttaataagtgatgatgtacctcaaggtgaatctgatgaagataacgttgaagttaaaaagtggggtacaccacgtgagttttcatttgaaccaaaagcacattgggatattgtagaagaattgaaaatggctgattttgatcgtgcagcaaaagtttcaggtgcgcgttttgtatatttaacaaatgaaggtgcgcaattagagcgtgctttaatgaactatatgattacaaaacatacaacacaacatggttatacagaaatgatggtaccacagcttgtgaacgcagatacaatgtatggtacaggtcaattacctaaatttgaagaagatttatttaaagtagaaaaagaaggattatatacaattccaactgctgaagtaccattaacgaatttctaccgtaatgaaattattcaaccaggtgtacttcctgaaaaattcactggtcaatctgcatgtttccgtagtgaagcaggatcagcaggtagagatacaagaggattaattcgtttacatcaattcgataaagtggaaatggtacgttttgaacaacctgaagattcatggaatgctttagaagaaatgacaacaaatgcagaagcaattctagaagagttaggtttaccataccgtcgtgttattttatgtacaggtgatattggatttagtgcaagcaaaacatatgatatagaagtttggttaccaagctacaatgattataaagaaattagttcatgctcaaactgtacggatttccaagcgcgtcgtgctaacatccgcttcaagcgtgacaaagcagctaaaccagaattagcacatacattaaatggtagtggtttagcagttggacgtacatttgctgctattgttgaaaattaccaaaatgaagatggaacagtaacaattccagaagcattagtaccatttatgggtggtaaaacacaaatttcaaaaccagttaaataa

SEQ ID NO: 5939 - protein, 428 aa, Staphylococcus aureus
MLDIRLFRNEPDTVKSKIELRGDDPKVVDEILELDEQRRKLISATEEMKARRNKVSEEIALKKRNKENADDVIAEMRTLGDDIKEKDSQLNEIDNKMTGILCRIPNLISDDVPQGESDEDNVEVKKWGTPREFSFEPKAHWDIVEELKMADFDRAAKVSGARFVYLTNEGAQLERALMNYMITKHTTQHGYTEMMVPQLVNADTMYGTGQLPKFEEDLFKVEKEGLYTIPTAEVPLTNFYRNEIIQPGVLPEKFTGQSACFRSEAGSAGRDTRGLIRLHQFDKVEMVRFEQPEDSWNALEEMTTNAEAILEELGLPYRRVILCTGDIGFSASKTYDIEVWLPSYNDYKEISSCSNCTDFQARRANIRFKRDKAAKPELAHTLNGSGLAVGRTFAAIVENYQNEDGTVTIPEALVPFMGGKTQISKPVK

SEQ ID NO: 5940 - DNA, 1287 bp, Staphylococcus aureus
  CDS (1)..(1287): transl_table=11
atgttagacattagattattcagaaatgagcctgacacagttaagagcaaaattgaattacgcggagatgatccaaaagttgtagatgaaattttagaattggatgagcaacgacgtaaattaattagtgcaacagaagaaatgaaagcacgtcgtaataaagtaagcgaagaaatcgcattaaaaaaacgtaataaagaaaatgctgatgatgtgattgctgaaatgcgcacattaggtgacgatattaaagaaaaagatagtcaattaaatgaaattgatagtaaaatgacaggtatcctttgtcgtattccaaatttaataagtgatgatgtacctcaaggtgaatctgatgaagataacgttgaagttaaaaagtggggtacaccacgtgagttttcatttgaaccaaaagcacattgggatattgtagaagaattgaaaatggctgattttgatcgtgcagcaaaagtttcaggtgcgcgttttgtatatttaacaaatgaaggtgcgcaattagagcgtgctttaatgaactatatgattacaaaacatacaacacaacatggttatacagaaatgatggtaccacagcttgtaaacgcagatacaatgtatggtacaggtcaattacctaaatttgaagaagatttatttaaagtagaaaaagaaggattatatacaattccaactgctgaagtaccattaacgaatttctatcgtaatgaaattattcaaccaggtgtacttcctgaaaaattcactggtcaatctgcatgtttccgtagtgaagcaggatcagcaggtagagatacaagaggattaattcgtttacatcaattcgataaagtggaaatggtacgttttgaacaacctgaagattcatggaatgctttagaagaaatgacaacaaacgcagaagcaattttagaagagttaggtttaccataccgtcgtgttattttatgtacaggtgatattggatttagtgcaagcaaaacatatgatttagaagtttggttaccaagctacaatgattataaagaaattagttcatgctcaaactgtacggatttccaagcgcgtcgtgctaacatccgcttcaagcgtgacaaagcagctaaaccagaattagcacatacattaaatggtagtggtttagcagttggacgtacatttgctgctattgttgaaaattaccaaaatgaagatggaacagtaacaattccagaagcattagtaccatttatgggtggtaaaacacaaatttcaaaaccagttaaataa

SEQ ID NO: 5941 - protein, 428 aa, Staphylococcus aureus
MLDIRLFRNEPDTVKSKIELRGDDPKVVDEILELDEQRRKLISATEEMKARRNKVSEEIALKKRNKENADDVIAEMRTLGDDIKEKDSQLNEIDSKMTGILCRIPNLISDDVPQGESDEDNVEVKKWGTPREFSFEPKAHWDIVEELKMADFDRAAKVSGARFVYLTNEGAQLERALMNYMITKHTTQHGYTEMMVPQLVNADTMYGTGQLPKFEEDLFKVEKEGLYTIPTAEVPLTNFYRNEIIQPGVLPEKFTGQSACFRSEAGSAGRDTRGLIRLHQFDKVEMVRFEQPEDSWNALEEMTTNAEAILEELGLPYRRVILCTGDIGFSASKTYDLEVWLPSYNDYKEISSCSNCTDFQARRANIRFKRDKAAKPELAHTLNGSGLAVGRTFAAIVENYQNEDGTVTIPEALVPFMGGKTQISKPVK

SEQ ID NO: 5942 - DNA, 1374 bp, Sulfolobus solfataricus
  CDS (1)..(1374): transl_table=11
atgtcgtggagtatcctagagcttttgcgaaaaaatccggaggatttgaaaaataatttgaaaagacgggctatagatgtttctttagtagataaagcagtagaattggacaaaaaatggagacaagtattacaagaagttgaaaaattaaggcatcaacataatgttttaagttcacagatttctaagctctctggagaagagagaaaaaagaaaattgaggaaagcaaaaacttattgaaaatcctagaagaaaaagaaaaagaactagaagaaatagagaatgaaagagatagattactatcatctctaccgaaccttgtagctgacgacgtcccaaacggtccggacgatagctataacgttcctattaagttttgggggaagtttaaagtatatgagggagacgttcaagaatttctaaagcagatcaaggatgctaaagtaaactatgaagtaattaaatggaaaccgaaagggcatgcggaaatgctagaagatgtattacatttaggaaatacgctgaaagcagctgaaattgcgggttctagattttactatttatttaatgatatagtttggctagacttctctctactacttttcgcaatcgattacattactcagcaagggtatactttagttctccctccttatatgctaaggggagaggttatacaatcagtaatagacctagacacgtttaaggatgctatatataagatagaaaacgaggatttatatctgattgcaaccgcagaacaccctatagcagctatgttctttaaagaagaaattgagaaagataaattacccttaaaattcgccggaattagtccagcttttagaaaagaagcaagtgctgcaaataaggatttaaagggaattttcagagttcatcaatttcataaagttgaacagtttatattttcaactccagaagatagttggaaatatcatagtgaattgataacgaatgctgaaagtatatttcagcaactcgaattgccatacagaattgtaaatatagcgtcaggtgatttaggtgcatgcgctgcaaagaaattcgatttagaggtatggatgccagctcaggccaaatttagagaaatggtaagttgtagcaattgtacggattggcaagctttcagaatgaagataagatatgtggatagaaaaaataatagaaggggctacgtacatacattaaatagtactgcaatagctagcacaagaactataacagctattctagaaaattatcagagagaagatggtgttgtcgaggtaccaaaagtactaagaaaatatcttgaggcgtttccgaaggctcctaaagattatatatacccgctaaaaaataagataatttag

SEQ ID NO: 5943 - protein, 457 aa, Sulfolobus solfataricus
MSWSILELLRKNPEDLKNNLKRRAIDVSLVDKAVELDKKWRQVLQEVEKLRHQHNVLSSQISKLSGEERKKKIEESKNLLKILEEKEKELEEIENERDRLLSSLPNLVADDVPNGPDDSYNVPIKFWGKFKVYEGDVQEFLKQIKDAKVNYEVIKWKPKGHAEMLEDVLHLGNTLKAAEIAGSRFYYLFNDIVWLDFSLLLFAIDYITQQGYTLVLPPYMLRGEVIQSVIDLDTFKDAIYKIENEDLYLIATAEHPIAAMFFKEEIEKDKLPLKFAGISPAFRKEASAANKDLKGIFRVHQFHKVEQFIFSTPEDSWKYHSELITNAESIFQQLELPYRIVNIASGDLGACAAKKFDLEVWMPAQAKFREMVSCSNCTDWQAFRMKIRYVDRKNNRRGYVHTLNSTAIASTRTITAILENYQREDGVVEVPKVLRKYLEAFPKAPKDYIYPLKNKII

SEQ ID NO: 5944 - DNA, 1326 bp, Thermoplasma acidophilum
  CDS (1)..(1326): transl_table=11
atgatagacgtaaagctcctgagatccaatagagaactgtttgagaaaaactgcgaatacaggggggtggataaggcaccggttgaggatttcttcaggcttgatgaggagtggagatccataaacagggaattgaacggattgagatcgcagaagaatagggagacgaggaagattgcagaactcataaagaataacggagacgcttcagcagagaagaaagcggttgaggatataaacgccagaatttcagatcttgaaaataaactgaagaagatcgaggaggagagggacaggatactgtggaccatccccaatcttgtccatgaaagcgtacctgtttgctttggtgatgagaataatcagctggtcagatatgtcgggcacgcgaaggtattccgggatgatatcgaggagttcaaaaagaattcaggaaacagccaagattacgaagttctggatgagaggccaaagagccatgtggatcttggcctggacctgaacgtcatcgatctcgagagcgcggctagaatatcgggttcgcgtttctacttcatcaagaacaggctgctcaagctggaaatggcgcttgagaactatgcggtggatttcctttcgcagagagggttttcgatagtggaacccccctatatgctgaatctggagagcatgcgcggcgctacggatctggagacgttcaaggataccctttacaagatcgagggtgaagatctttaccttatagcaacttcggagcattccatagcagcgatgctctcaaaccagttccttgaggagaaggatctgcctctcagggtggccggtatatcggcatgcttcaggcgtgaggccggtgcgcatggaaaggatacaaagggtatattccgtgtacatcagttcaacaagatagagcagttcgttttctgcaagccggaggactcgtgggatttccttgaggagattctcggcaatgctgaagccatatacaggagcctgggaataccatacagggtcgtcaacgtgtgctcgggagaactcggccggctagcggcaaagaagtacgatatagaggcctggttcccggctcaaggcaagttcagggagatagtgtcggcttcaaacgacacggactatcaggcaagatcgctgaatataaagtacaggaccagcgaagggaatagattcgtccacacgctcaacagcacggcgatagcgacgactaggatactggtagccataatggagaacttccaggaaggcgacagaataaggatacctgatgtacttgttccctacactggatttcaatacatagagaagggatga

SEQ ID NO: 5945 - protein, 441 aa, Thermoplasma acidophilum
MIDVKLLRSNRELFEKNCEYRGVDKAPVEDFFRLDEEWRSINRELNGLRSQKNRETRKIAELIKNNGDASAEKKAVEDINARISDLENKLKKIEEERDRILWTIPNLVHESVPVCFGDENNQLVRYVGHAKVFRDDIEEFKKNSGNSQDYEVLDERPKSHVDLGLDLNVIDLESAARISGSRFYFIKNRLLKLEMALENYAVDFLSQRGFSIVEPPYMLNLESMRGATDLETFKDTLYKIEGEDLYLIATSEHSIAAMLSNQFLEEKDLPLRVAGISACFRREAGAHGKDTKGIFRVHQFNKIEQFVFCKPEDSWDFLEEILGNAEAIYRSLGIPYRVVNVCSGELGRLAAKKYDIEAWFPAQGKFREIVSASNDTDYQARSLNIKYRTSEGNRFVHTLNSTAIATTRILVAIMENFQEGDRIRIPDVLVPYTGFQYIEKG

SEQ ID NO: 5946 - DNA, 1278 bp, Thermotoga maritima
  CDS (1)..(1278): transl_table=11
atgatagatataaagctcatcagacaaaatcccgatttcgtgaaggaagccctcagaaagcgaggagaggatcccgctataatcgatgagattttgaagatcgacgccgactggcgcgctaccatcacgaaaaccaacgagctgagatccagaagaaacgaaatttccaaaaatgtggcaaggttgaaaaaagaagggaaaaacgcagaggcagaggcactcatcgaggaagggaaaagattaggagaagagataaaagcgttagaagaaaaagaaaaagaacttcagaagaagttaaacgatcttcttttgatgattccgaacatcccgcatgagagtgtccccgttggagaagacgaatctcagaacgttgaagtgagaaggtggggagagccgagagaattcgacttcaccccgctcgctcactgggacctcggacctgcgtgggggctcatggatttcagcagggcgtccaagctcagcggttccagattcaccgttatgtatggaaaactcgcaagactcgagagggctctgataaacttcatgcttgacgttcatacaaaggaacacggttacacggaagtgtgggttccacacctggtgaaaagagaaaccatcaccataaccggacagctccccaaattcgaagaagagctttatcttgctgagagggatgacctgttcctcattccgacggctgaggttcccctcgcagcgcttcacagtggagagatcctcgaagagaaagaactaccaaagaaatacgtctcttacactccctgttaccgcagagaagcgggaagttacgggaaagacgtgagggggatgatcaggcagcatcaattcgacaaggtcgagctcgtctgggtgaccacaccggaaagatccttcgaagatcttgaagagcttgtgaaagacgccgaaaccattcttagaaaattggagctcccttacagagtcgtttcgctctgtacgggagatctcggattcacctccgcgaaaacctacgatatagaagtgtggcttccttcctacaacgcatacaaagagatatcttcctgcagtaacgtgacggactttcaggcgagaagaggaaacatgagatacagaaggagatcggatggaaagctcgaatacgttcacacgttgaacggatcgggtatcgccgttggaagggcactcgttgcgatactggaaaactaccagcaaccagacggcagtgtgagagtgccggaggtgctcgttccctacacagggttcgaggtgataccgtag

SEQ ID NO: 5947 - protein, 425 aa, Thermotoga maritima
MIDIKLIRQNPDFVKEALRKRGEDPAIIDEILKIDADWRATITKTNELRSRRNEISKNVARLKKEGKNAEAEALIEEGKRLGEEIKALEEKEKELQKKLNDLLLMIPNIPHESVPVGEDESQNVEVRRWGEPREFDFTPLAHWDLGPAWGLMDFSRASKLSGSRFTVMYGKLARLERALINFMLDVHTKEHGYTEVWVPHLVKRETITITGQLPKFEEELYLAERDDLFLIPTAEVPLAALHSGEILEEKELPKKYVSYTPCYRREAGSYGKDVRGMIRQHQFDKVELVWVTTPERSFEDLEELVKDAETILRKLELPYRVVSLCTGDLGFTSAKTYDIEVWLPSYNAYKEISSCSNVTDFQARRGNMRYRRRSDGKLEYVHTLNGSGIAVGRALVAILENYQQPDGSVRVPEVLVPYTGFEVIP

SEQ ID NO: 5948 - DNA, 1326 bp, Thermoplasma volcanium
  CDS (1)..(1326): transl_table=11
atgatagatgttaagcttctgcgctcaaacagagaactatttgagaagaattgtgagtatagaggtgtagataaggcaattatagatcaatttttcaagctggatgaagaatggagatctgtaaacagggagttgaatggtcaaagggctgaaaagaatcgcatgactagggctatcgcagagtccctaaaaagaggcaaaattgtaagtaatgagaaagatcgagtagagttgataaacgaaaagatagtttctttggaaaaaaagatcagggagatagaggaagaacgagatcgagttctgtggaccattccgaatttgatacatgaaagtgtacctatatgctttggtgatgaaaataataaaatagttaggtacgtagggcacgctaaggtatatagggatgatgaagaggagtttctcaaaggatcaggaggcaatggagattacgaagtcatcgacgagaggccgaaaagccatgtagatttaggccaggagctcggaataattgatttagaaagtgcagcgaaaatatcaggagcgaggttttattttataaaaaataggttgttgaagctggaaatggcactcgaaaactatgcagtggatttcctttcgcaaagaggctttaccgtagtcgagccgccgtatatgctgaaccttgaaagtatgaggggtgcaacagacctcgaaacgttcaaggatacgctttataaaatcgaagatgaagacctttatttaatagcaacgtctgaacattcaatagcttcaatgctttctaatgaatttcttgaagaaaaagagcttccaatacgcgttgccggagtttcggcttgcttcaggcgcgaggcaggcgctcatggaaaagatacaaagggtatattcagggtacatcagttcaacaagatagagcagttcatattctgcaagccagaagattcatgggattatcttgaggagatcctttcaaacgcagaggagatctacaggtcgttaggaatcccctatcgtgtcgtaaatgtctgctcaggtgaactaggtaggctggccgcaaagaaatacgatattgaggcctggttcccggcacagggtaaattcagggagattgtatctgcatctaacgatacagattatcaagcacgttcccttaacataaagtacaggaagagcggcgggaacgagttcgttcatacgctgaacagcacagccatagctaccacgaggatactggttgcaattatggaaaatttccaggaagatggcaggataagaatacctgatgtccttgtgccatatacaggattccagtatatagataaggaatga

SEQ ID NO: 5949 - protein, 441 aa, Thermoplasma volcanium
MIDVKLLRSNRELFEKNCEYRGVDKAIIDQFFKLDEEWRSVNRELNGQRAEKNRMTRAIAESLKRGKIVSNEKDRVELINEKIVSLEKKIREIEEERDRVLWTIPNLIHESVPICFGDENNKIVRYVGHAKVYRDDEEEFLKGSGGNGDYEVIDERPKSHVDLGQELGIIDLESAAKISGARFYFIKNRLLKLEMALENYAVDFLSQRGFTVVEPPYMLNLESMRGATDLETFKDTLYKIEDEDLYLIATSEHSIASMLSNEFLEEKELPIRVAGVSACFRREAGAHGKDTKGIFRVHQFNKIEQFIFCKPEDSWDYLEEILSNAEEIYRSLGIPYRVVNVCSGELGRLAAKKYDIEAWFPAQGKFREIVSASNDTDYQARSLNIKYRKSGGNEFVHTLNSTAIATTRILVAIMENFQEDGRIRIPDVLVPYTGFQYIDKE

SEQ ID NO: 5950 - DNA, 1269 bp, Treponema denticola
  CDS (1)..(1269): transl_table=11
atgttagactataaatttattaaagaaaatgttgaagccgtaaaacaaaatattaaaaaccggcacatgaatgcggatgccgataaggcagtagaactatatgataagcgtactgccctcgttacttctttgcagaacctgcaaaaagatcgaaacgataactcacagtcaatgaagcaaaaattaagtcccgaagaaagacaaaaactggtcgaccaagggaaagctataaaagaaaaaatcgcccaagttgaagccgaactggccgaggccgaaaaagccctgcatgaggccgtaagtaaaattccgaatatggctcatcccgaagcccccgtcggcaaagaagattccgacaatttggaagttaagcgctgcggaactgtgcccaagtttgactttgagcccaaagaccatgttcagttgggccaagatttggatcttatcgactttgaagccggcacaaaggtttcaggcgttaaattctattttttaaaaaacgaagccgtatttttggagcaagctcttacgatgtacggtcttaacatattgcggaaacacgggtttaaaccctttataactccggacattgcaaaagaagaaatcttatacggtataggctttaatccacgaggcgaagaatcaaacgtctattctcttgaaggcgagggcacttgcttggttgcaactgccgagattactctgggcggctatcactcggacgagattatcaaaaaagaaagcttgccgttaaaatactgcggtctttctcattgctttagacgtgaagcgggagccgccggacagttttcaaaggggctttacagggttcatcagttttcaaaactcgaaatgtttgtttattgtacacctgaagaatcggatgcccttcatgaagagctccgcttaattgaagaagaaatcttcaacggtttgggaattccgttcagggttgtcgatacctgcaccggagaccttggagctcctgcctaccgaaagtgggacttggaagcatggatgcccggaagaaacggaggcgaatggggcgaggttacctctacttcaaactgtaccgattatcaggcacgccgcttaaatatacgctacaaggacgatgacggtaaaaacaaatttcttcatactctaaacggaactgctttggcgatgtcgagggctatgatagccgtcttggaaaattatcagcaagctgacggttccattaagataccggaagctcttgttccttattgcggttttgatagaatcggttaa

SEQ ID NO: 5951 - protein, 422 aa, Treponema denticola
MLDYKFIKENVEAVKQNIKNRHMNADADKAVELYDKRTALVTSLQNLQKDRNDNSQSMKQKLSPEERQKLVDQGKAIKEKIAQVEAELAEAEKALHEAVSKIPNMAHPEAPVGKEDSDNLEVKRCGTVPKFDFEPKDHVQLGQDLDLIDFEAGTKVSGVKFYFLKNEAVFLEQALTMYGLNILRKHGFKPFITPDIAKEEILYGIGFNPRGEESNVYSLEGEGTCLVATAEITLGGYHSDEIIKKESLPLKYCGLSHCFRREAGAAGQFSKGLYRVHQFSKLEMFVYCTPEESDALHEELRLIEEEIFNGLGIPFRVVDTCTGDLGAPAYRKWDLEAWMPGRNGGEWGEVTSTSNCTDYQARRLNIRYKDDDGKNKFLHTLNGTALAMSRAMIAVLENYQQADGSIKIPEALVPYCGFDRIG

SEQ ID NO: 5952 - DNA, 1338 bp, Oryza sativa
  CDS (1)..(1338)
atgctcgacatcaacctcttccgcacggagaagggcggcgacccggagctgatccgcaggtcgcagcgcaaccgctccgcctccgtcgagctcgtcgacgaggtcatcgccctcgacgaccagtggcgccagaggcaattcgagctcgacaaaatccggcaggagctcaacaaaaccagcaaggaaatcggcaagctcaaggctaaaaaggaggacgcgtcggctctgattcagagcacggaagagattaagaagaggttggctgccaaggagacggaggtgcaggaggccaagggcacgctcgatgccaagctcgtgacgattggaaacattgtgcatgaatccgtccctgtcagcgatgacgaggctaacaatttaattgtacggacatggggagagaggaggctggagggtaatttgaagaatcacgtggatctttgtaagatgcttgacatagtagctttggagaaaggtgctgatgtagcaggtggaaggggttactatttaaaggatgaaggtgtcctactgaacttggcattgataaattttggactcgcttttctgagaaagcgaggcttcaagccaatgcaaactccttttttcatgagaaaggaaaccatgggaaaatgtgcccagttggcccaatttgacgaagagctttacaagctaacaggcgatggagaggaaaagtatctcatcgctacatccgagcaaccgctgtgtgcgtatcatctaggtgatcgaatttatcctgctgaattgccaattagatatgctggatattccacctgcttccggaaagaagctggttcacatggaagggacacggctggtatcttcagagtccaccaattcgaaaagattgagcaattctgtgttacaagtccaaatgacaatgaatcctgggagatgcatgaagaaatgataaaaaattcagaagatttctacaaggagattggcctaccgtaccaacttgtctccattgtgtctggtgctcttaatgatgctgcagctaagaagtatgatttagaagcatggttccctgcatcaaaaacctatagggaattagtgtcctgctcaaattgcacagattttcaagcaaggagacttggtataggttatggccagaaaaagaatgatgagcaatccaagcaattcgttcatatgttgaactcaacattgactgccactgagaggaccctttgctgtattttggagaacttccagaaggagaatggtgtcgaagttccaaaagcattgcagccttacatgggtggaatcgatttccttcctttcaagctggatagcaaacaagttgctcgactccaaatcaaataa

SEQ ID NO: 5953 - protein, 445 aa, Oryza sativa
MLDINLFRTEKGGDPELIRRSQRNRSASVELVDEVIALDDQWRQRQFELDKIRQELNKTSKEIGKLKAKKEDASALIQSTEEIKKRLAAKETEVQEAKGTLDAKLVTIGNIVHESVPVSDDEANNLIVRTWGERRLEGNLKNHVDLCKMLDIVALEKGADVAGGRGYYLKDEGVLLNLALINFGLAFLRKRGFKPMQTPFFMRKETMGKCAQLAQFDEELYKLTGDGEEKYLIATSEQPLCAYHLGDRIYPAELPIRYAGYSTCFRKEAGSHGRDTAGIFRVHQFEKIEQFCVTSPNDNESWEMHEEMIKNSEDFYKEIGLPYQLVSIVSGALNDAAAKKYDLEAWFPASKTYRELVSCSNCTDFQARRLGIGYGQKKNDEQSKQFVHMLNSTLTATERTLCCILENFQKENGVEVPKALQPYMGGIDFLPFKLDSKQVARLQIK

SEQ ID NO: 5954 - DNA, 1554 bp, Brassica napus
  CDS (1)..(1554)
atgggtttacacacactgagactcgccaccgtccctttgaccttctccacattcacctctcgcctcttcctcaaaccaatccctcccaatactctccaaacacttggtcaattctcccgccatgttcaaccgcgtaagcctttcctcgtcagagccttctccgcttcccccgccgctgtacaagagactccacccacgcaagcttcggattcctctgctgcgaggcctcagtggaaggcctccattgacttcaagtggataagggataacaaggaagcggtcgaaatcaatatcaagaatagaaactcgaatgctgatttgggaggtgtgatcgagctttacgagaacatggtcaatctccagaaggaagttgaggggattcgtgaggaaaggaacaacgttgccaagaagatgaaagggaagcttgaaccttcagaacgtgaaagactcgttgaagaaggtaaaagtcttaaggagagtcttgtaactctggaagaagacctcgtgaagcttcaagatgagctccaacaagtggcaaggtctataccaaatatgactcaccctgatgttcctattggtggagaggattcatcggctattagaaaggaggttggtagtccacgtgagtttacctttccaatcagggatcatcttcagcttgggaaggatcttgatctcattgattttgactccgcttcagaggtaagtggttcgaagttcttctatttgaagaatgaggcagtgttactagagatggccctccttaactggacgttatcagaagtcatgaagaagggctttactcccctaacgacccctgagatcgtgagatcttctattgttgagaaatgcggtttccaacctcgtggagataatactcaggtttattctatagatggaactgaccaatgtctcattggcaccgccgaaatccccgtaggaggaatacacatggattcaattcttcttgaatcagcactacctttgaaatatatagcattctctcattgcttccgtactgaagcaggtgcagctggcgccgccacaaaaggtctttacagagtccatcaattcagcaaagcagaaatgtttatcctgtgcagacctgaagatagtgaaacctgccacaacgaactcattcagatcgaagaagacctcttcacttctctaggactacacttcaaaacactggacatggccacagcagatttaggcgctccagcttaccgcaagtttgacattgaagcatggatgcccggtttacgaagatttggcgagatatcaagcgcatcgaactgcacggattaccaaagccggagactgggaatccgttaccgcccatctgaaccggttcagactggttccaagaaaggcaaagcgagtcttccagctactaagtttgtacacactctaaacgctacagcttgtgctgtcccaaggatgatggtgtgtttgctggagaattaccagcaagaagatggatctgtggtgatccctgagccccttaggccgttcatgggaggcattgagcttattaaacccaagcttagataa

SEQ ID NO: 5955 - protein, 517 aa, Brassica napus
MGLHTLRLATVPLTFSTFTSRLFLKPIPPNTLQTLGQFSRHVQPRKPFLVRAFSASPAAVQETPPTQASDSSAARPQWKASIDFKWIRDNKEAVEINIKNRNSNADLGGVIELYENMVNLQKEVEGIREERNNVAKKMKGKLEPSERERLVEEGKSLKESLVTLEEDLVKLQDELQQVARSIPNMTHPDVPIGGEDSSAIRKEVGSPREFTFPIRDHLQLGKDLDLIDFDSASEVSGSKFFYLKNEAVLLEMALLNWTLSEVMKKGFTPLTTPEIVRSSIVEKCGFQPRGDNTQVYSIDGTDQCLIGTAEIPVGGIHMDSILLESALPLKYIAFSHCFRTEAGAAGAATKGLYRVHQFSKAEMFILCRPEDSETCHNELIQIEEDLFTSLGLHFKTLDMATADLGAPAYRKFDIEAWMPGLRRFGEISSASNCTDYQSRRLGIRYRPSEPVQTGSKKGKASLPATKFVHTLNATACAVPRMMVCLLENYQQEDGSVVIPEPLRPFMGGIELIKPKLR

SEQ ID NO: 5956 - DNA, 1521 bp, Glycine max
  CDS (1)..(1521)
atgatgggcttacatggttgtactctcaaactcgcttcagttcccaatttctcttctccaactttccttttcaaaactccaaccctccgttttcagaaatctccattgtcacgccccatcagagctctatcttcctccgccctcgtccaaacatctactaccaaggccactgaagaccaaggtgtgaagcctcaatggaaggccacgatagacttcaagtggataaaggataacaaggaagctgttgctgccaacttaaagaaccgcaactctgatgctgatttgaacctcgtgctccacctttatgacaaaatgttcactcttcagaagatagcagggagggttcgtggtgaaagaaatgcagtggctaacaagatgaaagggaaactagaacagtctgagcgtcaaagattgattgaggaaggtaagaatttgaaggagggacttgctgctttggaagaagacttggcgaagcttaatgatgagcttcaacaggaagcgcagtgtataccaaacatgactcatccagatgttccaataggaggggaggattgttccaccataaggaagatggttggtagctctcccaaatttagctttcctgtcaaggatcatctccaactaggaaaggagcttgatctatttgattttgatgcagctgcagaggtcagtgggtcaaagttctactacctgaaaaatgaagcagttttgttagagatggctcttgtaaattggacactctctgaagtgatgaagagaggctttactccattaacaacgcctgaacttgtgcgatcctctgtggttgaaaaatgtggattccaacctcgtgcaaataatacccagatttattccatcgctgacagtgaccaatgcctcattggcactgcagagattcctgtcggtggccttcatatggattctatactctctgattcattgttacctttaaaatatgtggcattttctcattgtttccgtaccgaggctggtgctgctggcactgcaacaaggggtctttatcgagttcaccaattcagcaaggtggaaatgtttattttctgccgcccagaagagagtgaacattaccaccaagagcttattacaatcgaagaagacctcttctcatccctgggattgcattttaaaactttggatatggcttctgaagatttaggtgcacctgcctatcagaaattcgatgtggaggcttggatgcctggtttagaacggtttggtgagatctcaagcgcatcaaattgcacagactatcagagccgtcgtttgggaataaggtatcgtcctgcatcagaagcacaagccacaagtgcaaaaaaatctaaaggcaatcttgccccacctcagtttgttcatacattaaatgcaacagcttgtgctgtaccacggatgattatatgtttgcttgagaattaccaacaagaagatggatctgtccttatacctgagcccttgaggcccttcatgggtggccttagtgtcatcgccagaaaatcattatga

SEQ ID NO: 5957 - protein, 506 aa, Glycine max
MMGLHGCTLKLASVPNFSSPTFLFKTPTLRFQKSPLSRPIRALSSSALVQTSTTKATEDQGVKPQWKATIDFKWIKDNKEAVAANLKNRNSDADLNLVLHLYDKMFTLQKIAGRVRGERNAVANKMKGKLEQSERQRLIEEGKNLKEGLAALEEDLAKLNDELQQEAQCIPNMTHPDVPIGGEDCSTIRKMVGSSPKFSFPVKDHLQLGKELDLFDFDAAAEVSGSKFYYLKNEAVLLEMALVNWTLSEVMKRGFTPLTTPELVRSSVVEKCGFQPRANNTQIYSIADSDQCLIGTAEIPVGGLHMDSILSDSLLPLKYVAFSHCFRTEAGAAGTATRGLYRVHQFSKVEMFIFCRPEESEHYHQELITIEEDLFSSLGLHFKTLDMASEDLGAPAYQKFDVEAWMPGLERFGEISSASNCTDYQSRRLGIRYRPASEAQATSAKKSKGNLAPPQFVHTLNATACAVPRMIICLLENYQQEDGSVLIPEPLRPFMGGLSVIARKSL

SEQ ID NO: 5958 - DNA, 1539 bp, Zea mays
  CDS (1)..(1539)
atgctgacctgcggccgctttatctcctcctccgctgctaccagcaccgcatcctttttcccgtttcggactctcacccgctccctcgttcgccgccccgctccccacctcctctcctctgcctccgccgccgccgccaccgccgtggaactcgacaccaatggagacggtagtgcgggaggtggtgccggtgtggtgaggccgcagtggaaggccgcgattgatttcaaatggatccgagacaaccgggatgccgtcgccgacaacatccggacccggaactctaccgccaatctggacctcgtcttcgagctctacgatcagtacctcacactgcagaaggaggttgaaaggctccgagctgaaagaaatgcggttgccaacaagatgaaagggaaactagacccatctgttcgccaagcccttgttgaagaaggtaagaacctgaaagagggacttatagcactcgaggaggatcttgttcagctgacagataagcttcaacttgaagctcaaagtattcctaacactacccatccagatgttcctgttgggggtgaggaaagctctgtcctcaggaaagaggtaggcagtcagaggagcttcaattttgcaatcaaagatcatcttcagctggggaaggaacttgatttgtttgactttgatgcagcagccgaggtcagtggttcgaagttctactacttaaagaatgaagctgttttgttggagatggccctagtaaactgggctatttcagaggtctccaagaagggtttcacaccactcataactccagagatcgtaagatcatctgttgttgagaaatgtggctttcagccaagggccaaaaacactcaggtatactcaattgaggacagtgatcagtgtctcataggcacagcggaaattcctgttggaggcatccacatggactcaatacttgccgaatccgctttgcctttaaaatatgtagcatattcacactgttttcgcacagaagcaggtgcagcaggtgctgccactaggggcctctatcgggtacatcaatttagcaaggttgagatgttcatattctgtcggccagaggagagtggaaaatggcatgaagaacttattacaattgaagaggatctttatgcatcacttggacttcatttcaaaactctggacatggcaactggggatctgggtgcaccagcctaccggaaatttgatatcgaggcgtggatgcccggcctagagcgttatggtgagatctccagtgcatcaaattgtaccgactaccaaagtaggcgactaggcatccgttaccgcccatcaccctcggagcctccatcaacgagcaccaagaaagggaagggagctgcctcaggccctacgcagttcgtccacacgctcaacgctacagcagtggcggtgcctcgtctgatagtttgcattctagagaattttcagcagggcgatgggtcgattgtggttccagagccactaagaccctatatgggtggactagagttgctctccccaaaattcaagtga

SEQ ID NO: 5959 - protein, 512 aa, Zea mays
MLTCGRFISSSAATSTASFFPFRTLTRSLVRRPAPHLLSSASAAAATAVELDTNGDGSAGGGAGVVRPQWKAAIDFKWIRDNRDAVADNIRTRNSTANLDLVFELYDQYLTLQKEVERLRAERNAVANKMKGKLDPSVRQALVEEGKNLKEGLIALEEDLVQLTDKLQLEAQSIPNTTHPDVPVGGEESSVLRKEVGSQRSFNFAIKDHLQLGKELDLFDFDAAAEVSGSKFYYLKNEAVLLEMALVNWAISEVSKKGFTPLITPEIVRSSVVEKCGFQPRAKNTQVYSIEDSDQCLIGTAEIPVGGIHMDSILAESALPLKYVAYSHCFRTEAGAAGAATRGLYRVHQFSKVEMFIFCRPEESGKWHEELITIEEDLYASLGLHFKTLDMATGDLGAPAYRKFDIEAWMPGLERYGEISSASNCTDYQSRRLGIRYRPSPSEPPSTSTKKGKGAASGPTQFVHTLNATAVAVPRLIVCILENFQQGDGSIVVPEPLRPYMGGLELLSPKFK

SEQ ID NO: 5960 - DNA, 27 bp, Artificial sequence
  primer
atgattataaggcgcttattttcaatt

SEQ ID NO: 5961 - DNA, 26 bp, Artificial sequence
  primer
ttaaatgtatcgttggccattcataa

SEQ ID NO: 5962 - protein, 492 aa, Artificial sequence
  consensus sequence
  Variant (2)..(11): Xaa in position 2 to 11 is any amino acid
  Variant (12)..(15): Xaa in position 12 to 15 is any or no amino acid
  Variant (17)..(32): Xaa in position 17 to 32 is any amino acid
  Variant (33)..(34): Xaa in position 33 to 34 is any or no amino acid
  Variant (36)..(84): Xaa in position 36 to 84 is any amino acid
  Variant (85)..(99): Xaa in position 85 to 99 is any or no amino acid
  Variant (102)..(105): Xaa in position 102 to 105 is any amino acid
  Variant (106)..(106): Xaa in position 106 is any or no amino acid
  Variant (109)..(130): Xaa in position 109 to 130 is any amino acid
  Variant (131)..(156): Xaa in position 131 to 156 is any or no amino acid
  Variant (158)..(165): Xaa in position 158 to 165 is any amino acid
  Variant (166)..(168): Xaa in position 166 to 168 is any or no amino acid
  Variant (170)..(177): Xaa in position 170 to 177 is any amino acid
  Variant (179)..(190): Xaa in position 179 to 190 is any amino acid
  Variant (192)..(193): Xaa in position 192 to 193 is any amino acid
  Variant (196)..(206): Xaa in position 196 to 206 is any amino acid
  Variant (207)..(207): Xaa in position 207 is any or no amino acid
  Variant (209)..(214): Xaa in position 209 to 214 is any amino acid
  Variant (216)..(244): Xaa in position 216 to 244 is any amino acid
  Variant (245)..(257): Xaa in position 245 to 257 is any or no amino acid
  Variant (259)..(260): Xaa in position 259 to 260 is any amino acid
  Variant (262)..(262): Xaa in position 262 is any amino acid
  Variant (264)..(277): Xaa in position 264 to 277 is any amino acid
  Variant (278)..(283): Xaa in position 278 to 283 is any or no amino acid
  Variant (285)..(292): Xaa in position 285 to 292 is any amino acid
  Variant (293)..(294): Xaa in position 293 to 294 is any or no amino acid
  Variant (298)..(298): Xaa in position 298 is any amino acid
  Variant (302)..(303): Xaa in position 302 to 303 is any amino acid
  Variant (305)..(308): Xaa in position 305 to 308 is any amino acid
  Variant (310)..(311): Xaa in position 310 to 311 is any amino acid
  Variant (313)..(313): Xaa in position 313 is any amino acid
  Variant (315)..(315): Xaa in position 315 is any amino acid
  Variant (317)..(317): Xaa in position 317 is any amino acid
  Variant (319)..(319): Xaa in position 319 is any amino acid
  Variant (321)..(329): Xaa in position 321 to 329 is any amino acid
  Variant (330)..(331): Xaa in position 330 to 331 is any or no amino acid
  Variant (333)..(349): Xaa in position 333 to 349 is any amino acid
  Variant (350)..(356): Xaa in position 350 to 356 is any or no amino acid
  Variant (358)..(370): Xaa in position 358 to 370 is any amino acid
  Variant (373)..(374): Xaa in position 373 to 374 is any amino acid
  Variant (376)..(379): Xaa in position 376 to 379 is any amino acid
  Variant (381)..(381): Xaa in position 381 is any amino acid
  Variant (383)..(383): Xaa in position 383 is any amino acid
  Variant (385)..(385): Xaa in position 385 is any amino acid
  Variant (387)..(392): Xaa in position 387 to 392 is any amino acid
  Variant (393)..(400): Xaa in position 393 to 400 is any or no amino acid
  Variant (402)..(403): Xaa in position 402 to 403 is any amino acid
  Variant (405)..(405): Xaa in position 405 is any amino acid
  Variant (408)..(409): Xaa in position 408 to 409 is any amino acid
  Variant (411)..(411): Xaa in position 411 is any amino acid
  Variant (413)..(413): Xaa in position 413 is any amino acid
  Variant (416)..(429): Xaa in position 416 to 429 is any amino acid
  Variant (430)..(446): Xaa in position 430 to 446 is any or no amino acid
  Variant (451)..(453): Xaa in position 451 to 453 is any amino acid
  Variant (454)..(454): Xaa in position 454 is any or no amino acid
  Variant (456)..(457): Xaa in position 456 to 457 is any amino acid
  Variant (459)..(464): Xaa in position 459 to 464 is any amino acid
  Variant (467)..(467): Xaa in position 467 is any amino acid
  Variant (469)..(475): Xaa in position 469 to 475 is any amino acid
  Variant (476)..(488): Xaa in position 476 to 488 is any or no amino acid
  Variant (490)..(491): Xaa in position 490 to 491 is any amino acid
RXXXXXXXXXXXXXXLXXXXXXXXXXXXXXXXXXNXXXXXXXXXXXXXXXXXXXXXXXXXXXXXXXXXXXXXXXXXXXXXXXXXXXXXXXXXXXXXXXXPNXXXXXVPXXXXXXXXXXXXXXXXXXXXXXXXXXXXXXXXXXXXXXXXXXXXXXXXHXXXXXXXXXXXDXXXXXXXXGXXXXXXXXXXXXLXXALXXXXXXXXXXXXGXXXXXXPXXXXXXXXXXXXXXXXXXXXXXXXXXXXXXXXXXXXXXXXXXLXXTXEXXXXXXXXXXXXXXXXXXXXPXXXXXXXXXXCFRXEAGXXGXXXXGXXRXHXFXKXEXXXXXXXXXXXSXXXXXXXXXXXXXXXXXXXXXXXXLXXXXXXXXXXXXXLGXXAXXXXDXEXWXPXXXXXXXXXXXXXXEXXSXSNXXDXQXRRXXXXXXXXXXXXXXXXXXXXXXXXXXXXXXXHTLNXXXXAXXRXXXXXXENXQXXXXXXXXXXXXXXXXXXXXPXXL

SEQ ID NO: 5963 - protein, 31 aa, Artificial sequence
  protein pattern
  Variant (2)..(2): Xaa in position 2 is any amino acid
  Variant (3)..(3): Xaa in position 3 is Ile, Leu or Val
  Variant (4)..(7): Xaa in position 4 to 7 is any amino acid
  Variant (8)..(8): Xaa in position 8 is Ile, Leu, Met or Val
  Variant (9)..(10): Xaa in position 9 to 10 is any amino acid
  Variant (11)..(11): Xaa in position 11 is Ala, Cys, Pro or Val
  Variant (12)..(13): Xaa in position 12 to 13 is any amino acid
  Variant (14)..(14): Xaa in position 14 is Ala, Asp, Glu or Gly
  Variant (15)..(15): Xaa in position 15 is Ile, Leu or Met
  Variant (16)..(16): Xaa in position 16 is Gly, Asn or Ser
  Variant (17)..(18): Xaa in position 17 to 18 is any amino acid
  Variant (20)..(20): Xaa in position 20 is any amino acid
  Variant (21)..(21): Xaa in position 21 is any or no amino acid
  Variant (23)..(23): Xaa in position 23 is any amino acid
  Variant (24)..(24): Xaa in position 24 is any or no amino acid
  Variant (26)..(26): Xaa in position 26 is any amino acid
  Variant (28)..(28): Xaa in position 28 is Ala or Val
  Variant (30)..(30): Xaa in position 30 is any amino acid
LXXXXXXXXXXXXXXXXXAXXKXXDXEXWXP

SEQ ID NO: 5964 - protein, 14 aa, Artificial sequence
  protein pattern
  Variant (2)..(2): Xaa in position 2 is Ala, Ile, Leu or Val
  Variant (3)..(3): Xaa in position 3 is Ser, Thr or Val
  Variant (5)..(5): Xaa in position 5 is Ala, Cys, Thr or Val
  Variant (8)..(9): Xaa in position 8 to 9 is any amino acid
  Variant (11)..(11): Xaa in position 11 is any amino acid
  Variant (13)..(13): Xaa in position 13 is Ala or Ser
EXXSXSNXXDXQXR

SEQ ID NO: 5965 - protein, 14 aa, Artificial sequence
  protein pattern
  Variant (2)..(2): Xaa in position 2 is any amino acid
  Variant (5)..(5): Xaa in position 5 is Ala, Gly or Ser
  Variant (6)..(6): Xaa in position 6 is Ser or Thr
  Variant (7)..(7): Xaa in position 7 is Ala, Gly or Leu
  Variant (8)..(8): Xaa in position 8 is any amino acid
  Variant (10)..(11): Xaa in position 10 to 11 is any amino acid
  Variant (13)..(13): Xaa in position 13 is any amino acid
  Variant (14)..(14): Xaa in position 14 is Phe, Ile, Leu, Met or Val
HXLNXXXXAXXRXX

SEQ ID NO: 5966 - protein, 11 aa, Artificial sequence
  protein pattern
  Variant (2)..(2): Xaa in position 2 is Ala, Ile or Val
  Variant (3)..(3): Xaa in position 3 is Ala, Gly or Pro
  Variant (5)..(5): Xaa in position 5 is Ala or Ser
  Variant (7)..(7): Xaa in position 7 is any amino acid
  Variant (8)..(8): Xaa in position 8 is Ala, Pro, Ser or Thr
  Variant (9)..(9): Xaa in position 9 is Ile, Leu or Val
  Variant (10)..(10): Xaa in position 10 is Ala, Cys, Gly, Ser or Thr
  Variant (11)..(11): Xaa in position 11 is Ala, Gly, Asn or Ser
LXXTXEXXXXX

SEQ ID NO: 5967 - DNA, 732 bp, Saccharomyces cerevisiae
  CDS (1)..(732)
atggctagaaatagaacaacctccaagaaaaatgttcaaagtaaacgcttaatagacagagtggttcccatggacaagattaaaaaagttggcgtagcgaaaaaaaaaaccgtagaacacactaaagaaggatttagcgttgtcaacggtaagctagtaagcagcaatgacgtcggtgtactgttaagagaagcacagggtgctatcgataaaagaactaatgtttcccaaagaaataggaaaaagggaataaagaataataggccccacaaagacataaacagcagtcctgactggggcaatgcccacagaggaaccgattggcagagcgaaaaagcaaacggcatgaacagggccaagaactctcggaattttaccactaatattaaattgcagcgacaacattttggcgaagaaatacaaggtggcagccagcttgtgatatctacaaattcagatgcttcagataaattgttaatgctattcaacctaactttgggagtaaaccaagaaaacttgaaaaatgttctggaaaacatttctcaggtgcagatagctcaaattagggttagagacctgccttcaggatctgccaccgctaaggtccgtctggcatatcctacaacacagtctttggagaaggtaagaaaactgttccatggcgctctagttgatggaaggcgcatccaagtggtgattgcatctgatgaatcgtcccacttgtcgtattag

SEQ ID NO: 5968 - protein, 243 aa, Saccharomyces cerevisiae
MARNRTTSKKNVQSKRLIDRVVPMDKIKKVGVAKKKTVEHTKEGFSVVNGKLVSSNDVGVLLREAQGAIDKRTNVSQRNRKKGIKNNRPHKDINSSPDWGNAHRGTDWQSEKANGMNRAKNSRNFTTNIKLQRQHFGEEIQGGSQLVISTNSDASDKLLMLFNLTLGVNQENLKNVLENISQVQIAQIRVRDLPSGSATAKVRLAYPTTQSLEKVRKLFHGALVDGRRIQVVIASDESSHLSY

SEQ ID NO: 5969 - DNA, 696 bp, Candida glabrata CBS 138
  CDS (1)..(696)
atggcgaggaaagatagtggcaagtatgctggcaagagtcttattgacaggattggcaaggtgaatggcgctggtgttaaccgtaagcgtgccattcctggtcccacgcctactggccccaagaaggccggcagtgctggtttcaccgtagtcaatggtaaattagtgaaggctgacgatattggcgtgctattgagggccgctggcaactctcccagagacgttgtcaagggtaagcgtgaagtgaagaagagtatccggtctgcgaaggctaatagcgtgaaagttccaaccaagccaaagcaatcaactagcaaggcgcaaaagaaaatgaagagcaagccaaatgtaattacaccaactaatatacctactttcccagttggtactggcaacactttagtcatctccacgaacactgatgcgtctgacaagtcattagtgttgtacaacttgaccctgggtgtaaatcagaggaacttacaaaagatattggaaaacctggcgaacgtttccatcaagcgcgtgaaggtgcgtgatttgccctcaggctcggcgactgctcatgtctggctgaagaaagccaccatcgaggaactggaacgtgtacgaaaactattccatggtgctttggtcgatggcaggaccatccaggtgatgatcagttcagaaacaagtaacaacttgacttactaa

SEQ ID NO: 5970 - protein, 231 aa, Candida glabrata CBS 138
MARKDSGKYAGKSLIDRIGKVNGAGVNRKRAIPGPTPTGPKKAGSAGFTVVNGKLVKADDIGVLLRAAGNSPRDVVKGKREVKKSIRSAKANSVKVPTKPKQSTSKAQKKMKSKPNVITPTNIPTFPVGTGNTLVISTNTDASDKSLVLYNLTLGVNQRNLQKILENLANVSIKRVKVRDLPSGSATAHVWLKKATIEELERVRKLFHGALVDGRTIQVMISSETSNNLTY

SEQ ID NO: 5971 - DNA, 25 bp, Artificial sequence
  primer
atggctagaaatagaacaacctcca

SEQ ID NO: 5972 - DNA, 24 bp, Artificial sequence
  primer
ctaatacgacaagtgggacgattc

SEQ ID NO: 5973 - DNA, 1542 bp, Saccharomyces cerevisiae
  CDS (1)..(1542)
atgactgctggttctgccccccctgttgattacacttccttaaagaagaacttccaaccgtttctctccagaagagtagaaaatagatctctgaaaagcttttgggatgcttctgatatctcagatgacgtcattgagctagctggtggaatgccaaacgagagattttttcctatcgaatctatggatttgaaaatatcaaaagttccttttaatgataacccaaaatggcataattcgtttaccacggcgcatttggacttgggatcccccagtgagctacccattgcacgttctttccaatatgcagaaaccaagggtttaccccctctcttacattttgttaaagattttgtgtccagaattaatcgcccagccttttccgatgagacggagtctaactgggatgtcatcctttctggcgggtccaacgattcaatgtttaaggtttttgaaacaatttgcgacgaatcgaccactgtgatgattgaagagtttactttcaccccggctatgtccaatgtggaggctacaggagcaaaagtcatccccatcaagatgaacctgaccttcgacagagagtcccagggtattgatgtcgaatatctaacgcagttgctcgataattggtcaactggaccatacaaagacttaaacaagccaagggtcctatataccattgcaacgggccaaaatcctaccgggatgtctgtcccccagtggaaaagagagaaaatttaccagttggcccaaagacacgatttcctcattgttgaagatgatccctacggttatctgtactttccttcctataatccgcaagagccattagaaaacccttaccattctagcgacctgactactgaacggtatttgaatgattttttaatgaaatcattcttgactttggatacagatgcccgtgtcatccgtttggagactttttctaaaatttttgctcctggattaaggttatccttcatcgttgctaataaattccttttgcaaaaaatcttggatttggccgacattactacaagggcccccagtggtacctcacaagctattgtttattctacaataaaggcaatggctgagtccaacttatcgtcctctctttctatgaaagaagcaatgtttgagggttggataagatggataatgcagattgcttctaaatacaatcataggaaaaatcttactttgaaagccttatacgaaacagaatcttaccaagctggtcagtttaccgttatggaaccctccgcgggtatgttcatcattattaaaatcaattgggggaatttcgatagacctgacgatttgccgcaacagatggatattttagataagttcttgctgaagaatggtgttaaagtagtgcttggttataaaatggctgtttgcccaaattattcaaagcagaattcagattttctaagactcaccatcgcctatgcaagggatgatgatcagttgattgaagcttccaaaagaatcggtagtggcataaaagaattttttgacaactataaaagttga

SEQ ID NO: 5974 - protein, 513 aa, Saccharomyces cerevisiae
MTAGSAPPVDYTSLKKNFQPFLSRRVENRSLKSFWDASDISDDVIELAGGMPNERFFPIESMDLKISKVPFNDNPKWHNSFTTAHLDLGSPSELPIARSFQYAETKGLPPLLHFVKDFVSRINRPAFSDETESNWDVILSGGSNDSMFKVFETICDESTTVMIEEFTFTPAMSNVEATGAKVIPIKMNLTFDRESQGIDVEYLTQLLDNWSTGPYKDLNKPRVLYTIATGQNPTGMSVPQWKREKIYQLAQRHDFLIVEDDPYGYLYFPSYNPQEPLENPYHSSDLTTERYLNDFLMKSFLTLDTDARVIRLETFSKIFAPGLRLSFIVANKFLLQKILDLADITTRAPSGTSQAIVYSTIKAMAESNLSSSLSMKEAMFEGWIRWIMQIASKYNHRKNLTLKALYETESYQAGQFTVMEPSAGMFIIIKINWGNFDRPDDLPQQMDILDKFLLKNGVKVVLGYKMAVCPNYSKQNSDFLRLTIAYARDDDQLIEASKRIGSGIKEFFDNYKS

SEQ ID NO: 5975 - DNA, 1233 bp, Pyrococcus abyssi GE5
  CDS (1)..(1233): transl_table=11
atggaagaagaaattaagagcatgcttggaaatgttgagagattcttctcaaagaaggccatggaaatgaaggcctccgaggttagggaattactcaagctcgtcgagactagcgatataataagtctcgccgggggattgccaaatccaaaaacgttcccaaaagaaatcattaaggagattctcatcgaaattatggaggagcacgctgataaggccctgcaatatgggacaaccaaaggattcaccccactaagggagaccctacttgactggcttgaaaagagatacgggatatccaaggaaaacgatataatgataacgagcggttctcaacaggccctagatctaattggaagggtgtttattgatcctggggacatagttatagtggaggccccaacgtacctagcggcattacaagccttcaacttctatgagccaaagtacatccaagttccgctagatgataacggaatgaacgttgaagccctagaggatgagcttagaaagctaaaggctgaaggaaagaaggttaagatagtttacacagtcccaacttttcaaaacccggcaggagttacgatgagtgaagagagaagaaagcacctgatagagttagcaagcgaatatgacttaatagtcatagaagacgatccatatggagagctaaggtattcagggaagcctaaaaagaagataaaagctctagacaaagaaggcagggtgatatacttgggaaccttctccaagatccttgccccaggatttaggataggttggatcgttggagacccaggaatcataaggaagctcgagatagctaagcagagtactgacctctgtactaacgtctttggtcaagtagtagcctggaagtacgttagtgagggccacctggatagacacattccaaagattagggaattctacaagccaaggagagatgctatgcttgaagccctcgaggagtttatgccagaaaacgttaagtggacgaaaccagagggcggaatgttcgtctgggtaaccctaccggatggcatagattcaaagaagatgctagaaaaggctgttaagaaaggagtagcctatgtccctggggaagccttctacgcttacagggacgttaagaacacgatgagactcaacttcacgtacgttgatgaggataagataagggagggtgttaagaggctggctgaaacgatcaaggaagagacaggagtttga

SEQ ID NO: 5976 - protein, 410 aa, Pyrococcus abyssi GE5
MEEEIKSMLGNVERFFSKKAMEMKASEVRELLKLVETSDIISLAGGLPNPKTFPKEIIKEILIEIMEEHADKALQYGTTKGFTPLRETLLDWLEKRYGISKENDIMITSGSQQALDLIGRVFIDPGDIVIVEAPTYLAALQAFNFYEPKYIQVPLDDNGMNVEALEDELRKLKAEGKKVKIVYTVPTFQNPAGVTMSEERRKHLIELASEYDLIVIEDDPYGELRYSGKPKKKIKALDKEGRVIYLGTFSKILAPGFRIGWIVGDPGIIRKLEIAKQSTDLCTNVFGQVVAWKYVSEGHLDRHIPKIREFYKPRRDAMLEALEEFMPENVKWTKPEGGMFVWVTLPDGIDSKKMLEKAVKKGVAYVPGEAFYAYRDVKNTMRLNFTYVDEDKIREGVKRLAETIKEETGV

SEQ ID NO: 5977 - DNA, 1203 bp, Sulfolobus tokodaii str. 7
  CDS (1)..(1203): transl_table=11
atgttcgaaagatttctttcaaaagacgtatcaaatttaaggtcgtcagaaattagagatttattaaaactgactgaaggaaaaaaagttattagtttagctggcggtttaccagatcctactacttttcccgttgaagagattagaaaaataactgacgatgtactcagagaaaaatctgatagagccctacaatattcaacaacgtctgggataactgagttcaaaaaagagcttgttaacctatcaagatacagaggaataagcggtataaatgaaaataatacattcgtaactgtaggaagccaagaagccttatttatgatatttaatctcctagtagatccaggagatactgtaatcgtggaaatgcccacatatcttgctgcacttaatattcttagagcaagaaaacccaatttcattggcgtccatcttacacaaaatggtccagaccttgatgaattagagagaaaagtaaaagagagcataagtaatggcaaaaaaccgaagctaatgtatgttatacctacagctcaaaaccctggaggaacaacaatgagtttagatgataggaaaagacttcttgaaatagctcaaaaatacgactttttacttatagaagatgatgcttatggctttttagtttttgacggagaagcaccaccaccacttataagtttagataaagaaggaagagtaatatatacatctacattcagtaaaattttagctccaggtttaagattaggatgggttatagcacaagaagagtttattagagaaatggagttatacaagcagaatatagatttgcatactcctacacttactcaaatgatagcaatggaggcaataaagagaggagttatacaaaatcagttaccattgattagaagagtatatagagaaaaaagagatgtaatgctagcagcaatagagaaatacttcccgaaagaagctacgtggagcagaccagttggaggaatgtttgtttttgcctggttaccagaaaaaatagatacagtaaagatgttagaggaaagcatgagaagaggagtagcctatgttcctggatctagtttctaccatgattattctgggagaaatactatgagattaaacttcagctatcctactaagcaagaactagaagaaggtattaaaatcctaggaaatactatattagattttcttaaataa

SEQ ID NO: 5978 - protein, 400 aa, Sulfolobus tokodaii str. 7
MFERFLSKDVSNLRSSEIRDLLKLTEGKKVISLAGGLPDPTTFPVEEIRKITDDVLREKSDRALQYSTTSGITEFKKELVNLSRYRGISGINENNTFVTVGSQEALFMIFNLLVDPGDTVIVEMPTYLAALNILRARKPNFIGVHLTQNGPDLDELERKVKESISNGKKPKLMYVIPTAQNPGGTTMSLDDRKRLLEIAQKYDFLLIEDDAYGFLVFDGEAPPPLISLDKEGRVIYTSTFSKILAPGLRLGWVIAQEEFIREMELYKQNIDLHTPTLTQMIAMEAIKRGVIQNQLPLIRRVYREKRDVMLAAIEKYFPKEATWSRPVGGMFVFAWLPEKIDTVKMLEESMRRGVAYVPGSSFYHDYSGRNTMRLNFSYPTKQELEEGIKILGNTILDFLK

SEQ ID NO: 5979 - DNA, 1209 bp, Thermoplasma acidophilum DSM 1728
  CDS (1)..(1209): transl_table=11
atggaatacagattttctgacatatttcggtacataaagccctccgagattagatcgttattgaaatacacctccgatccggaactcatttctttcggcggcggaatgccaaatccggaatcatttccgatcaaagaaatgaaggagatactgaacgatgtgatagataattacggtaaaaaggccctccagtacgggacgaccgagggcctagatccgctcagggacgaactggccaaatacgtggagaagaccgagggaatcagggcaaagagggaggagatcatactcaccaccggatcgcagcaggccctttacgcgattggaaagatattcacgaatccaggagaaacagtcataacggaggggccaacctatgtcggcgccatatcggccttcaattccaacaaggctgagatgatcgcgatagatctcgatgacaagggaatggacgtggatgctctggaggaaaggataaggaattttatggccaacggaacgaaaccaaagttcatctacgtcataccgacattccagaaccctgctggcaccacgatggtgcttgacaggagaaagcagctgctcgaaatttcaaaaaggtatgagataccaattgtggaagataatccgtacggacagttgagatacgatggggatcctgttccatccatcaagagcatggacgatgacggaaatgtgatctacctggggacattctcaaaggtcatggctccgggcctgaggcttggatacgtcatagcggacaggcagatagtggagaagataaatctggtgaagcagggcctggatcttgcatcggactccctgtctgagtacatcgcatatgaatacctgaagcgcggagacatatacaggcagatacccaagacggtcagcctgtacaggaagaagcgcgacctgatgctgaaatcgatagctgagtatttccctgaaggggttaaatacacaaagccaaacggcggcatgttcctctgggtctctctcgatgagaagatcgacacaaccaggatgctggagagggctttgaaggcaaaggtcgcgtacgttagcggagctgccttctatccgcatggcgaaaagcacaacagcatgagactgaacttcacgtattctgacgatgacaagatcgtcgagggaataaaacgcctagcatacgtgataaatgaggagatggaggtcgtcgagtaa

SEQ ID NO: 5980 - protein, 402 aa, Thermoplasma acidophilum DSM 1728
MEYRFSDIFRYIKPSEIRSLLKYTSDPELISFGGGMPNPESFPIKEMKEILNDVIDNYGKKALQYGTTEGLDPLRDELAKYVEKTEGIRAKREEIILTTGSQQALYAIGKIFTNPGETVITEGPTYVGAISAFNSNKAEMIAIDLDDKGMDVDALEERIRNFMANGTKPKFIYVIPTFQNPAGTTMVLDRRKQLLEISKRYEIPIVEDNPYGQLRYDGDPVPSIKSMDDDGNVIYLGTFSKVMAPGLRLGYVIADRQIVEKINLVKQGLDLASDSLSEYIAYEYLKRGDIYRQIPKTVSLYRKKRDLMLKSIAEYFPEGVKYTKPNGGMFLWVSLDEKIDTTRMLERALKAKVAYVSGAAFYPHGEKHNSMRLNFTYSDDDKIVEGIKRLAYVINEEMEVVE

SEQ ID NO: 5981 - DNA, 1413 bp, Schizosaccharomyces pombe 972h-
  CDS (1)..(1413)
atggataatttaaaaaaaaaatatcaacatcatttatccctagaaagcgcatcccgtgagtatggtccgtttcagatgttaggtcgtattcaaagtgactcggatatcaaaatgctttcctttgctggtggagaacccaatcccagtaaattcccgattcataaactttcggtctccttcccagaagtaaattcttgggaaaaagacacgaacaaggacgcaactgtgtcttatgaattaagtaataatgcaaatgagggttctctggatttactgggagctttacagtacggccagtgccaaggaattccagaattggtcaagtttataaaagatcacgttggacaaatccacatgccacaatataaggactgggatataaaaataacaaatggaaatacgatcggccttgagtattgcttgcgattgctcgtcaaccgtggtgattgtattctcatagaaaaatatacataccctgccgcaattaccgcaatgcgtccccttggtgtgaaatttattcccattgacatggatgaaaacggcatgctaccagaaagttttgagaaagttatggaaacatgggattcatcgttaggagcaaggccccatgttttgtatactataccgactgggcaaaacccaactggatccacgttaactttggaaagaagaaagaagtttctaaccttggcaaaaaaatacgatattatcattgtcgaagatgaaccatactattttttgcaaatggaaaaatatgatgcaaattggaaacctgacaagcaagctttcaatatttcgtcattcaaaaaaaagctaattccctctttactccatctagataccgacggtagggttttgcgagttgattccttttccaaattgattgtaccgggattacgtttgggatggataactggaaattctctattcatcgatcgcataacccgttacgcagaagtttgtactgagagcccatccggcgtctctcaagtggttctctatgctatattaaatcgttggggacaaaatggttttttggagtggctacaagatttgcaaaactcatatactatgcgtcgaaatgctcttcttttggcagctgacaaacatcttccaaaatctgtttgtaaatatcattctcctaaagctggattgtttctatgggttgaacttgacaaaaaccgtcttatttgctcaaatatggacaagtccatttcggaaattgagatggaaatttttgtagaacttgttaacaatggggtaaagcctgtttgtggacagctatttatgggagaaccaaattcggcggacaaaattttttttcgatttgcttattcccttgctgacctaagcacttttgaagctggtttagagcggtttactagtactatacaaaaatattttcaattgtga

SEQ ID NO: 5982 - protein, 470 aa, Schizosaccharomyces pombe 972h-
MDNLKKKYQHHLSLESASREYGPFQMLGRIQSDSDIKMLSFAGGEPNPSKFPIHKLSVSFPEVNSWEKDTNKDATVSYELSNNANEGSLDLLGALQYGQCQGIPELVKFIKDHVGQIHMPQYKDWDIKITNGNTIGLEYCLRLLVNRGDCILIEKYTYPAAITAMRPLGVKFIPIDMDENGMLPESFEKVMETWDSSLGARPHVLYTIPTGQNPTGSTLTLERRKKFLTLAKKYDIIIVEDEPYYFLQMEKYDANWKPDKQAFNISSFKKKLIPSLLHLDTDGRVLRVDSFSKLIVPGLRLGWITGNSLFIDRITRYAEVCTESPSGVSQVVLYAILNRWGQNGFLEWLQDLQNSYTMRRNALLLAADKHLPKSVCKYHSPKAGLFLWVELDKNRLICSNMDKSISEIEMEIFVELVNNGVKPVCGQLFMGEPNSADKIFFRFAYSLADLSTFEAGLERFTSTIQKYFQL

SEQ ID NO: 5983 - DNA, 1425 bp, Schizosaccharomyces pombe 972h-
  CDS (1)..(1425)
atggctgctcaacctaaagacctttcacaccacttgtctgtggaaagtgcaagtcgtaaacaatctccacttaaagctgtcgctctttccaaaagcagccgcaatattaaaatcatttctttggctggcggtttgcctaaccctgaatactttcccattcgtgagatggatgcggagattcctgctataaactcttggaagaaggattcttcaaacagtggaaagctcgataccgtttctgttcctatgagctctagtgattctgatgtccttcctcttagtgtcgctttgcagtacggccagggttctggtgctgctttactttcccaatttttaaaggaacacactcgcatcattcataatcctccttatgaaggttggaacatcattatgactaccggtaatacttcatgcctagacatcgctcttcgtatgttgaccaatcgaggcgattccattttggtagagaaatactccttcccttccgcattacaaagcatgcgtcctcttggtttaagctgcattcctattgatatggaccagtttggttttttaccagagtctatggatgatattttgactaattgggatgctacttcctacggttctcctaaaccccacgtactttacactattcctactggtcaaaatcccactggtagtactctttctgtggagaggagaaagcaaatttacactctggcacaaaagcatgatattattatcctagaggatgaaccttactattacttacaaatggacgcttatgaaggaaaaccagaagctgctgataaagcttttaccaacgagcaatttgtaaaagaacttattccttcattcttaagtatggatgtcgacggtcgtgtcatccgtatggattctctgtcaaaggttgtagcccctggttctcgtgtaggttggttcactgctcaaccgttgttcattgaacgtggtttgcgtgctgctgaaactgcaactcaaagtgcttctggtatttcccaaggcatcctgtatgccatgttcaagcattggggtcaagacggatacctagagtggttgaagcatattcggtattcttatacgcttcgccgtaattatcttctttatgccatggacacatacttaccaaaatcggtctgctcttatatccctcctgtcgctggtatgtttatttggttcgaagttgacaaatcgcgctacatccatgccgataaaaatgaatctattcccgaaatcgaatctaaaatccatgctgaagctgttgaagaaggcgttaaccttgcttgcggtaactggttcgttgttgaccctagagtcaacgataagattttcttccgtgtgacatttgctcacgctgaattagaagaatttaatgttgccattgaacgttttgcgggcgttttgaagaataatttcaaatgctga

SEQ ID NO: 5984 - protein, 474 aa, Schizosaccharomyces pombe 972h-
MAAQPKDLSHHLSVESASRKQSPLKAVALSKSSRNIKIISLAGGLPNPEYFPIREMDAEIPAINSWKKDSSNSGKLDTVSVPMSSSDSDVLPLSVALQYGQGSGAALLSQFLKEHTRIIHNPPYEGWNIIMTTGNTSCLDIALRMLTNRGDSILVEKYSFPSALQSMRPLGLSCIPIDMDQFGFLPESMDDILTNWDATSYGSPKPHVLYTIPTGQNPTGSTLSVERRKQIYTLAQKHDIIILEDEPYYYLQMDAYEGKPEAADKAFTNEQFVKELIPSFLSMDVDGRVIRMDSLSKVVAPGSRVGWFTAQPLFIERGLRAAETATQSASGISQGILYAMFKHWGQDGYLEWLKHIRYSYTLRRNYLLYAMDTYLPKSVCSYIPPVAGMFIWFEVDKSRYIHADKNESIPEIESKIHAEAVEEGVNLACGNWFVVDPRVNDKIFFRVTFAHAELEEFNVAIERFAGVLKNNFKC

SEQ ID NO: 5985 - DNA, 1446 bp, Schizosaccharomyces pombe 972h-
  CDS (1)..(1446)
atgatccggaatagtgaggattttagccatcatttgtcgagagaaagcaaggctcgtgagaaaggcccttttcaaatgttaggaagaattaaaagtagtacagggattgacgctatatctttttcctcaggtttacctcatcctaacaagtttgctatccgtgagctttctatcaagtttcctcaacttggttgctttaaggaggaaaatgggacatacgccaaagaggttaatgtaacatttaacataaaagctgatccttctgagggtcttttaaatttctctcagtccttgcagtatggccaatgccaaggaatttctgaattggtgggatttataaaggaacacattcggcggattcatgctccccgatacgaaaactgggatattaagatgagtaatggtaatacaagtggtttggaatattgtttacgactgctagtcaattatggggatcatgtcttgacagaaaagtacacttatcctgctgccatcaccgcaatgcgagccctaggtgttcaatttgtatctgttgatatggattcggaaggtatgcttcctgaaagtcttgaagaaattatgagagactgggatatatctctgggacctagacctcatgtcttgtacacagttcctactggtcaaaatcctactggttctactttgtcattaagtcggcgcaaaaagcttttagcattagcaaggaaatacgatatcatcatcgttgaagatgagccatactattttctacaaatggaagattataacggaagtttaaaccctgcacagcaaaaatgtgatgggtcaacgtttttaaagagtttggtcccttcattgctaagtttagacacagaaggtcgagttttgcgacttgattcgttctctaaactgattgctccaggaacccgccttggctatattactggaaattcaatgtttattgatcatattacacggattgcagaagtatgcacggaaagcccgtctggtatttgccaatctgtattgtatgcaatgctgcataattggggtcaagagggcttttgtgcatggttacaggagctgcaatattcttatactgttcgtcgaaacgcattccttaatgtagcaaacaagtatctaccaaattctgtttgtatttatcacgtaccaagagctggattattcttgtgggttgagttaaacttaaatcattaccgcttttcggatacgaaaaagtcagtttcccaaattgaaatggaaatattcctagcgcttgtagaaaaaggtgtaaaaactgtttgtggtcagttttttatggcaaatccagaacgtagtactaagatctttttccgtttcgcatattcaattgctgactttgaggactttgaggagggaattaagcgatttacatcagtcataaatgagcattttaatgtcgaaagcagagtacgaatctgcccttga

SEQ ID NO: 5986 - protein, 481 aa, Schizosaccharomyces pombe 972h-
MIRNSEDFSHHLSRESKAREKGPFQMLGRIKSSTGIDAISFSSGLPHPNKFAIRELSIKFPQLGCFKEENGTYAKEVNVTFNIKADPSEGLLNFSQSLQYGQCQGISELVGFIKEHIRRIHAPRYENWDIKMSNGNTSGLEYCLRLLVNYGDHVLTEKYTYPAAITAMRALGVQFVSVDMDSEGMLPESLEEIMRDWDISLGPRPHVLYTVPTGQNPTGSTLSLSRRKKLLALARKYDIIIVEDEPYYFLQMEDYNGSLNPAQQKCDGSTFLKSLVPSLLSLDTEGRVLRLDSFSKLIAPGTRLGYITGNSMFIDHITRIAEVCTESPSGICQSVLYAMLHNWGQEGFCAWLQELQYSYTVRRNAFLNVANKYLPNSVCIYHVPRAGLFLWVELNLNHYRFSDTKKSVSQIEMEIFLALVEKGVKTVCGQFFMANPERSTKIFFRFAYSIADFEDFEEGIKRFTSVINEHFNVESRVRICP

SEQ ID NO: 5987 - DNA, 1215 bp, Streptomyces coelicolor A3(2)
  CDS (1)..(1215): transl_table=11
atgaccgtgactgagaacgtgcccgccgccaccgcttccctgccgccgctcgccgcgcgggcccggtcgatcggcggttcgcccgtacgggacatcctcgccgtcaccgcccgccccgaggtgatcaacttcgcgggcgggctgccggcccccgaactcttcgacgcggagggcatcgccgccgcgtaccgggacgtcctcgccgagacgcccgcgcgggctttgcagtactccacgaccgagggcgaacccgccctgcgggccgccctcgccgcccgcacctcggcccgcgggctggccaccgacgccgacgacatcctcgtcaccaccggctcgcagcaggcactctcgctcctcgccaccgccctgctcgaacccggcgacaccgtcctcgtcgaacgcccctgctacctggccgcgctccaggccttcggcttcgcgggcgcccgggtggtggccgtgcccggggacgagcacgggatagaccccggggcgctggaggagctggtggtgcgcgagcggcccaagctgctctacacggtccccaccttctccaaccccaccggccgcaccgtgcccgccgcccgccgcgccgccgtcgccgaggtcgccgggcggtgcggcctgtggatcgtcgaggacgacccgtacggcgaactgcgcttcgagggcgagcgggtgccgtggatcgcctcctacgagggcgcccgggaccggaccgtgctgctgggctccttctccaaggtcatggcgcccggcctgcgcctgggctggctgcgggcacccgccgagctgcgccgggcctgcgcggtcgccaagcaggccgccgacctgcacaccccgaccgtcaaccagctcgccgccgcccgctacctggccgaccgtgacctggacgcccacgtcgcccgcgtcgccgccgtctacggcgagcgccgggacgccatgctcgcgggcctcgcggacgccctcccggccgggtcggtgtggacccgtcccgagggcggcatgttcctgtgggcgcggctgccgcaggggtacgacaccaccgccctgctccccgaggtggtccggcacgacgtggcgtacgtccccggagcccccttccacgccggcgagcccgaccgcgccacgctgcggctctgcttcgtcacccagacaccggacgagatcgcggaggggctgcggaggctgggggaggggctgcgggcagcctga

SEQ ID NO: 5988 - protein, 404 aa, Streptomyces coelicolor A3(2)
MTVTENVPAATASLPPLAARARSIGGSPVRDILAVTARPEVINFAGGLPAPELFDAEGIAAAYRDVLAETPARALQYSTTEGEPALRAALAARTSARGLATDADDILVTTGSQQALSLLATALLEPGDTVLVERPCYLAALQAFGFAGARVVAVPGDEHGIDPGALEELVVRERPKLLYTVPTFSNPTGRTVPAARRAAVAEVAGRCGLWIVEDDPYGELRFEGERVPWIASYEGARDRTVLLGSFSKVMAPGLRLGWLRAPAELRRACAVAKQAADLHTPTVNQLAAARYLADRDLDAHVARVAAVYGERRDAMLAGLADALPAGSVWTRPEGGMFLWARLPQGYDTTALLPEVVRHDVAYVPGAPFHAGEPDRATLRLCFVTQTPDEIAEGLRRLGEGLRAA

SEQ ID NO: 5989 - DNA, 1764 bp, Magnaporthe grisea 70-15
  CDS (1)..(1764)
atgagcacgtcgacgcaggtcaggacctcgtccgcaatcaaaatcatgtctcctactctgttggccatcgacgaatccgcggcggccgccgagaccgttggccctatcgggttgcctgccaagcaggtccccgaacatccaaactctgtagctgcgagagcacccaagttggagcgcccgcgacgcatcacattcaaggacatagccgacaagaggaccagggccggcaagctcgtcgccctcacagcctcggcatcggacagcgacatgttcaaggtggccgccgccggccagaagcccaaggccaggcgttgggatcatctcctcagccaggagtcggccagccgcaagccgtgcaggctcaagcaggcggcactcaacctcaggaagccaggcatcatctccctcggcggcggtctgccatgcccagataacttcccaatcgagtccatctcgatgcgcgtcccctcagtcagcggtggcttctccgaggccgacacccgcgcccatggcctggatgtcaccgttggcaagtatgacgtccaggaacaggctgaagatcccaatggtgccgtttacgacctcagcatagcactcaactatagccaggccacaggctcggctcagatgatgcgcttcgtcacggagcacacagagctcgtcaacaacccgccgtacgcggactggcggtgctcaatgagcatcggcagcacgggcgcgctggagatggccctgcgcatcttttgcgacagggccaggaacgactcgatgctgaccgaggagttcagcttctcgacggcggtcgagacggccatgcctctaggaatcaaggtctttggtgtcccggtcgacggtgagggcctgatcccagagaagatggacgagatactgaggacctggaagcccgaagagaggaagggagccgcaaagccgcacgtgctatataccgtcccgtcgggtcagaacccgaccggatcgacgcagagcgaggagaggcggagggcactttaccaagtctgccgcgagcatgacgtctacataatcgaggacgaaccgtactactacatacagatgcccccttaccgcggccgggacgcaaagaaggaggaggagcagtccaacgacgccgaagagaccccggagcagttcctggagagcctggttccttcgatcctcagcatggacgtcgacggccgcgtcctgcggatggactcgttctccaaggtagtcgtcccgggctcccgcatgggctgggtcacggcgtcagagcagatcatcgaccgcttcatccggcacggcgagtcatgcaaccaggggcccagcggaatagcgcaggtgctgctgcacaagctgttggacgagacctggggtcacgagggctacattcgctggctgatgagcgtgcgtggagagtacacgcgaaggcgagacgtcctcctagccgcctgcgaggatcacctgccgcgggaggttgttaactgggaagttcccaagactggcatgtttcactggctcaaggttgatcataccaagcacccatgcgcctctaccatgagcatatcggagatggaggcggaaatattcaaagactgcatcgacaagggcgtcctggtggcagccggctcctggtttatggctgaccacgatgcggagccgagcggactgttcttccgcgctacgtttgcggccgccacccctgacaacatgattgaggctactcgaagactcggcgacgccatccggtctagcttccagttgaactga

SEQ ID NO: 5990 - protein, 587 aa, Magnaporthe grisea 70-15
MSTSTQVRTSSAIKIMSPTLLAIDESAAAAETVGPIGLPAKQVPEHPNSVAARAPKLERPRRITFKDIADKRTRAGKLVALTASASDSDMFKVAAAGQKPKARRWDHLLSQESASRKPCRLKQAALNLRKPGIISLGGGLPCPDNFPIESISMRVPSVSGGFSEADTRAHGLDVTVGKYDVQEQAEDPNGAVYDLSIALNYSQATGSAQMMRFVTEHTELVNNPPYADWRCSMSIGSTGALEMALRIFCDRARNDSMLTEEFSFSTAVETAMPLGIKVFGVPVDGEGLIPEKMDEILRTWKPEERKGAAKPHVLYTVPSGQNPTGSTQSEERRRALYQVCREHDVYIIEDEPYYYIQMPPYRGRDAKKEEEQSNDAEETPEQFLESLVPSILSMDVDGRVLRMDSFSKVVVPGSRMGWVTASEQIIDRFIRHGESCNQGPSGIAQVLLHKLLDETWGHEGYIRWLMSVRGEYTRRRDVLLAACEDHLPREVVNWEVPKTGMFHWLKVDHTKHPCASTMSISEMEAEIFKDCIDKGVLVAAGSWFMADHDAEPSGLFFRATFAAATPDNMIEATRRLGDAIRSSFQLN

SEQ ID NO: 5991 - DNA, 1680 bp, Gibberella zeae PH-1
  CDS (1)..(1680)
atgctttcagctgtaagaacagccaggcttagatcattgatcaaacacagccgtacgattcatagcagttcgaaacatctgtcaagcactgaagctgccccggctgctcgtccagcacactatgacacctcccagaagctttcagctatcgatgcggtaaaagagagacgactcaaggccggaaagctggtcgctggagttgctgccgcttctgatagtgatatgttcaaaggcccgacgacagggctgcccaagtctaagcgatgggataaccatctcagtcatgagagcaaagtaagagagccatgtacacttaaacaagcagctcgccatatgaagaagcccggtctcatctccctagggggcggcttaccatccagcgaagtcttccccttcgccgagctcggcttcaaggtcccagtggctcccaaattctcagagaaggacacggaagaatcaggccaaaccgtcacaattggaaaatacgacgttagagaccgtgggggtacttatgatttgtccatcgcctgcaactacggacaagctacagggtcccctcagatgatgagatacctgacggagcacactgagattgtgtacaaacccccttatgcagactggaaagtttgtcaaactattggaagtaccggagcactagaagaggcactacggatgttctgtgataaggaccgtggtgattctgtactcaccgaagactttagcttctcaaccgccttggaaaccgttggacctcttggcatcaaggcctttggtgtttccattgacgagcagggcctgattccagaggctatggatgagcttctgtcgaactgggatgctaaagagcgaggctcccgaaaacctcatctgctatacaccgtcccctcaggccagaaccccacaggtgcaacgcaagggaccgaaagacgcaaggcgatttacgccgtggcacagaagcacgatatatacatcatcgaagacgagccgtattacttcctccagatgcaaccctacacaggccgcaaccaacccgatgttccgccaccaaagacggtagatgaatttgtctcatcactcattccttcgcttctgagcatagatgttgatggtcgagttatgcgcatggactcgttctcaaaagtgcttgtcccaggatctcgtctaggatggatcactgcatcggagcagatcgtagagagatacattcgacacgctgaagttgcgagtcaaggcccaagtggcttctcacaggtcattctgtataagttgctcgacgagacgtggggacatgagggatacttgagatggttgatgaacttgcggctggagtataccaagaagcgagatgctctcctggccgcatgcgaagatcatctaccaagtgatctcgccagctggacgcctcccgtagctggcatgtttatgtggatcaatattgattatacaaagcatcccgacgcaggaaagcgaagtatcgtcgatatagaagaggaaatcttcaacttatgcattgagaatggcgtgctaatcgctagaggctcgtggttcttgactgaaaaggacaaggcaccaccaggactgttctttagggcgacgtacgcatctgctacacctgagaatatgaacaaggctattgagaggtttggaaaagctgttagggatagctttggacgaaagtaa

SEQ ID NO: 5992 - protein, 559 aa, Gibberella zeae PH-1
MLSAVRTARLRSLIKHSRTIHSSSKHLSSTEAAPAARPAHYDTSQKLSAIDAVKERRLKAGKLVAGVAAASDSDMFKGPTTGLPKSKRWDNHLSHESKVREPCTLKQAARHMKKPGLISLGGGLPSSEVFPFAELGFKVPVAPKFSEKDTEESGQTVTIGKYDVRDRGGTYDLSIACNYGQATGSPQMMRYLTEHTEIVYKPPYADWKVCQTIGSTGALEEALRMFCDKDRGDSVLTEDFSFSTALETVGPLGIKAFGVSIDEQGLIPEAMDELLSNWDAKERGSRKPHLLYTVPSGQNPTGATQGTERRKAIYAVAQKHDIYIIEDEPYYFLQMQPYTGRNQPDVPPPKTVDEFVSSLIPSLLSIDVDGRVMRMDSFSKVLVPGSRLGWITASEQIVERYIRHAEVASQGPSGFSQVILYKLLDETWGHEGYLRWLMNLRLEYTKKRDALLAACEDHLPSDLASWTPPVAGMFMWINIDYTKHPDAGKRSIVDIEEEIFNLCIENGVLIARGSWFLTEKDKAPPGLFFRATYASATPENMNKAIERFGKAVRDSFGRK

SEQ ID NO: 5993 - DNA, 1515 bp, Candida glabrata CBS 138
  CDS (1)..(1515)
atgactctgccagaatctaaagatttcacttacttcttctctgaagaaaccaaggctcgtaagccttctccattaaagacatgcattcaatacttttctgatcctaacatgatctttcttggtggtggtcttccaatgagtgcttacttcccttgggataacttggctgctgatacaccattgccacctttcaccaatggtatcggtgcaactataaccggctctcaagaagacacctcaaagttttcagtcaagaaggaatctaaagtccatgaaggtgacattcctctggctcgttccttgcaatatggtaagagtatgggtcaaccagaattgactgatttcttgaaggagcacactaagatgattcacgatatgaaatacagcgactgggatgttgttgctactacaggtaacaccaacgcttgggaatccaccttaagagtcttctgtaacagaggcgatgttattcttgctgaagctcactcattctcttcttctttagcttctgcagaagcccagggtatcattactttcccagttcctatcgatgctcacggtattattccagaaaagctagaagcattgctggacaactggaccgagggtgctccaaagccaaagctattgtataccattccaacgggccaaaacccaacagggtcttctttgaatgccgaaagaaagaaggagatttacagaattgctcaaaagcatgacttcttgattatagaggacgaaccatactacttcttgcaagttggtgaatatatcagtgacctaagtaagagagctgaagttgcccaaaagaacgcaaacatttcacatgaagatttcctaaagtcactagctcttactttcttgtctgttgataccgatggtagagtcatcagaatggactctttctccaaggttttagctccaggtactagattgggttggattactggttcatctaaactactccaagcatacttaagtctacatgaaatgactattcaatctccatccggtttctctcaatctcttgtgagtggtactttgaaccgttggggccaaaagggttacattgactggttgatcggtctacgtcatgaatacactgccaagcgtgaccattgtattgactccttgtataaattcattccaaaggataacaacaaagaaggtaaaccaatttttactatcaacccaccaattgctggtatgttctttactgttgacatggacgctagcgcccatcctgaatttgctaccacttacgaatcagatccaaccaaggttgaagaagcattatatcaaaaggttatcaagtctggtgtcctagtcgttccaggtatatggttcaaggccgatggtgaaactacaccagctcaaccagcttcatcaaaggaaaaccctaacccaaaccaaattttcttcagaggtacttacgctgctgttgaaccttctaagctggacgaaggtttgaagagattaggccaatgtctacgtgaagaatttcaattggcataa

SEQ ID NO: 5994 - protein, 504 aa, Candida glabrata CBS 138
MTLPESKDFTYFFSEETKARKPSPLKTCIQYFSDPNMIFLGGGLPMSAYFPWDNLAADTPLPPFTNGIGATITGSQEDTSKFSVKKESKVHEGDIPLARSLQYGKSMGQPELTDFLKEHTKMIHDMKYSDWDVVATTGNTNAWESTLRVFCNRGDVILAEAHSFSSSLASAEAQGIITFPVPIDAHGIIPEKLEALLDNWTEGAPKPKLLYTIPTGQNPTGSSLNAERKKEIYRIAQKHDFLIIEDEPYYFLQVGEYISDLSKRAEVAQKNANISHEDFLKSLALTFLSVDTDGRVIRMDSFSKVLAPGTRLGWITGSSKLLQAYLSLHEMTIQSPSGFSQSLVSGTLNRWGQKGYIDWLIGLRHEYTAKRDHCIDSLYKFIPKDNNKEGKPIFTINPPIAGMFFTVDMDASAHPEFATTYESDPTKVEEALYQKVIKSGVLVVPGIWFKADGETTPAQPASSKENPNPNQIFFRGTYAAVEPSKLDEGLKRLGQCLREEFQLA

SEQ ID NO: 5995 - DNA, 1614 bp, Candida glabrata CBS 138
  CDS (1)..(1614)
atggcttcatgcatagcctgcgatgacacatatatagttttcatatacattttcttacatagcagctttgtaccaattaggatactacaagcgatgacgacgatgattgatttagaggaaaagtttggacagtttttgtcctggaggatgcagaacaggaagttggtggctttctgggatgatgaagtgttgggtgacgatgtcattgagttgaccgccggtatgcccaacgagcagtttttccccatcaaggccatggacatgaccattgtcaacaagccatttgagtcagccgatgacacctctaagcacctgcactgtaagatgtccacttacgagcccaagagtttgcccatcgctagaagtttccagtacaacgaggtgccaggtttgccccagatcagaaactttgccaagtacttggtcaacaagatcaacaagccagcttactctgctgatcagtgggatgtgctgttgtcctcgggctcgtgtgactccatgttcaagttctttgagtgtttctgtgatgagaaatccacagtgcttatggaagagttcacattcacaccggtgatctctcacgtcaaggccactggtgctgaatgtatcccattgaagatgaacttgaccaaggatccaagcactcaaggtatcgatgtcgactacctgactcaattgctagacaactggtcctcaggcccttacaaacacttgaacaagccaagaattctttacaccatatgcactgggcaaaacccaactggtgtcaccatcccaatggagaaccgtaggaagatttacgagttggctcataagcataacttcttgatcttggaggatgacccatacggatatttgtcatttccatcttataaaccggaggacccattgaagaacgattatctagaagacggcttcacagtggaaaagtacactaacgaattcctagtggactcgttcttgaccatcgatacggacgctcgtgttattcgtatggagaccttctcaaaagtatttgcacctggcctaagactggggttcatcgtggctaacaagtatatcatcagcaacttgcttgaatacgccgagatcaccactagggcaccaagtggtgtctctcaggccgtgctgtacaacactttggagaccatggcgctataccaagatggcgatgacaaggaagacccagagaaaaagcaagaggcgctgttccaaggttggatgcattggatcatgaaggtggctgctgagtacacccacagaagaaacataacattgaaggcactatatgagaccgatgcctacaagaacggcctgttcacagtgatcgagccatctgctggtatgtttgtcggagtcaagatcaaatgggacaaagcgcccggtgagatcggtaacatccccgagcaaatgaagaaactcgacagattccttgtgcaaaatggtatcaagacagtgctgggatacagaatgggtgtgtcttccgagttgtcccacgacaactccgacttcttaagagtcacaattgcttacgccaaggatgaccagcagctagtagaggcctctcatagaatcggctccggtatcgagcaattcttcaaagagctaaaataa

SEQ ID NO: 5996 - protein, 537 aa, Candida glabrata CBS 138
MASCIACDDTYIVFIYIFLHSSFVPIRILQAMTTMIDLEEKFGQFLSWRMQNRKLVAFWDDEVLGDDVIELTAGMPNEQFFPIKAMDMTIVNKPFESADDTSKHLHCKMSTYEPKSLPIARSFQYNEVPGLPQIRNFAKYLVNKINKPAYSADQWDVLLSSGSCDSMFKFFECFCDEKSTVLMEEFTFTPVISHVKATGAECIPLKMNLTKDPSTQGIDVDYLTQLLDNWSSGPYKHLNKPRILYTICTGQNPTGVTIPMENRRKIYELAHKHNFLILEDDPYGYLSFPSYKPEDPLKNDYLEDGFTVEKYTNEFLVDSFLTIDTDARVIRMETFSKVFAPGLRLGFIVANKYIISNLLEYAEITTRAPSGVSQAVLYNTLETMALYQDGDDKEDPEKKQEALFQGWMHWIMKVAAEYTHRRNITLKALYETDAYKNGLFTVIEPSAGMFVGVKIKWDKAPGEIGNIPEQMKKLDRFLVQNGIKTVLGYRMGVSSELSHDNSDFLRVTIAYAKDDQQLVEASHRIGSGIEQFFKELK

SEQ ID NO: 5997 - DNA, 1593 bp, Kluyveromyces lactis NRRL Y-1140
  CDS (1)..(1593)
atgacggtaaccattgatgataagacgttagaagagcattattcgaagttcttgaatcgtcacgttgacagaagagttattctgcaattctgggatgattatttgcccaaggatgtgaaaccgcatccaaacccatatgttttggcagctggtatgccaaacgagggtttgttccctgtggaatctgtgcatgtcaatgtggttgaacgtccgttccagcatttggagtacccattcaaaagtgaaaagatccatgtcggtgctgctggtgaaatcggtgtcaatgaagctgaatacgtgaaatctagggtcgatgatggtagtatggttgatatttggaggtacgatccatctcatggtgataacattccaattgcccaggcactacaatattctgacacgaaagggttcccgcaattgattgatttctcaaagaagttggttagttacttaaacaagccagcttacgacaattgggatgttatgttagcaaatggatcttctgattctttatctaaagttttcaccactttaacagatgaagacgttaccgtgttaatggaagaatttactttcactccgactatctccaacgtcactgcaaatggtgggattccgattccattgaaagttgatatcacggatgatgcttctcagcagggtattaacgtcgagtatatggaccaattgcttgagaattggtcaacaggtgaatattctcacttatctaagcctagactgttatacacaatcgtcacagggcaaaatccaaccggtatgacacaatgcaaagagaagagacagaaaatatacgatctatgcgaaaaacatgacattataattgtggaagatgatccgtatggttacctaaagtttttaccctttgacaagtctgatccattaaagaatcaatataacgatggcactatcactttcgataaatattgtaaagaaatattagccccctcatatttgaccatagacacatcagggagagtcattagattagaaactttctccaaagtcttcgcccctgggatgcgtctttccttcattgtcgccaataaatttatcctagacaagttattgaaatatgcagacatttctgttagatcgccatgtggtcttgcccaagctatgaccattaatataatagacaaatgggcagaaaatttcaatggagacaaggtcagagcttggctatcatgggtcatgaaagttgctggtgagtatacacatagaagaaatgtgcttttccaagcattggaagctacaccagcttataaagaagaattatttgaattgattgaaccctctgccggtatgttcattagtatcaagatcaattttgataagttcggagaaatctcggataaattaaaggccatgaatttcttaaactacaagttgttggaagaaggttgcattgtaatcttgggttacagaatggcagttgacaagaaattttcatatgacaggtccaactttttaagaattacatttgctatggctccagatgaagagcatttacaaacagctgctgaaaggctaggtaaaggtgttgagagattcttcaaagagtatcacaactga

SEQ ID NO: 5998 - protein, 530 aa, Kluyveromyces lactis NRRL Y-1140
MTVTIDDKTLEEHYSKFLNRHVDRRVILQFWDDYLPKDVKPHPNPYVLAAGMPNEGLFPVESVHVNVVERPFQHLEYPFKSEKIHVGAAGEIGVNEAEYVKSRVDDGSMVDIWRYDPSHGDNIPIAQALQYSDTKGFPQLIDFSKKLVSYLNKPAYDNWDVMLANGSSDSLSKVFTTLTDEDVTVLMEEFTFTPTISNVTANGGIPIPLKVDITDDASQQGINVEYMDQLLENWSTGEYSHLSKPRLLYTIVTGQNPTGMTQCKEKRQKIYDLCEKHDIIIVEDDPYGYLKFLPFDKSDPLKNQYNDGTITFDKYCKEILAPSYLTIDTSGRVIRLETFSKVFAPGMRLSFIVANKFILDKLLKYADISVRSPCGLAQAMTINIIDKWAENFNGDKVRAWLSWVMKVAGEYTHRRNVLFQALEATPAYKEELFELIEPSAGMFISIKINFDKFGEISDKLKAMNFLNYKLLEEGCIVILGYRMAVDKKFSYDRSNFLRITFAMAPDEEHLQTAAERLGKGVERFFKEYHN

SEQ ID NO: 5999 - DNA, 1476 bp, Debaryomyces hansenii CBS767
  CDS (1)..(1476)
atgtctaaaccagaagctaaggatttgagccacttgttgagtgaagaagctaagtcgagaaaaaactctccattgaaggctgctttcaagtattacaaacaaccaggaatgacgttcttgggcggtggattaccattatcagattgttttccgttcaataaagtgacagcggacattccatcggtaccattttcagaaggtatttcggctccgctctctgatgaaaataaaactgtcgtagaggtatacaaaagagccgaaatgaacaagacagaagacaagcagatcgagcttgccagatcattgcaatatggacacactgaaggtcaagccgagattattgatttcttgaaggagcacacggaaaagattcacaatgttccatataaggattgggatcttattgcatctgttggtaacacgcaatcgtgggatgcaaccttgagatcgtttgtcaccagaggtgattctatcttggttgaagaatattcgttcagttcggcattggaaactgcccacgcacaaggcgttaataccattccagttccaatggacgccaagggaattcttccggaagcattggaaaagcagttagaccaatgggttggaccaaagccaaagttgttatataccatttgtactggtcaaaacccaaccgggtcttgtctctcggctgaaagaagaagggccatctacaaattggcatgcaagcacgatttcatcattattgaggacgagccttattacttcttgcaaatggaagattataccacggacgaaaagtcaagagctagcaacaaggtcgacagccacgacgaattcgtcaaggctttagttccatcctacatctccatggatgtcgaaggaagagttatcagattagactcattctctaaggttttggcacctggtttgagattcggttggattgtcggacaagccaaattactcgagagatatgtcagaatccatgaagtttctatccagtgtccatctggttttactcaatccatctgtaattccttgttgcaaaaatggggtcaaaagggttacttagattggttaatgggcttacgtgccgactacacccacaagagagatgtcgctattgatgcagttaacaagtacttccctaaggaagttgtatcatttatcccaccagtggccggtatgtttttcacaactaccatcgacgcttccaagcaccctaaattcaagtccgagtttaacgaggacccactccaggttgaaaatgccgtctacgagcaagctttgaaacaaggttgtttgatgatcccaggttcttggttcaaggccgacggtaaatcaaatcctccacaacctgaattaccagaaaaccctgctagcaaaaacaccttcttctttagaggtacatatgctgccgttccattagatcaattagtcataggattagaaaaattcggtaaagcaattaaggttgaatacggtctttaa

SEQ ID NO: 6000 - protein, 491 aa, Debaryomyces hansenii CBS767
MSKPEAKDLSHLLSEEAKSRKNSPLKAAFKYYKQPGMTFLGGGLPLSDCFPFNKVTADIPSVPFSEGISAPLSDENKTVVEVYKRAEMNKTEDKQIELARSLQYGHTEGQAEIIDFLKEHTEKIHNVPYKDWDLIASVGNTQSWDATLRSFVTRGDSILVEEYSFSSALETAHAQGVNTIPVPMDAKGILPEALEKQLDQWVGPKPKLLYTICTGQNPTGSCLSAERRRAIYKLACKHDFIIIEDEPYYFLQMEDYTTDEKSRASNKVDSHDEFVKALVPSYISMDVEGRVIRLDSFSKVLAPGLRFGWIVGQAKLLERYVRIHEVSIQCPSGFTQSICNSLLQKWGQKGYLDWLMGLRADYTHKRDVAIDAVNKYFPKEVVSFIPPVAGMFFTTTIDASKHPKFKSEFNEDPLQVENAVYEQALKQGCLMIPGSWFKADGKSNPPQPELPENPASKNTFFFRGTYAAVPLDQLVIGLEKFGKAIKVEYGL

SEQ ID NO: 6001 - DNA, 1599 bp, Yarrowia lipolytica CLIB122
  CDS (1)..(1599)
atgtccttccacgacaagttcatttctgaccgttcaaaggcccggtctcattcccatttcacgctcaaccagacggccaagacaaccaaaccccattccaacccgattttcatctctggaggtcttcccaaccccattgggttccccattgacgagatcaccgtcaatctgaccaccagtcccaatccccgacctcgatttgtgcctgctgcgactctgttttccaagccaggactggtcgagttccccgacatcaccgagaatagcacccggttgagccagaacctcaagatcctcaagtttgccgagtcgctggaaactgcgacaaacggcaatggcggccagctgactctcgagcgatctctccagtacggcgaacaagatggtcacccgcagctcaagaaatttgtgacggccctcaccaagcgcctccatccccccaagctggacgagaaggactggaacgtgatcatcaccaatggcggtggagacggtattcacaaggccgtggacctgctcattaaccctggagaccatgtccttgttgaggagtactgcttctctccctcctttgacaacattaaatctgtcggaggtattcttgttcccatcaagctagattatgacgagggactcgacgtgactggtctcaaacggatccttgaaaactgggatgaggccaagcagggacccaaaccccgagttctgtatagtgttccttctggccagaatccctacggagtctcccagtctctggagagacgtaaagcaatctatgctgttctgaaagaacatgggatcgtcatcatcgaagatgatccctacggagccctggcctacgagtcctacaacaagaaattcaccaacggcaactcctccaagtctctgaacactccggagaaggctcatgacgagtctgtcgactctgaggcacgtgaatccgacatctccaaggctgatatcgaccattacacctccttgatcgctccctcttacctcaccattgatgatgtaggactggttgttcgaattgacactttctccaaggtattttctccgggacttcgacttgggtggattgtcagtcacgtcaacttcattgagaagctatctctatacacttctctttcaacccgggccgcttccggcgtttctcagctgctgatcaacaacattgctcactcttggggtcttgagggctggttgcgttggtgtcttctgttgcgaaaccagtatctggagcgacgaaaccaccttctagcccagctggacaagctcgaccagtccaagatcacctacatcacgcctgtctgtggtatgtttgtgtctgcgcttgttcattttgataagattgcgtcttcgtcgtttaatggcgtcactcttccctaccagtcgcgactggtggagcttggaatcgaggaaggagttctgattgtttctggatccaatatggctgcttccgaagagctgcgtcaaacggccaagttcattcgactcacttttgcctatgaggatcccgatctgctcgacgaggctatcaagcgattgggtaaggcggtggaccggctttttgaggagggtgagattaagcagaagtag

SEQ ID NO: 6002 - protein, 532 aa, Yarrowia lipolytica CLIB122
MSFHDKFISDRSKARSHSHFTLNQTAKTTKPHSNPIFISGGLPNPIGFPIDEITVNLTTSPNPRPRFVPAATLFSKPGLVEFPDITENSTRLSQNLKILKFAESLETATNGNGGQLTLERSLQYGEQDGHPQLKKFVTALTKRLHPPKLDEKDWNVIITNGGGDGIHKAVDLLINPGDHVLVEEYCFSPSFDNIKSVGGILVPIKLDYDEGLDVTGLKRILENWDEAKQGPKPRVLYSVPSGQNPYGVSQSLERRKAIYAVLKEHGIVIIEDDPYGALAYESYNKKFTNGNSSKSLNTPEKAHDESVDSEARESDISKADIDHYTSLIAPSYLTIDDVGLVVRIDTFSKVFSPGLRLGWIVSHVNFIEKLSLYTSLSTRAASGVSQLLINNIAHSWGLEGWLRWCLLLRNQYLERRNHLLAQLDKLDQSKITYITPVCGMFVSALVHFDKIASSSFNGVTLPYQSRLVELGIEEGVLIVSGSNMAASEELRQTAKFIRLTFAYEDPDLLDEAIKRLGKAVDRLFEEGEIKQK

SEQ ID NO: 6003 - DNA, 1566 bp, Aspergillus nidulans FGSC A4
  CDS (1)..(1566)
atgagccgtttacatattcatgacatcgaatctttacgcgccagctccgcacccctaccgctgacggttgcgcccgccacttcctccgagcatttcaagtccattcacactcgccaaagacctgtcgcctgtcgattggaccatcacttcagcgccgagagcagggacttcaatggtgccgatttcaagaaaggtgcgagccccatcggaccacggaagatcattcctcttggtactggacgaccaacagccgactattatccgtgggaatcatttacattccacggtgtctcgcctgcttccctggcgagtagcacagctaacgactctggccattcggtttacacagtcacaaagcgagatgccacgtacaatctctcgctaggaatgaattacggtcatgcggcaggttcgccgcatctcctgcgattcatcacggaacacattgagctggtccataatccgccatatcaagactggcgtacttttctgtcttgcggcgcgacagtggcgcttgaagttgccctgcggatattctgcaatcggggtgattggattttgacagaacaatacacctactctggaacactcgagactgcaaccctgacctgtgcacgagtgtatggagttgaaatggatgcggatggtcttcggtccgatgtcctagaaagaaccctcgcctcttgggacacatctaagggcaggaaaccaagagtattatataccatacctacaggccaaaatcccacaggatacagccagtctctggagagacgtgcagccatctacgcgatcgcggtcaagcatgacctgatcataatcgaagatgacccttattacttcctccgtctgggtccctacaacgaagcaagtacagacgccgaagaacccacaaagatatctcctgatgcattctatagcactggagacccatcctacctctctctggatacatctggccgcgtcgtgcgcctggattcgacgtctaagattctcgccccagggctgcgcgcgggctgggtgactgcatcatcgcaaatcatcgacaagtttctcgcctaccaggaagttagtaccatagcagtgagtggctcgtcacaactaatgctatggagcctccttgatcaggggtggggccacaccggcttctcgtcctggttgctgcatctctcaggggagtaccgacagcgtcgtaatatccttttacgcgcatgccaacagcaccttccaagagatatagcagagtgggtgccgccgcggtacggcatgtttctttggattaaagtgaactggagacgacaccctgtaataggcaaattcgaaacaaaggcgacgccagaggaggtggattcccgccttcaagggctggaggcccagattgtttctgatgcgcttagtcgaggcgttttgatcaccaagggctcacttttttcttggaataagagacccaacggcgagctgcacttccggatgacctttgcggcggccgagaaggcagatttggaagagggcgtgaggcttctcggggagactctgagaggtgtatttcagacatgcttagattag

SEQ ID NO: 6004 - protein, 521 aa, Aspergillus nidulans FGSC A4
MSRLHIHDIESLRASSAPLPLTVAPATSSEHFKSIHTRQRPVACRLDHHFSAESRDFNGADFKKGASPIGPRKIIPLGTGRPTADYYPWESFTFHGVSPASLASSTANDSGHSVYTVTKRDATYNLSLGMNYGHAAGSPHLLRFITEHIELVHNPPYQDWRTFLSCGATVALEVALRIFCNRGDWILTEQYTYSGTLETATLTCARVYGVEMDADGLRSDVLERTLASWDTSKGRKPRVLYTIPTGQNPTGYSQSLERRAAIYAIAVKHDLIIIEDDPYYFLRLGPYNEASTDAEEPTKISPDAFYSTGDPSYLSLDTSGRVVRLDSTSKILAPGLRAGWVTASSQIIDKFLAYQEVSTIAVSGSSQLMLWSLLDQGWGHTGFSSWLLHLSGEYRQRRNILLRACQQHLPRDIAEWVPPRYGMFLWIKVNWRRHPVIGKFETKATPEEVDSRLQGLEAQIVSDALSRGVLITKGSLFSWNKRPNGELHFRMTFAAAEKADLEEGVRLLGETLRGVFQTCLD

SEQ ID NO: 6005 - DNA, 1590 bp, Aspergillus nidulans FGSC A4
  CDS (1)..(1590)
atgtctccgccggcagctttggacatggataccaacggcattggcgctcctaagccgttgactgtcgatggaattgctgctgtgagggcgaagagcgccccaatgcctgctggggttgctcctgctaccagtagtgatatgttcaagagtccggcctgttacaccaaaccaaaggcgaagagatgggacaatttcttcactcttgaagctaagtcacgaaagacctcgacattaaaaggagcggcgaagtttttgaaaaacccaggccttatttccttgggtggcgggctgccctccccagaatacttcccgttcgaagaactctctttcaaagtgcctaccccgcctggcttttcccccgaagcaacgcgacagtccggcactactttggtcgccggaaaacatgatattcgtgagggcaagagcctgtacgatcttgaggtttctctgaactacgggcaatcgactggatcccctcagctgctccgatttgtgacggaacataccgagctcattcataaccccccatactctgactggcaatgcgctttgactgccggaagtacctatgcctgggatacagctctccggttgttctgtgaaaggggtgattaccttctgatggaagagtatactttctctagcgcccaagaaaccgcccttccccagggagtcaacgttgcccccgttaagatggacgaacaaggacttctgcctggagacctggatgatgtcctgagcaactgggatgagaaagtccgcggtgctcggaagcctttcgttctctataccatcccgaccggccagaaccccacaggcgctacgcaatccgcagaacggcgaaaggagatctacaaagtcgctcagaagcacaacatttatatcattgaggacgagccgtactacttcttgcaaatgcagccgtacacaggagccgatagtgcgccagtgccgcctcctgcgaaccacgaagaatttgtcaagtcccttattccttcatatctgagcattgatgtcgatggccgtgttcttcgtgttgagtcattctccaaagtcctggcccctggctcgcgtaccggctgggtcgtcggctctgagcaggtcattgaacgctttcttcgaaacaccgaagtttccgcccagcatccgagcggtatctcccagctgatgctcttcaagctgttggatgagcactggggacaccttgggtacttcgattggcttatcaacctgcgcatgcaatacaccaaccgcagaaatattatggttcaagcatgcgagaagcatcttcctcaggagattgctagctggatcgcccctgcagcgggcatgttccactggattcaagtggactggaagaagcaccctgaactcacatctggtaagactcgcgactccatcgaagaggctcttttccatgccgctatcaacaacggcgtccttgtgtcgcgtggaagctggttcaaggccgctggagcaagcgaagacaagcttttcttccgtgctacattcgcggctgccagtgaggagaatatcacagaggcgatcaggagatttggtgatgcgctccgggttgagttcaagctatag

SEQ ID NO: 6006 - protein, 529 aa, Aspergillus nidulans FGSC A4
MSPPAALDMDTNGIGAPKPLTVDGIAAVRAKSAPMPAGVAPATSSDMFKSPACYTKPKAKRWDNFFTLEAKSRKTSTLKGAAKFLKNPGLISLGGGLPSPEYFPFEELSFKVPTPPGFSPEATRQSGTTLVAGKHDIREGKSLYDLEVSLNYGQSTGSPQLLRFVTEHTELIHNPPYSDWQCALTAGSTYAWDTALRLFCERGDYLLMEEYTFSSAQETALPQGVNVAPVKMDEQGLLPGDLDDVLSNWDEKVRGARKPFVLYTIPTGQNPTGATQSAERRKEIYKVAQKHNIYIIEDEPYYFLQMQPYTGADSAPVPPPANHEEFVKSLIPSYLSIDVDGRVLRVESFSKVLAPGSRTGWVVGSEQVIERFLRNTEVSAQHPSGISQLMLFKLLDEHWGHLGYFDWLINLRMQYTNRRNIMVQACEKHLPQEIASWIAPAAGMFHWIQVDWKKHPELTSGKTRDSIEEALFHAAINNGVLVSRGSWFKAAGASEDKLFFRATFAAASEENITEAIRRFGDALRVEFKL

SEQ ID NO: 6007 - DNA, 1773 bp, Aspergillus nidulans FGSC A4
  CDS (1)..(1773)
atggcttccttgtcgccccctttagatttgtcgcatcactttagcctcacaacgaagcggcgtgctccgagcgccgtcaaagacttctataagtattttatgattccgggcattgccaatttggccggtggactgccaaatgcttcttattttccgtacgacacactcgaagcctctgccgcacatccccagcgattcccgacaataccgggcggaaagaaggccaagggaccccagacaagcgagcgtatcgtcgtacctaaagaatctcggagtgcgacatcaaagaagattgatatcacaacagccttgcaatatggcaccagcgagggtctccctcctctggcgacttttgtcaatcagttcgttcgcgagcatcttcacccgaacattccctacgctggcggtcctggcaccctcttgaccacgggcgcaaccgacggcttctccaaggctattgaagctttcacggaaacgtggaatcccgaccgtgacgggatacacttgcgccagggcattctctgcgaggaattcgtgtatatgaatgctattcagaccgtcaagccaagagggttgaacatcgtcccggtggctattgatgacgagggtatgctgccatacggcccgggcggattggccgaggttttgggaaactggaaccatcgcaaaggctgtcgtccacatctgatgtataccataaccatcggccagaacccaactggtggcacattgtctgtcgaacgtcgcaagcagatctacgctatttgccaaaagtacgatgtgatcattgtcgaggacgacccatactggaacctgcagtacccgtcagcccaggaactccaagcacgacatcggaactcgtcagtaaacccagctttgtcggagcgcaattacaacgctggaagaaagtcatctgggtacaagtttcttgattcccttgtgccgtcgtatctctccatcgacatggacggccgggttgtccgcctggacacgttttcgaagacaattgctccgggttgccgtctcggctggattacagcacaaccagctttcattgagaggctggcgcgaatcgcagaatcgtcaacccaagcaccatcaggcttcgtccaagctatggttgccgaactgatcctgggccagcaggtggatgatggatctgctgattccgcgaaaagcaaggacaccgaaagggcctggaagatggatggctgggtacgctggcttgaaggtctacgagcaggttacgaacaacgcatgcagcagatgtgcagtggcctggaggagggtaaatatatcgcactccacactaggtcggatgagttctccttgagcgggaatgaagaagactcatgggaggtcttggaaaaagtacaaatgtacgacttcgcatggcccactggcggcatgttcgtctgggttaaagtaaactatgagagtcaccccttacgtcagatatatggacctgagaggctctccaaagcgctatgggtgcatttcacccaaaaaccacagctctgcctccttggtccaggcaccatattctcgccgacggacgaggtacaagctcgtggtcatcaatacttccggctgtgcttcgctgcaatgccggcagatgatgttgtccccatcactcaacgagtggtcgatggtttcagatcgttttggcagagaaagaacttagacggacttgaaggtgatgacggcattgcacaaacgatggagcagctgcagatggaaccatctgctaattttctgggaatgggctgttga

SEQ ID NO: 6008 - protein, 590 aa, Aspergillus nidulans FGSC A4
MASLSPPLDLSHHFSLTTKRRAPSAVKDFYKYFMIPGIANLAGGLPNASYFPYDTLEASAAHPQRFPTIPGGKKAKGPQTSERIVVPKESRSATSKKIDITTALQYGTSEGLPPLATFVNQFVREHLHPNIPYAGGPGTLLTTGATDGFSKAIEAFTETWNPDRDGIHLRQGILCEEFVYMNAIQTVKPRGLNIVPVAIDDEGMLPYGPGGLAEVLGNWNHRKGCRPHLMYTITIGQNPTGGTLSVERRKQIYAICQKYDVIIVEDDPYWNLQYPSAQELQARHRNSSVNPALSERNYNAGRKSSGYKFLDSLVPSYLSIDMDGRVVRLDTFSKTIAPGCRLGWITAQPAFIERLARIAESSTQAPSGFVQAMVAELILGQQVDDGSADSAKSKDTERAWKMDGWVRWLEGLRAGYEQRMQQMCSGLEEGKYIALHTRSDEFSLSGNEEDSWEVLEKVQMYDFAWPTGGMFVWVKVNYESHPLRQIYGPERLSKALWVHFTQKPQLCLLGPGTIFSPTDEVQARGHQYFRLCFAAMPADDVVPITQRVVDGFRSFWQRKNLDGLEGDDGIAQTMEQLQMEPSANFLGMGC

SEQ ID NO: 6009 - DNA, 1572 bp, Candida albicans SC5314
  CDS (1)..(1572): transl_table=12
atgtctgatcctactcatttaatttctaagcgagctgctggaagaacttcggtacattttacaaatgctccatctgataagcctccggcaaatttcaagcctcatgaaaaaccgttggcattgtcttatggtatgccgaatcacgggtttttcccaattgattccatagatgtcaatttagttgattacccattccaaaaaattaccacaccttctactacttcgtctactgcagaagaagaacctccttcttcttctttgaatggttccgagaacggtcatcaaaccaaaactccgccttccagtatacacacaccacagtcaactgttcatatcagcagacatactactgatccaaaattaattgatttggctagaggattacaatatgctgctgttgaaggtcatgcaccattattacaatttgcaagagatttcatcattcgtacacataaaccaaattatgacgattggaatgttttcattactactggtgccagtgatggattaaataaagctgctgatgtatttttagatgatggtgatgttatcttagttgaggaatttacatttagtccatttttaagatttctggataatgctggtgctaaagctgttccagtgaaaatcaattttgataatgattctgatggaattgatttgactcaatttgttgatttattggagaattgggagaaacattatccaaacttacctaaaccaaaggcattatatactattgccacaggacaaaatccaactggatttactcaatctttagaatttagaaagaaaatttatgatttggctgtcaaatatgattttgccattattgaagatgatccttatggttatttgacattaccaaaatatgaaaaacctaatataggtggtagtggtagtggcaataatgaattgaaaaacgatcttgaaattgacgattatttgaaaaatcatttgactccatcttaccttgaattggacactactggtagagttcttagagttgagaccttttccaaattatttgctccaggtttgagattaggatttattgttggtcataaagaagtcattgacgcagttaagaattatagtgacgttgttaatcgaggtgctctgggtttaacacaaactattgttaataatgttattcaagaaaactttaaaggtgttgatggatggctagaatggattttaaaaatgagattgaattattcttacagaaaagatttgttattatattcaatttttgaatcacaagcttataaaaaaggttatgttgatgttattgaccctaaagctggtatgtttgttacttttaaaattaatttgccaaaagatgttgatgttttacaaaaaatgaaattattattatggaaattgatttcttatggaattttggttgttccaggatataatatgacggttgatttagagtttagtaaagatagaagcaatttctttagattatgttatgctcttgctaataatgatgaagaaattcttgaaagtggtaaaagattgactgatgcagtttatgaattctttagtaatgggttagagttttaa

SEQ ID NO: 6010 - protein, 523 aa, Candida albicans SC5314
MSDPTHLISKRAAGRTSVHFTNAPSDKPPANFKPHEKPLALSYGMPNHGFFPIDSIDVNLVDYPFQKITTPSTTSSTAEEEPPSSSLNGSENGHQTKTPPSSIHTPQSTVHISRHTTDPKLIDLARGLQYAAVEGHAPLLQFARDFIIRTHKPNYDDWNVFITTGASDGLNKAADVFLDDGDVILVEEFTFSPFLRFSDNAGAKAVPVKINFDNDSDGIDLTQFVDLLENWEKHYPNLPKPKALYTIATGQNPTGFTQSLEFRKKIYDLAVKYDFAIIEDDPYGYLTLPKYEKPNIGGSGSGNNELKNDLEIDDYLKNHLTPSYLELDTTGRVLRVETFSKLFAPGLRLGFIVGHKEVIDAVKNYSDVVNRGASGLTQTIVNNVIQENFKGVDGWLEWILKMRLNYSYRKDLLLYSIFESQAYKKGYVDVIDPKAGMFVTFKINLPKDVDVLQKMKLLLWKLISYGILVVPGYNMTVDLEFSKDRSNFFRLCYALANNDEEILESGKRLTDAVYEFFSNGLEF

SEQ ID NO: 6011 - DNA, 1572 bp, Candida albicans SC5314
  CDS (1)..(1572): transl_table=12
atgtctgatcctactcatttaatttctaagcgagctgctggaagaacttcggtgcattttacaaatgctccatctgataagcctccggcaaatttcaagcctcatgaaaaaccgttggcattgtcttatggtatgccgaatcacgggtttttcccaattgattccatagatgtcaatctagttgattacccatttcaaaaaattaccacaccttctactacttcgtctactgcagaagaagaacctccttcttcttctttgaatggttccgagaacggtcatcaaaccaaaactccgccttccagtatacacacaccacagtcaactgttcatatcagcagacatactactgatccaaaattaattgatttggctagaggattacaatatgctgctgttgaaggtcatgcaccattattacaatttgcaagagatttcatcattcgtacacataaaccaaattatgacgattggaatgttttcattactactggtgccagtgatggattaaataaagctgctgatgtatttttagatgatggtgatgttatcttagttgaggaatttacatttagtccatttttaagatttctggataatgctggtgctaaggctgttccagtgaaaatcaattttgataatgattccgatggaattgatttgactcaatttgttgatttattggagaattgggagaaacattatccaaacttacctaaaccaaaggcattatatactattgccacaggacaaaatccaactggatttactcaatctttagaatttagaaagaaaatttatgatttggctgtcaaatatgattttgccattattgaagatgatccttatggttatttgacattaccaaaatatgaaaaacctaatataggtggtagtggtagtggcaataatgaattgaaaaacgatcttgaaattgatgattatttgaagaatcatttgactccatcttaccttgaattggacactactggtagagttcttagagttgagaccttttccaaattatttgctccaggtttgagattaggatttattgttggtcataaaaaagtcattgacgcagttaagaattatagtgacgttgttaatcgaggtgctctgggtttaacacaaactattgttaataatgttattcaagaaaactttaaaggtgttgatggatggctagaatggattttaaaaatgagattgaattattcttatagaaaagatttattattatattcaatttttgaatcacaagcttataaaaaaggttatgttgatgttattgaccctaaagctggtatgtttgttacttttaaaattaatttgccaaaagatgttgatgttttacaaaaaatgaaattattattatggaaattgatttcttatggaattttggttgttccaggatataatatgacggttgatttagagtttagtaaagatagaagcaatttctttagattatgttatgctcttgctaataatgatgaagaaattcttgaaagtggtaaaagattgactgatgcagtttatgaattctttagtaatgggttagagttttaa

SEQ ID NO: 6012 - protein, 523 aa, Candida albicans SC5314
MSDPTHLISKRAAGRTSVHFTNAPSDKPPANFKPHEKPLALSYGMPNHGFFPIDSIDVNLVDYPFQKITTPSTTSSTAEEEPPSSSLNGSENGHQTKTPPSSIHTPQSTVHISRHTTDPKLIDLARGLQYAAVEGHAPLLQFARDFIIRTHKPNYDDWNVFITTGASDGLNKAADVFLDDGDVILVEEFTFSPFLRFSDNAGAKAVPVKINFDNDSDGIDLTQFVDLLENWEKHYPNLPKPKALYTIATGQNPTGFTQSLEFRKKIYDLAVKYDFAIIEDDPYGYLTLPKYEKPNIGGSGSGNNELKNDLEIDDYLKNHLTPSYLELDTTGRVLRVETFSKLFAPGLRLGFIVGHKKVIDAVKNYSDVVNRGASGLTQTIVNNVIQENFKGVDGWLEWILKMRLNYSYRKDLLLYSIFESQAYKKGYVDVIDPKAGMFVTFKINLPKDVDVLQKMKLLLWKLISYGILVVPGYNMTVDLEFSKDRSNFFRLCYALANNDEEILESGKRLTDAVYEFFSNGLEF

SEQ ID NO: 6013 - DNA, 1443 bp, Cryptococcus neoformans var. neoformans B-3501A
  CDS (1)..(1443)
atgccttccatcaactccacgcccgtcccagtggactttactaaatacttcagcaaggaaactacggggaggaagaggtcgcaattgaaggagcttcgaccgtatttcgagatccctggtatgatcagctttggagttggcattccccatccctcgacatggccagtcaacggcatgacgctttcggtgccattcgcaggcaaatcagtctttgtcccgggctacaacagccggtcacctgaagacatgcttcctctcgcgctttatcaagagccttcgaaaaatgaaccccttcgacctgaccttactgaggagctccaatacagcgcaacttacggtaccaagcacctcctcagctggattaaggagcacatcgagcgagtccatgcgcctccttatgaggactggattaacctccttactgcgggaaacactgatggagtcgatgcggtgatgcgagcttgtttcgaccggggcgattacatgctggttgaagaattcgcataccctggattacttagccctgcagcgactttgggcatcaagtgcttgggtgtgccgctcgattcggaaggtattgatccaagcgctctggacgagatccttacaaactgggacgaaacagaaagaggaggccctaggccaaagatgcttgttatggtacccacatgctcaaatcccgctggtgtgacggtacctgctcaccggaaacaagagatctacgcgatttgtcgaaaatgggatctgctcatctgcgaggacgatccatactgcttcttgcaaatcagaccgaatggcgctgatagccctatcgttcccagcttcttgtcgcttgataccgacggtcgagtcatccgggttgacagcttttctaagatcgtagcgccaggtagtcggctaggcttcgttacgggtcacaaggtccttgtggaaaagattatgaatacgcgagaaagctcaactcaatgcccatctggtttctctatcgctgctatcgctgctatccttcgagcttggggcggtcacgagggtttcgagcgaaaatacattcctcacatctcagacatttactccaaaaggtgcctgtccattattgacctcctcaaaaagcacgttccctccaataccatcgaaatccccaagcccgccggaggcatgttcctctgggtccgtctcaggatcgagtcccacccatcttttccttctgaagaccccgaaacgatctccaaacaagttttccaagcgatgatcgatgagaaagtcttgatggctccctccgagttctttaaagcgccctcgacgtcggtttggacgccggagcaagaggcaaagaggatctttgtcaggattagcttttccttgcctccgcaggatgagatggaggaaggtgcgaaaaggatgggaagggctttggcgagggagtggggtctggagcaagcttga

SEQ ID NO: 6014 - protein, 480 aa, Cryptococcus neoformans var. neoformans B-3501A
MPSINSTPVPVDFTKYFSKETTGRKRSQLKELRPYFEIPGMISFGVGIPHPSTWPVNGMTLSVPFAGKSVFVPGYNSRSPEDMLPLALYQEPSKNEPLRPDLTEELQYSATYGTKHLLSWIKEHIERVHAPPYEDWINLLTAGNTDGVDAVMRACFDRGDYMLVEEFAYPGLLSPAATLGIKCLGVPLDSEGIDPSALDEILTNWDETERGGPRPKMLVMVPTCSNPAGVTVPAHRKQEIYAICRKWDLLICEDDPYCFLQIRPNGADSPIVPSFLSLDTDGRVIRVDSFSKIVAPGSRLGFVTGHKVLVEKIMNTRESSTQCPSGFSIAAIAAILRAWGGHEGFERKYIPHISDIYSKRCLSIIDLLKKHVPSNTIEIPKPAGGMFLWVRLRIESHPSFPSEDPETISKQVFQAMIDEKVLMAPSEFFKAPSTSVWTPEQEAKRIFVRISFSLPPQDEMEEGAKRMGRALAREWGLEQA

SEQ ID NO: 6015 - DNA, 1476 bp, Cryptococcus neoformans var. neoformans B-3501A
  CDS (1)..(1476)
atgccctccgttgcagccgtccctgttaagctcgattatcaatctttccttagtcaggaggcgaagggacgagtaaggtctccattgagagatctcaggtattttcatgccatccctggtatgatcagtttcggaggaggcttaccccatccatccacctggccagtcaacgctatgacgctgtctgtcccattcgccaaaaagtctatcttcattcccgggtatgagagcaatgacccaaccagtctctatcctttggctccgtatatcccgcctacgaagctcaatagtgtgactgagcccttaatccctgatctcgcgcgggatctccaatattcatcgaactttggtttgccatactttgttgactggctcactcagcacgtgaaaagaatacatgatcccccctaccctgaaaaccagtggcaggttctcgccaccgctggtaacacggatgcgtcggatggggtagtcagaacactgtgcagcccaggagactctatactacttgaagaatttgctttcccaggctctttaactcattacaagtcactcggcatcaaatgtgctggtgttccaatggatggtgaaggaattgtccccagcgcacttgaaaagatactggccgaatgggacgacgaagctcgaggcggtccaaagccgaaagttatccttattgtacccacttgctcaaacccctcagggatcacttacccggcctccaggaaacgtgaaatatacgcagtctgtcgaaaatggaatttgcttatcattgaggatgatccttattgctaccttcaggtaaggcccaatggagcggacaccccattaattccgtcattcttgtccttggatcttgatggtcgagtggtgcgcttggactctttttctaaattcatagcccctgggagcaggtgtggttggatcacaggagcgaaggagctggtaaccactatcatggtaaaggcagaagcgagctccaatggaccttcaggttttgcagttgcttccatctccgctgtgatcaaggcatggggcggccatgaagggctggaaagggattatcttccccacatctcggatacatattccaagcggtccaatcttatggtgtctctcattcgcaaatatgtccctgcagaagcggctgaatgccctgatgggtctggagggatgttcctctgggtacgactgcgagttgaatcccatccccagctatccactctctcacctgaagagatttcagacaaagtgtttcacactctcatcggagagaaagtaatggtagccccgtctagctacttcaaaacacctggagggccggtatggtctaaagacgaagaatctaaaaggatctttgtcaggttgagcttctctctctctaccgcagatgaaatggaagagggcgtgaagagattcgctagaggattgagaaaggaatggggaatccggaatcttgatgaagctgagcattag

SEQ ID NO: 6016 - protein, 491 aa, Cryptococcus neoformans var. neoformans B-3501A
MPSVAAVPVKLDYQSFLSQEAKGRVRSPLRDLRYFHAIPGMISFGGGLPHPSTWPVNAMTLSVPFAKKSIFIPGYESNDPTSLYPLAPYIPPTKLNSVTEPLIPDLARDLQYSSNFGLPYFVDWLTQHVKRIHDPPYPENQWQVLATAGNTDASDGVVRTLCSPGDSILLEEFAFPGSLTHYKSLGIKCAGVPMDGEGIVPSALEKILAEWDDEARGGPKPKVILIVPTCSNPSGITYPASRKREIYAVCRKWNLLIIEDDPYCYLQVRPNGADTPLIPSFLSLDLDGRVVRLDSFSKFIAPGSRCGWITGAKELVTTIMVKAEASSNGPSGFAVASISAVIKAWGGHEGLERDYLPHISDTYSKRSNLMVSLIRKYVPAEAAECPDGSGGMFLWVRLRVESHPQLSTLSPEEISDKVFHTLIGEKVMVAPSSYFKTPGGPVWSKDEESKRIFVRLSFSLSTADEMEEGVKRFARGLRKEWGIRNLDEAEH

SEQ ID NO: 6017 - DNA, 1503 bp, Saccharomyces cerevisiae
  CDS (1)..(1503)
atgactttacctgaatcaaaagacttttcttacttgttttcggatgaaaccaatgctcgtaaaccatccccattgaaaacctgcatccatcttttccaagatcctaacattatctttttgggtggtggcctgccattaaaagattatttcccatgggataatctatctgtagattcacccaagcctccttttccccagggtattggagctccaattgacgagcagaattgcataaaatacaccgtcaacaaagattacgctgataaaagtgccaatccttccaacgatattcctttgtcaagagctttgcaatacgggttcagtgctggtcaacctgaactattaaacttcattagagatcataccaagattatccacgatttgaagtataaggactgggacgttttagccactgcaggtaacacaaatgcctgggaatctactttaagagtcttttgtaaccgaggtgatgtcatcttagttgaggcacattctttttcctcttcattggcttctgcagaggctcaaggtgtcattaccttccccgtgccaattgacgctgatggtatcattcctgaaaaattagctaaagtcatggaaaactggacacctggtgctcctaaaccaaagttgttatacactattccaacgggccaaaatccaactggtacttccattgcagaccatagaaaggaggcaatttacaagatcgctcaaaagtacgacttcctaattgtggaagatgaaccttattatttcttacaaatgaatccctacatcaaagacttgaaggaaagagagaaggcacaaagttctccaaagcaggaccatgacgaatttttgaagtccttggcaaacactttcctttccttggatacagaaggccgtgttattagaatggattccttttcaaaagttttggccccagggacaagattgggttggattactggttcatccaaaatcttgaagccttacttgagtttgcatgaaatgacgattcaagccccagcaggttttacacaagttttggtcaacgctacgctatccaggtggggtcaaaagggttacttggactggttgcttggcctgcgtcatgaatacactttgaaacgtgactgtgccatcgatgccctttacaagtatctaccacaatctgatgctttcgtgatcaatcctccaattgcaggtatgtttttcaccgtgaacattgacgcatctgtccaccctgagtttaaaacaaaatacaactcagacccttaccagctagaacagagtctttaccacaaagtggttgaacgtggtgttttagtggttcccggttcttggttcaagagtgagggtgagacggaacctcctcaacccgctgaatctaaagaagtcagtaatccaaacataattttcttcagaggtacctatgcagctgtctctcctgagaaactgactgaaggtctgaagagattaggtgatactttatacgaagaatttggtatttccaaatag

SEQ ID NO: 6018 - protein, 500 aa, Saccharomyces cerevisiae
MTLPESKDFSYLFSDETNARKPSPLKTCIHLFQDPNIIFLGGGLPLKDYFPWDNLSVDSPKPPFPQGIGAPIDEQNCIKYTVNKDYADKSANPSNDIPLSRALQYGFSAGQPELLNFIRDHTKIIHDLKYKDWDVLATAGNTNAWESTLRVFCNRGDVILVEAHSFSSSLASAEAQGVITFPVPIDADGIIPEKLAKVMENWTPGAPKPKLLYTIPTGQNPTGTSIADHRKEAIYKIAQKYDFLIVEDEPYYFLQMNPYIKDLKEREKAQSSPKQDHDEFLKSLANTFLSLDTEGRVIRMDSFSKVLAPGTRLGWITGSSKILKPYLSLHEMTIQAPAGFTQVLVNATLSRWGQKGYLDWLLGLRHEYTLKRDCAIDALYKYLPQSDAFVINPPIAGMFFTVNIDASVHPEFKTKYNSDPYQLEQSLYHKVVERGVLVVPGSWFKSEGETEPPQPAESKEVSNPNIIFFRGTYAAVSPEKLTEGLKRLGDTLYEEFGISK

SEQ ID NO: 6019 - DNA, 1542 bp, Saccharomyces cerevisiae
  CDS (1)..(1542)
atgactgctggttctgccccccctgttgattacacttccttaaagaagaacttccaaccgtttctctccagaagagtagaaaatagatctctgaaaagcttttgggatgcttctgatatctcagatgacgtcattgagctagctggtggaatgccaaacgagagattttttcctatcgaatctatggatttgaaaatatcaaaagttccttttaatgataacccaaaatggcataattcgtttaccacggcgcatttggacttgggatcccccagtgagctacccattgcacgttctttccaatacgcagaaaccaagggtttaccccctctcttacattttgttaaagattttgtgtccagaattaatcgcccagccttttccgatgagacggagtctaactgggatgtcatcctttctggcgggtccaacgattcaatgtttaaggtttttgaaacaatttgcgacgaatcgaccactgtgatgattgaagagtttactttcaccccggctatgtccaatgtggaggctacaggagcaaaagtcatccccatcaagatgaacctgaccttcgacagagagtcccagggtattgatgtcgaatatctaacgcagttgctcgataattggtcaactggaccatacaaagacttaaacaagccaagggtcctatataccattgcaacgggccaaaatcctaccgggatgtctgtcccccagtggaaaagagagaaaatttaccagttggcccaaagacacgatttcctcattgttgaagatgatccctacggttatctgtactttccttcctataatccgcaagagccattagaaaacccttaccattctagcgacctgactactgaacggtatttgaatgattttttaatgaaatcattcttgactttggatacagatgcccgtgtcatccgtttggagactttttctaaaatttttgctcctggattaaggttatccttcatcgttgctaataaattccttttgcaaaaaatcttggatttggccgacattactacaagggcccccagtggtacctcacaagctattgtttattctacaataaaggcaatggctgagtccaacttatcgtcctctctttctatgaaagaagcaatgtttgagggttggataagatggataatgcagattgcttctaaatacaatcataggaaaaatcttactttgaaagccttatacgaaacagaatcttaccaagctggtcagtttaccgttatggaaccctccgcgggtatgttcatcattattaaaatcaattgggggaatttcgatagacctgacgatttgccgcaacagatggatattttagataagttcttgctgaagaatggtgttaaactagtgcttggttataaaatggctgtttgcccaaattattcaaagcagaattcagattttctaagactcaccatcgcctatgcaagggatgatgatcagttgattgaagcttccaaaagaatcggtagtggcataaaagaattttttgacaactataaaagttga

SEQ ID NO: 6020 - protein, 513 aa, Saccharomyces cerevisiae
MTAGSAPPVDYTSLKKNFQPFLSRRVENRSLKSFWDASDISDDVIELAGGMPNERFFPIESMDLKISKVPFNDNPKWHNSFTTAHLDLGSPSELPIARSFQYAETKGLPPLLHFVKDFVSRINRPAFSDETESNWDVILSGGSNDSMFKVFETICDESTTVMIEEFTFTPAMSNVEATGAKVIPIKMNLTFDRESQGIDVEYLTQLLDNWSTGPYKDLNKPRVLYTIATGQNPTGMSVPQWKREKIYQLAQRHDFLIVEDDPYGYLYFPSYNPQEPLENPYHSSDLTTERYLNDFLMKSFLTLDTDARVIRLETFSKIFAPGLRLSFIVANKFLLQKILDLADITTRAPSGTSQAIVYSTIKAMAESNLSSSLSMKEAMFEGWIRWIMQIASKYNHRKNLTLKALYETESYQAGQFTVMEPSAGMFIIIKINWGNFDRPDDLPQQMDILDKFLLKNGVKLVLGYKMAVCPNYSKQNSDFLRLTIAYARDDDQLIEASKRIGSGIKEFFDNYKS

SEQ ID NO: 6021 - DNA, 21 bp, Artificial sequence
  primer
atgactgctggttctgccccc

SEQ ID NO: 6022 - DNA, 28 bp, Artificial sequence
  primer
tcaacttttatagttgtcaaaaaattct

SEQ ID NO: 6023 - protein, 602 aa, Artificial sequence
  consensus sequence
  Variant (2)..(27): Xaa in position 2 to 27 is any amino acid
  Variant (28)..(35): Xaa in position 28 to 35 is any or no amino acid
  Variant (37)..(37): Xaa in position 37 is any amino acid
  Variant (39)..(42): Xaa in position 39 to 42 is any amino acid
  Variant (45)..(64): Xaa in position 45 to 64 is any amino acid
  Variant (65)..(120): Xaa in position 65 to 120 is any or no amino acid
  Variant (123)..(126): Xaa in position 123 to 126 is any amino acid
  Variant (128)..(155): Xaa in position 128 to 155 is any amino acid
  Variant (156)..(161): Xaa in position 156 to 161 is any or no amino acid
  Variant (163)..(183): Xaa in position 163 to 183 is any amino acid
  Variant (184)..(193): Xaa in position 184 to 193 is any or no amino acid
  Variant (195)..(208): Xaa in position 195 to 208 is any amino acid
  Variant (210)..(220): Xaa in position 210 to 220 is any amino acid
  Variant (221)..(226): Xaa in position 221 to 226 is any or no amino acid
  Variant (228)..(241): Xaa in position 228 to 241 is any amino acid
  Variant (242)..(250): Xaa in position 242 to 250 is any or no amino acid
  Variant (252)..(254): Xaa in position 252 to 254 is any amino acid
  Variant (256)..(258): Xaa in position 256 to 258 is any amino acid
  Variant (260)..(260): Xaa in position 260 is any amino acid
  Variant (264)..(264): Xaa in position 264 is any amino acid
  Variant (266)..(272): Xaa in position 266 to 272 is any amino acid
  Variant (274)..(286): Xaa in position 274 to 286 is any amino acid
  Variant (288)..(288): Xaa in position 288 is any amino acid
  Variant (291)..(291): Xaa in position 291 is any amino acid
  Variant (294)..(295): Xaa in position 294 to 295 is any amino acid
  Variant (297)..(309): Xaa in position 297 to 309 is any amino acid
  Variant (310)..(353): Xaa in position 310 to 353 is any or no amino acid
  Variant (355)..(356): Xaa in position 355 to 356 is any amino acid
  Variant (357)..(357): Xaa in position 357 is any or no amino acid
  Variant (361)..(361): Xaa in position 361 is any amino acid
  Variant (363)..(365): Xaa in position 363 to 365 is any amino acid
  Variant (369)..(370): Xaa in position 369 to 370 is any amino acid
  Variant (374)..(374): Xaa in position 374 is any amino acid
  Variant (376)..(376): Xaa in position 376 is any amino acid
  Variant (378)..(401): Xaa in position 378 to 401 is any amino acid
  Variant (403)..(404): Xaa in position 403 to 404 is any amino acid
  Variant (406)..(427): Xaa in position 406 to 427 is any amino acid
  Variant (428)..(449): Xaa in position 428 to 449 is any or no amino acid
  Variant (451)..(473): Xaa in position 451 to 473 is any amino acid
  Variant (474)..(499): Xaa in position 474 to 499 is any or no amino acid
  Variant (501)..(502): Xaa in position 501 to 502 is any amino acid
  Variant (506)..(532): Xaa in position 506 to 532 is any amino acid
  Variant (533)..(554): Xaa in position 533 to 554 is any or no amino acid
  Variant (556)..(568): Xaa in position 556 to 568 is any amino acid
  Variant (569)..(583): Xaa in position 569 to 583 is any or no amino acid
  Variant (585)..(600): Xaa in position 585 to 600 is any amino acid
  Variant (601)..(601): Xaa in position 601 is any or no amino acid
SXXXXXXXXXXXXXXXXXXXXXXXXXXXXXXXXXXGXPXXXXFPXXXXXXXXXXXXXXXXXXXXXXXXXXXXXXXXXXXXXXXXXXXXXXXXXXXXXXXXXXXXXXXXXXXXXXXXXXXXQYXXXXGXXXXXXXXXXXXXXXXXXXXXXXXXXXXXXXXXXGXXXXXXXXXXXXXXXXXXXXXXXXXXXXXXXEXXXXXXXXXXXXXXGXXXXXXXXXXXXXXXXXGXXXXXXXXXXXXXXXXXXXXXXXPXXXYXXXTXQNPXGXXXXXXXRXXXXXXXXXXXXXIXEDXPYXXLXXXXXXXXXXXXXXXXXXXXXXXXXXXXXXXXXXXXXXXXXXXXXXXXXXXXXXXXXDXXXGRVXRXXXFSKXXAPGXRXGXXXXXXXXXXXXXXXXXXXXXXXXGXXQXXXXXXXXXXXXXXXXXXXXXXXXXXXXXXXXXXXXXXXXXXXXYXXXXXXXXXXXXXXXXXXXXXXXXXXXXXXXXXXXXXXXXXXXXXXXXXPXXGMFXXXXXXXXXXXXXXXXXXXXXXXXXXXXXXXXXXXXXXXXXXXXXXXXXGXXXXXXXXXXXXXXXXXXXXXXXXXXXXRXXXXXXXXXXXXXXXXXR

SEQ ID NO: 6024 - protein, 23 aa, Artificial sequence
  protein pattern
  Variant (2)..(2): Xaa in position 2 is Thr or Val
  Variant (3)..(3): Xaa in position 3 is Ile, Leu, Met or Val
  Variant (4)..(5): Xaa in position 4 to 5 is any amino acid
  Variant (6)..(6): Xaa in position 6 is Asp, Glu, Gly or Ser
  Variant (7)..(7): Xaa in position 7 is Ser or Thr
  Variant (11)..(11): Xaa in position 11 is any amino acid
  Variant (12)..(12): Xaa in position 12 is Phe, Ile, Leu, Met or Val
  Variant (13)..(13): Xaa in position 13 is Ala or Val
  Variant (16)..(16): Xaa in position 16 is any amino acid
  Variant (18)..(18): Xaa in position 18 is any amino acid
  Variant (19)..(19): Xaa in position 19 is Gly or Ser
  Variant (20)..(20): Xaa in position 20 is Phe, Trp or Tyr
  Variant (21)..(21): Xaa in position 21 is Ile, Leu or Val
  Variant (22)..(22): Xaa in position 22 is any amino acid
  Variant (23)..(23): Xaa in position 23 is Ala or Gly
RXXXXXXFSKXXXPGXRXXXXXX

SEQ ID NO: 6025 - protein, 18 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is any or no amino acid
  Variant (7)..(7): Xaa in position 7 is Ser, Thr or Val
  Variant (8)..(8): Xaa in position 8 is Ile or Val
  Variant (9)..(9): Xaa in position 9 is Ala, Cys, Pro, Thr or Val
  Variant (10)..(11): Xaa in position 10 to 11 is any amino acid
  Variant (12)..(12): Xaa in position 12 is Gln or Ser
  Variant (15)..(15): Xaa in position 15 is any amino acid
  Variant (17)..(17): Xaa in position 17 is any amino acid
  Variant (18)..(18): Xaa in position 18 is Cys, Ser or Thr
PXXLXYXXXXXXNPXGXX

SEQ ID NO: 6026 - protein, 19 aa, Artificial sequence
  protein pattern
  Variant (2)..(7): Xaa in position 2 to 7 is any amino acid
  Variant (8)..(9): Xaa in position 8 to 9 is any or no amino acid
  Variant (11)..(11): Xaa in position 11 is any or no amino acid
  Variant (14)..(14): Xaa in position 14 is Asp or Glu
  Variant (17)..(18): Xaa in position 17 to 18 is any amino acid
AXXXXXXXXIXEDXPYXXL

SEQ ID NO: 6027 - DNA, 1650 bp, Saccharomyces cerevisiae
  CDS (1)..(1650)
atggcaagacaaaagatgttttataacaaattactcggcatgctcagcgtaggattcgggtttgcttgggcgctcgagaacattactatatacgaatttgactttggcaagggcattctcgatcaaagctacggcggtgtattttcaaacaacggcccttcgcaagtgcagctgcgggatgcagtcttgatgaatgggacagtggtatacgattcaaacggcgcttgggacagtagtgcgctggaggaatggctccagggacagaaaaaagtttccatcgaaaaaatatttgaaaatattgggcccagcgccgtgtatccgtctatttcgcctggggtcgtgattgcgtcaccatcgcaaacgcatccagactacttctaccaatggataagggacagcgcgttgacgataaacagtattgtctctcattctgcgggcccggcaatagagacgttattgcagtacctgaacgtttcattccacttgcaaagaagcaacaacacattgggcgctggcattggttacactaacgatacagtggctttgggagaccctaagtggaacgtcgacaacacggctttcacggaagattggggtcgtcctcaaaacgatgggcctgctcttcgaagcattgccatcttaaaaatcatcgactacatcaagcaatctggcactgatctgggggccaagtacccattccagtccaccgcagatatctttgatgatattgtacgttgggacctgaggttcattattgaccactggaattcttccggatttgatctatgggaggaagtcaatggcatgcatttctttactttactggtacaactgtctgcagtggacaagtcgctgtcgtattttaacgcctcagaacggtcgtctccctttgttgaagaattgcgtcagacacgccgggacatctccaagtttttagtggaccctgcgaatgggtttatcaacggcaagtacaattatattgttgggacacccatgattgccgacacattgagatccggactggacatatccactttattagctgcgaacaccgtccacgatgcgccatctgcttcccatcttccgttcgatatcaatgaccctgccgtcctgaacacgttgcaccatttgatgttgcacatgcgttcgatataccccatcaacgatagctccaaaaatgcaacgggtattgccctgggccggtatcctgaggacgtatatgatggatatggctttggcgagggaaatccctgggtcctggccacgtgtaccgcttcaacaacgctttatcagctcatttacagacacatctctgagcagcatgacttggttgtcccaatgaacaacgattgttcgaacgcattttggagcgagctggtattctccaacctcacgactttgggaaatgacgaaggctatttgattttggagttcaatacacctgccttcaatcaaaccatacaaaaaatcttccaactagctgattcattcttggtcaagctgaaagctcacgtgggaacagacggggaactaagtgaacaatttaacaaatacacagggtttatgcagggtgcccaacaccttacctggtcctatacttcattctgggatgcctatcaaataagacaagaagttttacagagtttgtag

SEQ ID NO: 6028 - protein, 549 aa, Saccharomyces cerevisiae
MARQKMFYNKLLGMLSVGFGFAWALENITIYEFDFGKGILDQSYGGVFSNNGPSQVQLRDAVLMNGTVVYDSNGAWDSSALEEWLQGQKKVSIEKIFENIGPSAVYPSISPGVVIASPSQTHPDYFYQWIRDSALTINSIVSHSAGPAIETLLQYLNVSFHLQRSNNTLGAGIGYTNDTVALGDPKWNVDNTAFTEDWGRPQNDGPALRSIAILKIIDYIKQSGTDLGAKYPFQSTADIFDDIVRWDLRFIIDHWNSSGFDLWEEVNGMHFFTLLVQLSAVDKSLSYFNASERSSPFVEELRQTRRDISKFLVDPANGFINGKYNYIVGTPMIADTLRSGLDISTLLAANTVHDAPSASHLPFDINDPAVLNTLHHLMLHMRSIYPINDSSKNATGIALGRYPEDVYDGYGFGEGNPWVLATCTASTTLYQLIYRHISEQHDLVVPMNNDCSNAFWSELVFSNLTTLGNDEGYLILEFNTPAFNQTIQKIFQLADSFLVKLKAHVGTDGELSEQFNKYTGFMQGAQHLTWSYTSFWDAYQIRQEVLQSL

SEQ ID NO: 6029 - DNA, 1950 bp, Magnaporthe grisea 70-15
  CDS (1)..(1950)
atggacatctcacgagtcgatcatgggacctccacctccaacatcaccacctccgtcaatcccgtcatgcacgccatctcatccttcgttctcctgggcacttatgctgtccaggctgtgcttggtcgtcccaattcccttgcaagacgtgccaatgtcgactccttcattgaggtcgaacgcccaattgcccttcaaggagtcctccgcaacataggctcagatggcgccttggttcgtggtgccggtccaggtgtcgtcatcgcatctccgtccaccgtggacccggactacttttacacctggacccgagacagcgcccttgtgctcaagtgcttgacggatattttcgccaacaagtacgacgccgggctccagtcgaccatcacccagtacatcaccacccaggcccaggtgcaacgcatcgacaacccctccggacccctgagtgacggctcgggtctgggcgagcccaagtacaatgccaacctctctccgtacctcggctcttggggaaggccgcagagggatgggcctgcgttgagggccactgccttggttgcctatgcaaactggctcatcgggaacaactacacgagcactgcccgtgacatcgtgtggcctatcctgaggaatgacttgaactatgtggctcagtactggaacagaactgggtttgatctttgggaggaggttcaaggcagctcattcttcaccactggcgctcagtataaagccttgattgagggagacgctttggccaagaagcttggagcgacttgctcatcctgcgagagcatcgcccctaatatcctctgcttcctgcagagcttctggactccgaatggcaactacatcgtctccaacaccaacacgggtactaaccgctccggcaaagacgccaacagtattctatcatcgattcactcgttcgaccccgctgctggctgcgacgagcttaccttccagccctgcagtgcaaagtcccttgcaaatcacaaggccgtcgtcgactctttcaggttctaccccatcaactctgggatccaagttggccgaggattggccgttggacgctactcggaagatgtctactacggtggcaacccatggcacctgacaacgctcgcggccgcagagcagatctacgatgccgtctatgtgtggaaaaagcaaggccgtcttgaagttaccagcgcatcactcccgtttttccgtgatctttcgtcatctattgccgtcggaagctacgcgtccgattcgacaacctttacccagatcatcgatgcagctctggtgtacgcagatggcttcatcgaggtcgtgcagcgctatgctggcgccaatgggtctctggatgagcagatcgacaagaacaatggtagccagcgctcggcacgcgacctgacttggtcgtatgcagctttccttaccgccactgatcgccgcgccggagttgttccgccatcgtggtttgtgccggccagccttcccggctcgtgctctacaggctcacagcagggagtctactcggccgtgacgccagcctcgttcccagcatctcagacgcccatcaccggcgcgccgcccgtcccccctactactacggcgcctccaggcggttgcacgacggcgcccgtagtagctgttactttcaacgtgctggtgacgacaacgcccggtgatactatcaagatcgtgggcgacattgaggacttgggcaagtggaacccgcagaacggcatcgccctggacgcgaacgactacactgccagcaggccgctgtggaagaaggccatcactctcaaggcgggccaggttgtgcagtacaagttcatcaacgtggccagcggtggtgcagtccgatgggaggctgatccgaaccgggtgtacacggtacccagctcgtgtgccactgctgttgctgtagatggacagtggcagacgtag

SEQ ID NO: 6030 - protein, 649 aa, Magnaporthe grisea 70-15
MDISRVDHGTSTSNITTSVNPVMHAISSFVLLGTYAVQAVLGRPNSLARRANVDSFIEVERPIALQGVLRNIGSDGALVRGAGPGVVIASPSTVDPDYFYTWTRDSALVLKCLTDIFANKYDAGLQSTITQYITTQAQVQRIDNPSGPLSDGSGLGEPKYNANLSPYLGSWGRPQRDGPALRATALVAYANWLIGNNYTSTARDIVWPILRNDLNYVAQYWNRTGFDLWEEVQGSSFFTTGAQYKALIEGDALAKKLGATCSSCESIAPNILCFLQSFWTPNGNYIVSNTNTGTNRSGKDANSILSSIHSFDPAAGCDELTFQPCSAKSLANHKAVVDSFRFYPINSGIQVGRGLAVGRYSEDVYYGGNPWHLTTLAAAEQIYDAVYVWKKQGRLEVTSASLPFFRDLSSSIAVGSYASDSTTFTQIIDAALVYADGFIEVVQRYAGANGSLDEQIDKNNGSQRSARDLTWSYAAFLTATDRRAGVVPPSWFVPASLPGSCSTGSQQGVYSAVTPASFPASQTPITGAPPVPPTTTAPPGGCTTAPVVAVTFNVLVTTTPGDTIKIVGDIEDLGKWNPQNGIALDANDYTASRPLWKKAITLKAGQVVQYKFINVASGGAVRWEADPNRVYTVPSSCATAVAVDGQWQT

SEQ ID NO: 6031 - DNA, 1749 bp, Gibberella zeae PH-1
  CDS (1)..(1749)
atgcttatcaaagtcttgtatggcctggcagccagtgccgccctgtggcaaggccaagtcgttgcatcaccaagcaaagacaactcactcgagcgttttatcgacaaacaagctgatgtttctatcaagggcgtccttgccaacattggcgctgatgggaaaagggcacagggtgcggcacctggcgctgttgtcgcgagcccatcaaaagaagatcctgattattggtacacttggacgcgtgattcagctttgacgtacaaggtcattgtggagagattcatccacggtgacaagtctctccaacgaaagatagacgaatatgtctctgcacaggctaaactacagggaaccacaaatccatctggcagtccagaatcaggcggtctcggcgagccaaagttccacgtgaatctcactgctttcacaggatcttggggtcgacctcagcgcgacggcccacctctcagagccaccgctttgacgctgtacgcagagtggctcatttcccacggcgagcgatccaaggctttgaacaaggtctggccagtcattgaaaaggatcttgcgtatactaccaagttctggaatcgtactggctacgatctctgggaagaggtcaatggatcttctttctttacgctttcggcttcgcatcgcactcttgtcgagggtgcagcgctggctaagaaactcggaaagtcctgccccgactgtgtcaccaacgctcctcgcgttctgtgcttcctccagagtttctggacaggtggatacatcgactctaacatcaacgtcaaggatggtcgcaagggccttgacgtcaactccatcctctcctcgattcacactttcgatcccaactccaagtgcaccgactcgaccttccagccttgctcacccagagctcttgcgaaccacaaggccgtcgtcgattctttcaggtcaatttatggcgttaacaagaacagaggccaaggaaaggctgccgctgtcggtcgatatagtgaggacgtgtactatgatggcaacccctggtacctggccactcttgctgctgcggaacagctctacgccgcggtctaccagtggaacaaggttggagctatcactgttgacgatatgtcattgtctttcttcaaggatattgtccccaagatttccaagggaacttattccaagaacagcaagacatacaaggagatcatcaagtcagccaaggcttacgccgatggcttcgtcgcagttgtgcagacatacactcccaacgatggctcactagctgagcaatttgacaagtccactggagctcccaagtccgctgtccacctcacctggtcctacgcctcattcgtcagcgccaccgaacgtcgcgacggcattgtatccccctcatggggcgagagcagcgccaacaaggtccccgccgtctgccaagctgctccagcatgtgacacgaccatcaccttcactgtcaagaacgtgcaagttacgtctggtcagaaagtttacgtggttggttccgtgactgaactttccaactggtcacctgaggacggcattccgcttacggagggtactgagggtgtgtggagcacaaaggttaagattccttctgatacaagctttgagtacaagtacatcaagaagactagcagtggcgaagttacgtggttgagtgatcccaacaatcgagctttgacgggtagcaagtgtgggagtaccagtactctcaatgatgagtggaggtag

SEQ ID NO: 6032 - protein, 582 aa, Gibberella zeae PH-1
MLIKVLYGLAASAALWQGQVVASPSKDNSLERFIDKQADVSIKGVLANIGADGKRAQGAAPGAVVASPSKEDPDYWYTWTRDSALTYKVIVERFIHGDKSLQRKIDEYVSAQAKLQGTTNPSGSPESGGLGEPKFHVNLTAFTGSWGRPQRDGPPLRATALTLYAEWLISHGERSKALNKVWPVIEKDLAYTTKFWNRTGYDLWEEVNGSSFFTLSASHRTLVEGAALAKKLGKSCPDCVTNAPRVLCFLQSFWTGGYIDSNINVKDGRKGLDVNSILSSIHTFDPNSKCTDSTFQPCSPRALANHKAVVDSFRSIYGVNKNRGQGKAAAVGRYSEDVYYDGNPWYLATLAAAEQLYAAVYQWNKVGAITVDDMSLSFFKDIVPKISKGTYSKNSKTYKEIIKSAKAYADGFVAVVQTYTPNDGSLAEQFDKSTGAPKSAVHLTWSYASFVSATERRDGIVSPSWGESSANKVPAVCQAAPACDTTITFTVKNVQVTSGQKVYVVGSVTELSNWSPEDGIPLTEGTEGVWSTKVKIPSDTSFEYKYIKKTSSGEVTWLSDPNNRALTGSKCGSTSTLNDEWR

SEQ ID NO: 6033 - DNA, 1548 bp, Candida glabrata CBS 138
  CDS (1)..(1548)
atgtttctgtggattgttggagtgttgtcgctgtatgtgtcgttgccctttgtgaaatttctccgtagcgatgctgtctcttggcatgacaggtatgtgccaagaggtaatttcacagagtgggtgcatgcacagaactccattgctctggagaggttgctggacaacttcatcgatgagaacggtgccatactggcttcaccctctcgaaatgagcccgattactactaccagtgggtaagagacagtgctattgtggtcaatacattagttaaacagttgcctgcaattgaacagaacctgcaatatgatcaattggtgcataggaggatactccagttcttgaacaactcgtttgtgttgcaacgcttggataatctctccggtaaaggagttccaacttcaataagagggttgggtgagcccaaattcaacgttgacaacacccagtttaacgaaaattggggcagaccccagaatgatggcccacctttacgaataattaccatcttgaattacttacaacatttgaacaacacaggtaaacagattgatcacattattactcataatgccaaagagggtttcctacctttcaaggtaacaaaagatatatttgacaatattctattttgggatttgcaattcatagtcgatgaatggaaaagtgaaaacttcgacctatgggaagaagttaggggacatcatttcttcacctctgttatgcagctttatgcaattgagagaacattaccaatcgctaaacagaatcacttattgagaaaaaaatttgtggaatctctggtggatactagacataagattcgtgaattcatattagacaataggacagggttcatttcaaaatctgctaaccacatcatatcatgcccggagatctatggcaagcgctcgggtttagatattgcgaccatattggctagtatttacacccatgatggtagtaatacatctgaacatctagacttatttcatgtggacaaccgctatatactgaatacattatatggtctcaccgaatccatgtcagacttgtacccgataaacaaagagaacgagaggcattcaaagaagcataatctagccgctgtggcactaggtagatatccggaggatgtgtatgatggtgtcggaatatcagaaggtaacccatggtacttagccactgctgctgccgccgaacacatgtacaaacttgcaagaaaattcatagaagatgaaaaaagtattccaatttctccaagtgacgaattttggaaatttattatcgagacggatagtaaagataaatttgatgtgaagtatcattcacacgcattcaatgaaacaatcaaatcatttgttgctttaggggactcgtttctcgacaaaatcagattacatgtagccgacgatggatctatgagtgaacaaataaacaagtacacagggtataaccaaggtgcctctgatctaacatggtcttatggttcttatttgaatgcgtatcaagctagagaggaaattctagcttatttatcgcattga

SEQ ID NO: 6034 - protein, 515 aa, Candida glabrata CBS 138
MFLWIVGVLSLYVSLPFVKFLRSDAVSWHDRYVPRGNFTEWVHAQNSIALERLLDNFIDENGAILASPSRNEPDYYYQWVRDSAIVVNTLVKQLPAIEQNLQYDQLVHRRILQFLNNSFVLQRLDNLSGKGVPTSIRGLGEPKFNVDNTQFNENWGRPQNDGPPLRIITILNYLQHLNNTGKQIDHIITHNAKEGFLPFKVTKDIFDNILFWDLQFIVDEWKSENFDLWEEVRGHHFFTSVMQLYAIERTLPIAKQNHLLRKKFVESLVDTRHKIREFILDNRTGFISKSANHIISCPEIYGKRSGLDIATILASIYTHDGSNTSEHLDLFHVDNRYILNTLYGLTESMSDLYPINKENERHSKKHNLAAVALGRYPEDVYDGVGISEGNPWYLATAAAAEHMYKLARKFIEDEKSIPISPSDEFWKFIIETDSKDKFDVKYHSHAFNETIKSFVALGDSFLDKIRLHVADDGSMSEQINKYTGYNQGASDLTWSYGSYLNAYQAREEILAYLSH

SEQ ID NO: 6035 - DNA, 1710 bp, Kluyveromyces lactis NRRL Y-1140
  CDS (1)..(1710)
atgaataaccctaatacgatgctaagtaaaagctcaagaaaaccgagaatacctaagcactcacattattttctgtccttcgtttgcatttcttcgttattagcatactatttccttttatcaccatttcaagctgggaatcacaatgcgaatcacagtatagagtgccctttatcaaggtcatctccactaattgaagtgtcagatttcaataggatatctgaattcaaattgcaaccaatcccagtctcgaagaacatttcaaggaatgatttcaataaatggttggaagaacaaacggagatttccttctatcatatgttcgaaaacatttgtcatgcagaaacatcagataaatttgataattgtactcctggtgttgtctttgcgtctccttccaagaacaaaccagattatttctatcattggattagagatggtgccatcaccataaacactttaattaatacgtatcttgatattgatagggaacggactcttgagacagtcttggattacgtgaacgcatctttggatttacaacataaatctaatcccagtgggccagctgatgatcctttgttcagaaatttgggagaaccaaaatatcatgttgataacagcgcttatgaacttgtctggggcagaccacagaatgatggcccaccattaagagctattgcattgttgaacttcttgaaccaggtagacgatggggaaaccgagaaatacaattggatatttgatgaggtaattgccttagatttgaagtttgtgttatataattggcatattccaacgtatgacctatgggaagaagtgcgtgcttatcatttttttactagtatggttcaattgaaggcgctagtagaaggtaagagatatcttttaacgtcggaagcaaaaggtgtaaaattgagcaagcagttgactatactattgaaggatattgagacttgtatagacaaaattgaggattttatcatcgatgccaattcagggtttataaatcatgaaaagggttacattgtggaaacccccagtattttggatgaaaggtcaggtttagacattgctgtgatcatggcaagcaccttgacacatgatgattctataaaagatatgaacaccgtttatgattccttcttgtttgatattgatgatcctttcatattgaatcatttcaatgaactaattgagagaatggcagtactttacccgatcaatcacaacagacttaatacaaacatgggagttgccattgggagatatccagaggatatttatgatggaattgacatctctgaaggtaatccctggtttatctcaacgttaacctctgccgaattgatttacaaattagtcaataaaatgtatcacgatgagaaacctttactcattgatccgatatcgaacaagttctggactaaattcttcgaatttgggaatatgaaggattcgctgatcttgataccatataatacattagcgttcaaccaaacgttgtacacaatattcaaatacggtgattcattcctaagcaaagttaacgagcatgtaagtaacgacggatcgatgagcgaacagttcaacaaatatcatggatacaaccaaggggctccaaatttgacatggtcttacggtactttcagcaatgcacttcgctggagggaaattgtcgatcgattcatccatcctattgccatataa

SEQ ID NO: 6036 - protein, 569 aa, Kluyveromyces lactis NRRL Y-1140
MNNPNTMLSKSSRKPRIPKHSHYFLSFVCISSLLAYYFLLSPFQAGNHNANHSIECPLSRSSPLIEVSDFNRISEFKLQPIPVSKNISRNDFNKWLEEQTEISFYHMFENICHAETSDKFDNCTPGVVFASPSKNKPDYFYHWIRDGAITINTLINTYLDIDRERTLETVLDYVNASLDLQHKSNPSGPADDPLFRNLGEPKYHVDNSAYELVWGRPQNDGPPLRAIALLNFLNQVDDGETEKYNWIFDEVIALDLKFVLYNWHIPTYDLWEEVRAYHFFTSMVQLKALVEGKRYLLTSEAKGVKLSKQLTILLKDIETCIDKIEDFIIDANSGFINHEKGYIVETPSILDERSGLDIAVIMASTLTHDDSIKDMNTVYDSFLFDIDDPFILNHFNELIERMAVLYPINHNRLNTNMGVAIGRYPEDIYDGIDISEGNPWFISTLTSAELIYKLVNKMYHDEKPLLIDPISNKFWTKFFEFGNMKDSLILIPYNTLAFNQTLYTIFKYGDSFLSKVNEHVSNDGSMSEQFNKYHGYNQGAPNLTWSYGTFSNALRWREIVDRFIHPIAI

SEQ ID NO: 6037 - DNA, 1638 bp, Debaryomyces hansenii CBS767
  CDS (1)..(1638)
atgatgaagttaaatttgattatactgatgcttatagcaaattttgctgtttcttatggactttatgtgcctgggtatgaccttcattacttgaatactggtgtggctgaagcagtacaaaaggttttatccttaaatctatttccaaattacgacgacaaagtagattcactggataccacagaacaatctgaatatgaaaaatggttagtaactcaaggaaatacttcgtttcaaggaattttgaataatattggaggcattagtgagttcctagaaggaacggaggttagtgaaggggcagtcattgcatctccttcaaagaataaaccaaattatttctaccaatgggtcagagatgctgcattaaccattcgatccttggttcattatcttgaggacaacaatactaacaaccagaagatatgttccataattgaaaaatatattgagaataattactacttgcaaagattaccgaacaatctggggaggtttgatgataatactcgatcaggtttaggagaaccaaaatttatgcccgattgtacagctttcgatgagcattgggggagacctcaaaatgatgggccaggattaagaatttcgacaattgtttcctacctaaatttaatagaaaagtatagactaagcttgtctaataagtttttaaaagatgaaagatttatatacgacgaaatcattaaaccagatttattttatattgttaaaaattggaagaaggagagttttgacatttgggaagaagtcaattctattcatttctttacatctatgtcccaattgagagctgttatagatgggctcaagttagccaagaaatatgaagtagataaacagtttgttgaccaattgtatgaatctatcaccaacttgaagctgtttattgaagttgacgcaagatttgctatcccatcatctctttatattattgagacaccaggcttattttctagtggtaaaagatcaggactagatgctgctgctttactcgcaagtatacattcacatgaccttgaagttgatgaatactctgatgtaccgtttgatgttaatgactatcacattttaaatacgattaatgcaatggcttctgacatgaggtttaggtatccaataaaccgtgatagaataggaaaaccttcacttggtgttgcgctaggcagataccctgaggatatttatgatggagtagggtcatcagagggtaatccatggtttatcgcgactgcgtcagcagcagaagttatttttaaaacagtttacaagctactggacagtcaacaagatttattgattaacaaatataatcaagaattctttaagtcattcattaactttgaagccgacgatttagaagaatttgtcattccgtgtaattccatccggtacaacaatgcgttacttaatttatttgactttggtgactcctttttgaagataataaaagaccatgttgatggaaatggtcatatgtctgaacaattcaataaatatacgggctacatgcaaggtgctatggacctaacttggagttatagtgcattctggaatgctttgaggtggagaaataagacccttgaagtcatatccaatcacaataataatcataattag

SEQ ID NO: 6038 - protein, 545 aa, Debaryomyces hansenii CBS767
MMKLNLIILMLIANFAVSYGLYVPGYDLHYLNTGVAEAVQKVLSLNLFPNYDDKVDSLDTTEQSEYEKWLVTQGNTSFQGILNNIGGISEFLEGTEVSEGAVIASPSKNKPNYFYQWVRDAALTIRSLVHYLEDNNTNNQKICSIIEKYIENNYYLQRLPNNLGRFDDNTRSGLGEPKFMPDCTAFDEHWGRPQNDGPGLRISTIVSYLNLIEKYRLSLSNKFLKDERFIYDEIIKPDLFYIVKNWKKESFDIWEEVNSIHFFTSMSQLRAVIDGLKLAKKYEVDKQFVDQLYESITNLKLFIEVDARFAIPSSLYIIETPGLFSSGKRSGLDAAALLASIHSHDLEVDEYSDVPFDVNDYHILNTINAMASDMRFRYPINRDRIGKPSLGVALGRYPEDIYDGVGSSEGNPWFIATASAAEVIFKTVYKLLDSQQDLLINKYNQEFFKSFINFEADDLEEFVIPCNSIRYNNALLNLFDFGDSFLKIIKDHVDGNGHMSEQFNKYTGYMQGAMDLTWSYSAFWNALRWRNKTLEVISNHNNNHN

SEQ ID NO: 6039 - DNA, 1809 bp, Yarrowia lipolytica CLIB122
  CDS (1)..(1809)
atgcggaaggatggtcacacagcaagaggtaaatctcaatgcagaaccgtgagtgctaaaaaatactaccacaacaaaacaagagcgcgaacgcatggtgcagaagtgacagttttgcttttctccgacaagcacgattttcttcttgtgcaggtacctacaccttctctcttttgctataaatggcttgattgcgctattctcatccttacacacacacacacacacacacacacacacacacatacacacataccgacgatgttgctacaagcgtttgtttctgttttagcacttccagggtctctagcgcttccgctattcgatcagaagcctctgttgctggcaccatacgcgagaccaaacgtgacactcattgacgcccagaaattcgagttgtggctcgctcagcagactcatcacgcctttgagtctgtcctcgacaatgtgggacaccaaggtagcaacaacggtcttcccgtaggcgttgttatcgctagtccctctaaaacggcccctgactactattaccaatggactcgggatgctgccatcaccatggactcagttgtgcggcggttctatgaccaggctagtcaaggtatactgaacgacacactcagcaacatcatcatgggatacattgagactcaaggcatgttgcagcacgtcagcaatccctccgggtactttgactggaacagacgtgttgttagtggtttgggagagcctaaatttgagactgacggctcagcattcacagggcactggggtagacctcagaatgatggacctgcactcagaattaaaacgatctcgcattatattcaaacccaggtggagtggaatgaaacagcttctctcgacgactatgtgtatatctacaagtctatgatcctacccgatgtcgagtacattctacagtattgggatcagccgacttttgatctctgggaggaactggagggctaccatctcttcacttctcaagtgcagttcaacgctctcattaacgtcgtggaacttgcaagacattactcagatcgagagaccgaaagcagatgtacattcactgctggatcgattcgacaattcatcaagacacatttcgaggctggttctcggctgaatgcacaatttgagcccagaagttttggaaggtcgggccttgattcctccatattcttggccgctcttgactcggttagatgggagtctagcatagctgcaggtacatctctcaagccctacgacgatcttctcattgctactatcatgccttatgtgcactccttcgactaccctattaatcatcaacgattagctgagttcgaggagtctttccaggatgaaaatcctgggtacgtcgccgttggtgttggtcgttatgctgaggacgtctacgatggagtgggaacctctcatggcaatccttggttcatctgtaccgctaccattgcagagaccatattcttcattgctcaccacttggcccagcagtcgtctgattttgttcttgagatcaatagtctcaccaaggagttttatggtacgtttgtgtcttctgaccgcattgctagagactccgaagagtatcagcatctgttggaccgtctcgttgacctcggtgactcgttcttggatgtcatcagagagcatcaggctaacaatggagatatgtcggagcaattcaatagatacgatgggttcatgcaaggagctgagaagctgacatggagctacggcagtttctggtctgctgttagagctcgccaggaagttatcaaagggaccagtgggaggaaatga

SEQ ID NO: 6040 - protein, 602 aa, Yarrowia lipolytica CLIB122
MRKDGHTARGKSQCRTVSAKKYYHNKTRARTHGAEVTVLLFSDKHDFLLVQVPTPSLFCYKWLDCAILILTHTHTHTHTHTHTHIPTMLLQAFVSVLALPGSLALPLFDQKPLLLAPYARPNVTLIDAQKFELWLAQQTHHAFESVLDNVGHQGSNNGLPVGVVIASPSKTAPDYYYQWTRDAAITMDSVVRRFYDQASQGILNDTLSNIIMGYIETQGMLQHVSNPSGYFDWNRRVVSGLGEPKFETDGSAFTGHWGRPQNDGPALRIKTISHYIQTQVEWNETASLDDYVYIYKSMILPDVEYILQYWDQPTFDLWEELEGYHLFTSQVQFNALINVVELARHYSDRETESRCTFTAGSIRQFIKTHFEAGSRLNAQFEPRSFGRSGLDSSIFLAALDSVRWESSIAAGTSLKPYDDLLIATIMPYVHSFDYPINHQRLAEFEESFQDENPGYVAVGVGRYAEDVYDGVGTSHGNPWFICTATIAETIFFIAHHLAQQSSDFVLEINSLTKEFYGTFVSSDRIARDSEEYQHLLDRLVDLGDSFLDVIREHQANNGDMSEQFNRYDGFMQGAEKLTWSYGSFWSAVRARQEVIKGTSGRK

SEQ ID NO: 6041 - DNA, 1695 bp, Candida albicans SC5314
  CDS (1)..(1695): transl_table=12
atgagattgttgtcattcaatttatttatcatctttatcattaatctaggttatgttaattcatttttaataccaacaaaaggattaaacctttttcatctacagcaacagcaacagcaatcaatattctcaactaatcttaaacaagctctaaccacaccaccaccaaattcattttatgattggttagttttccaaaaacaagtttgtttgaaatcaatactcaataatattggtggagatttcactattgataacaaagatttattgccaggggtggttatagcatcaccgtcaacttcaaatcctgattattactatcaatggacaagggattctgctattataataaatatcttgattgatcatttatcccaaactccattgcatttgataaacaaaaattcaacttcaagtttggttcatattattgaatcatacatttttaatacccaaattttacagcaattacccaatttatctggtaatgttgacaacttggaaaatttaggtgaaccaaaatttcatgtcaatttgactgcatttaatgaatcttggggtcgtcctcaacgagatggaccaggattaagatcaattgccataatgaattatctaagtttattgaacaatacccagcatcaaccatcattttctaatttgacaatgaataatactctgaaaatatatcatgatattataaaaccagatttaaaatattcaattgaattttggcaatttgaaggatttgatttatgggaagaaatcaagggtattcattttttcactagtttggtccagttaaaaagtttaactatgggattaaaatttgcacaattttataatgattcatttgaatttagacttgatataatgaatctgattgaattattgactaaatatattgaattggaatcagggtttatcaataacgaagatagtgatggcgatgaagacaacgaacaacagttgttatcaaaatcatatataatttcatccccgaaattgttctataccaaatcaagaagtggattagatattgcttcaattcttgctgtattgtacacccacaataataacaatgctaatgatgatgatgataacgatttcccatttgatgtagataatggattggtattaacaacattaagataccttattcaagacatgacattaagatatccaataaatttccaagataattttcaaggagtagcattaggtcgataccctgaagatatttatgatggatatggtaaatcagaaggaaatccttggtttataagtactgcaactgcaagtgaattgatttatcgattaatttataaattgaaactgaataatcaggcgattataattgatcaaaaaaatatcgagttttataaagaatttattcacagtgtcagtgcaacagaaatttccaataatgaactaaaatttgaagcccatattaatggacatccaatgatgatcatcaataaagatgataaattatatgatgaattaatcaataaattattccattatgctgatgggtttttaaaagttgttcaaaaacatgttgataataatggtgatatgaatgaacaatttaataaatatattggattcatgcaaggcgcagaaaaattgacttggagttatggagctgtatttacagcaattaattggcgtaataaaactttatcaattttataa

SEQ ID NO: 6042 - protein, 564 aa, Candida albicans SC5314
MRLLSFNLFIIFIINLGYVNSFLIPTKGLNLFHLQQQQQQSIFSTNLKQALTTPPPNSFYDWLVFQKQVCLKSILNNIGGDFTIDNKDLLPGVVIASPSTSNPDYYYQWTRDSAIIINILIDHLSQTPLHLINKNSTSSLVHIIESYIFNTQILQQLPNLSGNVDNLENLGEPKFHVNLTAFNESWGRPQRDGPGLRSIAIMNYLSLLNNTQHQPSFSNLTMNNTSKIYHDIIKPDLKYSIEFWQFEGFDLWEEIKGIHFFTSLVQLKSLTMGLKFAQFYNDSFEFRLDIMNSIELLTKYIELESGFINNEDSDGDEDNEQQLLSKSYIISSPKLFYTKSRSGLDIASILAVLYTHNNNNANDDDDNDFPFDVDNGLVLTTLRYLIQDMTLRYPINFQDNFQGVALGRYPEDIYDGYGKSEGNPWFISTATASELIYRLIYKLKSNNQAIIIDQKNIEFYKEFIHSVSATEISNNELKFEAHINGHPMMIINKDDKLYDELINKLFHYADGFLKVVQKHVDNNGDMNEQFNKYIGFMQGAEKLTWSYGAVFTAINWRNKTLSIL

SEQ ID NO: 6043 - DNA, 1644 bp, Ustilago maydis 521
  CDS (1)..(1644)
atgacgaccaacatggacacgctcgagagcaaaagagccgctactgaatcgacgcctcttctgtgctcgacgcatgcatcccataaatgtgcctcctacccctggcttgcacaaggcgccgatagtgaagacatgactcgttcgaccgaatcgcgtgtcgcgcgcatccgcatcgctctgcttagcagtggcggtctgtgcctactgctcatctggttctgcgcgttgagcagcaatgttgacgcggcttggatagtcaagttggtgatcgggcaacagtctagcgctcgtgcttcacacctcgcttcacgttctgtcagttcgacgtacgcgtaccagcgtatgttggccaacatcggaggtgcctcgtccacggtcggcgacaatcaagtgcctaacgtcgaaacgggcgctgtgatcgcctcgccttccactgcacatcccgactacttgtactcgtgggtgcgcgatgcagctctcaccatcaaggtggtcatctcacagccgacactcgaccgaacgctggtgaccaactatgccaatgccgaatacacgcaccagcaaaacgcagccagatcggctgcaggccaaggcgaacccaagttcaacgtcgacggttcgctcttcacgggtgcatggggaagacctcagaacgacggcgctgcgttgcgcgcttcggctctgatggcgttcgctaagcgcatcggcctgaacgacagcttcacaacaggtacactgtacaaacgcgagctaggctcgcccagcttgatcaagaccgacctcgagtacgtggcgcaccactggcaggattcgagctttgatttgtgggaggaagtggagggtgcccactttttcacactcatcgtacagtggaggagtatggtggatggcgccaagtttgcaagtgcgatcaacgatgcgggtgcggcgagctactacgaccaacaggcggcggaaatgctggtcaagctgcagtcgttctgggatgcagacaagggttatgtgcaggcgtaccaaggtgttggcaacagagatgggatcgactgttccgtgctgcttggctcactcaaggggtgggatacaacagactacaacgcagctgtcaacgcgacgcttttcggacccgcttcggacaaagtactggcaacacacaaaaagtatgtggatgcattccgatcaatgtacgcgatcaacggcggcgctgctgctcctgcagcggtggccacagggcgctacccatcagatgtctacgacggcgatggaacgtcgcaagccaacccgtggtacatctgtacgctcgctgctgccgaagtgctgaatacggcgctcagcatcgttcgcgctcgtggcagtctggaaatcacctcaacttcgctggcgttctaccggcagttcgcctcgtcggccactacaggaagcttctcctcgacctcggatcagtacatcaccctcactaccgccatcaagcgtatggctgatggatttgtgcagatcgtcaaccagcacgcttggcacaacggcagcttgaacgaacagttcaaccgcaacaccggcttcaaccagggcgccagagatttgacctggtcctacgccgcattcgtcacaaacgactgggcaagtcacaacatgttcctcgtaacctag

SEQ ID NO: 6044 - protein, 547 aa, Ustilago maydis 521
MTTNMDTLESKRAATESTPLLCSTHASHKCASYPWLAQGADSEDMTRSTESRVARIRIALLSSGGLCLLLIWFCALSSNVDAAWIVKLVIGQQSSARASHLASRSVSSTYAYQRMLANIGGASSTVGDNQVPNVETGAVIASPSTAHPDYLYSWVRDAALTIKVVISQPTLDRTLVTNYANAEYTHQQNAARSAAGQGEPKFNVDGSLFTGAWGRPQNDGAALRASALMAFAKRIGLNDSFTTGTLYKRELGSPSLIKTDLEYVAHHWQDSSFDLWEEVEGAHFFTLIVQWRSMVDGAKFASAINDAGAASYYDQQAAEMLVKLQSFWDADKGYVQAYQGVGNRDGIDCSVLLGSLKGWDTTDYNAAVNATLFGPASDKVLATHKKYVDAFRSMYAINGGAAAPAAVATGRYPSDVYDGDGTSQANPWYICTLAAAEVLNTALSIVRARGSLEITSTSLAFYRQFASSATTGSFSSTSDQYITLTTAIKRMADGFVQIVNQHAWHNGSLNEQFNRNTGFNQGARDLTWSYAAFVTNDWASHNMFLVT

SEQ ID NO: 6045 - DNA, 1734 bp, Cryptococcus neoformans var. neoformans B-3501A
  CDS (1)..(1734)
atggcatcaagaacagagatggcatccgacgatcttctctcattcgaaaagagtctattcctacccagaaatgcgacgccgcgcccatacatttctagaactgaacacaactgtcacaggtataggagtgtggtcatcaaggggctatttctctgccttctcatattatctgcgatagttaccagcgtctctctaggactttggccccattatttgaattcgcggtcggtactctttgaccactggagtggtcaccaaaatgtttttttggagtctagaattttggcgaatataggaccagggataggcgcaaaggaagggcttgtagtggccagtcctagtaagggacatggaaaagagccagactactactatacctggacccgtgattctgctctaaccatttctacattgatacctcatttgagatttgatttagccgatatcaataataccaccgaaccgtgggagttatacagcgccctgtctgacgtactaaaggaatatctctttcgggactatattgaaagtcaagcagagatacaaataggcaaaaacccttctggtgacttgaaaaaaggtggccttaatgaaccaaaattccatgtcgacggtacccccttcacggggaattggggaaggcctcagagagacggtccagcacttcgggccattgcggtgatgatttatgccaacttcctccttgaccgtggatttccttcagacgtcagctacgtgcagcaacggatctatgatcccaggcatctcaaatcaccagggagagtccttaagaacgatttggaagaggtagcacaaggatggtcaaaaggcggctttgatctgtgggaagaggttgatgggcatcacctattcacccttcttgtttcccgtaaagccctgtacgatggttcgacatttgcgaaacgtctcaacgatgtcggagcagcggatcattacctcgcccaagctcactctatcacgcagaagctttcatcgttttgggattccaaaagaggctattggctctcaagcttgagtggtcgcgattttgagcttgtgcagctcaagtcggaatttaacttcaccaacgcatatccaagacgagaatggctcgattgttcgatacccctgtctattatccatgctggctcccacacatttcaaccccgccataatttctcttttccgttctctgcaactgatcccagtgtcctttcgaccatacacctttatatcaagtcttttgatggactttacagtatcaatgatggcaagccttggtcagatggatgggcgttagggcgttacaaggaagacgtatatgatggtaagggccaaagtcaagggaatccttggttcatttgcactttttctgttgcgcatagtctgtatctcgcctacaaggagtttcgcgaggcaggtgtcattgtgattgccaaccaaaccgttgcgttttgggaagatgtcgtttcgatctcatctaaacctcctaaagttagggagggcgatgtttggactgaaggggaagactggcaatttaaggagggaatgaaatgtttgaaagacgttgcagacaggttcatggaagttggccagcaagtggcggcagcgaacgggggaagaatgagcgaacaaatagacagagacgatgggcaatgcagaggggcaagggatttgacctggtcatacgcaagcttgttggatttgatcagagtgagatcggatttggattga

SEQ ID NO: 6046 - protein, 577 aa, Cryptococcus neoformans var. neoformans B-3501A
MASRTEMASDDLLSFEKSLFLPRNATPRPYISRTEHNCHRYRSVVIKGLFLCLLILSAIVTSVSLGLWPHYLNSRSVLFDHWSGHQNVFLESRILANIGPGIGAKEGLVVASPSKGHGKEPDYYYTWTRDSALTISTLIPHLRFDLADINNTTEPWELYSALSDVLKEYLFRDYIESQAEIQIGKNPSGDLKKGGLNEPKFHVDGTPFTGNWGRPQRDGPALRAIAVMIYANFLLDRGFPSDVSYVQQRIYDPRHLKSPGRVLKNDLEEVAQGWSKGGFDLWEEVDGHHLFTLLVSRKALYDGSTFAKRLNDVGAADHYLAQAHSITQKLSSFWDSKRGYWLSSLSGRDFELVQLKSEFNFTNAYPRREWLDCSIPLSIIHAGSHTFQPRHNFSFPFSATDPSVLSTIHLYIKSFDGLYSINDGKPWSDGWALGRYKEDVYDGKGQSQGNPWFICTFSVAHSLYLAYKEFREAGVIVIANQTVAFWEDVVSISSKPPKVREGDVWTEGEDWQFKEGMKCLKDVADRFMEVGQQVAAANGGRMSEQIDRDDGQCRGARDLTWSYASLLDLIRVRSDLD

SEQ ID NO: 6047 - DNA, 1350 bp, Legionella pneumophila subsp. pneumophila str. Philadelphia 1
  CDS (1)..(1350): transl_table=11
atggcgaccttcttttttaaaactaactactatcaggagattatgttgaaaaggatctttttcttaatgattttttttgtctctcaaactatggcttcagtatttacccatgaagaggttcaaatattaaaaaaacattttttaaataactttcaaaccaatggagccatcgtagcctcaccctcgcaatacaaccccaattattattatgactggattcgagactcagccattgccatgggattggttgaaacatggtatgaagccagccaatctgctcgatataaaaaacttttattagaatacgtttcatggacagaaaaaatacagcatcaagcggatcccattgctggccaggatatattgggtgaacccaaattttatatcaatggcaatccttttgatggggaatggggacggccacaaaatgatggtccggcactcagagcatctgttttaattcgttttgcgcaacagcttctcgatcataatgaaatagattatgttaaatcacatctttataacaacaccatggacccacaatccatgggcactatcaagatggatttggaatacatcgcacatcattggcaagatgcaaattttgacctgtgggaagaggtttatggccatcattttttcacggctatggcacaacaaaaagcgctgaccgatggcgccattttagctcaccaacttcatgacagacaagctgctgttttttatgaaatgcaagccaacttaattaacagtcgactgaaacagcatttggaccatcagaataaaataattcaagccacattattacctcaccccggtcctcaaaaaacactagagcttgattcgtccgtcatgttgggtattttaattaacccacaaaaagaaggtgtttttgccccacatcacacctttgtgcaaaatactgcaaaggctttgcatgagcaatttaatttgatgtttcctattaataaaaaccgttctggagcaatattgtttggtcgttatcccggcgatacttatgatggctaccaaacaaacagcatagggaacccctggtttatcttaaccgctacgatggctgaatattattttaccatggctcataatctgtccccgaacagcattaataaacttcatatacagaactatctaaagaaaggggacaattacctaaggctgataaaacaatatggccctgatctgaatttaagtgaacaaattaatttgaataccggagttcagcaaggagcgacatccttgacctggagttacgtttccgtcttgcgagctattcatttaagagaacaattggaaaatagaataaaaactacgggctggaatacctattag

SEQ ID NO: 6048 - protein, 449 aa, Legionella pneumophila subsp. pneumophila str. Philadelphia 1
MATFFFKTNYYQEIMLKRIFFLMIFFVSQTMASVFTHEEVQILKKHFLNNFQTNGAIVASPSQYNPNYYYDWIRDSAIAMGLVETWYEASQSARYKKLLLEYVSWTEKIQHQADPIAGQDILGEPKFYINGNPFDGEWGRPQNDGPALRASVLIRFAQQLLDHNEIDYVKSHLYNNTMDPQSMGTIKMDLEYIAHHWQDANFDLWEEVYGHHFFTAMAQQKALTDGAILAHQLHDRQAAVFYEMQANLINSRLKQHLDHQNKIIQATLLPHPGPQKTLELDSSVMLGILINPQKEGVFAPHHTFVQNTAKALHEQFNLMFPINKNRSGAILFGRYPGDTYDGYQTNSIGNPWFILTATMAEYYFTMAHNLSPNSINKLHIQNYLKKGDNYLRLIKQYGPDLNLSEQINLNTGVQQGATSLTWSYVSVLRAIHLREQLENRIKTTGWNTY

SEQ ID NO: 6049 - DNA, 1482 bp, Aspergillus oryzae
  CDS (1)..(1482)
atgcggaacaaccttcttttttccctcaatgccattgctggcgctgtcgcgcatccgtccttccctatccataagaggcagtcggatctcaacgccttcattgaggcacagacacccatcgccaaacagggcgtcctcaataatatcggcgctgatggcaagcttgttgagggggctgccgctggtatcgttgtagcctccccatccaagagtaatcccgactacttctacacctggacgcgcgacgctggcctcaccatggaagaagtgatagagcaattcatcgggggagatgcgactctcgagtccacaatccagaattatgttgactctcaagcgaacgagcaggcagtctccaacccatcaggcggcctgtcggatggctcgggtcttgctgaacccaaattttacgtcaatatctctcaattcaccgattcttggggccgaccccagcgcgacgggccagccttacgtgcttccgctttgatcgcatatggcaactctctgatttccagcgacaaacaatctgttgtcaaagctaacatctggccaattgtccagaatgacttgtcttatgtgggtcaatactggaaccagaccgggtttgatctttgggaagaggttcagggcagctccttcttcactgttgctgtgcagcacaaagccttggtggagggcgatgcgtttgcaaaggcactcggagaggaatgccaggcatgctccgtggcgcctcaaatcctctgccatcttcaggacttctggaatgggtctgctgttctttctaacttaccaaccaatgggcgcagtggactggataccaactctcttttgggctccattcacacttttgatccagccgccgcttgtgatgatacaacattccagccctgctcctctcgcgccctgtcgaaccataagcttgtggttgactctttccggtcggtctacggtatcaacaatggacgtggagcaggaaaggccgcggcagtgggcccgtacgcagaggacacctatcagggaggcaatccatggtatcttaccaccctggtcgctgcggaattgctctacgacgccttgtatcagtgggacaaacaaggtcaagtgaacgtcactgaaacttcccttcccttcttcaaggacctctccagcaatgtcaccaccggatcctacgccaagtcttcctcagcctatgagtcgcttacgagcgctgtcaagacctacgcagacggcttcatctccgttgtccaggagtatactcccgatggcggtgctttggctgagcagtacagtcgggaccagggcaccccagtttcggcatccgatctgacttggtcttatgcagctttcttgagtgctgttggacgacgaaacggcactgtccctgctagctggggctcttccacggccaacgcagttccaagccaatgttcggggggtacagtttctggaagttacactaccccaactgttgggtcgtggtag

SEQ ID NO: 6050 - protein, 493 aa, Aspergillus oryzae
MRNNLLFSLNAIAGAVAHPSFPIHKRQSDLNAFIEAQTPIAKQGVLNNIGADGKLVEGAAAGIVVASPSKSNPDYFYTWTRDAGLTMEEVIEQFIGGDATLESTIQNYVDSQANEQAVSNPSGGLSDGSGLAEPKFYVNISQFTDSWGRPQRDGPALRASALIAYGNSLISSDKQSVVKANIWPIVQNDLSYVGQYWNQTGFDLWEEVQGSSFFTVAVQHKALVEGDAFAKALGEECQACSVAPQILCHLQDFWNGSAVLSNLPTNGRSGLDTNSLLGSIHTFDPAAACDDTTFQPCSSRALSNHKLVVDSFRSVYGINNGRGAGKAAAVGPYAEDTYQGGNPWYLTTLVAAELLYDALYQWDKQGQVNVTETSLPFFKDLSSNVTTGSYAKSSSAYESLTSAVKTYADGFISVVQEYTPDGGALAEQYSRDQGTPVSASDLTWSYAAFLSAVGRRNGTVPASWGSSTANAVPSQCSGGTVSGSYTTPTVGSW

SEQ ID NO: 6051 - DNA, 1803 bp, Phaeosphaeria nodorum
  CDS (1)..(1803)
atgctcctcacatcgtttctaagtgcccttccggcagccctactcctggttggcgctcaaggttcgcctttccctggaaatgatggtgcgagacagcaaactgcactcgacctgttcatcgaagctcaagcaaatgtctccatcaatggcatattcgcaaacatgggtcccgatggctccaaggcgcagggtgccgcggagggcgttgttatcgccagcccatcacgatctgacccagattactggttcacgtggactagggattccgcattgacctataagatgcttatcgaacgttttgttgccggagatcaatcactcaagcagaagattgatgattatgtgtctacacaagccgaacttcaaggtgtcacgagcccatctggcagccctgacaatggaggacttggtgagcccaagtttaacgtcgacaggaccgcctttaccggtccttggggtcgtcctcaacgtgatggaccagctcttcgtgccactgcgctcaccatttatgccaactacctcgctgccaatggcgcatccacccaggtagccaatattgtttggcccgtcatcgcaaaagacctcgcatatgttgtacgttactggaaccagactggcttcgacttgtgggaggagaccaacggctcatcgttcttcactctgtcggcttctcaccgcgctcttgtcgagggcgctgctcttgcgactaaacttggtaagacatgcgatgggtgtgccgaagctgctccccaggtaatctgtttcgtccagagcttctggactggaagttatattgactccaacatcaacctcaacgatggtcgcactggcaaggatgccaactctcttatctctacgatccacacttttgaccccaattcgaagtgcaccgatgccactttccagccttgctcgtctcgggctcttgccaaccataaggccgttaccgactcttttcgctccgtgtacgccatcaacgaaggtattccgcaaggtcaagccgtcggtgtcggaagatattctgaggacgtttactttaatggcaacccgtggtacctgactacgactgctgccgcagagcagctctattccgctgcctatcaatggaacaagctggagtctattaccgtggacgccgtatccctaccgttcttcaacgacctcttacccaacgtcgcggtcggcacctatgccaaggactctgcgacctacacttcgatcatccacgccgtcaaaacatatgctgatggctacatggcgattgttatgaaatacacacctgccaacggcggtctttcagagcagttcaacaaggcaaatggctctcctgtttccgccgttgacctgacctggtcgtacgccgccttcattaccgcgactgagcgccgcaatggtgtcgtaagcccatcttgggacgaatcatccaacaatgtaccgccagaaacctgcaccggaactcctgcctgcatctccaggacaactttcaacgttctcgccactaccgaccttggccaggaggtcttcgttgtcggccaattgacggaacttggcaactgggcccctgtaggtgctcaggcactcagcgcgagccagtacaccggcagcaacccgccttggagtggaaccatcgatcttccagccggtactatctttgagtacaagtacatcaagaagacttccgatggtcaagtgttctggcaagcaggggcaaacagcaagtttaccactagtaccgagtgcgacagtactacaacgatcagtgacgggagcgtgacattcgaaagctggagttatccacaatga

SEQ ID NO: 6052 - protein, 600 aa, Phaeosphaeria nodorum
MLLTSFLSALPAALLLVGAQGSPFPGNDGARQQTALDLFIEAQANVSINGIFANMGPDGSKAQGAAEGVVIASPSRSDPDYWFTWTRDSALTYKMLIERFVAGDQSLKQKIDDYVSTQAELQGVTSPSGSPDNGGLGEPKFNVDRTAFTGPWGRPQRDGPALRATALTIYANYLAANGASTQVANIVWPVIAKDLAYVVRYWNQTGFDLWEETNGSSFFTLSASHRALVEGAALATKLGKTCDGCAEAAPQVICFVQSFWTGSYIDSNINLNDGRTGKDANSLISTIHTFDPNSKCTDATFQPCSSRALANHKAVTDSFRSVYAINEGIPQGQAVGVGRYSEDVYFNGNPWYLTTTAAAEQLYSAAYQWNKLESITVDAVSLPFFNDLLPNVAVGTYAKDSATYTSIIHAVKTYADGYMAIVMKYTPANGGLSEQFNKANGSPVSAVDLTWSYAAFITATERRNGVVSPSWDESSNNVPPETCTGTPACISRTTFNVLATTDLGQEVFVVGQLTELGNWAPVGAQALSASQYTGSNPPWSGTIDLPAGTIFEYKYIKKTSDGQVFWQAGANSKFTTSTECDSTTTISDGSVTFESWSYPQ

SEQ ID NO: 6053 - DNA, 1575 bp, Phaeosphaeria nodorum
  CDS (1)..(1575)
atgttggttcagaccattggtctagtatgtttcgctctggatgccgccgccttcgcaatcccaccgctgccacatctgagccacttcctaggtgttggtcaggcacagaaacagcagcaaccgttacaagatacccttgattcatggatagacaaagaagaacgaatcgcactggacaagttgctagcgaacgttgcaccaggtggtagaagtgtcgaaggcaaaggcgttgtgcctggcacagtaatcgcgagtccaagtacggatgagccagattactggtatcaatgggtacgagatgctgcgatcaccatgaactccgtcgtagacgtctatgccgatgacccgtcatcttcccacggctcccaactttctacgatactcgaagcgtacacgtccctccaatatactatacaacatacgcccaacccttcaggcaccttcgaagacttgtctggtctaggcgagcccaagttcggtgttgatggcaagccttttacaggctcttggggaaggccacaacgtgatgggcccgcattacgcgctctaacgctcatgcactacctgcgcgaatacaatgcttcgaatccctctctttggtcttcatcacaggctgcatacttcttcgagccatactatcatgcatcaatgccgccaaatagtgtgatcaaggccgacctggagtatgtgagccattactggaatgagaccagtttcgacctgtgggaagaagtcgagggactacatttcttcaatctcatggttagcgccaggagtttaagagaaggcagtggctttgcaagatcctttggagaccatggggcggcagagtggtatgaagagcaggcaggatacatcgagaagcttcttaccaaattctggaacccgaacaaagggcacctagtcgagacgctctggagcaaaagaagcggcctggactgcggtctacttctcggatctttgcattccttgccttctgaagaatcttcagaagaagcggtatatccaccgtggtctgatgagatcctcatctccctcctcgccttgactcgtgaccagcacgatcgatttccaatcaacagcagtccatccgaggaccaagatgacggggaagacgcttacgcgttcgaaggtactggtcttggtcgctatccagaagacgtgtatgatggttacggcaattcctacaggggtggcaatccctggtttctgtgcacatcttctgctgccgaagtcttgtatcgcaccgcctcacacctctccaccacgtcgaaccttaccatcacgcttctcgccctaccattctaccagtcacttctcgcaacttcaagcctcgatgttgaagtgggcacatttggctccagtgacgcactctataactcggtcatcgaaaagctcaaaacgactggcgacagtttcctcgaagtcgtcaaagctcatgtggacgctgaaggcagcatgagcgagcagttcgatgggatgaatggctttatgcgcggagcaagagatttgacatggagctatggtgcctttttgggcgctgtgagagcaagaaagatggcgcgggatgcgtga

SEQ ID NO: 6054 - protein, 524 aa, Phaeosphaeria nodorum
MLVQTIGLVCFALDAAAFAIPPLPHLSHFLGVGQAQKQQQPLQDTLDSWIDKEERIALDKLLANVAPGGRSVEGKGVVPGTVIASPSTDEPDYWYQWVRDAAITMNSVVDVYADDPSSSHGSQLSTILEAYTSLQYTIQHTPNPSGTFEDLSGLGEPKFGVDGKPFTGSWGRPQRDGPALRALTLMHYLREYNASNPSLWSSSQAAYFFEPYYHASMPPNSVIKADLEYVSHYWNETSFDLWEEVEGLHFFNLMVSARSLREGSGFARSFGDHGAAEWYEEQAGYIEKLLTKFWNPNKGHLVETLWSKRSGLDCGLLLGSLHSLPSEESSEEAVYPPWSDEILISLLALTRDQHDRFPINSSPSEDQDDGEDAYAFEGTGLGRYPEDVYDGYGNSYRGGNPWFLCTSSAAEVLYRTASHLSTTSNLTITLLALPFYQSLLATSSLDVEVGTFGSSDALYNSVIEKLKTTGDSFLEVVKAHVDAEGSMSEQFDGMNGFMRGARDLTWSYGAFLGAVRARKMARDA

SEQ ID NO: 6055 - DNA, 1920 bp, Aspergillus awamori
  CDS (1)..(1920)
atgtcgttccgatctcttctcgccctgagcggccttgtctgctctgggttggcaagtgtgatttccaagcgcgcgaccttggattcgtggttgagcaacgaagcgaccgtggctcgtactgcgatcctgaataacatcggggcggacggtgcttgggtgtcgggcgcggactctggcattgtcgttgccagtcccagcaccgataacccggactacttctacacctggactcgcgactctggtctcgtcatcaagaccctcgtcgacctcttccgcaatggagatactgatctcctttccaccattgagcactacatctcctctcaggcaattattcagggtgtcagtaacccctctggtgatctgtccagcggtggtcttggtgagcccaagttcaatgtcgatgagactgcctacaccggttcttggggacggccgcagcgtgatggtcctgccctgagagcaactgctatgatcggctttgggcagtggctgcttgacaatggctacaccagcgctgcaacagagattgtttggcccctcgttaggaacgacctgtcgtatgtggctcagtactggaaccagacgggatatgatctctgggaagaagttaatggctcgtccttcttcactattgccgtgcaacaccgcgccctcgtcgaaggtagtgccttcgcgacggccgtcggctcgtcctgctcctggtgtgattcgcaggcacctcagattctctgttacttgcagtccttcagcagccgttccggctggaccggcagctacatcctggccaactttgacaaggacacaaacaccctcctgggaagcatccacacctttgatcctgaggctggatgcgacgactccaccttccagccctgctccccgcgtgcgctcgccaaccataaggaggttgtagactctttccgctcgatctatactctcaacgatggtctcagtgacagtgaggcggttgcggtcggtcggtaccctgaggatagctactacaacggcaacccgtggttcctgtgcaccttggctgccgcggaacagctgtacgatgctctgtaccagtgggacaagcaggggtcgttggagatcacagacgtgtcacttgacttcttcaaggctctgtacagtggtgctgccaccggcacgtactcttcgtccagctcgacctatagcagcattgtgagtgccgtcaagactttcgctgatggttttgtttctattgtggaaactcacgccgcaagcaacggctctctgtctgagcaattcgacaagtctgatggcgacgagctttctgctcgcgatctgacctggtcttacgctgctctgctgaccgccaacaaccgtcgtaattctgtcgtgcccccgtcttggggtgagacctctgccagcagctggcccggcacctgtgcggctacctctgcctctggtacctacagcagtgtgaccgtcacctcgtggccgagcatcgtggctactggtgccaccactacgacggctactaccactggatcgggcggcgtgacctcgaccagcaagaccaccacaactgctagtaagaccagcaccactacgtcctcgacctcctgcaccacccccactgccgtagctgtgacctttgatctgacggcgaccaccacctacggcgagaacatctacctggtcgggtcgatctctcagctcggtgactgggagaccagcgatggcatagctctgagcgctgacaagtacacttccagtaacccgctttggtatgtaactgtgactctgccggctggtgagtcatttgagtacaagttcatccgcgttgagagcgatgactccgtggagtgggagagcgacccgaaccgggaatacaccgttcctcaggcgtgcggcgagtcgaccgcgacggtgaccgacacctggcggtag

SEQ ID NO: 6056 - protein, 639 aa, Aspergillus awamori
MSFRSLLALSGLVCSGLASVISKRATLDSWLSNEATVARTAILNNIGADGAWVSGADSGIVVASPSTDNPDYFYTWTRDSGLVIKTLVDLFRNGDTDLLSTIEHYISSQAIIQGVSNPSGDLSSGGLGEPKFNVDETAYTGSWGRPQRDGPALRATAMIGFGQWLLDNGYTSAATEIVWPLVRNDLSYVAQYWNQTGYDLWEEVNGSSFFTIAVQHRALVEGSAFATAVGSSCSWCDSQAPQILCYLQSFSSRSGWTGSYILANFDKDTNTLLGSIHTFDPEAGCDDSTFQPCSPRALANHKEVVDSFRSIYTLNDGLSDSEAVAVGRYPEDSYYNGNPWFLCTLAAAEQLYDALYQWDKQGSLEITDVSLDFFKALYSGAATGTYSSSSSTYSSIVSAVKTFADGFVSIVETHAASNGSLSEQFDKSDGDELSARDLTWSYAALLTANNRRNSVVPPSWGETSASSWPGTCAATSASGTYSSVTVTSWPSIVATGATTTTATTTGSGGVTSTSKTTTTASKTSTTTSSTSCTTPTAVAVTFDLTATTTYGENIYLVGSISQLGDWETSDGIALSADKYTSSNPLWYVTVTLPAGESFEYKFIRVESDDSVEWESDPNREYTVPQACGESTATVTDTWR

SEQ ID NO: 6057 - DNA, 1876 bp, Athelia rolfsii
  CDS (8)..(1747)
cttcacaatgtttcgttcactcctggccttggctgcgtgtgcagtcgcctctgtatctgcacagtctgcgtctgcgacagcatatcttaccaaggaatctgcagttgccaagaatggcgtactttgcaacattggtagccagggatgcatgtctgagggtgcctatagcggtattgtgatcgcatctccctctaaaactagccctgactatctctatacctggactcgcgactcgtcgctcgtcttcaagatgttaattgaccaatacacaaatggcctggatacgacactgcgcactctcattgacgagtttgtctctgcggaagccaccattcaacaaaccagtaactcatctggtaccgtctctaccggtggtctcggcgaacccaaattcaatatcgacgagacggcatttacgggcgcatggggtcgtccccaacgtgatggtcccgccctccgtgcaaccgcaatcatgacctatgcgacgtatctgtacaacaatggcaacacttcctacgtgaccaacaccctttggcctatcatcaagctcgaccttgactatgtcaactcggactggaaccagaccacgtttgacctctgggaagaagttgactcgtcttctttctttacgactgccgttcagcaccgtgctcttgttcagggcgcagcctttgctaccctcatcggccaaacttcgtctgcttcgacttactccgccacggcccctagcattctctgcttcttgcagtcttactggaacaccaacggatactggacggccaacactggtggcggacgttccggcaaggacgccaacaccatactcgcttctatccacacatttgacgccagcgccggctgctctgctgccacgtctcaaccatgctctgacgtagcattggccaacctgaaggtatacgttgactctttccgtagtatttatacgatcaacagcggtatttcctctacctcgggtgttgctactggtcgctaccccgaagattcgtattacaatggcaacccctggtacctctgcacactcgccgtcgccgagcagctctatgatgctctcatcgtatggaaggctgccggggagctcaacgtcacctccgtctcgctcgcgttcttccagcaattcgactcgagcatcaccgccggcacttacgcctcctcgtcgagcgtatacacttcgctcatctctgacatccaggcgttcgcagacgagtttgttgacattgttgccaagtacacgccttcgtctggcttcttgtctgagcagtatgataagtccacgggtgctcaggattcggctgctaacttgacttggtcctatgctgctgctatcaccgcttaccaagcccgcaatggcttcacaggtgcttcgtggggtgctaagggagtttctacctcctgctcgactggtgctacaagcccgggtggctcctcgggtagtgtcgaggtcactttcgacgtttacgctaccacagtatatggccagaacatctatatcaccggtgatgtgagtgagctcggcaactggacacccgccaatggtgttgcactctcttctgctaactaccccacctggagtgccacgatcgctctccccgctgacacgacaatccagtacaagtatgtcaacattgacggcagcaccgtcatctgggaggatgctatcagcaatcgcgagatcacgacgcccgccagcggcacatacaccgaaaaagacacttgggatgaatcttaaactgctgaacttgaacggcttgcaaaagcgaatggtgtagaaaataaacgaagattttgattgctttgttttgtttctcttcctatcttgtttctctagatatatacgaatgtattgcgttattctttc

SEQ ID NO: 6058 - protein, 579 aa, Athelia rolfsii
MFRSLLALAACAVASVSAQSASATAYLTKESAVAKNGVLCNIGSQGCMSEGAYSGIVIASPSKTSPDYLYTWTRDSSLVFKMLIDQYTNGLDTTLRTLIDEFVSAEATIQQTSNSSGTVSTGGLGEPKFNIDETAFTGAWGRPQRDGPALRATAIMTYATYLYNNGNTSYVTNTLWPIIKLDLDYVNSDWNQTTFDLWEEVDSSSFFTTAVQHRALVQGAAFATLIGQTSSASTYSATAPSILCFLQSYWNTNGYWTANTGGGRSGKDANTILASIHTFDASAGCSAATSQPCSDVALANLKVYVDSFRSIYTINSGISSTSGVATGRYPEDSYYNGNPWYLCTLAVAEQLYDALIVWKAAGELNVTSVSLAFFQQFDSSITAGTYASSSSVYTSLISDIQAFADEFVDIVAKYTPSSGFLSEQYDKSTGAQDSAANLTWSYAAAITAYQARNGFTGASWGAKGVSTSCSTGATSPGGSSGSVEVTFDVYATTVYGQNIYITGDVSELGNWTPANGVALSSANYPTWSATIALPADTTIQYKYVNIDGSTVIWEDAISNREITTPASGTYTEKDTWDES

SEQ ID NO: 6059 - DNA, 1863 bp, Humicola grisea
  CDS (1)..(1863)
atgcataccttctccaagctcctcgtcctgggctctgccgtccagtctgccctcgggcggcctcacggctcttcgcgtctccaggaacgcgctgccgttgataccttcatcaacaccgagaagcccatcgcatggaacaagctgctcgccaacatcggccctaacggcaaagccgctcccggtgccgccgccggcgttgtgattgccagcccttccaggacggaccctccttacttcttcacctggaccccggatgccgccctggtcctcaccggcatcatcgagtcccttggccacaactacaacaccaccctgcagcaggtctcgaacccctcgggaaccttcgccgacggctcgggtctcggtgaggccaagttcaatgtcgacctcactgccttcactggcgaatggggtcgccctcagagggacggcccgcccctgcgcgccatcgctctcatccagtacgccaagtggctgatcgccaacggctacaagagcacggccaagagcgtcgtctggcccgtcgtcaagaacgatctcgcctacacggcccagtactggaacgagaccggcttcgatctctgggaggaggtccccggcagctcgttctttaccatcgccagctctcacagggctctgactgagggtgcttacctcgccgctcagctcgacaccgagtgcccgccctgcacgaccgtcgcccctcaggttctgtgcttccagcaggccttctggaactccaagggcaactatgtcgtctcaacatcaacggcgggcgagtatcgctccggcaaggacgccaactcgatcctggcgtccatccacaacttcgaccctgaggccggctgcgacaacctgaccttccagccctgcagcgagcgcgccctggccaaccacaaggcctatgtcgactcgttccgcaacctctacgccatcaacaagggcatcgcccagggcaaggccgttgccgtcggccgctactcggaggatgtctactacaacggcaacccgtggtacctggccaactttgccgccgccgagcagctctacgacgccatctacgtgtggaacaagcagggctccatcaccgtgacctcggtctccctgcccttcttccgcgaccttgtctcgtcggtcagcaccggcacctactccaagagcagctcgaccttcaccaacatcgtcaacgccgtcaaggcctacgccgacggcttcatcgaggtggcggccaagtacaccccgtccaacggcgcgctcgccgagcagtacgaccgcaacacgggcaagcccgactcggccgccgacctgacgtggtcgtactcggccttcctctcggccatcgaccgccgcgcgggtctcgtccccccgagctggcgggccagcgtggccaagagccagctgccgtccacctgctcgcgcatcgaggtcgccggcacctacgtcgccgccacgagcacctcgttcccgtccaagcagaccccgaacccctccgcggcgccctccccgtccccctacccgaccgcctgcgcggacgctagcgaggtgtacgtcaccttcaacgagcgcgtgtcgaccgcgtggggcgagaccatcaaggtggtgggcaacgtgccggcgctggggaactgggacacgtccaaggcggtgaccctgtcggccagcgggtacaagtcgaatgatcccctctggagcatcacggtgcccatcaaggcgacgggctcggccgtgcagtacaagtatatcaaggtcggcaccaacgggaagattacttgggagtcggaccccaacaggagcattaccctgcagacggcgtcgtctgcgggcaagtgcgccgcgcagacggtgaatgattcgtggcgttaa

SEQ ID NO: 6060 - protein, 620 aa, Humicola grisea
MHTFSKLLVLGSAVQSALGRPHGSSRLQERAAVDTFINTEKPIAWNKLLANIGPNGKAAPGAAAGVVIASPSRTDPPYFFTWTPDAALVLTGIIESLGHNYNTTLQQVSNPSGTFADGSGLGEAKFNVDLTAFTGEWGRPQRDGPPLRAIALIQYAKWLIANGYKSTAKSVVWPVVKNDLAYTAQYWNETGFDLWEEVPGSSFFTIASSHRALTEGAYLAAQLDTECPPCTTVAPQVLCFQQAFWNSKGNYVVSTSTAGEYRSGKDANSILASIHNFDPEAGCDNLTFQPCSERALANHKAYVDSFRNLYAINKGIAQGKAVAVGRYSEDVYYNGNPWYLANFAAAEQLYDAIYVWNKQGSITVTSVSLPFFRDLVSSVSTGTYSKSSSTFTNIVNAVKAYADGFIEVAAKYTPSNGALAEQYDRNTGKPDSAADLTWSYSAFLSAIDRRAGLVPPSWRASVAKSQLPSTCSRIEVAGTYVAATSTSFPSKQTPNPSAAPSPSPYPTACADASEVYVTFNERVSTAWGETIKVVGNVPALGNWDTSKAVTLSASGYKSNDPLWSITVPIKATGSAVQYKYIKVGTNGKITWESDPNRSITLQTASSAGKCAAQTVNDSWR

SEQ ID NO: 6061 - DNA, 1815 bp, Rhizopus oryzae
  CDS (1)..(1815)
atgcaattattcaatttgccattgaaagtctcattctttcttgtcctctcttacttttctttgcttgtttctgctgcaagtattcctagcagtgcttctgtccagcttgattcatacaactacgatggctctactttttcaggaaaaatttatgtcaagaacattgcttactccaagaaagttactgtagtttacgccgatggctctgacaactggaataataatggaaacaccattgctgcttctttctctggccctatctctggatcaaattacgaatactggacattctctgcctccgttaaaggtatcaaggagttctacattaagtatgaagtcagtggaaaaacatactatgataacaacaattctgccaattaccaagtatctacatccaagcccactactactactgctgctactactactactactgctccttctacttctaccacaactcgcccctcaagctctgagccagctactttcccaactggtaactctacaatctcctcatggattaagaagcaagaagatatcagtcgctttgctatgcttcgaaacatcaaccctcctggaagtgctaccggtttcattgctgcttcactctctaccgctggtcccgattactactacgcttggactcgtgatgctgcattaacctccaatgtaattgtttacgaatacaacactactttgtctggtaataagactatcctcaacgtcctcaaggactatgttacattctcagttaagacccaatcaacttctaccgtctgtaactgccttggtgagcctaagttcaatcctgatggttctggatacactggtgcttggggaagacctcaaaatgatggacctgctgaacgtgctactactttcgttttgtttgctgacagttatcttactcaaacaaaggatgcttcctatgtcactggtacactcaagcctgctatcttcaaggatttggactatgtcgtcaatgtctggtctaatggctgtttcgatttatgggaagaagtcaatggtgttcacttctatactttaatggttatgcgtaagggtttgcttcttggtgcagatttcgctaaacgtaacggtgactctactcgtgcatctacttatagcagtactgcatccactattgcaaacaagatctctagcttctgggtttcttctaataactgggttcaagtcagtcaaagtgttactggtggtgtcagtaaaaagggtttggatgtctctacattgttggctgctaatcttggtagtgttgatgatggattcttcactcctggttctgaaaagatccttgccactgctgtagctgttgaagattccttcgcttccttgtatcctatcaacaaaaaccttccatcttaccttggtaacgctattggtagatatcctgaagacacttacaatggtaacggaaactctcaaggaaacccttggttcttggctgtaactggttatgctgagctctattaccgtgccatcaaggaatggatcagcaacggtggtgtcactgtcagcagcatcagtttacccttcttcaagaagtttgattcatctgctacatctggaaagaaatacactgttggtacctccgactttaataaccttgctcaaaatattgcactcgctgctgaccgtttcttgtccactgtccagctccatgctcccaacaatggatctcttgctgaagagtttgaccgtaccactggtttctccaccggtgctagagacttgacctggtctcacgcttctttaatcaccgcttcttacgctaaggctggtgcacctgctgcttaa

SEQ ID NO: 6062 - protein, 604 aa, Rhizopus oryzae
MQLFNLPLKVSFFLVLSYFSLLVSAASIPSSASVQLDSYNYDGSTFSGKIYVKNIAYSKKVTVVYADGSDNWNNNGNTIAASFSGPISGSNYEYWTFSASVKGIKEFYIKYEVSGKTYYDNNNSANYQVSTSKPTTTTAATTTTTAPSTSTTTRPSSSEPATFPTGNSTISSWIKKQEDISRFAMLRNINPPGSATGFIAASLSTAGPDYYYAWTRDAALTSNVIVYEYNTTLSGNKTILNVLKDYVTFSVKTQSTSTVCNCLGEPKFNPDGSGYTGAWGRPQNDGPAERATTFVLFADSYLTQTKDASYVTGTLKPAIFKDLDYVVNVWSNGCFDLWEEVNGVHFYTLMVMRKGLLLGADFAKRNGDSTRASTYSSTASTIANKISSFWVSSNNWVQVSQSVTGGVSKKGLDVSTLLAANLGSVDDGFFTPGSEKILATAVAVEDSFASLYPINKNLPSYLGNAIGRYPEDTYNGNGNSQGNPWFLAVTGYAELYYRAIKEWISNGGVTVSSISLPFFKKFDSSATSGKKYTVGTSDFNNLAQNIALAADRFLSTVQLHAPNNGSLAEEFDRTTGFSTGARDLTWSHASLITASYAKAGAPAA

SEQ ID NO: 6063 - DNA, 1443 bp, Rhizopus oryzae
  CDS (1)..(1443)
atgcaattattcaatttgccattgaaagtctcattctttcttgtcctctcttacttttctttgcttgtttctacatccaagccagctactttcccaactggtaactctacaatctcctcatggattaagaagcaagaggatatcagtcgctttgctatgcttcgaaacatcaaccctcctggaagtgctaccggtttcattgctgcttcactcactacctctaatcccgattactactactattggactcgtgatgctgcattaacctccaatgtaattgtttacgaatacaacactactttgtctggtaataagactatcctcaacgtcctcaaggactatgttacattctcagttaagacccaatcaactcctacagtctgtaactgccttggtgagcctaggttcaatcctgatggttctggccacactggtgcttggggaagacctcaaaatgatggacctgctgaacgtgctattaccttcgttttgtttgctgacagttatcttactcaaacaaaggatgcttcctatgtcactggtacactcaagcctgctatcttcaaggatttggactatgtcgtcaatgtctggcctaatagctgtttcgatttatgggaagaagccaatggtgttcacttctatactttaatggttatgcgtaagggtttgcttcttggtgcagatttcgctaaacgtaacggtgactctactcgtgcatctacttatagcagtactgcatccactattgcaaacaagatctctagcttctgggtttcttctaataactggattcaagtcagtcaaaatgttactggtggtttcagtcaaaatgctgctgctgctgtcagtaaaaagggtttggatttctctacattgttggctgctaaccttggtagtgttgatgatggattcttcactcctggttctgaaaagatccttgccactgctgtagctgttgaagattccttcgcttccttgtatcctatcaacaaaaaccttccatcttatcttggtaacgctattggtagatatcctgaagacacttccaatggtgtcggatacactcaaggaaacccttggttcttggctgtaactggttacgctgagctctattaccgtgccatcaaggaatggatcagcaacggtggtgtcactgtcagcagcatcagtttacccttcttcaagaagtttgattcatctgctatatctggaaagaaatacactgttggtacctccgactttaacaaccttgctcaaaatattgcactcgctgctgaccgtttcttgtccactgtccagttccatgctcacaacaatggatctattcctgaagagtttaaccgtaccactggtttacccaccggtgctagagacttgacctggtctcacgctgctgtaatcaccgcttcttacgctaaggctggtgcacctgctgcttaa

SEQ ID NO: 6064 - protein, 480 aa, Rhizopus oryzae
MQLFNLPLKVSFFLVLSYFSLLVSTSKPATFPTGNSTISSWIKKQEDISRFAMLRNINPPGSATGFIAASLTTSNPDYYYYWTRDAALTSNVIVYEYNTTLSGNKTILNVLKDYVTFSVKTQSTPTVCNCLGEPRFNPDGSGHTGAWGRPQNDGPAERAITFVLFADSYLTQTKDASYVTGTLKPAIFKDLDYVVNVWPNSCFDLWEEANGVHFYTLMVMRKGLLLGADFAKRNGDSTRASTYSSTASTIANKISSFWVSSNNWIQVSQNVTGGFSQNAAAAVSKKGLDFSTLLAANLGSVDDGFFTPGSEKILATAVAVEDSFASLYPINKNLPSYLGNAIGRYPEDTSNGVGYTQGNPWFLAVTGYAELYYRAIKEWISNGGVTVSSISLPFFKKFDSSAISGKKYTVGTSDFNNLAQNIALAADRFLSTVQFHAHNNGSIPEEFNRTTGLPTGARDLTWSHAAVITASYAKAGAPAA

SEQ ID NO: 6065 - DNA, 1854 bp, Thermomyces lanuginosus
  CDS (1)..(1854)
atgttattccaaccgactttgtgcgcggcccttggactcgccgccttgatcgtccaaggcggagaagctagacctgaaacaaccgtcccacatgcaacgggctcgctcgacgacttcctcgccgcacagagtccgattgctttccaaggcatcctgaacaatatcgggcctagcggagcgtactcggaaggtgtcaatccgggtgtggtcattgcgagtccaagtaaacaagatcccgactacttttacacctgggtgcgcgacgctgctctcactgtccaatatctggtggaggagctggttgcaggaaatgccagtcttcagttcctcattcaggactacatcagctcccaggcacgactgcagacggtggaaaatccatccggctccctctcgtcgggtggtctaggagagcccaagtttcatgtcgacgagaccgcctttacggactcctggggccgaccacagcgggacggcccgcctctccgcgccattgccatgatttcgtttgccaattacctgattgacaacggtcatcaatcgactgtggaggacatcatctggccgattgttcgcaatgacttgtcctatgtctcgcagcattggaacgaaacaacttttgacatctgggaggaagtccatagctcatcgtttttcaccacggctgtccagtaccgtgctctggtccaaggcagtgccttggctagcaagctcggccatacctgcgacaactgcgggtcccaagcaccgcagatcctttgcttcctgcagtcgtattggaccgggtcgcacatcttagccaacaccggtggcggccgctcgggaaaggacgtcagcacgatcctcggcgtcattggctcgtttgatccgaacgccgactgtgatgacgttaccttccagccctgctcggcccgggctcttgcaaatcacaagcaggtcgttgacagcttccgcagtatctatgccatcaacgctggcatcccgtcagggtcggctgttgcggttggacgttatcccgaggatgtctatcagggtggacacccctggtacctaacaacggctgcggcggcggagcagctttacgacgccatttaccagtggaaccatgtagggcacatcgacatcaatgctgtcaatctggacttcttcaagagcatttatccgtcagccgccgagggcacatacacatcagactcttcaacatttcaagacattatatctgctgtacggacctatgcggacgggtttctcagcgtaattgagaaatacactccgccggataacttgcttgccgagcagttccaccgggagacgggcattccactatcggcagcttctctgacatggtcctacgccgcgctcaacacggccgcgcagcggcgagcgtcaatcgtgccctcaccgtggaactctaacagcacagatctcccggacaaatgctcggcaacctcggcaacagggccgtatgccacgcccacaaacacggcatggccaaccactacgcagccaccggagcggccggcatgcacaccgccgtcggaagtaacactcaccttcaacgcgctcgtcgacaccgcgtttggccagaatatttatctcgtgggctccattccggagctcggatcgtgggatccggccaacgccctcttgatgagcgcaaagagctggactagcggaaatccggtctggacgctatccatttcccttccagcaggaacctcttttgagtacaagttcattcgaaaggatgatggttcctcggatgttgtctgggaaagtgacccgaatcgttcgtacaacgtgccgaaagattgcggtgccaacacggccaccgtgaattcttggtggcgatga

SEQ ID NO: 6066 - protein, 617 aa, Thermomyces lanuginosus
MLFQPTLCAALGLAALIVQGGEARPETTVPHATGSLDDFLAAQSPIAFQGILNNIGPSGAYSEGVNPGVVIASPSKQDPDYFYTWVRDAALTVQYLVEELVAGNASLQFLIQDYISSQARLQTVENPSGSLSSGGLGEPKFHVDETAFTDSWGRPQRDGPPLRAIAMISFANYLIDNGHQSTVEDIIWPIVRNDLSYVSQHWNETTFDIWEEVHSSSFFTTAVQYRALVQGSALASKLGHTCDNCGSQAPQILCFLQSYWTGSHILANTGGGRSGKDVSTILGVIGSFDPNADCDDVTFQPCSARALANHKQVVDSFRSIYAINAGIPSGSAVAVGRYPEDVYQGGHPWYLTTAAAAEQLYDAIYQWNHVGHIDINAVNLDFFKSIYPSAAEGTYTSDSSTFQDIISAVRTYADGFLSVIEKYTPPDNLLAEQFHRETGIPLSAASLTWSYAALNTAAQRRASIVPSPWNSNSTDLPDKCSATSATGPYATPTNTAWPTTTQPPERPACTPPSEVTLTFNALVDTAFGQNIYLVGSIPELGSWDPANALLMSAKSWTSGNPVWTLSISLPAGTSFEYKFIRKDDGSSDVVWESDPNRSYNVPKDCGANTATVNSWWR

SEQ ID NO: 6067 - DNA, 2641 bp, Trichoderma harzianum
  CDS (563)..(2425)
gtctgtcttacatccagccagcccgcgtgaagaggagacgacagaaggatagaagagccgagcaggaaagagctgaagatccctgcaattgcccaactactgtttattgccatcgccgctgcttgctcctttgtttctatcccgcagccactgagtgcaaaccgccatattcagccggtttttcttttcacaggtttgcaccgcccgtcgcggcacttgggccccggagaatcggccctttcacagcgttgcggccctcagttccccatggggatgatccgcacatccactcttggccctgtagaccttttgttgtcggtccgagtcggactaaactgagtgttgagagttgtacctacgcacgacgttgcgggcaacagctgatctcattggaccaagtcggcaaaacgaaagccgttgttgttattgcgagaagtgctctgactcggggcgccgtatcataaagatgcctgccttcgccatggacctggccgcgagccactcggcatcggctctgtctctcaacgtttcctctcatacgtcttccttcattccgcccatcatgcacgtgctgtcgactgctgtgctacttggctcagttgccgtccaaaaagttctgggaagaccaggatcaaacggcctgtccggcgtcacaaaacgatctgtggatgactttatcaacacacagactcccattgcactaaacaaccttctttgcaatgttggccctgatggatgccgtgcctttggtacatcggccggtgctgtgattgcatctccgagcacaactgacccagactactactacatgtggacgcgagatagtgctcttgtcttcaagaacattgtcgaccgcttcactcagcagtatgatgccggcctgcagcgccgcatcgagcagtacatttctgcccaggtcactcttcagggcatctcaaacccctctggctctctttcggacgggtccggtcttggtgaacccaagtttgagttgaccttgagccagttcactggcaactggggtcgcccgcagcgcgatggcccagctctccgagccattgccttgattggttattcgaagtggctcatcaacaacaactaccagtcaacggtgtcaaatatcatctggcccattgtacggaatgacctcaactatgttgcccaatactggaaccaaaccggtttcgacctgtgggaggaagtcaatggtagctcgttctttaccgttgccaaccagcaccgagctcttgtagggcgccacacttgctgccaccctcggccagtcgggaagcacctattcctcagttgcgcctcaagatcctgtgcttcctccaaagattctgggtgtcgggtggatacattgactccaccatcaccaccaacgaaggcaggactggaaaagatgccaactctcttctcgcatctatccacacgttcgatcctagcctcgggctgcgacgcctctaccttccagccttgcagtgacaaagctctctccaacctcaaggttgttgtagactccttccgctccatctacggtgtcaacaagggcattcccgctggctctgctgtcgccatcggcagataccccgaagacgtgtactttaacggtaacccctggtatctcgccacgttcgctgctgccgagcaactttacgactccgtctacgtctggaagaagacaggctccatcacagtgacttccacttctttggccttcttccaggagctcgtccccggcgtcgcagctggaacttactccagcagccagtctaccttcacaagcatcatcaacgccgtctcgacatatgctgatggattcctcagcgaggctgccaagtacgtccccgctgatggttcgctcgccgagcagtttgatcgcaacaccggcacacctctgtcagctgttcacctgacctggtcgtacgcctcgtttctcaccgccgcggcccgtcgggctggcgttgtccccccctcgtgggccagcagtggcgccaactcagtcccttcaagctgctcgggagcttctgtggttggatcctactcgcgtcctacagccagtcattccaccatcgcacccccaagcggcgttcttgggtactccttcacttcccattcctgtgctaccccgacttccgttgccgtcactttccatgagcttgccgcaaccaagtttggtcagactatcaaagtcgctggtagcgctcccgagctgggcaatggagcacgagcgcagccattgctctggatgccgtcaactatgccactaaccatcccttgtggattggatcggtcaatctggaggccggggacgttatcgagtacaagtacatcaacgtgggccaggatggttccgtcacctgggagagcgaccccaaccacacctacactgttcctgcggtggcctgtgttaccgaggtggtgaaggaggatacctggcagtcataataaatgaaagcactgaggatacagagtactgagcatgaagtacagattgcagatggaagatgggggattgaaattgccaatagaacaagtgggatacatcgggcaaccagtagggaagaatgctcttcacgatgatgcgttatagcattaatttagccgttatgaatcagacatgaatatccgatcaatatgg

SEQ ID NO: 6068 - protein, 620 aa, Trichoderma harzianum
MHVLSTAVLLGSVAVQKVLGRPGSNGLSGVTKRSVDDFINTQTPIALNNLLCNVGPDGCRAFGTSAGAVIASPSTTDPDYYYMWTRDSALVFKNIVDRFTQQYDAGLQRRIEQYISAQVTLQGISNPSGSLSDGSGLGEPKFELTLSQFTGNWGRPQRDGPALRAIALIGYSKWLINNNYQSTVSNIIWPIVRNDLNYVAQYWNQTGFDLWEEVNGSSFFTVANQHRALVGRHTCCHPRPVGKHLFLSCASRSCASSKDSGCRVDTLTPPSPPTKAGLEKMPTLFSHLSTRSILASGCDASTFQPCSDKALSNLKVVVDSFRSIYGVNKGIPAGSAVAIGRYPEDVYFNGNPWYLATFAAAEQLYDSVYVWKKTGSITVTSTSLAFFQELVPGVAAGTYSSSQSTFTSIINAVSTYADGFLSEAAKYVPADGSLAEQFDRNTGTPLSAVHLTWSYASFLTAAARRAGVVPPSWASSGANSVPSSCSGASVVGSYSRPTASHSTIAPPSGVLGYSFTSHSCATPTSVAVTFHELAATKFGQTIKVAGSAPELGNGARAQPLLWMPSTMPLTIPCGLDRSIWRPGTLSSTSTSTWARMVPSPGRATPTTPTLFLRWPVLPRW

SEQ ID NO: 6069 - DNA, 2065 bp, Aspergillus niger
  CDS (1)..(1923)
atgtcgttccgatctcttctcgccctgagcggcctcgtctgcacagggttggcaaatgtgatttccaagcgcgcgaccttggattcatggttgagcaacgaagcgaccgtggctcgtactgccatcctgaataacatcggggcggacggtgcttgggtgtcgggcgcggactctggcattgtcgttgctagtcccagcacggataacccggactacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcggcttcaggcagtggctgcttgacaatggctacaccagcaccgcaacggacattgtttggcccctcgttaggaacgacctgtcgtatgtggctcaatactggaaccagacaggatacgatctctgggaagaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccggcaaggacgcaaacaccctcctgggaagcatccacacctttgatcctgaggccgcatgcgacgactccaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctgctactggcacctactcttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatttgacagctaccaccacttacggcgagaacatctacctggtcggatcgatctctcagctgggtgactgggaaaccagcgacggcatagctttgagtgctgacaagtacacttccggggacccgctttggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtagacaatcaatccattacgctatagttaaaggatggggatgagggcaattggttatatgatcatgtatgtagtgggtgtgcataatagtagtaaaatggaagccaagtcatgtgattgtaaaaaaaaaaaaaaaaaaaaaaaaa

SEQ ID NO: 6070 - protein, 640 aa, Aspergillus niger
MSFRSLLALSGLVCTGLANVISKRATLDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFRQWLLDNGYTSTATDIVWPLVRNDLSYVAQYWNQTGYDLWEEVNGSSFFTIAVQHRALVEGSAFATAVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSGDPLWYVTVTLPAGESFEYKFIRIESDDSVEWESDPNREYTVPQACGTSTATVTDTWR

SEQ ID NO: 6071 - DNA, 2067 bp, Aspergillus ficuum
  CDS (1)..(1923)
atgtcgttccgatctctactcgccctgagcggcctcgtctgcacagggttggcaaatgtgatttccaagcgcgcgaccttggattcatggttgagcaacgaagcgaccgtggctcgtactgccatcctgaataacatcggggcggacggtgcttgggtgtcgggcgcggactctggcattgtcgttgctagtcccagcacggataacccggactacttctacacctggactcgcgactctggtctcgtcctcaaggccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcgacttcgggcagtggctgcttgacaatggctacaccagcaccgcaacggacattgtttggcccctcgttaggaacgacctgtcgtatgtggctcaatactgggaccagacaggatatgatctctgggaagaagtcaatggctcgtctttcttcacgattgctgtgcaacaccgcgcccttgtcgaaggtagtgccttcgcgaagtccgtcggctcgtcctgctcctggtgtgattctcaggcacctgagattctctgctacctgcagtcattctggaccggcagcttcattttggccaacttcgatagcagccgttccggcaaggacgcaaacaccctcctgggaagcatccacacctttgatcctgaggccgcatgcgacgactccaccttccagccctgctccccccgcgcgctcgccaaccacaaggaggtcgtagactctttccgctcaatttataccctcaacgacggtctcagtgacagtgaggctgttgcggtcggtcggtaccctgaggacacgtactacaacggcaacccgtggttcctgtgcaccttggctgctgcagagcagttgtacgatgctctataccagtgggacaagcaggggtcgttggaggtcacggatgtgtcgctggacttcttcaaggcactgtacagcgatgctgctactggcacctactcttcgtccagctcgacttatagtagcattgtagatgccgtgaagactttcgccgatggcttcgtctctattgtggaaactcacgccgcaagcaacggctccatgtccgagcaatacgataagtctgatggcgagcagctttccgctcgcgacctgacctggtcttatgctgctctgctgaccgccaacaaccgtcgtaactccgtcgtgcctgcttcttggggcgagacctctgccagcagcgtgcccggcacctgtgcggccacatctgccactggtacctacagcagtgtgactgtcacctcgtggcccagtatcgtggctactggcggcaccactacgacggctacccccactggatccggcagcgtgacctcgaccagcaagaccaccgcgactgctagcaagaccagcaccagtacgtcattagcctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtagacaatcaatccatttcgctatagttaaaggatgggatgagggcaattggttatatgatcatgtatgtagtgggtgtgcataatagtagtgaaatggaagccaagtcatgtgattgtaaaaaaaaaaaaaaaaaaaaaaaaaaaa

SEQ ID NO: 6072 - protein, 640 aa, Aspergillus ficuum
MSFRSLLALSGLVCTGLANVISKRATLDSWLSNEATVARTAILNNIGADGAWVSGADSGIVVASPSTDNPDYFYTWTRDSGLVLKALVDLFRNGDTSLLSTIENYISAQAIVQGISNPSGDLSSGAGLGEPKFNVDETAYTGSWGRPQRDGPALRATAMIDFGQWLLDNGYTSTATDIVWPLVRNDLSYVAQYWDQTGYDLWEEVNGSSFFTIAVQHRALVEGSAFAKSVGSSCSWCDSQAPEILCYLQSFWTGSFILANFDSSRSGKDANTLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDAATGTYSSSSSTYSSIVDAVKTFADGFVSIVETHAASNGSMSEQYDKSDGEQLSARDLTWSYAALLTANNRRNSVVPASWGETSASSVPGTCAATSATGTYSSVTVTSWPSIVATGGTTTTATPTGSGSVTSTSKTTATASKTSTSTSLASCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 6073 - DNA, 1961 bp, Penicillium chrysogenum
  CDS (205)..(1671)
ggacacctttccaatgaacatcattatccgaagttttacatgagagatcaatgtgaaactcaatttccgacgtgcctgactgcttgatgacctaattatccgaacagtgttggctgtcgaacatataaagagactaggattcccagaagatcccgaagaacagtcacacaattacaatattacaaaatcatcaaatcatacattatgttgacattgaatgttttgacggcactgttggcacctggtgtgttatcatctgccttgcctgctcgcgatctcaatgcgcgtgccgattcgaagcctgctgctcttcaagccatcctgaacaacattggcgccgatggatctgctgtttcgagagcatctgcaggcgttgtggtagcatccccatccaaatcggatcccgattacttttacacctggactcgtgatgcagccttgacatacaaggtcttgattgatgagctcattgccggagacacctcgctggaacctaccatccaggactacgtctctgctcaagcaaagctgcaggccgtgtctaacccgtctggtgacttgtccgatggatcaggacttgcagagcccaagtaccacgtggacttgactgccttcacggaggcctggggtcgtccccagcgtgacggacccgctcttcgagccacagcactgattacccatggtaactatttgatttcgaaggagagaacatccgtcgtcaagtcgaacatctggcccattgtgcaaaatgatctcaactatgttgcgcaatactggaaccaaaccggattcgatctgtgggaggaggtcgagggctcctcgttctttaccattgctgcacaacaccgcgcattggtggagggcagcgcatttgccaaggcgctgggagagtcctgcgagggatgcgattcccaggcacctcaggtcctatgcttccagcagtccttctgggatggcaaggctattgtttctaacttcgccaacaatggtcgaaccggtctcgatgccaattcggtgcttacctcgatcggaaacttcgaccccaaggctccctgcgatgacgtgaccttccagccttgctctgctcgtgccctgtcgaaccacaagctatacgttgactcattccgtaagatctatcctgtgagcagtggtaaggaagctggaactgccgttgctgttggacgttattccgaagacacttacatgggcggcaacccatggtatttgaccaccctggccgcggccgagcagctgtacgatgctctttaccagtggaagcaactgggatcgctagaaatcaccgagatcagtcttcctttcttcaaggaccttgtttcgtctgccgccgccggaaagtatcccagctcctcggaaacttacacgtccatcactgccgcagtcaaaaagtatgccgatggatttgtggctgttgttaaggagcacacgcccagcgatgggtctctcgctgaacaatacactcgggacaacggcagcccggcctctgctaaggacttgacctggtcctacgcggcgctcctgtctgctgcccgccgtgaggctggaacagtgccccctacctggggtgcgtcgactgccaataaggtaccctcaaagtgtgagggtagctcggccaaggggagctacacgacaccatcagtcggcaagtggtaaagggaggagatgcggtaccaacagcatctgattcagtgaggcagtatagctgtgtcgatctttcctaatctagagggattctgaatgagtcggagggtctgtgaaggtgaagcattgcttgcttgtaggctggttgtcaaatctccttttgtccctttcaggcctttgtccctttacccttgtcaaagtacattcgagaactgcattacagtagggcagatcatcaagagttatgttagagaggttattgataggttataagccaaaaaaaaaaaaaaaaaaaaaaaaaa

SEQ ID NO: 6074 - protein, 488 aa, Penicillium chrysogenum
MLTLNVLTALLAPGVLSSALPARDLNARADSKPAALQAILNNIGADGSAVSRASAGVVVASPSKSDPDYFYTWTRDAALTYKVLIDELIAGDTSLEPTIQDYVSAQAKLQAVSNPSGDLSDGSGLAEPKYHVDLTAFTEAWGRPQRDGPALRATALITHGNYLISKERTSVVKSNIWPIVQNDLNYVAQYWNQTGFDLWEEVEGSSFFTIAAQHRALVEGSAFAKALGESCEGCDSQAPQVLCFQQSFWDGKAIVSNFANNGRTGLDANSVLTSIGNFDPKAPCDDVTFQPCSARALSNHKLYVDSFRKIYPVSSGKEAGTAVAVGRYSEDTYMGGNPWYLTTLAAAEQLYDALYQWKQLGSLEITEISLPFFKDLVSSAAAGKYPSSSETYTSITAAVKKYADGFVAVVKEHTPSDGSLAEQYTRDNGSPASAKDLTWSYAALLSAARREAGTVPPTWGASTANKVPSKCEGSSAKGSYTTPSVGKW

SEQ ID NO: 6075 - DNA, 2113 bp, Aspergillus awamori
  CDS (62)..(1981)
  misc_feature (2003)..(2003): n is a, g, c or t
  misc_feature (2095)..(2095): n is a, g, c or t
taagcagtggtaacaacgcaaagtacgcggggatcctcaacatcgttactcccccgccgcaatgtcgttccgatctcttctcgccctgagcggccttgtctgctcggggttggcaagtgttatttccaagcgcgcgaccttggattcgtggttgagcaacgaagcgaccgtggctcgtactgcgatcctgaataacatcggggcggacggtgcttgggtgtcgggcgcggactctggcattgtcgttgccagtcccagcacggataacccggactacttctacacttggactcgcgactctggtctcgtcatcaagaccctcgtcgatctcttccgcaatggagatactgatctcctttccaccattgagaactacatctcctctcaggcaattgttcagggtatcagtaacccctctggtgatctgtccagcggtggtcttggtgagcccaagttcaatgtcgatgagactgcctacaccgggtcttggggacggccgcagcgtgatggtcctgccctgagagcaactgctatgatcggcttccgccagtggctgcttgacaatggctacaccagcgctgcaacggagattgtttggcctctcgttaggaatgacctgtcgtatgtggctcagtactggaaccagacgggatatgatctctgggaagaagttaatggctcgtccttcttcactattgctgtgcagcaccgcgccctcgtcgaaggtagtgccttcgcgacggccgttggctcgtcctgctcctggtgtgattcgcaggcacctcagattctctgctacctgcagtccttctggaccggcgaatacatcctggccaactttgatagcagccgttccggcaaggacaccaataccctcctgggaagcatccacacctttgatcctgaggctgggtgcgacgactccaccttccagccctgctccccgcgtgcgctcgccaaccataaggaggttgtagactctttccgctcgatctatactctcaacgatggtctcagtgacagtgaggcggttgccgtcggtcggtaccccaaggatagctactacaacggcaacccgtggttcctgtgcaccttggctgccgcggagcagctgtacgatgctctgtaccagtgggacaagcagggatccttggagatcacagacgtgtcacttgacttcttccaggctctgtacagtgatgctgccaccggcacatactcttcgtccagctcgacctatagcagcattgtggatgccgtaaagactttcgctgatggtttcgtttctattgtggaaactcacgccgcaagcaacggctctctgtccgagcaatacgacaagtctgatggcgacgagctttctgctcgcgacctgacctggtcttacgctgctctgctgaccgccaacaaccgtcgtaactctgtcatgcctccttcttggggcgagacttctgccagcagcgtgcccggcacctgtgcggctacctctgcctctggtacctacagtagtgtgactgtcacctcgtcgcccagtatcgtggctactggtggcaccactacgacggctaccaccactggatttggcggcgtgacctcgaccagcaagaccaccacaactgctagtaagaccagcaccactacgtcttcgacctcctgcaccactcccaccgccgtagctgtgacatttgatctgacggcgaccaccacctacggcgagaacatctacctggtcgggtcgatctctcagctcggtgactgggacaccagcgacggcatagctctgagcgctgacaagtacacttccagcaacccgctctggtatgtaaccgtgactctgccggctggtgagtcgtttgagtacaagttcatccgcattgagagcgatgactccgtggagtgggagagcgacccgaaccgggagtacacggttcctcaggcgtgtggcgagtcgaccgcgacggtgactgacacctggcggtagacaattcattcctattgatatngaaggatgaaaatgacagtcattggttatataatcatgtatgtagtggatgtgcataagagcaacgaaatggaagcctgatcatgtgattgnaaaaaaaaaaaaaaaaaa

SEQ ID NO: 6076 - protein, 639 aa, Aspergillus awamori
MSFRSLLALSGLVCSGLASVISKRATLDSWLSNEATVARTAILNNIGADGAWVSGADSGIVVASPSTDNPDYFYTWTRDSGLVIKTLVDLFRNGDTDLLSTIENYISSQAIVQGISNPSGDLSSGGLGEPKFNVDETAYTGSWGRPQRDGPALRATAMIGFRQWLLDNGYTSAATEIVWPLVRNDLSYVAQYWNQTGYDLWEEVNGSSFFTIAVQHRALVEGSAFATAVGSSCSWCDSQAPQILCYLQSFWTGEYILANFDSSRSGKDTNTLLGSIHTFDPEAGCDDSTFQPCSPRALANHKEVVDSFRSIYTLNDGLSDSEAVAVGRYPKDSYYNGNPWFLCTLAAAEQLYDALYQWDKQGSLEITDVSLDFFQALYSDAATGTYSSSSSTYSSIVDAVKTFADGFVSIVETHAASNGSLSEQYDKSDGDELSARDLTWSYAALLTANNRRNSVMPPSWGETSASSVPGTCAATSASGTYSSVTVTSSPSIVATGGTTTTATTTGFGGVTSTSKTTTTASKTSTTTSSTSCTTPTAVAVTFDLTATTTYGENIYLVGSISQLGDWDTSDGIALSADKYTSSNPLWYVTVTLPAGESFEYKFIRIESDDSVEWESDPNREYTVPQACGESTATVTDTWR

SEQ ID NO: 6077 - DNA, 1920 bp, Aspergillus niger
  CDS (1)..(1920)
atgtcgttccgatctctactcgccctgagcggcctcgtctgcacagggttggcaaatgtgatttccaagcgcgcgacctgggattcatggttgagcaacgaagcgaccgtggctcgtactgccatcctgaataacatcggggcggacggtgcttgggtgtcgggcgcggactctggcattgtcgttgctagtcccagcacggataacccggactacttctacacctggactcgcgactctggtctcgtcctcaagaccctcgtcgatctcttccgaaatggagataccagtctcctctccaccattgagaactacatctccgcccaggcaattgtccagggtatcagtaacccctctggtgatctgtccagcggcgctggtctcggtgaacccaagttcaatgtcgatgagactgcctacactggttcttggggacggccgcagcgagatggtccggctctgagagcaactgctatgatcggcttcgggcaatggctgcttgacaatggctacaccagcaccgcaacggacattgtttggcccctcgttaggaacgacctgtcgtatgtggctcaatactggaaccagacaggatatgatctctgggaagtcaatggctcgtctttctttacgattgctgtgcaacaccgcgcccttgtcgaaggtagtgccttcgcgacggccgtcggctcgtcctgctcctggtgtgattctcaggcacccgaaattctctgctacctgcagtccttctggaccggcagcttcattctggccaacttcgatagcagccgttccgccaaggacgcaaacaccctcctgctgggaagcatccacacctttgatcctgaggccgcatgcgacgactccaccttccagccctgctccccgcgcgcgctcgccaaccacaaggaggttgtagactctttccgctcaatctataccctcaacgatggtctcagtgacagcgaggctgttgcggtgggtcggtaccctgaggacacgtactacaacggcaacccgtggttcctgtgcaccttggctgccgcagagcagttgtacgatgctctataccagtgggacaagcaggggtcgttggaggtcacagatgtgtcgctggacttcttcaaggcactgtacagcgatgctactggcacctactcttcgtccagttcgacttatagtagcattgtagatgccgtgaagactttcgccgatggcttcgtctctattgtggaaactcacgccgcaagcaacggctccatgtccgagcaatacgacaagtctgatggcgagcagctttccgctcgcgacctgacctggtcttatgctgctctgctgaccgccaacaaccgtcgtaacgtcgtgccttccgcttcttggggcgagacctctgccagcagcgtgcccggcacctgtgcggccacatctgccattggtacctacagcagtgtgactgtcacctcgtggccgagtatcgtggctactggcggcaccactacgacggctacccccactggatccggcagcgtgacctcgaccagcaagaccaccgcgactgctagcaagaccagcaccagtacgtcatcaacctcctgtaccactcccaccgccgtggctgtgactttcgatctgacagctaccaccacctacggcgagaacatctacctggtcggatcgatctctcagctgggtgactgggaaaccagcgacggcatagctctgagtgctgacaagtacacttccagcgacccgctctggtatgtcactgtgactctgccggctggtgagtcgtttgagtacaagtttatccgcattgagagcgatgactccgtggagtgggagagtgatcccaaccgagaatacaccgttcctcaggcgtgcggaacgtcgaccgcgacggtgactgacacctggcggtag

SEQ ID NO: 6078 - protein, 639 aa, Aspergillus niger
MSFRSLLALSGLVCTGLANVISKRATWDSWLSNEATVARTAILNNIGADGAWVSGADSGIVVASPSTDNPDYFYTWTRDSGLVLKTLVDLFRNGDTSLLSTIENYISAQAIVQGISNPSGDLSSGAGLGEPKFNVDETAYTGSWGRPQRDGPALRATAMIGFGQWLLDNGYTSTATDIVWPLVRNDLSYVAQYWNQTGYDLWEVNGSSFFTIAVQHRALVEGSAFATAVGSSCSWCDSQAPEILCYLQSFWTGSFILANFDSSRSAKDANTLLLGSIHTFDPEAACDDSTFQPCSPRALANHKEVVDSFRSIYTLNDGLSDSEAVAVGRYPEDTYYNGNPWFLCTLAAAEQLYDALYQWDKQGSLEVTDVSLDFFKALYSDATGTYSSSSSTYSSIVDAVKTFADGFVSIVETHAASNGSMSEQYDKSDGEQLSARDLTWSYAALLTANNRRNVVPSASWGETSASSVPGTCAATSAIGTYSSVTVTSWPSIVATGGTTTTATPTGSGSVTSTSKTTATASKTSTSTSSTSCTTPTAVAVTFDLTATTTYGENIYLVGSISQLGDWETSDGIALSADKYTSSDPLWYVTVTLPAGESFEYKFIRIESDDSVEWESDPNREYTVPQACGTSTATVTDTWR

SEQ ID NO: 6079 - DNA, 1830 bp, Mucor circinelloides
  CDS (1)..(1830)
atgaagttctcaaatcttctcaagaagcctctccttctgatcgctggtatcttggctgtcactgtagtcgctgaaactgtccctactactgaagcagtcaaagtcaagtcctttacctatgatggatctaccttggctggtcaaatctatatcaagaacattgcttacaccaagacggttactgtaatctactctgatgcctctgataattggaacaacaatggtaacacgatcgctgcttcttacagtgcagccatcgcaggcaccaactatgaatactggactttcagtgctcctgtaagcggcatcaagcaattctacgtcaagtatgttgtcagcggtactacctactatgacaacaacaacagcggaaactaccaagtttcagtcaccaccactaccactactgctcctaccactaccacttctggcggttcatccactaccactggcggctccactactactgctactagcgtccccactggtgttccttctggtttccctacaggtaactctaccattagctcttggatcgatggtcaaacctctgtcagccgttatgccatgctccgcaacatcaaccctgctggtgccgtcactggtttcattgctgcctctatgtctacttctggtcctgactacttttatgcctggacgcgtgattctgccttgacctctcatgtcgttgcctacgactacaataccactttggccggtaactctaccattctcggtctcttgaagaactatgttaccttctctctcaacagccaaactacctccactgtctgtaactgtctcggtgagcccaagttcaacaaagatagcagcggttacagcggcgcctggggtagacctcaaaatgacggacctgccagccgtgccgacactttcatcttgattgccgacagtatcctcaagcaaaccggcgatgctacctatgttactggtaccctcgctcctgccatctacaaggatttggattacgttgtctctacttggtccaacggctgtttcgatttgtgggaggaggtcaacggtgttcacttttacactttgatggtgatgcgcagaggtttagttaagggtgctaactttgctactcgcaatggtgacagcacacgtgccaccacttacaccaacacagctgcttccatcaagaccaagattgacagcttctggaactccaacggtcaatatgtctctgtcagccaaagcgtcactggtggcgtcagcaaggctggttatgatgcctctgtcttgattgcttccaacttgggtagtcttcaagattgtttctatactcctggctctgacaagatgcttgctactgctgttgccattgagagcaagtttgcttctctctactctatcaaccaaaacttgaacggttaccttggtaatgctatcggtcgctaccctgaagacacctacaacggcaacggtaactctcaaggtaacccttggttcatctgtaccaacgcctttgccgagctctactaccgcgctatcaaggaatggttcaacaatggcggtgtcactgtcactagcatcagtttgaacttcttcaagaagtttgattcctctgctgctgttggcaccaagtacactgtcggcacctcttctttcaacagcttggttcaaaatgttgctgtcgctgctgatgccttcttctctactatcaagttccatgctgccaccaacggttccatgagcgagcaatacggccgcgctgatggcttgatgactggtgctcgtgatttgacttggtctcacgcttcattgatctctgcttcttatgcaaaggctggttctcctgctgcctaa

SEQ ID NO: 6080 - protein, 609 aa, Mucor circinelloides
MKFSNLLKKPLLLIAGILAVTVVAETVPTTEAVKVKSFTYDGSTLAGQIYIKNIAYTKTVTVIYSDASDNWNNNGNTIAASYSAAIAGTNYEYWTFSAPVSGIKQFYVKYVVSGTTYYDNNNSGNYQVSVTTTTTTAPTTTTSGGSSTTTGGSTTTATSVPTGVPSGFPTGNSTISSWIDGQTSVSRYAMLRNINPAGAVTGFIAASMSTSGPDYFYAWTRDSALTSHVVAYDYNTTLAGNSTILGLLKNYVTFSLNSQTTSTVCNCLGEPKFNKDSSGYSGAWGRPQNDGPASRADTFILIADSILKQTGDATYVTGTLAPAIYKDLDYVVSTWSNGCFDLWEEVNGVHFYTLMVMRRGLVKGANFATRNGDSTRATTYTNTAASIKTKIDSFWNSNGQYVSVSQSVTGGVSKAGYDASVLIASNLGSLQDCFYTPGSDKMLATAVAIESKFASLYSINQNLNGYLGNAIGRYPEDTYNGNGNSQGNPWFICTNAFAELYYRAIKEWFNNGGVTVTSISLNFFKKFDSSAAVGTKYTVGTSSFNSLVQNVAVAADAFFSTIKFHAATNGSMSEQYGRADGLMTGARDLTWSHASLISASYAKAGSPAA

SEQ ID NO: 6081 - DNA, 1548 bp, Saccharomycopsis fibuligera
  CDS (1)..(1548)
atgatcagattgacagtctttttgacagcagtttttgctgcagttgctagttgcgtcccggtggaattggacaaaagaaacactggacatttccaagcttattctggatacacagttgccagatcaaatttcactcaatggattcatgagcaaccagctgtttcttggtattatcttttgcaaaacattgattatccagaaggacaatttaaatctgcaaagccaggcgtggtagttgcttctccatccacctcagaacctgactatttttatcaatggaccagagacactgccattacatttctttcgttgattgccgaggttgaagaccatagctttagcaataccacccttgccaaggtcgtggaatactacatcagcaacacctacactttgcaaagagtttcaaacccaagtggaaatttcgacagtcctaaccacgacggtttgggagaaccaaagttcaatgttgacgacaccgcctacacagcttcttggggcagacctcaaaatgatggcccagctttaagagcttatgccatttccagatatttgaatgctgtggccaaacataacaatggcaaattgttgctcgccggccaaaacggaatcccttattctagtgcttctgacatttattggaaaattattaaaccagacttgcaacatgtcagcacccattggagcacctctggctttgatctttgggaagaaaatcaaggaactcatttcttcactgctttggttcaactcaaagctcttagctacggtattcctttgagtaagacttacaacgaccctggctttacttcctggcttgaaaaacaaaaagatgccttgaactcatacatcaactcctctggattcgtcaactcgggtaaaaaacatattgttgaaagcccacaactttcttctagaggcggtttggacagtgccacctacattgctgccttgatcacccatgacattggtgatgatgacacttacactcctttcaacgtggataattcctatgtgctcaattccctatactacttgttggttgacaacaaaaacagatacaagatcaatggcaactacaaagcaggtgctgcggttggaagatatccagaagacgtctacaatggcgttggaactagcgaaggtaacccatggcaattggctactgcctacgctggtcaaactttctacactttggcttacaactctttgaaaaataaaaagaacttggttatagaaaaactcaattacgacctttacaactcctttattgctgacttgtccaagattgactcttcttatgcttccaaagatagtttgactttgacttatggcagcgacaactataaaaatgttatcaaaagtttgctacaatttggtgactctttcttgaaagttctccttgaccatattgatgacaatggccaactcaccgaggaaatcaacagatacactggtttccaagccggcgctgtctccttgacttggagtagtggcagtttgcttagtgcaaacagagctagaaacaaattgattgaacttctttga

SEQ ID NO: 6082 - protein, 515 aa, Saccharomycopsis fibuligera
MIRLTVFLTAVFAAVASCVPVELDKRNTGHFQAYSGYTVARSNFTQWIHEQPAVSWYYLLQNIDYPEGQFKSAKPGVVVASPSTSEPDYFYQWTRDTAITFLSLIAEVEDHSFSNTTLAKVVEYYISNTYTLQRVSNPSGNFDSPNHDGLGEPKFNVDDTAYTASWGRPQNDGPALRAYAISRYLNAVAKHNNGKLLLAGQNGIPYSSASDIYWKIIKPDLQHVSTHWSTSGFDLWEENQGTHFFTALVQLKALSYGIPLSKTYNDPGFTSWLEKQKDALNSYINSSGFVNSGKKHIVESPQLSSRGGLDSATYIAALITHDIGDDDTYTPFNVDNSYVLNSLYYLLVDNKNRYKINGNYKAGAAVGRYPEDVYNGVGTSEGNPWQLATAYAGQTFYTLAYNSLKNKKNLVIEKLNYDLYNSFIADLSKIDSSYASKDSLTLTYGSDNYKNVIKSLLQFGDSFLKVLLDHIDDNGQLTEEINRYTGFQAGAVSLTWSSGSLLSANRARNKLIELL

SEQ ID NO: 6083 - DNA, 1857 bp, Talaromyces emersonii
  CDS (1)..(1857)
atggcgtccctcgttgctggcgctctctgcatcctgggcctgacgcctgctgcatttgcacgagcgcccgttgcagcgcgagccaccggttccctggactcctttctcgcaaccgaaactccaattgccctccaaggcgtgctgaacaacatcgggcccaatggtgctgatgtggcaggagcaagcgccggcattgtggttgccagtccgagcaggagcgacccaaattatttctactcctggacacgtgacgcagcgctcacggccaaatacctcgtcgacgccttcatcgcgggcaacaaggacctagagcagaccatccagcagtacatcagcgcgcaggcgaaggtgcaaactatctccaatccgtccggagatttatccaccggtggcttaggtgagcccaagttcaatgtgaatgagacggcttttaccgggccctggggtcgtccacagagggacggaccagcgttgagagcgacggccctcattgcgtatgcgaactatctcatcgacaacggcgaggcttcgactgccgatgagatcatctggccgattgtccagaatgatctgtcctacatcacccaatactggaactcatccaccttcgacctctgggaagaagtagaaggatcctcattcttcacaaccgccgtgcaacaccgcgccctggtcgaaggcaatgcactggcaacaaggctgaaccacacgtgctccaactgcgtctctcaggcccctcaggtcctgtgtttcctgcagtcatactggaccggatcgtatgttctggccaactttggtggcagcggtcgttccggcaaggacgtgaattcgattctgggcagcatccacacctttgatcccgccggaggctgtgacgactcgaccttccagccgtgttcggcccgtgccttggcaaatcacaaggtggtcaccgactcgttccggagtatctatgcgatcaactcaggcatcgcagagggatctgccgtggcagtcggccgctaccctgaggatgtctaccagggcgggaacccctggtacctggccacagcagcggctgcagagcagctttacgacgccatctaccagtggaagaagatcggctcgataagtatcacggacgttagtctgccatttttccaggatatctacccttctgccgcggtgggcacctataactctggctccacgactttcaacgacatcatctcggccgtccagacgtatggtgatggatatctgagtattgtcgagaaatatactccctcagacggctctcttaccgaacaattctcccgtacagacggcactccgctttctgcctctgccctgacttggtcgtacgcttctctcctaaccgcttcggcccgcagacagtccgtcgtccctgcttcctggggcgaaagctccgcaagcagcgtccctgccgtctgctctgccacctctgccacgggcccatacagcacggctaccaacaccgtctggccaagctctggctctggcagctcaacaaccaccagtagcgccccatgcaccactcctacctctgtggctgtgaccttcgacgaaatcgtcagcaccagttacggggagacaatctacctggccggctcgatccccgagctgggcaactggtccacggccagcgcgatccccctccgcgcggatgcttacaccaacagcaacccgctctggtacgtgaccgtcaatctgccccctggcaccagcttcgagtacaagttcttcaagaaccagacggacgggaccatcgtctgggaagacgacccgaaccggtcgtacacggtcccagcgtactgtgggcagactaccgccattcttgacgatagttggcagtga

SEQ ID NO: 6084 - protein, 618 aa, Talaromyces emersonii
MASLVAGALCILGLTPAAFARAPVAARATGSLDSFLATETPIALQGVLNNIGPNGADVAGASAGIVVASPSRSDPNYFYSWTRDAALTAKYLVDAFIAGNKDLEQTIQQYISAQAKVQTISNPSGDLSTGGLGEPKFNVNETAFTGPWGRPQRDGPALRATALIAYANYLIDNGEASTADEIIWPIVQNDLSYITQYWNSSTFDLWEEVEGSSFFTTAVQHRALVEGNALATRLNHTCSNCVSQAPQVLCFLQSYWTGSYVLANFGGSGRSGKDVNSILGSIHTFDPAGGCDDSTFQPCSARALANHKVVTDSFRSIYAINSGIAEGSAVAVGRYPEDVYQGGNPWYLATAAAAEQLYDAIYQWKKIGSISITDVSLPFFQDIYPSAAVGTYNSGSTTFNDIISAVQTYGDGYLSIVEKYTPSDGSLTEQFSRTDGTPLSASALTWSYASLLTASARRQSVVPASWGESSASSVPAVCSATSATGPYSTATNTVWPSSGSGSSTTTSSAPCTTPTSVAVTFDEIVSTSYGETIYLAGSIPELGNWSTASAIPLRADAYTNSNPLWYVTVNLPPGTSFEYKFFKNQTDGTIVWEDDPNRSYTVPAYCGQTTAILDDSWQ

SEQ ID NO: 6085 - DNA, 1839 bp, Aspergillus oryzae
  CDS (1)..(1839)
atggtgtctttctcctcttgtctccgggccttagccctcggatcctcagttctcgcggtccaacctgtccttagacaggcgactggtctagatacctggctgagcacagaagcaaatttttcccgccaggcaatcttgaataatatcggcgcagatggccagtcggcgcagggcgcaagtccaggggtggtgattgccagccctagcaaaagtgacccagattatttctatacctggacccgtgactcgggtctcgtcatgaaaaccctggtcgatctgttcagaggcggagatgccgatcttctccctatcatcgaggagttcattagctcccaggctcggatccaaggcatctcaaacccttctggtgctctttccagtgggggtctgggcgagcctaagttcaatgtcgacgagacagcatttaccggcgcatggggtcggccgcagcgtgacggaccagctttgcgcgcgaccgctatgatctcgtttggagaatggctagttgaaaatggtcatacaagcatagcgacggacctggtatggcctgttgttaggaatgatctatcctatgtggctcagtattggagccaatccgggttcgatctctgggaggaagtccaaggcacatcattctttactgttgcagtttctcatcgcgctttggtagaaggtagcagcttcgcaaagactgtcggttcctcgtgcccctattgtgactcgcaagcgccccaagtccgatgttatttacaatccttctggaccgggagttacatccaggccaatttcggtggcgggcgatcgggcaaagacatcaacactgtcctgggtagtatccacacgttcgatcctcaagcgacgtgtgatgatgctaccttccagccctgttcggcgcgagccttggccaaccataaggtagtaacggactcgttccgatcaatctatgccatcaactccggtcgtgctgagaatcaagctgttgctgttggccgctaccccgaagacagctattacaacgggaatccttggttcctgaccaccctggccgccgcagagcagttgtatgacgcgttgtaccagtgggataaaattggatcattggccatcacggacgtttctttgccattcttcaaagctctttacagttctgccgcgacagggacctacgcatcgtccacgacggtgtataaggatattgtctcagccgtcaaggcctatgcagacggatacgtgcagatcgtccaaacctacgctgcatccaccggctccatggccgagcaatataccaagacggacgggagtcagacctccgcccgggatcttacctggtcgtacgctgcacttctcacggccaacaaccgacgaaacgcggtcgttcctgcaccatggggcgagaccgctgccaccagcattccgtcagcttgctctacgacttccgcctcgggcacctacagcagcgtggttatcacatcctggccgaccattagcggatacccaggcgcgccagacagcccctgccaggtgccgacgactgtgtcggtgaccttcgcggtgaaagctactacggtctacggtgagtctatcaagatcgtcgggtcgatctctcagctcgggagctggaatcctagcagcgcgaccgcattgaacgcggacagctacactactgacaaccccttgtggacgggaacaataaacttgcctgctggacagtcgttcgagtataagtttattcgcgttcagaacggggcggttacgtgggagagtgaccccaaccggaaatataccgttccttcgacttgcggggtgaaaagtgctgtgcagagcgatgtttggcggtga

SEQ ID NO: 6086 - protein, 612 aa, Aspergillus oryzae
MVSFSSCLRALALGSSVLAVQPVLRQATGLDTWLSTEANFSRQAILNNIGADGQSAQGASPGVVIASPSKSDPDYFYTWTRDSGLVMKTLVDLFRGGDADLLPIIEEFISSQARIQGISNPSGALSSGGLGEPKFNVDETAFTGAWGRPQRDGPALRATAMISFGEWLVENGHTSIATDLVWPVVRNDLSYVAQYWSQSGFDLWEEVQGTSFFTVAVSHRALVEGSSFAKTVGSSCPYCDSQAPQVRCYLQSFWTGSYIQANFGGGRSGKDINTVLGSIHTFDPQATCDDATFQPCSARALANHKVVTDSFRSIYAINSGRAENQAVAVGRYPEDSYYNGNPWFLTTLAAAEQLYDALYQWDKIGSLAITDVSLPFFKALYSSAATGTYASSTTVYKDIVSAVKAYADGYVQIVQTYAASTGSMAEQYTKTDGSQTSARDLTWSYAALLTANNRRNAVVPAPWGETAATSIPSACSTTSASGTYSSVVITSWPTISGYPGAPDSPCQVPTTVSVTFAVKATTVYGESIKIVGSISQLGSWNPSSATALNADSYTTDNPLWTGTINLPAGQSFEYKFIRVQNGAVTWESDPNRKYTVPSTCGVKSAVQSDVWR

SEQ ID NO: 6087 - DNA, 1996 bp, Hormoconis resinae
  CDS (30)..(1880)
ttcccggttacttccagactcatctcatcatgcgcctcctcccctcgtcgtgtgcaggggctctctctttgctctgctccctggcgatcgcagcacctacggaattgaaagccagagatttgagctcttttatagcttcagagagagcaattgcattgcagggcgcgctcaataacattggacccgatggctcagcagtaccaggggctggagcgggcttcgtagtcgcaagtccttcaaaggccaatcccgattacttctacacatggagtcgggactcagccttgacattgaaaatgatcattgatgagtttatccttggaaacaccaccctccagacgataatcgaacaatatatccatgcccaagcagttcttcagaccgtttccaatccatctggaaccttcctgcctgacggtgtcggattaggagagccaaagttcatggtcgatggaactcggttcaatgggccttggggacggcctcaacgtgacggcccagctctccgcgctattgccttaatgacctatagtaattggctcattaagaatggtcaatttgcggaggccaagacaaagatatggcccattattgccaacgatctctcatacgtgggacaatattggaaccagagtggttttgacctttgggaagaaacttacgcatccagcttcttcaccatccagaaccagcaccgagctcttgtcgagggtgcgcagctcgcccatgatctcggtgtcacatgtacaggctgtgaccaggcaccggaggttctctgcttcctccaaagtttctggaacggtaaatacatcgtgtcgaacatcaacgtcaataacggccgaactggcttggatggaaactccatactaggggccatctcaacttttgatatcgatgcgtactgcgatagtccaaccttgcaaccttgccatagccagtctttggcaaatttcaaggtcttgacagacacttttaggaacttgtataccatcaacgctggcattccggaaggccaaggggtagctgtcgggagatacgccgaggacgtttacatgggcggtaatccatggtatctgatcaccaccgcagcagcagagttcttgtatgatgcagtagcacagtggaaggctcgtcatgtgctcaccgttgacgagacgtctctcgcattcttcaaagatatctaccccgaagtcaccgtccgcgagtacaaaagcgggaacgccaacagcccattcgcacagatcatggatgctgtgaccgcctacgccgactcgtacgtcgccatcgccgagaaatacatcccctccaacggatccctctcggagcaattcaaccgcgatacaggaacccccctatccgccatcgacctcacctggtcctacgccgccttcataaccatgtctcaacgccgcgccggccaataccccagcagctggggctcccgcaacgccttgccgcctcctaccacctgctccgccagctccaccccgggcatctacacccccgccaccgccgccggcgcccccaacgtaacatccagctgccaggtcagcatcaccttcaacatcaacgccaccacctactacggcgagaacctctacgtgatcggtaactcgtcagatctgggcgcctggaatatcgccgatgcgtacccgctcagcgccagtgcatatacgcaggaccgcccgctctggagtgccgctatcccgttgaatgcgggtgaggttattagctatcagtatgtgcgccaggaagactgtgatcagccgtatatatacgagacggttaatcgcaccctgacggtacccgcgtgtggaggcgcggctgtcactacggatgatgcgtggatgggaccggtgggctcatctgggaattgctgaagggggtttggggtttgggattgaagatagatagatggagatttagatctggttaattactgggtttataaacttacgtgcattcagtaattcatgggttttgcaaaaaaaaaaaa

SEQ ID NO: 6088 - protein, 616 aa, Hormoconis resinae
MRLLPSSCAGALSLLCSLAIAAPTELKARDLSSFIASERAIALQGALNNIGPDGSAVPGAGAGFVVASPSKANPDYFYTWSRDSALTLKMIIDEFILGNTTLQTIIEQYIHAQAVLQTVSNPSGTFLPDGVGLGEPKFMVDGTRFNGPWGRPQRDGPALRAIALMTYSNWLIKNGQFAEAKTKIWPIIANDLSYVGQYWNQSGFDLWEETYASSFFTIQNQHRALVEGAQLAHDLGVTCTGCDQAPEVLCFLQSFWNGKYIVSNINVNNGRTGLDGNSILGAISTFDIDAYCDSPTLQPCHSQSLANFKVLTDTFRNLYTINAGIPEGQGVAVGRYAEDVYMGGNPWYLITTAAAEFLYDAVAQWKARHVLTVDETSLAFFKDIYPEVTVREYKSGNANSPFAQIMDAVTAYADSYVAIAEKYIPSNGSLSEQFNRDTGTPLSAIDLTWSYAAFITMSQRRAGQYPSSWGSRNALPPPTTCSASSTPGIYTPATAAGAPNVTSSCQVSITFNINATTYYGENLYVIGNSSDLGAWNIADAYPLSASAYTQDRPLWSAAIPLNAGEVISYQYVRQEDCDQPYIYETVNRTLTVPACGGAAVTTDDAWMGPVGSSGNC

SEQ ID NO: 6089 - DNA, 1848 bp, Saccharomycopsis fibuligera
  CDS (80)..(1639)
ttttttttttttttttttttttttttttttctttcttttttcaaatttttttgctaccttcctgaaacttctatttgctatgaaattcggtgttttattttccgtctttgctgctattgttagtgctttacctttgcaagaaggtcctttgaacaaaagagcctatccttcttttgaagcttattcaaactataaagttgacagaactgacttggaaaccttcttggacaaacaaaaagaagtatctttatactatcttttacaaaacattgcttatcctgaaggccaatttaataatggtgttcctggtactgttattgcttctccatcaacctctaatccggactactattaccaatggaccagagattccgcaattacatttttgacagttctttctgaactagaagataataacttcaataccactttggccaaggcagttgagtactacattaacaccagttacaaccttcaaagaaccagtaacccaagtggcagctttgatgatgaaaatcataaaggcttgggagaaccaaaatttaacacagatggttctgcatacaccggagcttgggggagaccgcaaaatgatggtcctgctttgagagcttatgctatcagtagatacttgaatgatgtcaattctttaaatgaaggtaaattagtattgactgattcaggtgatatcaacttttcttcaactgaagatatttacaaaaatatcatcaaaccagacttggaatatgttatagggtactgggattctactgggtttgatctttgggaggaaaaccaaggcagacacttttttacaagcttggttcaacagaaagcccttgcttatgctgtcgatattgccaaaagttttgacgacggcgactttgcgaacacactttcttcgactgcttctaccctcgaaagttatttgagtggcagtgatggtggatttgttaatactgatgttaaccacattgttgaaaacccagatttgcttcaacaaaactctagacaaggtctagattcagccacatatattggcccacttttgactcatgatattggtgaaagcagctcaactccatttgatgttgacaatgagtatgttttgcaatcatattacttgttattggaggataacaaagacagatactctgttaacagtgcttattctgctggtgcagctattggcagatacccagaagatgtttacaatggtgatggttcatctgaaggcaatccatggttcttagctactgcctatgctgcccaagttccatacaaacttgcttatgatgcaaagtcggcctcaaatgacattaccattaacaagattaactacgatttttttaacaagtatattgttgatttatctaccatcaattctgcttaccagtcttctgatagtgtcaccattaaaagtggctctgatgaatttaacacggttgctgataatttggtcacattcggtgattcctttttgcaagtcattttggatcatattaatgatgatggctccttgaatgaacaacttaacagatataccggttattccaccggtgcctactctttgacatggagcagtggtgctcttcttgaagctattagacttagaaataaggtcaaggctttggcttaagtgctttgaaaagtaagtgtttttcctttgtggagaacatgcaaccataatccgacagctttgttatgatactacttttttgatattttccccttctttgaccaggctatctaattatggctctattttctttctactttttggctcgagcttctgaaacatatacgtcagcgagtatcaataaacttttatttgttactttaaaaaaa

SEQ ID NO: 6090 - protein, 519 aa, Saccharomycopsis fibuligera
MKFGVLFSVFAAIVSALPLQEGPLNKRAYPSFEAYSNYKVDRTDLETFLDKQKEVSLYYLLQNIAYPEGQFNNGVPGTVIASPSTSNPDYYYQWTRDSAITFLTVLSELEDNNFNTTLAKAVEYYINTSYNLQRTSNPSGSFDDENHKGLGEPKFNTDGSAYTGAWGRPQNDGPALRAYAISRYLNDVNSLNEGKLVLTDSGDINFSSTEDIYKNIIKPDLEYVIGYWDSTGFDLWEENQGRHFFTSLVQQKALAYAVDIAKSFDDGDFANTLSSTASTLESYLSGSDGGFVNTDVNHIVENPDLLQQNSRQGLDSATYIGPLLTHDIGESSSTPFDVDNEYVLQSYYLLLEDNKDRYSVNSAYSAGAAIGRYPEDVYNGDGSSEGNPWFLATAYAAQVPYKLAYDAKSASNDITINKINYDFFNKYIVDLSTINSAYQSSDSVTIKSGSDEFNTVADNLVTFGDSFLQVILDHINDDGSLNEQLNRYTGYSTGAYSLTWSSGALLEAIRLRNKVKALA

SEQ ID NO: 6091 - DNA, 1353 bp, Schizosaccharomyces pombe
  CDS (1)..(1353)
atgcgtacatactggttattcttactccttgggggggtcgtatctgcagaaagcttactttcccctaataaaagaagcaaggaagcttctatggatgaatggacggatcagcaaaagggtattgctatgggacatatgctgaacaatatcggtgacagcggtatgcatgctaaggatattaatcctggatgtattattgcttccccttcaactgattcccctgattactattatcaatgggttcgtgatagtgcattgacgatcatgactattttagatcgtttctttgaaggggacaaaggacttgagccgattatcgtcaaatatatggatgaaatggtcaggctccaaaaggtcccgaacccaagtggagacttttacgccggaggtcttggtgagcctaaatttaatgttgatgggacaagctatgacggagattggggacgtccccagaatgattcccctgctcttcgggctattgcatttatcaaatacatgaattatttatttgaaaatggtaaagaggtccatgaagttactgtctggattgaggctgtattagccgacttggattatactgcaaatcactggacagaggcaagctttgatctttgggaagaaattaaggacgttcattactttactctagccgttcagaagcgtgccatgcaagatggtacagcttttgcaaagagaattggagcacctgaccaagccgcactctaccaacgcacgatcgagcctattgatctaaaactgggagagttctgggatcctggaatgggtgttattaagggttataaaggcagagtcgatcgctcaggacttgattgctccactttgcttgcaagcctttactcaaatgagtttgatatgcacatccttccaaccttgttgaagttgcaagaaaccatgaccagagattatcccgtcaatcagggatggaagcaagcaatgggacgctatcccgaggatgtatacgatggtgtctctaagtctattggtaacccttggttcatttgcacaagcagcgctgccgagattatctacaaagcaatcgcatactacgataataaaggtttaccagaattgactgaatataacatccatttctttatgaaatttgctgagtttggagatccatacaactggtccgttatcaggaaaaacatgcacacatatgctgataactttttaaaagctgttgctgagttccaacatccaaatggttcaatgtctgaacaattttcgcgtgacgatggtcaccaaaaaggtgcaagagatttgacatggagttattcatccttattaaatgccatctacagaagagaggcaatcaaaggctctgtctaa

SEQ ID NO: 6092 - protein, 450 aa, Schizosaccharomyces pombe
MRTYWLFLLLGGVVSAESLLSPNKRSKEASMDEWTDQQKGIAMGHMLNNIGDSGMHAKDINPGCIIASPSTDSPDYYYQWVRDSALTIMTILDRFFEGDKGLEPIIVKYMDEMVRLQKVPNPSGDFYAGGLGEPKFNVDGTSYDGDWGRPQNDSPALRAIAFIKYMNYLFENGKEVHEVTVWIEAVLADLDYTANHWTEASFDLWEEIKDVHYFTLAVQKRAMQDGTAFAKRIGAPDQAALYQRTIEPIDLKLGEFWDPGMGVIKGYKGRVDRSGLDCSTLLASLYSNEFDMHILPTLLKLQETMTRDYPVNQGWKQAMGRYPEDVYDGVSKSIGNPWFICTSSAAEIIYKAIAYYDNKGLPELTEYNIHFFMKFAEFGDPYNWSVIRKNMHTYADNFLKAVAEFQHPNGSMSEQFSRDDGHQKGARDLTWSYSSLLNAIYRREAIKGSV

SEQ ID NO: 6093 - DNA, 1881 bp, Saccharomycopsis fibuligera
  CDS (322)..(1881)
ctgcagtcaacatgcgcattcgaaggataaaagatgttccgaggggttaaactgattatgactacacatcgtagatcacaacattatgccatagcacttttttggaagtgttcaaaaaatgtaagcgtgtcttcaatatagcggcgaggttctcttggtttggtaaatagaaattggtataaatacttactacatcacctcattttctacagttttacacaatataatctttatatatcaaaaatattcaaacaaaatcaataaaaacagaactttcttttttcaaatttttttgctaccttcctgaaacttctatttgctatgagattcggtgttttaatttccgtctttgttgctattgttagtgctttacctttgcaagaaggtcctttgaacaaaagagcctatccttcttttgaagcttattcaaactataaagttgacagaactgacttggaaaccttcttggacaaacaaaaagatgtatctttatactatcttttacaaaacattgcttatccagaaggccaatttaatgacggtgttcccggtactgttattgcttctccatcaacctctaatccggactactattaccaatggaccagagattccgcaattacatttttgacagttctttctgaactagaagataataacttcaataccactttggctaaggcagttgagtactacattaataccagttacaaccttcaaagaaccagtaacccaagtggcagctttgatgatgaaaatcataaaggcttgggagaaccaaaatttaacacagatggttctgcatacaccggagcttgggggagaccgcaaaatgatggtcctgctttgagagcttatgctatcagtagatacttgaatgatgtcaattctttaaataaaggtaaattagtattgactgattcaggtgatatcaacttttcttcaactgaagatatttacaaaaatatcatcaaaccagacttggaatatgttatagggtactgggattctactgggtttgatctttgggaggaaaaccaaggcagacacttttttacaagcttggttcaacagaaagcccttgcttatgctgtcgatattgccaaaagttttgacgatggcgactttgcgaacacactttcttcgactgcttctaccctcgaaagttatttgagtggcagtgatggtggatttgttaatactgatgttaaccacattgttgaaaacccagatttgctccaacaaaactctagacaaggtctagattcagccacttatattggcccacttttgactcatgatattggcgaaagcagctcaactccatttgatgttgacaatgagtatgttttgcaatcatattacttgttattggaggataataaagacagatactctgttaacagtgcttattctgctggtgcagctattggcagatacccagaagatgtttacaatggtgatggttcatctgaaggcaatccatggtttttagctactgcctatgctgcccaagttccatacaaacttgtttatgatgcaaagtctgcctcaaatgacattaccattaacaagattaactacgatttttttaacaagtatattgttgatttatctaccatcaattctggttaccagtcttctgatagtgtcaccattaaaagtggctctgatgaatttaacacggttgctgataatttggtcacattcggtgattcctttttgcaagtcattttggatcatattaatgatgatggctccttgaatgaacaacttaacagaaataccggttattccaccagtgcctactctttgacatggagcagtggtgctcttcttgaagctattagacttagaaataaggtcaaggctttggcttaa

SEQ ID NO: 6094 - protein, 519 aa, Saccharomycopsis fibuligera
MRFGVLISVFVAIVSALPLQEGPLNKRAYPSFEAYSNYKVDRTDLETFLDKQKDVSLYYLLQNIAYPEGQFNDGVPGTVIASPSTSNPDYYYQWTRDSAITFLTVLSELEDNNFNTTLAKAVEYYINTSYNLQRTSNPSGSFDDENHKGLGEPKFNTDGSAYTGAWGRPQNDGPALRAYAISRYLNDVNSLNKGKLVLTDSGDINFSSTEDIYKNIIKPDLEYVIGYWDSTGFDLWEENQGRHFFTSLVQQKALAYAVDIAKSFDDGDFANTLSSTASTLESYLSGSDGGFVNTDVNHIVENPDLLQQNSRQGLDSATYIGPLLTHDIGESSSTPFDVDNEYVLQSYYLLLEDNKDRYSVNSAYSAGAAIGRYPEDVYNGDGSSEGNPWFLATAYAAQVPYKLVYDAKSASNDITINKINYDFFNKYIVDLSTINSGYQSSDSVTIKSGSDEFNTVADNLVTFGDSFLQVILDHINDDGSLNEQLNRNTGYSTSAYSLTWSSGALLEAIRLRNKVKALA

SEQ ID NO: 6095 - DNA, 2753 bp, Saccharomyces cerevisiae
  CDS (126)..(2429)
gatcttttgcttcctaaactaaacctataaaaagcaccctattcatcagttataatctcttgtcatgttgtggttctaattgaaaatatactatggtaggcctcaaaaatccatatacgcacactatgcaaagaccatttctactcgcttatttggtcctttcgcttctatttaactcagctttgggttttccaactgcactagttcctagaggatcctcctctagcaacatcacttcctccggtccatcttcaactccattcagctctgctactgaaagcttttctactggcactactgtcactccatcatcatccaaataccctggcagtaaaacagaaacttctgtttcttctacaaccgaaactaccattgttccaactacaactacgacttctgtcataacaccatcaacaaccactattaccactacggtttgctctacaggaacaaactctgccggtgaaactacttctggatgctctccaaagaccattacaactactgttccatgttcaaccagtccaagcgaaaccgcatcggaatcaacaaccacttcacctaccacacctgtaactacagttgtctcaaccaccgtcgttactactgagtattctactagtacaaaacaaggtggtgaaattacaactacatttgtcaccaaaaacattccaaccacttacctaactacaattgctccaacttcatcagtcactacggttaccaatttcaccccaaccactattactactacggtttgctctacaggaacaaactctgccggtgaaactacctctggatgctctccaaagactgtcacaacaactgttccttgttcaactggtactggcgaatacactactgaagctaccgcccctgttacaacagctgtcacaaccaccgttgttaccactgaatcctctacgggtactaactccgctggtaagacgacaactagttacacaacaaagtctgtaccaaccacctatgtatttgactttggcaagggcattctcgatcaaagctgcggcggtgtattttcaaacaacggctcttcgcaagtgcagctgcgggatgtagtcttgatgaatgggacagtggtatacgattcaaacggcgcttgggacagtagtgcgctggaggagtggctccagcgacagaaaaaagtttccatcgaaagaatatttgaaaatattgggcccagcgccgtgtatccgtctattttgcctggggtcgtgattgcgtcaccatcgcaaacgcatccagactacttctaccaatggataagggacagcgcgttgacgataaacagtattgtctctcattctgcggacccggcaatagagacgttattgcagtacctgaacgtttcattccacttgcaaagaaccaacaacacattgggcgctggcattggttacactaacgatacagtggctttgggagaccctaagtggaacgtcgacaacacggctttcacggaaccttggggtcgtcctcaaaacgatggccctgctcttcgaagcattgccatcttaaaaatcatcgactacatcaagcaatctggcactgatctgggggccaagtacccattccagtccaccgcagatatctttgatgatattgtacgttgggacctgaggttcattattgaccactggaattcttccggatttgatctatgggaggaagtcaatggcatgcatttctttactttactggtacaactgtctgcagtggacaggtcgctgtcgtattttaacgcctcagaacggtcgtctccctttgttgaagaattgcgtcagacacgccgggacatctccaagtttttagtggaccctgcgaatgggtttatcaacggcaagtacaattatattgttgagacacccatgattgccgacacattgagatccggactggacatatccactttattagctgcgaacaccgtccacgatgcgccatctgcttcccatcttccgttcgatatcaatgaccctgccgtcctgaacacgttgcaccatttgatgttgcacatgcgttcgatataccccatcaacgatagctccaaaaatgcaacgggtattgccctgggccggtatcctgaggacgtatatgatggatatggcgttggcgagggaaatccctgggtcctggccacgtgtgccgcttcaacaacgctttatcagctcatttacagacacatctctgagcagcatgacttggttgtcccaatgaacaacgattgttcgaacgcattttggagcgagctggtattctccaacctcacgactttgggaaatgacgaaggctatttgattttggagttcaatacacctgccttcaatcaaaccatacaaaaaatcttccaactagctgattcattcttggtcaagctgaaagccacgtgggaacagacggggaactaagtgaacaatttaacaaatacacagggtttatgcagggtgcccaacaccttacctggtcctatacttcattctgggatgcctatcaaataagacaagaagttttacagagtttgtagacaaaaaaaaataaaagaaaagcgagaagtatacacaagtgtatttcctagatatttacatcaaatatatatatatatacttatttacaaaactctgatattataaattaattagatactatgtcggaacgtccagcccaaccacgtttgcagttcttttcactttctcatcctgtgtcaacttgttgccaggattgtatctgtcgac

SEQ ID NO: 6096 - protein, 767 aa, Saccharomyces cerevisiae
MQRPFLLAYLVLSLLFNSALGFPTALVPRGSSSSNITSSGPSSTPFSSATESFSTGTTVTPSSSKYPGSKTETSVSSTTETTIVPTTTTTSVITPSTTTITTTVCSTGTNSAGETTSGCSPKTITTTVPCSTSPSETASESTTTSPTTPVTTVVSTTVVTTEYSTSTKQGGEITTTFVTKNIPTTYLTTIAPTSSVTTVTNFTPTTITTTVCSTGTNSAGETTSGCSPKTVTTTVPCSTGTGEYTTEATAPVTTAVTTTVVTTESSTGTNSAGKTTTSYTTKSVPTTYVFDFGKGILDQSCGGVFSNNGSSQVQLRDVVLMNGTVVYDSNGAWDSSALEEWLQRQKKVSIERIFENIGPSAVYPSILPGVVIASPSQTHPDYFYQWIRDSALTINSIVSHSADPAIETLLQYLNVSFHLQRTNNTLGAGIGYTNDTVALGDPKWNVDNTAFTEPWGRPQNDGPALRSIAILKIIDYIKQSGTDLGAKYPFQSTADIFDDIVRWDLRFIIDHWNSSGFDLWEEVNGMHFFTLLVQLSAVDRSLSYFNASERSSPFVEELRQTRRDISKFLVDPANGFINGKYNYIVETPMIADTLRSGLDISTLLAANTVHDAPSASHLPFDINDPAVLNTLHHLMLHMRSIYPINDSSKNATGIALGRYPEDVYDGYGVGEGNPWVLATCAASTTLYQLIYRHISEQHDLVVPMNNDCSNAFWSELVFSNLTTLGNDEGYLILEFNTPAFNQTIQKIFQLADSFLVKLKATWEQTGN

SEQ ID NO: 6097 - DNA, 3308 bp, Saccharomyces cerevisiae
  CDS (678)..(2984)
gctagcgtatcaacccatctccagatttgcccagcatttctgtagaacacccaatgcgaatgaagactaatgaatattttaaagacaaaaaataggaaaagtttaattattgatggttctcaccaccgcaaaacggtcacttgcatgcattgaggacatgcactgcagtacttgtttttctcgaatgttttttaccatctcttttttccttatctgagctgctgacgcagacggacattgtttcatatttcgaaagctgtgcgggaaaacggaccctaacacgaatgtggatgcgctaatcggtatttccacctcatgaaacctgctactttttcagtgctcttcgtatgcatttcccaaaattcattcgtagccttgtcaacttagactcagtccacggcgtgcaggacggggtattatgaataaaggatccacgggtaagatttgttctatgttttaggtatggagttttgtaccacaaaactttgaggaataccggattgtgtgcctacgccagccccagagtatgttctcacggctgtaattcctagtgatcttttgcttcctaaactaaacctataaaaagcaccctattcatcagttataatctcttgtcatgttgtggttctaattgaaaatatactatggtaggcctcaaaaatccatatacgcacactatgcaaagaccatttctactcgcttatttggtcctttcgcttctatttaactcagctttgggttttccaactgcactagttcctagaggatcctcctctagcaacatcacttcctccggtccatcttcaactccattcagctctgctactgaaagcttttctactggcactactgtcactccatcatcatccaaataccctggcagtaaaacagaaacttctgtttcttctacaaccgaaactaccattgttccaactacaactacgacttctgtcataacaccatcaacaaccactattaccactacggtttgctctacaggaacaaactctgccggtgaaactacttctggatgctctccaaagaccattacaactactgttccatgttcaaccagtccaagcgaaaccgcatcggaatcaacaaccacttcacctaccacacctgtaactacagttgtctcaaccaccgtcgttactactgagtatgcgtctactagtacaaaacaaggtggtgaaattacaactacatttgtcaccaaaaacattccaaccacttacctaactacaattgctccaacttcatcagtcactacggttaccaatttcaccccaaccactattactactacggtttgctctacaggaacaaactctgccggtgaaactacctctggatgctctccaaagactgtcacaacaactgttccttgttcaactggtactggcgaatacactactgaagctaccgcccctgttacaacagctgtcacaaccaccgttgttaccactgaatcctctacgggtactaactccgctggtaagacgacaactagttacacaacaaagtctgtaccaaccacctatgtatttgactttggcaagggcattctcgatcaaagctgcggcggtgtattttcaaacaacggctcttcgcaagtgcagctgcgggatgtagtcttgatgaatgggacagtggtatacgattcaaacggcgcttgggacagtagtccgctggaggagtggctccagcgacagaaaaaagtttccatcgaaagaatatttgaaaatattgggcccagcgccgtgtatccgtctattttgcctggggtcgtgattgcgtcaccatcgcaaacgcatccagactacttctaccaatggataagggacagcgcgttgacgataaacagtattgtctctcattctgcggacccggcaatagagacgttattgcagtacctgaacgtttcattccacttgcaaagaaccaacaacacattgggcgctggcattggttacactaacgatacagtggctttgggagaccctaagtggaacgttgacaacacggctttcacggaaccttggggtcgtcctcaaaacgatggccctgctcttcgaagcattgccatcttaaaaatcatcgactacatcaagcaatctggcactgatctgggggccaagtacccattccagtccaccgcagatatctttgatgatattgtacgttgggacctgaggttcattattgaccactggaattcttccggatttgatctatgggaggaagtcaatggcatgcatttctttactttactggtacaactgtctgcagtggacaggtcgctgtcgtattttaacgcctcagaacggtcgtctccctttgttgaagaattgcgtcagacacgccgggacatctccaagtttttagtggaccctgcgaatgggtttatcaacggcaagtacaattatattgttgagacacccatgattgccgacacattgagatccggactggacatatccactttattagctgcgaacaccgtccacgatgcgccatctgcttcccatcttccgttcgatatcgatgaccctgccgtcctgaacacgttgcaccatttgatgttgcacatgcgttcgatataccccatcaacgatagctccaaaaatgcaacgggtattgccctgggccggtatcctgaggacgtatatgatggatatggcgttggcgagggaaatccctgggtcctggccacgtgtgccgcttcaacaacgctttatcagctcatttacagacacatctctgagcagcatgacttggttgtcccaatgaacaacgattgttcgaacgcattttggagcgagctggtattctccaacctcacgactttgggaaatgacgaaggctatttgattttggagttcaatacacctgccttcaatcaaaccatacaaaaaatcttccaactagctgattcattcttggtcaagctgaaagccacgtgggaacagacggggaactaagtgaacaatttaacaaatacacagggtttatgcagggtgcccaacaccttacctggtcctatacttcattctgggatgcctatcaaataagacaagaagttttacagagtttgtagacaaaaaaaaataaaagaaaagcgagaagtatacacaagtgtatttcctagatatttacatcaaatatatatatatatacttatttacaaaactctgatattataaattaattagatactatgtcggaacgtccagcccaaccacgtttgcagttcttttcactttctcatcctgtgtcaacttgttgccaggattgtatctgtcgac

SEQ ID NO: 6098 - protein, 768 aa, Saccharomyces cerevisiae
MQRPFLLAYLVLSLLFNSALGFPTALVPRGSSSSNITSSGPSSTPFSSATESFSTGTTVTPSSSKYPGSKTETSVSSTTETTIVPTTTTTSVITPSTTTITTTVCSTGTNSAGETTSGCSPKTITTTVPCSTSPSETASESTTTSPTTPVTTVVSTTVVTTEYASTSTKQGGEITTTFVTKNIPTTYLTTIAPTSSVTTVTNFTPTTITTTVCSTGTNSAGETTSGCSPKTVTTTVPCSTGTGEYTTEATAPVTTAVTTTVVTTESSTGTNSAGKTTTSYTTKSVPTTYVFDFGKGILDQSCGGVFSNNGSSQVQLRDVVLMNGTVVYDSNGAWDSSPLEEWLQRQKKVSIERIFENIGPSAVYPSILPGVVIASPSQTHPDYFYQWIRDSALTINSIVSHSADPAIETLLQYLNVSFHLQRTNNTLGAGIGYTNDTVALGDPKWNVDNTAFTEPWGRPQNDGPALRSIAILKIIDYIKQSGTDLGAKYPFQSTADIFDDIVRWDLRFIIDHWNSSGFDLWEEVNGMHFFTLLVQLSAVDRSLSYFNASERSSPFVEELRQTRRDISKFLVDPANGFINGKYNYIVETPMIADTLRSGLDISTLLAANTVHDAPSASHLPFDIDDPAVLNTLHHLMLHMRSIYPINDSSKNATGIALGRYPEDVYDGYGVGEGNPWVLATCAASTTLYQLIYRHISEQHDLVVPMNNDCSNAFWSELVFSNLTTLGNDEGYLILEFNTPAFNQTIQKIFQLADSFLVKLKATWEQTGN

SEQ ID NO: 6099 - DNA, 27 bp, Artificial sequence
  primer
atggcaagacaaaagatgttttataac

SEQ ID NO: 6100 - DNA, 26 bp, Artificial sequence
  primer
ctacaaactctgtaaaacttcttgtc

SEQ ID NO: 6101 - protein, 542 aa, Artificial sequence
  consensus sequence
  Variant (2)..(6): Xaa in position 2 to 6 is any amino acid
  Variant (7)..(16): Xaa in position 7 to 16 is any or no amino acid
  Variant (18)..(18): Xaa in position 18 is any amino acid
  Variant (20)..(20): Xaa in position 20 is any amino acid
  Variant (25)..(27): Xaa in position 25 to 27 is any amino acid
  Variant (28)..(30): Xaa in position 28 to 30 is any or no amino acid
  Variant (34)..(34): Xaa in position 34 is any amino acid
  Variant (36)..(36): Xaa in position 36 is any amino acid
  Variant (38)..(38): Xaa in position 38 is any amino acid
  Variant (41)..(60): Xaa in position 41 to 60 is any amino acid
  Variant (61)..(91): Xaa in position 61 to 91 is any or no amino acid
  Variant (93)..(95): Xaa in position 93 to 95 is any amino acid
  Variant (97)..(97): Xaa in position 97 is any amino acid
  Variant (98)..(98): Xaa in position 98 is any or no amino acid
  Variant (100)..(105): Xaa in position 100 to 105 is any amino acid
  Variant (106)..(110): Xaa in position 106 to 110 is any or no amino acid
  Variant (117)..(118): Xaa in position 117 to 118 is any amino acid
  Variant (120)..(126): Xaa in position 120 to 126 is any amino acid
  Variant (132)..(132): Xaa in position 132 is any amino acid
  Variant (140)..(167): Xaa in position 140 to 167 is any amino acid
  Variant (168)..(184): Xaa in position 168 to 184 is any or no amino acid
  Variant (187)..(187): Xaa in position 187 is any amino acid
  Variant (189)..(192): Xaa in position 189 to 192 is any amino acid
  Variant (194)..(197): Xaa in position 194 to 197 is any amino acid
  Variant (204)..(205): Xaa in position 204 to 205 is any amino acid
  Variant (207)..(208): Xaa in position 207 to 208 is any amino acid
  Variant (212)..(217): Xaa in position 212 to 217 is any amino acid
  Variant (220)..(225): Xaa in position 220 to 225 is any amino acid
  Variant (227)..(247): Xaa in position 227 to 247 is any amino acid
  Variant (248)..(264): Xaa in position 248 to 264 is any or no amino acid
  Variant (266)..(280): Xaa in position 266 to 280 is any amino acid
  Variant (281)..(300): Xaa in position 281 to 300 is any or no amino acid
  Variant (302)..(302): Xaa in position 302 is any amino acid
  Variant (304)..(320): Xaa in position 304 to 320 is any amino acid
  Variant (321)..(349): Xaa in position 321 to 349 is any or no amino acid
  Variant (351)..(362): Xaa in position 351 to 362 is any amino acid
  Variant (363)..(363): Xaa in position 363 is any or no amino acid
  Variant (365)..(366): Xaa in position 365 to 366 is any amino acid
  Variant (368)..(372): Xaa in position 368 to 372 is any amino acid
  Variant (373)..(386): Xaa in position 373 to 386 is any or no amino acid
  Variant (388)..(388): Xaa in position 388 is any amino acid
  Variant (392)..(392): Xaa in position 392 is any amino acid
  Variant (395)..(395): Xaa in position 395 is any amino acid
  Variant (397)..(398): Xaa in position 397 to 398 is any amino acid
  Variant (399)..(405): Xaa in position 399 to 405 is any or no amino acid
  Variant (410)..(412): Xaa in position 410 to 412 is any amino acid
  Variant (414)..(416): Xaa in position 414 to 416 is any amino acid
  Variant (419)..(420): Xaa in position 419 to 420 is any amino acid
  Variant (422)..(444): Xaa in position 422 to 444 is any amino acid
  Variant (445)..(493): Xaa in position 445 to 493 is any or no amino acid
  Variant (495)..(495): Xaa in position 495 is any amino acid
  Variant (497)..(507): Xaa in position 497 to 507 is any amino acid
  Variant (509)..(509): Xaa in position 509 is any amino acid
  Variant (510)..(512): Xaa in position 510 to 512 is any or no amino acid
  Variant (515)..(519): Xaa in position 515 to 519 is any amino acid
  Variant (521)..(524): Xaa in position 521 to 524 is any amino acid
  Variant (526)..(527): Xaa in position 526 to 527 is any amino acid
  Variant (532)..(537): Xaa in position 532 to 537 is any amino acid
  Variant (539)..(541): Xaa in position 539 to 541 is any amino acid
NXXXXXXXXXXXXXXXGXVXASPSXXXXXXPDYXYXWXRDXXXXXXXXXXXXXXXXXXXXXXXXXXXXXXXXXXXXXXXXXXXXXXXXXXXQXXXNXXGXXXXXXXXXXXLGEPKFXXDXXXXXXXWGRPQXDGPALRAXXXXXXXXXXXXXXXXXXXXXXXXXXXXXXXXXXXXXXXXXXXXXDLXYXXXXWXXXXFDLWEEXXGXXFFTXXXXXXALXXXXXXAXXXXXXXXXXXXXXXXXXXXXXXXXXXXXXXXXXXXXXFXXXXXXXXXXXXXXXXXXXXXXXXXXXXXXXXXXXGXDXXXXXXXXXXXXXXXXXXXXXXXXXXXXXXXXXXXXXXXXXXXXXXLXXXXXXXXXXXXXYXXNXXXXXXXXXXXXXXXXXXXAXGRYXEDXYXXXXXXXXXGNPWXXXTXXXAEXXYXXXXXXXXXXXXXXXXXXXXXXXXXXXXXXXXXXXXXXXXXXXXXXXXXXXXXXXXXXXXXXXXXXXXXXXXDXFXXXXXXXXXXXGXXXXEQXXXXXGXXXXAXXLTWSXXXXXXAXXXR

SEQ ID NO: 6102 - protein, 17 aa, Artificial sequence
  protein pattern
  Variant (2)..(2): Xaa in position 2 is any amino acid
  Variant (3)..(3): Xaa in position 3 is Phe or Tyr
  Variant (4)..(7): Xaa in position 4 to 7 is any amino acid
  Variant (9)..(9): Xaa in position 9 is Asp, Asn, Pro, Gln, Ser or Thr
  Variant (10)..(10): Xaa in position 10 is any amino acid
  Variant (11)..(11): Xaa in position 11 is Ala, Glu, Gly, Ser or Thr
  Variant (12)..(12): Xaa in position 12 is Cys, Gly, Asn, Ser or Thr
  Variant (13)..(13): Xaa in position 13 is Phe or Tyr
LXXXXXXWXXXXXDLWE

SEQ ID NO: 6103 - protein, 30 aa, Artificial sequence
  protein pattern
  Variant (2)..(2): Xaa in position 2 is any amino acid
  Variant (3)..(3): Xaa in position 3 is Leu or Met
  Variant (4)..(4): Xaa in position 4 is Ala, Asp, Asn, Ser or Thr
  Variant (7)..(7): Xaa in position 7 is any amino acid
  Variant (8)..(8): Xaa in position 8 is Asp, Gly, Asn, Ser or Thr
  Variant (9)..(11): Xaa in position 9 to 11 is any amino acid
  Variant (13)..(15): Xaa in position 13 to 15 is any amino acid
  Variant (16)..(16): Xaa in position 16 is Gly or Ser
  Variant (18)..(19): Xaa in position 18 to 19 is any amino acid
  Variant (24)..(24): Xaa in position 24 is any amino acid
  Variant (25)..(29): Xaa in position 25 to 29 is any or no amino acid
GXXXEQXXXXXGXXXXAXXLTWSXXXXXXA

SEQ ID NO: 6104 - protein, 17 aa, Artificial sequence
  protein pattern
  Variant (3)..(3): Xaa in position 3 is Phe, Trp or Tyr
  Variant (5)..(5): Xaa in position 5 is any amino acid
  Variant (7)..(7): Xaa in position 7 is any amino acid
  Variant (10)..(10): Xaa in position 10 is Ala, Gly, Ser or Thr
  Variant (11)..(11): Xaa in position 11 is Ala or Gly
  Variant (12)..(12): Xaa in position 12 is Ile or Leu
  Variant (13)..(16): Xaa in position 13 to 16 is any amino acid
  Variant (17)..(17): Xaa in position 17 is Ile, Leu or Val
DYXYXWXRDXXXXXXXX

SEQ ID NO: 6105 - protein, 14 aa, Artificial sequence
  protein pattern
  Variant (2)..(2): Xaa in position 2 is any amino acid
  Variant (3)..(4): Xaa in position 3 to 4 is any or no amino acid
  Variant (8)..(8): Xaa in position 8 is Ala, Pro or Ser
  Variant (11)..(11): Xaa in position 11 is any amino acid
  Variant (13)..(13): Xaa in position 13 is any amino acid
  Variant (14)..(14): Xaa in position 14 is Asp, Gly or Asn
AXXXGRYXEDXYXX

SEQ ID NO: 6106 - protein, 8 aa, Artificial sequence
  protein pattern
  Variant (2)..(2): Xaa in position 2 is any amino acid
  Variant (4)..(4): Xaa in position 4 is Ile or Val
GXVXASPS

SEQ ID NO: 6107 - DNA, 3663 bp, Saccharomyces cerevisiae
  CDS (1)..(3663)
atgcgatttggcctgccatcaaaattggaactcactcctccgtttaggataggcatccgaactcaactaacggcactagttagtatagtggctttgggctcactgattattctggctgtaacgacaggggtctattttacctcgaactataaaaatttaaggtccgatagactgtacattgccgctcagttaaagtcatcacagattgaccaaactctaaactacttatattaccaggcgtactatttggcatcaagagacgccctgcaaagctcactaacaagttacgttgcaggtaacaagagtgcagataattgggtagattccttgagtgtgattcaaaaatttttgagctcttcaaacttgttttatgttgctaaagtttacgattcttcatttaatgctgttttgaacgctacgaataatggaactggtgatctaattccagaagatgttttagacagtttgttcccattatccaccgatacaccgctaccttcttcactggaaactataggtatattgacggatccagtactaaatagcaccgactatttgatgtctatgtctttacctatttttgccaatccttctattatcttgactgattcaagggtttacggatacattactataataatgtcggcagagggtctgaaaagtgtgttcaacgatacaactgctttagaacattccacaattgccattatttctgcagtatataatagtcaaggcaaagcttcagggtatcattttgtctttccaccgtatggatcacgatcagacctcccgcaaaaagttttttctataaaaaatgatacattcattagtagcgcatttagaaacgggaagggagggtctttgaaacaaaccaatatcctttctacacggaatactgctttaggctattcaccatgttcgtttaacctagttaattgggtcgcgatagtttcacagcctgagtcggttttcctttctccagcaacgaaactagcaaaaatcatcaccggcactgtcatcgctattggtgtctttgtcattttgttaacccttcctctagcacactgggcagtgcaaccaattgtacgtctacaaaaggcaactgaattaattacagaggggagaggccttcgaccgagcaccccaagaacgataagcagagccagttcattcaaaagaggatttagttctggatttgctgttccttcttcgttattacaatttaatactgctgaagctggcagcaccacaagcgtaagtggccatggaggcagtggccatggcagtggtgcagctttttcagcaaatagtagcatgaaaagcgctataaaccttggaaatgagaaaatgtcacctccagaggaggagaacaaaataccgaataaccacaccgatgctaaaatatcaatggatggctcgctaaatcacgatttgcttggaccacattccttgagacataatgacactgacagaagttccaatagatctcacattctcacaacttctgcaaatttaactgaagctaggctaccagattatagaagactattttctgatgaactttccgatttaacagaaaccttcaatactatgacagacgcattagaccaacattatgctcttctagaagaaagagttagggcgaggacaaaacaactcgaagctgccaagattgaggcagaggccgcaaatgaagcaaaaaccgtctttattgccaatatttcgcacgaattgagaacgcctttaaatggtattctgggtatgacggctatttcaatggaagaaaccgatgttaacaaaataagaaatagtttaaaactcatttttagatcaggtgagcttttgcttcatattctaacggaattgttaactttttccaaaaacgttcttcaaagaacgaaactggagaaaagagatttttgcattaccgatgttgccttacaaataaaatcgatatttggtaaagttgcaaaggatcagcgtgttcgtctttcaatatcattgtttcctaatttgataaggacaatggttctttggggtgattccaacagaattattcaaattgtgatgaatctagtgtccaatgcactaaagttcacccctgtagatggtaccgttgatgtaagaatgaaactgttgggtgaatacgacaaagaattaagcgagaagaagcaatacaaagaagtgtatatcaaaaaagggacagaagtaaccgaaaatttagaaactacagataaatacgatcttccaactttatcgaaccataggaaaagtgtcgatttagaatccagcgctacttccctaggaagtaatagagacacttcgacaattcaggaagagataacaaaaagaaatactgttgcgaatgaaagtatctataagaaagtgaatgacagggaaaaagcttcgaatgatgatgtatcttctatagtatcaacaactaccagctcgtatgataacgctatcttcaatagtcagttcaataaagcacctggctcagatgatgaagaaggtggtaacctaggaagacctatcgaaaaccccaaaacgtgggttatttctattgaagtggaagacactgggcctggtattgacccttccttacaagaatctgtatttcatccatttgttcaaggtgatcaaacattgtccaggcaatatggtggtactggcttaggtctatcaatctgtagacagttagcaaatatgatgcatggaacgatgaaattagagtcgaaagtaggtgttggtagtaaattcacttttaccttgccattaaatcaaactaaagagatcagttttgcagatatggagtttccttttgaggacgaatttaatcctgagagtagaaagaacagaagagtcaagtttagtgttgctaaaagcatcaagagccgacaatccacatcatctgttgcaacaccagctacaaatagaagtagcctaaccaacgacgtgctaccggaggtaagaagtaaaggtaagcatgagacgaaagatgttggaaatcctaacatgggaagagaagaaaaaaacgacaatggagggcttgaacaactgcaggaaaaaaatattaaaccttctatatgtcttacaggtgctgaagttaacgaacaaaattccttgtcttctaagcatcgttctcgacatgaaggtctaggttctgtcaatcttgatagaccatttttgcaaagtactggtacagccacatcaagtagaaacatccccacagtcaaagacgacgataaaaatgaaacaagtgtcaaaattttggttgtagaagataatcatgtaaatcaggaagttatcaaaagaatgttgaacttggagggcattgaaaatattgaactggcttgcgatggccaagaagcattcgacaaagttaaagaattgacatctaagggcgaaaattataatatgattttcatggatgtccagatgcctaaagtggatggtttactttctaccaagatgataaggcgcgatttaggttatacctcacctattgtcgctctaaccgcttttgctgacgatagcaacattaaagaatgtttggaatcaggaatgaacggatttttatcgaaaccaatcaaaagaccaaaattgaaaactattcttactgagttttgtgcagcatatcagggaaagaaaaataacaaatga

SEQ ID NO: 6108 - protein, 1220 aa, Saccharomyces cerevisiae
MRFGLPSKLELTPPFRIGIRTQLTALVSIVALGSLIILAVTTGVYFTSNYKNLRSDRLYIAAQLKSSQIDQTLNYLYYQAYYLASRDALQSSLTSYVAGNKSADNWVDSLSVIQKFLSSSNLFYVAKVYDSSFNAVLNATNNGTGDLIPEDVLDSLFPLSTDTPLPSSLETIGILTDPVLNSTDYLMSMSLPIFANPSIILTDSRVYGYITIIMSAEGLKSVFNDTTALEHSTIAIISAVYNSQGKASGYHFVFPPYGSRSDLPQKVFSIKNDTFISSAFRNGKGGSLKQTNILSTRNTALGYSPCSFNLVNWVAIVSQPESVFLSPATKLAKIITGTVIAIGVFVILLTLPLAHWAVQPIVRLQKATELITEGRGLRPSTPRTISRASSFKRGFSSGFAVPSSLLQFNTAEAGSTTSVSGHGGSGHGSGAAFSANSSMKSAINLGNEKMSPPEEENKIPNNHTDAKISMDGSLNHDLLGPHSLRHNDTDRSSNRSHILTTSANLTEARLPDYRRLFSDELSDLTETFNTMTDALDQHYALLEERVRARTKQLEAAKIEAEAANEAKTVFIANISHELRTPLNGILGMTAISMEETDVNKIRNSLKLIFRSGELLLHILTELLTFSKNVLQRTKLEKRDFCITDVALQIKSIFGKVAKDQRVRLSISLFPNLIRTMVLWGDSNRIIQIVMNLVSNALKFTPVDGTVDVRMKLLGEYDKELSEKKQYKEVYIKKGTEVTENLETTDKYDLPTLSNHRKSVDLESSATSLGSNRDTSTIQEEITKRNTVANESIYKKVNDREKASNDDVSSIVSTTTSSYDNAIFNSQFNKAPGSDDEEGGNLGRPIENPKTWVISIEVEDTGPGIDPSLQESVFHPFVQGDQTLSRQYGGTGLGLSICRQLANMMHGTMKLESKVGVGSKFTFTLPLNQTKEISFADMEFPFEDEFNPESRKNRRVKFSVAKSIKSRQSTSSVATPATNRSSLTNDVLPEVRSKGKHETKDVGNPNMGREEKNDNGGLEQLQEKNIKPSICLTGAEVNEQNSLSSKHRSRHEGLGSVNLDRPFLQSTGTATSSRNIPTVKDDDKNETSVKILVVEDNHVNQEVIKRMLNLEGIENIELACDGQEAFDKVKELTSKGENYNMIFMDVQMPKVDGLLSTKMIRRDLGYTSPIVALTAFADDSNIKECLESGMNGFLSKPIKRPKLKTILTEFCAAYQGKKNNK

SEQ ID NO: 6109 - DNA, 3606 bp, Magnaporthe grisea 70-15
  CDS (1)..(3606)
atgaggatcgccatccgcgagcagctcgccctgctcgtcgtgttggccactctggttgcccttgctatcgtctcgatacctgtctggatatatgttcaccaattcataattggcgttcaagaaaatgccctcagcttgactgcgtcactcaaagctgctcgcatagccgccgagatcgacctcctgcagacgacatgctctaccatcgcttcccgggtactggttcagcgtgcgctgttgaacttttacaatgggtcttcgtcgccaagcttgtgggatgaagccaggattgatgttgaaaacgcgctcaacttacctggccagcccgatctcttgcaagctcgcatctactcccggaactcgacggggtcctcgtcaactggtcttatggcgaccacatcgaccatgttccacgacatcaaacttccatacaacaaacccgatggtacttctgcaatgctgggcaacgacagctacggcttcccgcctatgctttaccccaatattacatacacggacacgggcgagccgagtcccatcgctcccgatacgaacatattcttcgccgatgcatttcccggaatacgcctgacgcaggggctgttccttggccctcttgtcatcaatgatacctacgccctggtctcgctcaccgtcgccgtccggggcaacgccgacaagcttattctcggctacatgaccctcgttgcttcggcatcgaatcttatcctcatcaggaactcccccgaggggctcggcaatagtgggctgacgctcttgtttggacctaatgagacgtataataggttcaactataccgaccctccggtgaccaacagcacttacaagatcccagacactttcaaatttgccaagacaaagatacacttcgtactgccacctacgaagccaaacggcacagctgaccgacatcttaagcacagctttgacagcggtaattacaacgaagagtttgagctcgggagttatcctgccgtcttcgaaagtttgacaacgttcaaccgacgggctgtcaataacgccatggcaaacctttggacgactaacgagcaaggggtagacgtgtcggttggtacggcgcggccaaaatcgcagtacgtcgactgggtggttgtggtggagcaagacagggccgaagcgctgcaggctataactactctgcgaaccatcttgcttggttgtgtgtttggcgccgctggcctcatgttcctactcatcttcccttgcgcgcactttagtgtgcgaccgattcgcgatctcaagattgcaacggaaaagtcgataatgcctccaggctatgacgattatcacggcggtacgagtgagaaccccggttctggggtcctttcatcactttcagaaaagggatggctcggagccattattaggaggacgaggcataagctagggattcccgccaggagacagcggcgggaatctgatcaggacgaaagcctgacacagcgtcaagtgttcaagattcctggaaaggttcaggatcgcaaacactacataacagacgagctgacagagctcactaccactttcaacgagatgacggatgaactttacaaacagtactcgtcccttgacgacaaggtcgccgagaggacgagggagcttgagatcagtaaaaaggccgcagaggcggccaacgagagcaagacgctctttatcgcaaacatttcacacgagctcaagacgcctctcaacggcatcatgggcatgtgcgccgtgtgcatggaggagacggacgttacgcgcatcaaacaatccctcaagacgctctacaagtctggcgacttactgctgcacctccttgaggatcttttgagcttttcaaagaaccagatcggacatcagatcagcctggaagagcgagacttccgcttgggcgatattcggcagcagcttttgtcgatctttgacaaacaggttcgcgagagcggcacgcacttcacggtggagtttgtgggtcacgatatactcgacttttaccagtacccaatcagttctgaaaggcaaagcatggaaaagacaagactgcctgctctcgggcctgcgggtgccggcaggttgaaggacatgtgcctgtggggagatcaacacaggattctccaggtgatcatcaacctggtcagcaacagcctgaagttcacaccttcaggaggcaaggtgcaactaaggatacgatgtgtagaagagatcgagcagatcaacgcgaccggcgacaacagtcgctcttcgtcattttcgaagagcggatccgcaaggccaggacgcccacggcaccgggtaggctcgtcgtcagcacaatcggcagcctcaaccaagggcgtctcaacgccaggcacgacaggaactgcgctggccatcaacccgatggaccccaaaactgtaccacacatccaggtacgcgagcggtccctgtcgccgcctccaccaggagccaaggccttcctgttcgagttcgaggttgaggactctggtcctggtataccagagcatatgcaagcccgtgtgtttgagccttttgtacagggcgacttgggacttagcaagaagtatggaggcaccgggctagggctgagcatttgccagcagcttgccacgctgatgggtggaaacattacgctgaggagtactgttggtgttgggtcggtctttacgatgaggataccgctgaaatacgtaaaggacagaccatccagcacagcctctagcagcataaagtctcgcccacagagcttggtctctactgatggtgacaccaccaacgtgcgtgtggtatcacatagcaagtctgctccagacggaaagcacgcttcagtattagacaacaagccgcgcctcgtaggactgagccatccgttcttctcgccaacccaagcgacggcaccaaagctatcgacagaagatcacaaagccaacttgaacgaaaagattgccaaggcagtcgcggcaaaaggcggcaacaagcttcgcgttctcgtcgccgacgacaactcaacaaatgtcgaggtcgtttccaagatgcttcggttagagcacgtctctgacgtcacggtcgcctcggacgggcaggaagccctagaggtggtgaaggctaacatggagaacaacctctacttcgatctcatcttcatggacgtgcagatgcccaacctggacggattacaatccacgcggctgatccggcagatgggctacagcgcacccatcgtggcgctgacagccttcagcgaggagagcaacgtcaaggagtgcatggagagcggaatgaacgagttcttggccaagcctatccgcaggcccgcgttgaagcaggtcttgcggaagtttgccaccattcctgaggagcccgaagatggccggcggacgacaccacctacgagtgccaaaaacgtcgttaccgattcccacgggaccaagtcatcagtacgcactgaggttgccgagacgaaacgcgaagacctgccaaacggcaacggcaatgctgtagtcgggccggataacaacagcagcagcgtcttgatctccaagcctccattacctcctatgaacggtgctgctgtggcgacgtga

SEQ ID NO: 6110 - protein, 1201 aa, Magnaporthe grisea 70-15
MRIAIREQLALLVVLATLVALAIVSIPVWIYVHQFIIGVQENALSLTASLKAARIAAEIDLLQTTCSTIASRVLVQRALLNFYNGSSSPSLWDEARIDVENALNLPGQPDLLQARIYSRNSTGSSSTGLMATTSTMFHDIKLPYNKPDGTSAMLGNDSYGFPPMLYPNITYTDTGEPSPIAPDTNIFFADAFPGIRLTQGLFLGPLVINDTYALVSLTVAVRGNADKLILGYMTLVASASNLILIRNSPEGLGNSGLTLLFGPNETYNRFNYTDPPVTNSTYKIPDTFKFAKTKIHFVLPPTKPNGTADRHLKHSFDSGNYNEEFELGSYPAVFESLTTFNRRAVNNAMANLWTTNEQGVDVSVGTARPKSQYVDWVVVVEQDRAEALQAITTLRTILLGCVFGAAGLMFLLIFPCAHFSVRPIRDLKIATEKSIMPPGYDDYHGGTSENPGSGVLSSLSEKGWLGAIIRRTRHKLGIPARRQRRESDQDESLTQRQVFKIPGKVQDRKHYITDELTELTTTFNEMTDELYKQYSSLDDKVAERTRELEISKKAAEAANESKTLFIANISHELKTPLNGIMGMCAVCMEETDVTRIKQSLKTLYKSGDLLLHLLEDLLSFSKNQIGHQISLEERDFRLGDIRQQLLSIFDKQVRESGTHFTVEFVGHDILDFYQYPISSERQSMEKTRLPALGPAGAGRLKDMCLWGDQHRILQVIINLVSNSLKFTPSGGKVQLRIRCVEEIEQINATGDNSRSSSFSKSGSARPGRPRHRVGSSSAQSAASTKGVSTPGTTGTALAINPMDPKTVPHIQVRERSLSPPPPGAKAFLFEFEVEDSGPGIPEHMQARVFEPFVQGDLGLSKKYGGTGLGLSICQQLATLMGGNITLRSTVGVGSVFTMRIPLKYVKDRPSSTASSSIKSRPQSLVSTDGDTTNVRVVSHSKSAPDGKHASVLDNKPRLVGLSHPFFSPTQATAPKLSTEDHKANLNEKIAKAVAAKGGNKLRVLVADDNSTNVEVVSKMLRLEHVSDVTVASDGQEALEVVKANMENNLYFDLIFMDVQMPNLDGLQSTRLIRQMGYSAPIVALTAFSEESNVKECMESGMNEFLAKPIRRPALKQVLRKFATIPEEPEDGRRTTPPTSAKNVVTDSHGTKSSVRTEVAETKREDLPNGNGNAVVGPDNNSSSVLISKPPLPPMNGAAVAT

SEQ ID NO: 6111 - DNA, 3447 bp, Gibberella zeae PH-1
  CDS (1)..(3447)
atgcgcatcgccattcgtgagcagcttgcggccctcgtccttctcgccgtccttgtctccctcgccatcgtctctatcccaacatggatttatgtcaaccgctttgtcgtcgacatcgagcgcgatggcctgcaactcacagcttctctcaaggcgtcccggatttcggccgagctggaccttattgagaccatcgccatgaccatttcctcacgaattctcgtccagaacgcactcaccaactactacaacactggcaagaatgagtgggaagatgcccacgaggatctcgaaagcgcactttctgtcagcacagcctcgggcttactgcaaataagactattctcgagaaacaacacaaaaactaaaggcggcgttttgctcaatgtgacatctctttcggtgccagagattgaactcccctacaaggattcggaagggtctaatgttcgtcttggtgacactgacctgggttaccccccaagcctgttccctaatcttacatatattgatctcgaacgaccaaacaatgtacggaacaacacaaccgcatatgcagccgaggccttcgacgatgttagaattgctcgcgatgggggtttattgctcggtcctctggttctcaacgagtctgcatctctcctgtccgtgaccattcctgtccgtgacaacaacgacacttttattctgggctatatgagcgttgtcactcttgctcagtccctcactgcgatccaggattcccgtgaaggactgggcgagacaggttcagtcctacttataggcccaacggaccgatccaaccgctttaacaagacacagccagcaagcaatgcgacatacacccctaatcgtgatgaatttggcaatgtcatggtcaaattcatacttcccccaaagagcccagaggggcacaaggatcttcacgatgttcaccagtttgtcagcgaatatggcaacagggcatttccagtaaagaattatccagccgcgttagattcattcaccaaacattacaatacggtcagcaacgccagttccctaataaatacccacaacgaacaaaacgcccgtgtcgctgttggctttgctcgaactcagacccccttagcaaactggacagttatcgtcgagaaagccaaatgggaggcctataagccaataaacactttgaggaatatccttcttggtactgtctttggcactgtggggttgatagcattgattatcgttccctgtgctcacgtcagtgttttgcctattcgaaaactcaaggctgccacggaaaaatcggtcaaccctccaggatatgaagactcgtttatcgactccgactctgattttgatgacgagattccaagctccggaggccaatcacgacgatcgaaaaagaaggggcctatatctaagttcatccgacgactcaagggcaaatccaatggacccagctcgaatcgagatgtggcccgtcggatgttcaagatccctgccaaggtcgatgatcgaaaacactttgtcacggatgagcttactgaactgacccgaacctttaacgacatgagcgacgaattagtgaagcagtatctgtctctcgaagtcaaggttgccgagcgcacgagggaattggaggagagcaaaaaggccgcagaggcagccaacgaaagcaaaacgttgttcatcgccaacatttcccatgagctcaagacccctttgaatggcattcttggcatgtgcgccgtgtgcatggaggagaatgacattgtgaggatcaagcagtcgttgaagacgctctacaaatcgggtgacctactactccatcttttggaggatttgttgagcttttccaagaatcagattggccaacagctcagtctcgagttgagggagtttcgcctggccgatatccgatcacaaatcttgaccatttttgacaaacaggttcgagaaggaaagatcaacttctcagtagatttcattagctccgacaacgccgagttcagtgcaagtccagatcggacgaatggcgagacaagattacctgcactgggcccccacggaactggaaggctcaaggacatgtgcctctggggtgaccagcatcgaatactgcaggtcatcataaacttggtgagcaacagtctgaagtttacgcctcacaatggaactgtttcggtacgtatcaggtgtcttggagaagcagaagcacttgccgagaatgacagtcgggcatcatcaatctccaagaactcacgaaacaattcgcggacaggacgccctcggcaacgtgggagtgctagctcagctaattcaggagcctcgggtcgaaattcggcacagaaattcgtcagcacagggaccgcactctctatcaaccccagggacccgaaggcgacacctcacgtgcaagtccgcgagcggtcgcccacgccgcctccccccggtgccaagtcgtacatctttgagttcgaggttcaagatactggcccgggaattcctgagcacatgcagcaaaaggtgtttgagcctttcgtccaaggagatcttggtttgagtaagaagttcggcggtactggtcttggcttgagtatctgccaccagctggcaggtcttatgggaggttctatcaagttacggagttctgtgggcgtgggtacgaccttcactatgcagattccactgaaatacgtgaaagaccggacttcaagtactgcttcaagcagtatcaaatctcgaccaacaagcgtagatgccggcgatttggaactacagcgcaccgcccccagcactcctaagcctgctgctgaggcaaagtcagcgggtgccctcaaccctcagcctcgattagtcggcttaagccaaccttactttgctgccaaccctccagctgtcaagagtactcagcaaaagatggccgaaattgaccgtgccatggcgaacaagagcggtcaaagagtacgtgttttggtagcagatgacaactcgaccaacatcgaagttgtcagccgtatgctgaaactagaggacgtttatgacgtgaccattgcaaaagacggccaggaagcatacgatctcgtcaaggcgacaatggagaaaaaccagtcttttgacgttatcttcatggatgttcagatgccgaatgttgacggactacaaagtacccgacttattagggagatgggctacaaatctcccattgttgccttaacagccttttccgaagagagcaacgtcaaggaatgcatagactctggtatggatgagtttcttgctaaacctatccgacggccagctctcaagcaagttctcaagaagtttgcgactatccccgaggaaccagagaacgagaagcgctcgtcttcactgaagcccaaagccagagcgaatgggcacgccgttccaccacataaggagggagagaacggcgcaccgaaggagaagcacggatga

SEQ ID NO: 6112 - protein, 1148 aa, Gibberella zeae PH-1
MRIAIREQLAALVLLAVLVSLAIVSIPTWIYVNRFVVDIERDGLQLTASLKASRISAELDLIETIAMTISSRILVQNALTNYYNTGKNEWEDAHEDLESALSVSTASGLLQIRLFSRNNTKTKGGVLLNVTSLSVPEIELPYKDSEGSNVRLGDTDLGYPPSLFPNLTYIDLERPNNVRNNTTAYAAEAFDDVRIARDGGLLLGPLVLNESASLLSVTIPVRDNNDTFILGYMSVVTLAQSLTAIQDSREGLGETGSVLLIGPTDRSNRFNKTQPASNATYTPNRDEFGNVMVKFILPPKSPEGHKDLHDVHQFVSEYGNRAFPVKNYPAALDSFTKHYNTVSNASSLINTHNEQNARVAVGFARTQTPLANWTVIVEKAKWEAYKPINTLRNILLGTVFGTVGLIALIIVPCAHVSVLPIRKLKAATEKSVNPPGYEDSFIDSDSDFDDEIPSSGGQSRRSKKKGPISKFIRRLKGKSNGPSSNRDVARRMFKIPAKVDDRKHFVTDELTELTRTFNDMSDELVKQYLSLEVKVAERTRELEESKKAAEAANESKTLFIANISHELKTPLNGILGMCAVCMEENDIVRIKQSLKTLYKSGDLLLHLLEDLLSFSKNQIGQQLSLELREFRLADIRSQILTIFDKQVREGKINFSVDFISSDNAEFSASPDRTNGETRLPALGPHGTGRLKDMCLWGDQHRILQVIINLVSNSLKFTPHNGTVSVRIRCLGEAEALAENDSRASSISKNSRNNSRTGRPRQRGSASSANSGASGRNSAQKFVSTGTALSINPRDPKATPHVQVRERSPTPPPPGAKSYIFEFEVQDTGPGIPEHMQQKVFEPFVQGDLGLSKKFGGTGLGLSICHQLAGLMGGSIKLRSSVGVGTTFTMQIPLKYVKDRTSSTASSSIKSRPTSVDAGDLELQRTAPSTPKPAAEAKSAGALNPQPRLVGLSQPYFAANPPAVKSTQQKMAEIDRAMANKSGQRVRVLVADDNSTNIEVVSRMLKLEDVYDVTIAKDGQEAYDLVKATMEKNQSFDVIFMDVQMPNVDGLQSTRLIREMGYKSPIVALTAFSEESNVKECIDSGMDEFLAKPIRRPALKQVLKKFATIPEEPENEKRSSSLKPKARANGHAVPPHKEGENGAPKEKHG

SEQ ID NO: 6113 - DNA, 3510 bp, Candida glabrata CBS 138
  CDS (1)..(3510)
atggattccacagaatcagctccgcgaaggaggcgttttctgaaaccgccgtttcgcattgggataagagcacagctgaccgcactggtcagtatagtggcgtgcttgtcgctgattatcttagcagtcacaactggtgtctatttcacctcaaattacaagaatctaagatctgatagactatatatagcagcgcagttgaagtcctctcaactggatcaaaatttgaattatctctattatcagtgctactggctagcctctagagatactttgcaaaacgcgctcgcgagctatgtcgcaggtaataagactgaagagaactgggaagaatctactaatgtgatacagaagtttttgagttcatcaaacttattcttcttgagtcgtgtctatgactatgatttcaaacctgtcctgaacacaaccaataacggtacaggtgatgaagtacctgagtcgattcagaatcagttatttccactttcaaccgatgtaccattgccatcctctcttatgacaaatggtatgctaacagatccggtgttaaatggcaccgattacttaatgtcaatgtcactgccgatctttgcaaacccttctattatattctcagatttaaaggtatatgggtatatcactgttgttatgtcagcagaaggtctccgatcagttttcaatgatacaactgcattagagaagtctaatgtcgctatcgtctctgcacgatactctaattacacaaagatcgattcctatagattcgtgtttcccccttatggtgtaagtcccagtatattaaatcgaacgttcgagctggatgacagttccttcttaaacggtgctttcaagcaagcgaaaggtggatccatcaagaaaactaaatttttctatacaaaagacgttgcaatcggctactatccttgctcttttaactttgttaattgggtagctgttgtttcccaagccgaatctgtctttttatctccttcaactaagctgaccaaaatcataagtggtacagtagttggtattgctgtatttgtctcattattgacattcccattggctagctgggcagtgaaaccaattgtgcggttgcaaaaggctacagagttgattgccgaaggcagaggcctgcgaccggcaggtgctggtagtggtagcagatcaggcagtcgcacaagctcgatgaagaaggatattaatgatctcaattttattagtcgactgtctttaagtgaaaagaatcatcgaccggcttatgattctgctagcgacagcaattatgccacagacggttctctttctcatgatttacaaacttcacaggcctctaatagacccagtgataacgaccgatcttcaagtagatcaaggtttttaactacttctacaaatcttaatgaagctaggctacctgattacagaaggctattttcagatgagttatctgatttgaccaatactttcaatgcaatgacagatgctctcgaccaacactacgccctattagaggatagagtgagagcaagaacaaaacagttagaagctgctaaaattcaagccgaagccgcaaatgaagctaaaactgttttcattgccaatatatctcatgagttaagaacaccactaaatggtattttaggtatgactgcgatttctatggaagagacagatattgcaaagattagaaatagtttgaaattaattttcagatcaggtgaactactgttgcatattcttaccgaacttcttacattttccaagaatgtcctgaagagaactgcactagagaagcgtaacttctgtataacagatgttgctctccagattaaatctatttttggtaaagtagcgaaagatcaacatgtcagattgtctatttcattaacaccaaatgttataagaaccatggtattatggggtgactcaaatagaattattcaaattgttatgaatttggtgtcaaatgccttaaaattcactcctgttgacggcaaagtaaatgttagaataaagttattaggtgagtatgacgaggaagcaactaaagccgacaattttaaacaaatacataccatagcagactcggatgcccatcaacaacatcctgttagttcgtcaccaaacggagtcttggtaaagcatttgtctactagttccgactctaactccaacttgagtgacagcgataagtacaatgagaaaacctatgacgaagatgacgatgaacatagcattactaacatctcagaccattcagacgatctgtcatcactagtttcatcaagcacaagctcttatgataatgcattgttcaatactcaattcaagaaaactcctgatctgtacgaagacagtaatgatggtttaggaactgaactggctgatcagaaaacttgggtttttgctattgaggttgaggatacaggtccaggtattgatcctaaattacatgagtctgtgttcgaaccttttgttcaaggtgaccaaactttgtccagacaatatggtggtacaggtttagggttatcgatctgtaggcaattggcaacaatgatgcacggcaccatgaagctggagtctaaagtaggagtaggaagtaagtttacatttactgtacctttgaagcagacaagagttataaagtttgatgaagaagaagatctatttgaagatgagttcaatcctgaaagtaagaaaaatagaagagttaagtttaaagactctacacgtagtttgcacagtcgtagatctagaactagtgtggacagaataacaaaccactctggagataaacagagtagtgaaggacattcaacttcattcaagattagtgaggttaaagatgaagatattgaacaatcaccagagcctgacaacttacctaaggttggtgacgaaaacgattctaaagcaagctcttcctcttctaagtctgacaatataaaggagaaagaagaaaaagttcatttggatagaccattcctgcaaagtactggtacagcaacatcaagcagaaacgtccctacaatggcagatgtgactatgcgcttcaaaattttagttgcggaagataaccatgtcaatcaagaggtcattaagcgtatgctaaacctagaaggaattaataatattgatttagcatgtgatggtcaagatgcattcgataaagtccaaagcttagtcgagcagaatgacagttacgatatgatcttcatggatattcagatgccaaaagttgatggtttattatctactaagatgattcgcagagatttaaactacaaaggttcgattgttgctttaactgcatttgccgatgacagcaatatcaaagagtgcatagaggcagggatgaacgggtttctatcaaagcctattaagagacctaaattaaagatgatcttggaggagtattgtccaaattggatagaaatgaagaaaagcaaagaaaacaaagacggggacaaaaaagttgaagaaaataaacccaaaaaagaatga

SEQ ID NO: 6114 - protein, 1169 aa, Candida glabrata CBS 138
MDSTESAPRRRRFLKPPFRIGIRAQLTALVSIVACLSLIILAVTTGVYFTSNYKNLRSDRLYIAAQLKSSQLDQNLNYLYYQCYWLASRDTLQNALASYVAGNKTEENWEESTNVIQKFLSSSNLFFLSRVYDYDFKPVLNTTNNGTGDEVPESIQNQLFPLSTDVPLPSSLMTNGMLTDPVLNGTDYLMSMSLPIFANPSIIFSDLKVYGYITVVMSAEGLRSVFNDTTALEKSNVAIVSARYSNYTKIDSYRFVFPPYGVSPSILNRTFELDDSSFLNGAFKQAKGGSIKKTKFFYTKDVAIGYYPCSFNFVNWVAVVSQAESVFLSPSTKLTKIISGTVVGIAVFVSLLTFPLASWAVKPIVRLQKATELIAEGRGLRPAGAGSGSRSGSRTSSMKKDINDLNFISRLSLSEKNHRPAYDSASDSNYATDGSLSHDLQTSQASNRPSDNDRSSSRSRFLTTSTNLNEARLPDYRRLFSDELSDLTNTFNAMTDALDQHYALLEDRVRARTKQLEAAKIQAEAANEAKTVFIANISHELRTPLNGILGMTAISMEETDIAKIRNSLKLIFRSGELLLHILTELLTFSKNVLKRTALEKRNFCITDVALQIKSIFGKVAKDQHVRLSISLTPNVIRTMVLWGDSNRIIQIVMNLVSNALKFTPVDGKVNVRIKLLGEYDEEATKADNFKQIHTIADSDAHQQHPVSSSPNGVLVKHLSTSSDSNSNLSDSDKYNEKTYDEDDDEHSITNISDHSDDLSSLVSSSTSSYDNALFNTQFKKTPDLYEDSNDGLGTELADQKTWVFAIEVEDTGPGIDPKLHESVFEPFVQGDQTLSRQYGGTGLGLSICRQLATMMHGTMKLESKVGVGSKFTFTVPLKQTRVIKFDEEEDLFEDEFNPESKKNRRVKFKDSTRSLHSRRSRTSVDRITNHSGDKQSSEGHSTSFKISEVKDEDIEQSPEPDNLPKVGDENDSKASSSSSKSDNIKEKEEKVHLDRPFLQSTGTATSSRNVPTMADVTMRFKILVAEDNHVNQEVIKRMLNLEGINNIDLACDGQDAFDKVQSLVEQNDSYDMIFMDIQMPKVDGLLSTKMIRRDLNYKGSIVALTAFADDSNIKECIEAGMNGFLSKPIKRPKLKMILEEYCPNWIEMKKSKENKDGDKKVEENKPKKE

SEQ ID NO: 6115 - DNA, 3468 bp, Kluyveromyces lactis NRRL Y-1140
  CDS (1)..(3468)
atgttggcaggcttaaagagacgttgcagtcttaaagctcttcgggaacggtttacaccgccgtttaatgttggtttacgaacccaacttattattctcgtgtgctctatttgcgttttatcgttaacaatcattacggttactactggggtttatttcacaacgaactacaaatccgtacgagctgaaagattacaggttgcagcacaattaaaatcatcacaagttgatcagaacttgaattatttatactatcaaatatattggttgtctacaagagacacattacaagatgcgttagtcaattttagagctggtaattcatctagagataattggaattctgcagaagacagtttagaaaagtttcttggttcttcaggtttgttcagtgctgctagagtttatgatacgtctttcaacaccgtaataaactccaccaataatgggtctggtgacaacattccggaaaacgttttagcagagctctttcctctatctggcgtagagcctttgtcttcttcgctactaactacgggtatcgttacagatccggtatataactggacaaattacttgttgtccatgtcattgccagtttcaacaaatccatctattattctgaatactaacgaaattgccggctatattactgtcattgcatcggcggaaagtttaaaggctgttgtaaatgatacaattgctttagataagtcatccgtatcaatcctatctgctgttttcgatagtaatagttcactgactggttatcatttcgttttccctccgcatggaacctcatcattcagttcaaaagtgacttttccaattaagaacggcacgtttatagctgatgcattcgaaaatgggaaagttggttcagttatgaaaacaaatatggttcaggagagaaacatagcagtagggtattcaccaccaacttttaaacttgtaaattgggtggccgttgttacccaacctgaacaagtattcttgtctcccactatacggcttatgaaaatcattgctggtacggtgtgcgctattgccgtatttatgtgcttattgactttccctatagcacactgggctgtgcaacctatagtcagacttcagaaggctactgaaatcattacatctgggagagacttaaagcactatagcaacactggcaattcagattcaaatactgcaattacacattctaggactcgtagcacatctaaccaaaaccaggtgatgaagctgttcaacaaatctgtcaccaaaggtacgcccagtaattatctgaatcacaattataatgttttccctccaagtagaacagattcaccaagcgtttccgcaagaaactcacagactatacccagaggccccggagacctgacacgttcagctactactggatctaccccattttctaatgattcttcttcatatacctccgaacgatatatcaaatcaaccaacctagtggaagcatatgtcccagtatacagaagattttttcaagatgaactatcagaactcacagatacatttaacacaatgacagatgagctagatagacactatgctcttttagaagaaagagttcgtgctagaacaaaacaattagaagcggctaagattcaggccgagtctgcaaatgaagcaaaaacagttttcattgccaacatttctcatgaattgaggactccactaaacggtatccttggtatgactgcaattgccatggcagaaactgatatgcaaaaagtgcagaacagtttgaagttgattttcagatcaggtgaattgttgttgcatattctaacagaacttttgactttctctaagaatgtcttaaagagaacaaaattggaggaacgtgacttctccgttatggatattgctttgcagattaaatccatctttggcaaactagcaaaagatcagcatgttaaattgtccattgcccttacaccaaatttcattagaactttggtattatggggtgattcaaatagaatcattcaaattgttatgaatctagtctcaaatgctctaaaattcacaccagttgatggtaaagttgatgttaggatcaaattgcttggcgaatacgactcaaaaaggagtgaaagtgtcgattatcaagaggtatttgtggtccctggttctgaagcaaatgatgattttgagttcaatttaacttcaactactcccatgaggcttcctttcaattcttctagtggcagcgttaatactgctactaaagatggatcaacttccccaacaactaagacaaaagaaggctcaattcaagtcgaatccgaaacgtcaacggagggcaatgacaacgatgaaagtagcattgttcttgaaagtaagcacgaagaaaacgaagacgaaaaagaaaagatgtcaatattatctacaagtacttcaagctcttacgatgatgcaattttccattcgcagttcaagaaagttctgtcttcaacggattcagatacggaagagaatacgttcagagatcttaaggtaccaaagacttgggttataagtatggaagtggaagatactggctcgggtattgatccttcacttcaagaatctgtttttgaaccgtttgttcaaggtgatcagacgctctctagacaatacggtggaactggcttgggcttatccatttgtaggcagttggcaaagatgatgaaaggtacaatgaagttggattcgaaagttggtgttggaagtaaatttattttcactgtgccactacagcaaacaaaagagatagtattcgatggtgctgaaaaacagtttgaagatgagttcaatattcacagcaggaagaacagaaaggttaaatttaaaatcaattcctctaggaaatctgttcaaacaaagaaatctaaatctagtatcgacggacatagcgataacaatgtcagtgagagaaaagccagtaattctactgaaaatagcgttgggaatgttcgtgttgatagaccatttttacaaagtacgggtacggcgaccagtactaggagtatatcatctgtagcaagtgaagttactcggcatagagttttggttgctgaagataataatgtcaatcaggaagttataaaaagaatgcttcagttagaaggactcacagatcttgatatggcatgtgacggacaagaagcttatgagaaagttgaagaaatcttaaagaatggcgaatcctactccatgatattcatggatgttcaaatgccgagggtggatgggttgttggctaccaaaatgatccggaatgatctattatataaagggcccattgttgcgttaaccgcatacgcagatgatagcaatattaaagtttgtctagaaagtggaatggatggtttcctaccaaaacccattaaaagaccattgttaaagaaaataatcgcacagtactgttcgaaaaaagagaaacagagagaagaatag

SEQ ID NO: 6116 - protein, 1155 aa, Kluyveromyces lactis NRRL Y-1140
MLAGLKRRCSLKALRERFTPPFNVGLRTQLIILVCSICVLSLTIITVTTGVYFTTNYKSVRAERLQVAAQLKSSQVDQNLNYLYYQIYWLSTRDTLQDALVNFRAGNSSRDNWNSAEDSLEKFLGSSGLFSAARVYDTSFNTVINSTNNGSGDNIPENVLAELFPLSGVEPLSSSLLTTGIVTDPVYNWTNYLLSMSLPVSTNPSIILNTNEIAGYITVIASAESLKAVVNDTIALDKSSVSILSAVFDSNSSLTGYHFVFPPHGTSSFSSKVTFPIKNGTFIADAFENGKVGSVMKTNMVQERNIAVGYSPPTFKLVNWVAVVTQPEQVFLSPTIRLMKIIAGTVCAIAVFMCLLTFPIAHWAVQPIVRLQKATEIITSGRDLKHYSNTGNSDSNTAITHSRTRSTSNQNQVMKLFNKSVTKGTPSNYLNHNYNVFPPSRTDSPSVSARNSQTIPRGPGDLTRSATTGSTPFSNDSSSYTSERYIKSTNLVEAYVPVYRRFFQDELSELTDTFNTMTDELDRHYALLEERVRARTKQLEAAKIQAESANEAKTVFIANISHELRTPLNGILGMTAIAMAETDMQKVQNSLKLIFRSGELLLHILTELLTFSKNVLKRTKLEERDFSVMDIALQIKSIFGKLAKDQHVKLSIALTPNFIRTLVLWGDSNRIIQIVMNLVSNALKFTPVDGKVDVRIKLLGEYDSKRSESVDYQEVFVVPGSEANDDFEFNLTSTTPMRLPFNSSSGSVNTATKDGSTSPTTKTKEGSIQVESETSTEGNDNDESSIVLESKHEENEDEKEKMSILSTSTSSSYDDAIFHSQFKKVLSSTDSDTEENTFRDLKVPKTWVISMEVEDTGSGIDPSLQESVFEPFVQGDQTLSRQYGGTGLGLSICRQLAKMMKGTMKLDSKVGVGSKFIFTVPLQQTKEIVFDGAEKQFEDEFNIHSRKNRKVKFKINSSRKSVQTKKSKSSIDGHSDNNVSERKASNSTENSVGNVRVDRPFLQSTGTATSTRSISSVASEVTRHRVLVAEDNNVNQEVIKRMLQLEGLTDLDMACDGQEAYEKVEEILKNGESYSMIFMDVQMPRVDGLLATKMIRNDLLYKGPIVALTAYADDSNIKVCLESGMDGFLPKPIKRPLLKKIIAQYCSKKEKQREE

SEQ ID NO: 6117 - DNA, 3390 bp, Yarrowia lipolytica CLIB122
  CDS (1)..(3390)
atgtctccaagtaacacacatcacagcaatatccctctcagaaacacctggtgtaaaattcctttttcaaaattgcatcgtcttcctgtgccgatacaaattccactccttgttttcttatcatgtggccacgtcgctccacagcgttcacacatccatctcatctctcatccgcttgtcggaggtaggcaaactctattaccagcatgcattcacccttttttactgctgtcaaaaacagcctacaagtacaccaaaccgcacacgttcaaccgcctgttcatctctgcaggtttcgcgaagatgaagttccgcatttcgctgaaatggcagctgtcctttgcggtgtcgttcacggccttctgctgcctaggtctgttgagtatcatcacgtacttcaacaaccagggcacagttttggacctgcgacgaaaccgactgacggtcattgcccagctgaaaagctcacagatcagttactacttgaaatcgctccagacagggacggtgtctctggggtcacgtgagttcctacagacgctactgatggactcgtataacggagcaagcatcaacatcacggcccaggtggatccgtttgtgacggctctggagagctccgacgggctcggaggcgtggtttacgactacgagttcaaccagattgctgccgtgctgttggatgaccccgtcacacagaacgtaaccgagtggcccatgagtatgcttcctgtgactctttcgccgttccaaaagcagattctccgcacaaactcgtggatgttgcaggggccagaaatcataaacagcagaaacgactttgtgttcaccatgacaacagctgtcggcaaaaacgggtttgagttcccacaggtcaacggctccattgtgggatatattacggtactagtcaaggccaacggactcatgagcattctcaacatgaatgacgccgttactgaggcgtcgaaatccgacctgtcacttatctctctcaccgacgacacctcggaagcaatctacaaacaattttcgctcaagaacgacacttttatggactctataggtagagagggtatccgttcgccactcatcgacgacatgaaatacacctacgcgctgccaacaaactcgtgcatgacctgctacacgtacgagttccctctcaatgcaaacgagggtgcatatgaagcctacctggggtactacttcaacgacaatgtaccctatgggtccatattgaacgttcagtatgcgcgcacaaatgtggcagtgggatacgccaaggttacgaccaactcagcaaacacgtatcctcgatgggccgttatcgctgctcaaagtcactccgatgtctacaagccattgtatacactgcggaacattctgctgatttccgtcttctcactaggagctggagtgtgtcttgtgacgttggtgttggcgtcgtgggctgtgggacccattctgaggcttcaggcagccactgatcggtctacaggccgagcacacaaactggcctggtggcggaacttgagttggaaaaagaacggaggaaagggaggaaagggaggaaagggaggtgatgatggcaaaaagccagcgacaaagacgtccataaacacgctggatacggttcattcggaaaagggtgctcgatcagatggggtacctgaaagcacgtcttcggaggatactcgtatcgacagccagaccaagggcgctaccacggccttccaccgacgacacgagtctcaagagcttagaaaaattgtttccaaccccaacatggagttcaaggtgcctgccaaggtggaaaaccgaaagcggtttgtgattgacgagctgtccgagttgacggacacgttcaacattatggccgaggagctgcgcaagcagtacgacacattggaccaacaggtcaagcagcgaaccaaggaaattgagagtgccaaggagctggccgagacggccaacgaggcaaagacgctgtttattgcaaacattacacacgagctacagactcctctgaacgccattctaggtctaactgctgtgtgtatgggtgagaaggatgtcgtcaaggtgaagagaaacctcaaagtcatttaccagagtggagagctgctattgcatcttttgactgatctgttgacgttcagtaagaaccagctgggcaagttgacgctctacgaagtcgatttcaccgtctccgaggtggtcatgcagctggagagtattttccagcagccctgccaggatctgaacatcagtttcagtattgcgtcgtctgaccatgccctggttcttcatggagatatgaaccgaatgttgcaagttgccatcaacctcatttcgtcgtctttgaagtctctgacaggaggtgactcggttgaagttgttgttaaggtcgatattgaaaagctgacatctggtctagctaataagcatcattcgttggtcacatcatctacccgtggccgaggcaattccttgacgttggctactacccagaactctccctgcggctcctttacttcaaccactaaccgagagtcagtgagttcaatctccggtactggcttcctgtctctggttgtcaacactacacacacggagcacgatctcaacgaaggcaaggacatttccaacgcaattcaaaactccggaaccgagcttggcttatccatttgtcgtcagcttgcggagttgatggacggagaagttcatcttgagaaccccttctggttccgattgcctgtcaagattggcgatcgaagcaactccggaattgaggaggtgatccagcccaaggccaagaagaagaacaacgtcagcagtggtctagtgatccaagcacctgctgccaacacatgtgtggagtcagctaccagtcctcctgtgcctgccacccccactgtggctcatcctactccttctccagtgcctatacacccgcccttgcgtccctcactgagcaaggtcactgccgccacatgtaaggtgcttattgtggaggacaaccacgtgaacaaggaggtgatgacacgaatgctcaatctggagggtattcgagacgtgtctgttgctgtggacggtctcaaggcggttgaagccgtggaggccattcttgctcagggccagatgtttgacgttatcttcatggacgttcagatgcctgtgatggatggaagagaggccactcggatcattcgaacaaagttgggttatacaaaccccattattgccgtgtctgcgtatgctgatcagtccaacatcaacgactgtcttgccactggtatggagaccttcctggccaagcctctcaagcggcctcagttgagagaggttttgattaacttgggtattcaagtgaaggagagaaagtag

SEQ ID NO: 6118 - protein, 1129 aa, Yarrowia lipolytica CLIB122
MSPSNTHHSNIPLRNTWCKIPFSKLHRLPVPIQIPLLVFLSCGHVAPQRSHIHLISHPLVGGRQTLLPACIHPFLLLSKTAYKYTKPHTFNRLFISAGFAKMKFRISLKWQLSFAVSFTAFCCLGLLSIITYFNNQGTVLDLRRNRLTVIAQLKSSQISYYLKSLQTGTVSLGSREFLQTLLMDSYNGASINITAQVDPFVTALESSDGLGGVVYDYEFNQIAAVLLDDPVTQNVTEWPMSMLPVTLSPFQKQILRTNSWMLQGPEIINSRNDFVFTMTTAVGKNGFEFPQVNGSIVGYITVLVKANGLMSILNMNDAVTEASKSDLSLISLTDDTSEAIYKQFSLKNDTFMDSIGREGIRSPLIDDMKYTYALPTNSCMTCYTYEFPLNANEGAYEAYLGYYFNDNVPYGSILNVQYARTNVAVGYAKVTTNSANTYPRWAVIAAQSHSDVYKPLYTLRNILLISVFSLGAGVCLVTLVLASWAVGPILRLQAATDRSTGRAHKLAWWRNLSWKKNGGKGGKGGKGGDDGKKPATKTSINTLDTVHSEKGARSDGVPESTSSEDTRIDSQTKGATTAFHRRHESQELRKIVSNPNMEFKVPAKVENRKRFVIDELSELTDTFNIMAEELRKQYDTLDQQVKQRTKEIESAKELAETANEAKTLFIANITHELQTPLNAILGLTAVCMGEKDVVKVKRNLKVIYQSGELLLHLLTDLLTFSKNQLGKLTLYEVDFTVSEVVMQLESIFQQPCQDLNISFSIASSDHALVLHGDMNRMLQVAINLISSSLKSLTGGDSVEVVVKVDIEKLTSGLANKHHSLVTSSTRGRGNSLTLATTQNSPCGSFTSTTNRESVSSISGTGFLSLVVNTTHTEHDLNEGKDISNAIQNSGTELGLSICRQLAELMDGEVHLENPFWFRLPVKIGDRSNSGIEEVIQPKAKKKNNVSSGLVIQAPAANTCVESATSPPVPATPTVAHPTPSPVPIHPPLRPSLSKVTAATCKVLIVEDNHVNKEVMTRMLNLEGIRDVSVAVDGLKAVEAVEAILAQGQMFDVIFMDVQMPVMDGREATRIIRTKLGYTNPIIAVSAYADQSNINDCLATGMETFLAKPLKRPQLREVLINLGIQVKERK

SEQ ID NO: 6119 - DNA, 3690 bp, Yarrowia lipolytica CLIB122
  CDS (1)..(3690)
atgcgacaaataaaaatcgggatccgcacgcagatgatcgtgctggtcatcgtcgtcatcacgctgtctctgttgattctcgccatcgtcaccggcgtcaagtacaccaacagcgtgctggagttgcggcaagaacgaatcaaaatcgtaagcatgctcaaggccgcgcagctcgtgcagtccgtcatggccatctattaccaggtgcaagctctggccaaccgcgacgagctgcaggtggctatggcacgggccaaggccggaaacaacacggacgcaaactgggctgcaactcgaacgctgatgcagtcgtcactggactcatcgtccaccttcttccagctagaaatctacgaccgcagcctgagcacggtgctcgacatgggcggccaggtgcaatacgacctgccaggagccagactcgtgtctggagacagcttctactccggagcagcgcccaacctgtcggagtttgccgacatctttccgctgagaggagccacacaagtgccgcagtcgctggtcgaacacggggcgctcataggcggcccacggcacttttcccgctaccccagtaacatgaaccccgtcatgtccttcaccgtgcccatctacgtcaacatgtccgtgctggtcgaccagcggtcactagcgggctacctgacggtatcgtgctcggctaacacggtcatggacgtgtccaaaagcgactccgcatcaccagtggaaaaggagggaacggtggttctggtggaggctgtcacgccccaggacattaaccgaacaggcatggtcctcgtgactcagccgccaaagagagaggacatggacagagccaagaagaagagacagctagataagagacaactcacggtggtggcctcagagcaggaaaaagccagccaggatggaggagaggaggagctggaagacggaggagcacgccatccactgaccccttcgccgttggactccgcagacggaatcattgcaggcaacacaaacaagtctaatccccagacaaactactttcgctacattgtggcgccctatctcaccactggtcaaactgaccaaaaggcttattctgatgagctgtaccccccggctcagaaagccttttcgacaacacttcccaacaatctgatgaccaaaaacatgattggcgaaaagatttcggccggatatgctcccgttgacttgttgtttgcctcctgggctgtcattgttgaagagccccaaaaggacgtgtatgcgtctatcaaccggttgaagaacattgtgattggtgctgccattggactggcgtttctcacggtcattatcacctttcccatcgctgcatatgtcgttcgccccatcattcggctccaaaaggccaccgaacacaccgcatacaagtacaggacgattgagaaggacgacggcgcatctcccaatccgcccgacaactcgccagtgacgtcgtccactgatgttggctctgggctctttgatttggagaacccggccaatcagagtgttccgaggcgcaagacgtggtggaaacacacccgttctatcggtatgaagattctgcggacactcggaatgactcgattcacagccgaggccctcgatctcgatggccacgaggggtacattgagatccaccctgtagtcattgaggacgagctcaccgagctgacgcagaccttcaacaccatgaccgaggagctgcacaagcagtattcgattatggagcagcgggtggctcagcgtaccctcgagctcgaggctgcccgtgtgcaggccgagagtgccaacgaggcgaagacgctgttcattgccaacattacgcatgaactgcgaacccccctcaacggtatcctgggtatgacatccgtttcattgtctgaaaaggatgccaagaagattggcaagagcttgaaggtgattttcaagtcgggagagttgctgcttcatctcttgaccgatctgctcacgttttccaagtcgcaagtcggcagaatggttctggatgagcgggagtttgtgttccatgagattctgtcgcagatttctgccattttcgtcaaacaggcacgtgaccacggtgtgcgacttaccgtgaccgtggagcctcccgaggtctccaactacgtcttcctgggcgattccaaccgtatgctgcaggtcatgatcaacctgatttccaactcgctaaaattcacgcctgttggaggtcaggtggagctccgaatcaagagctacggcgagtttgaccccggggcaactgccaacactggcaacgaacgtctcgttgtcaaggaggaactaccacctcaggacaagatggtgctggatctcaattccggagagatgttcaccgagtcgccgattagctacttccgtatgtctaacaacgactccaccagcaagagcgagccacatactcctctcgccaccgtcgacgaggtgcacaccgtgttccccacctcggccaactccgtggccacgcccttggtggtttatactccccagagcagcaccacgccctcagaggaccgccccgggtgctctcaatcgggctcttcgggcggtcttagggctgcccccaagggccagtccgtgcggttcgagcagccgcacacgctggtgatggagtttgaggtcgaagacaacggtcctggaattgccgagcatctccaggaacgagtgtttgagctctttgtgcagggcgagcaggctctgagtcgaactcatggcggtacgggcctcggactatccatctgcaagcagctgacggcaatgatgggcggtcacatgacgctcaagtccaaggtgggcgaaggctcgacctttacggtgcaaattccgctcaagcagacgggcgtgattggcaaggaggacgcatactcgtcttctagcggcggaggaggttctggtggcggttcgggctccggctcgtccggtcagagtcctctgggtgtgatccattcagacaagccgcgctactcgccttctgcgttcacgtacggcggtaccgccatgcgacgagcggagttggtgagtttctcgtccgacgatgacgacgacgacgacgatgacgaggagggaggagaagtgggagtgtcgcggacggtttcgtacgaggctgcccaggaggtgccgtctgtggctgtggtgggaccttctcctgccgccacaaccgttcctcctctgtcgacccctcagaaactccctccaaagtccgagtcatcctactttgctcttcctgtcgaggagcgggcgcggattctcgtggcggaggacaatatcgtcaaccagcaggtcattcggcgaatgctcaagctggaagacattccacacattgttcttgccaacgacggagagcaggccgtggccaaggtgcgcgaggcgatggagcaggccaagccgttcgacctggtgttcatggacgttcagatgcccaagatggacggtattgctgctacacggttcattcgaaacgagctaggatacacgcatccgattgtggctctgacggcgtttaacgacgacgagaacgccaagtcgtgcaaggaggctggcatgtcgggtttcttgtccaagcccatccggcggtcggctctacatgagacgttggtcaagttttgtccgaccaaggcgtttgtggagcctgctcggacgcccaatagggatatttaa

SEQ ID NO: 6120 - protein, 1229 aa, Yarrowia lipolytica CLIB122
MRQIKIGIRTQMIVLVIVVITLSLLILAIVTGVKYTNSVLELRQERIKIVSMLKAAQLVQSVMAIYYQVQALANRDELQVAMARAKAGNNTDANWAATRTLMQSSLDSSSTFFQLEIYDRSLSTVLDMGGQVQYDLPGARLVSGDSFYSGAAPNLSEFADIFPLRGATQVPQSLVEHGALIGGPRHFSRYPSNMNPVMSFTVPIYVNMSVLVDQRSLAGYLTVSCSANTVMDVSKSDSASPVEKEGTVVLVEAVTPQDINRTGMVLVTQPPKREDMDRAKKKRQLDKRQLTVVASEQEKASQDGGEEELEDGGARHPLTPSPLDSADGIIAGNTNKSNPQTNYFRYIVAPYLTTGQTDQKAYSDELYPPAQKAFSTTLPNNLMTKNMIGEKISAGYAPVDLLFASWAVIVEEPQKDVYASINRLKNIVIGAAIGLAFLTVIITFPIAAYVVRPIIRLQKATEHTAYKYRTIEKDDGASPNPPDNSPVTSSTDVGSGLFDLENPANQSVPRRKTWWKHTRSIGMKILRTLGMTRFTAEALDLDGHEGYIEIHPVVIEDELTELTQTFNTMTEELHKQYSIMEQRVAQRTLELEAARVQAESANEAKTLFIANITHELRTPLNGILGMTSVSLSEKDAKKIGKSLKVIFKSGELLLHLLTDLLTFSKSQVGRMVLDEREFVFHEILSQISAIFVKQARDHGVRLTVTVEPPEVSNYVFLGDSNRMLQVMINLISNSLKFTPVGGQVELRIKSYGEFDPGATANTGNERLVVKEELPPQDKMVLDLNSGEMFTESPISYFRMSNNDSTSKSEPHTPLATVDEVHTVFPTSANSVATPLVVYTPQSSTTPSEDRPGCSQSGSSGGLRAAPKGQSVRFEQPHTLVMEFEVEDNGPGIAEHLQERVFELFVQGEQALSRTHGGTGLGLSICKQLTAMMGGHMTLKSKVGEGSTFTVQIPLKQTGVIGKEDAYSSSSGGGGSGGGSGSGSSGQSPLGVIHSDKPRYSPSAFTYGGTAMRRAELVSFSSDDDDDDDDDEEGGEVGVSRTVSYEAAQEVPSVAVVGPSPAATTVPPLSTPQKLPPKSESSYFALPVEERARILVAEDNIVNQQVIRRMLKLEDIPHIVLANDGEQAVAKVREAMEQAKPFDLVFMDVQMPKMDGIAATRFIRNELGYTHPIVALTAFNDDENAKSCKEAGMSGFLSKPIRRSALHETLVKFCPTKAFVEPARTPNRDI

SEQ ID NO: 6121 - DNA, 3243 bp, Aspergillus nidulans FGSC A4
  CDS (1)..(3243)
atgcgcgttcctattgccgtgcagttggggctgctggtcctcttgacggcccttgctggtctggcggctctagccatcgcaacatggattaacaactacaacttcgtcgtcgacgtcaagtctcaaagccttcaactcgtcgctagcatcaagtctagtcagatcaccagcaatttggatctactcgaaacgacgtccaagacaatcatcactcgcattctcatacaatccgccttacagcgctattatgctggtaatacaaccgaggaaaatttcgcctcgtcgatcaccgacgtgcaatcagccctaggtagtcgcgggtatctcagcctctaccaagccagcatctatgcgagaaatgtcgagaacggagaatcaaaagcaaggcgattactcaacgtgaccagcgacgaggttcctgaaatcaggcttccctatgatcatccgaatggcacagcggtgatgcttggggatgaaggattgggatatccaccctcactctatccgaatctgacagaagatgcgaccacgaacaagttatacgcttttgatggtgtgccgataaccacgaaccagccgttacttctgggaccgctcgccacgaacgattctttctcgctgatttccttgtcgctgccgattatcaacaatacttcagctgcggatattctgggctatattactgtcgttgcgagcgccgcgaatctgcaggatgcgatgagctctcggcaagggcttggaagctccggtcaagtcctcctgcttgccccttctagaccggaaaatcgtttccctaccggctcccggcctgccacggcaacctcagaaccacagattgctggcttggacaaccaggaagtacggtacgtgttcaggccgactccgttgccagggaacaagagacggcacagtcccgctgtcgcttccggagcatctttccctttgcgcgattatcctatcgcgctcaaggtcttgaaccagccgtacgattcaatcaaccactcaatcaccgatctttcgtcaaagaatgagaatggcacccgtgtcgcggtcggtgcaattcagcagcgatccgacttggtggaatgggtgctaatcatcgaagagacccacggagaggcgtttgccccggtttcccgtcttcgaaaaatcattttggcttgcgtatttggcactgctggcgttattgctctgctcatcccgccgctcgcccatctttcagtagcgcctattcggagactccgcgaggcgactcgaaagtccgttaatcccacaattgggcccttaagtccgtcgttgtcaaccatggttgaccccattgaaatatcaatgcataatggcaacgaaaagagcgagaaaggcggattcttcaaccggctcaaacgaggcagaggcaatttagcaaccggtcatgatcgcgacaacgaaccgcatcagttccaaatccccggccgtgtcaaggagcgtaagcatatcattacggatgaactaaccgacctgacgaagacatttaacgaaatgtccgatgaactcgtgatccagtacaatcgtcttgaggagcgggtggcagagcgaacccgtgagcttgaaaaggccaaaatagcggcagagacagcgaatgagagtaaaactctctttatcgccaatatatctcatgagctcaaaacgccgctgaatgggattcttggtatgtgtgcggtctgcatgggtgaggacgatcttccgcggatcaaaaggtcgcttcagactgtatacaagtcgggcgatttgctgttgcatctattgaatgacctgctcacctttagccggaaccaaattgatcaggccattaggcttgaagaaaaagagttcaagctctcggatatccggtcgcagttacagattatctttcagaaccaggtccaggaaaagcagatatcattcagtatcaagttctgtcatccagacactcctccgatcaatgacactccagaagttatatctcgcgcacctggtccggtatatgggccgccgggaaccgccaaattgaaggacatggtcctatggggagatcagcaccggatcttacagatcctgatcaacctagtgggcaacagtctcaagttcacacctgagcagggcaccgtcgcgatccgcatcaagtgcgtcggcgaggagaagaacccttccgccagcccaagaccggagtcaagagctctctcgcgctggcgatctataggctcatcccatgccagctcgcgtcccaaaacctccctcgaccgtcccagggacggtggagacgaagagacaacacgcccaccgaacttgcgcacgctcatccttcaattcgaagttgaggacactggccccggaattccgcagcacctgcaaaaccgcgtctttgaaccgtttgtgcaaggtgacctccgtctaaatcgcaaatatggtggcacgggcttgggtttgagtatctgctcgcaactggccaggctcatgagaggtcagatacagctaaatagtgagcagggacggggcacgctatttttagtccggatcccgttgggttttgtcaaggaatctcccccaagcaccgccagctcgatgacgagtctagccgggtcgcggacgtcgagcgttttctcgttggatgacctggcgagtgtcactaaggcgccgtctaatcatagcgtcgcatctcaacatgaatcaacgaagagcaatgctgaaatacaggactcacagcctcgcttggttggcttgagtcaaccattctttgcgccgcctgttccgcaagctaaggacaatgggctgaagaagataagagcgttggtagctgaggataatgtggttaaccaggaagtggttctaaggtatgcactactttttcgattcgtatcatgtactgacccctgcagaatgctggcgttagaagacgtctatgacgtgactgtggtcaaagacggccaagaggcttatgacaccgtgaaagccaatatggaggagggcaaagtattcgatttgatttttatggatattcagatgccaaacctagacggcattgaaagcacccgtcttatccgtcaaatgggctgttcggcccccatcgtcgcgctgagcgcattctcagaagacagcaatatcaaagattgcatgaactcgggaatggacatgtttatcagcaaaccgattcgacggccggcattgaagcaggtattacggaggtttacccccattcctgaggaagcggagaaaccgcagatgtga

SEQ ID NO: 6122 - protein, 1080 aa, Aspergillus nidulans FGSC A4
MRVPIAVQLGLLVLLTALAGLAALAIATWINNYNFVVDVKSQSLQLVASIKSSQITSNLDLLETTSKTIITRILIQSALQRYYAGNTTEENFASSITDVQSALGSRGYLSLYQASIYARNVENGESKARRLLNVTSDEVPEIRLPYDHPNGTAVMLGDEGLGYPPSLYPNLTEDATTNKLYAFDGVPITTNQPLLLGPLATNDSFSLISLSLPIINNTSAADILGYITVVASAANLQDAMSSRQGLGSSGQVLLLAPSRPENRFPTGSRPATATSEPQIAGLDNQEVRYVFRPTPLPGNKRRHSPAVASGASFPLRDYPIALKVLNQPYDSINHSITDLSSKNENGTRVAVGAIQQRSDLVEWVLIIEETHGEAFAPVSRLRKIILACVFGTAGVIALLIPPLAHLSVAPIRRLREATRKSVNPTIGPLSPSLSTMVDPIEISMHNGNEKSEKGGFFNRLKRGRGNLATGHDRDNEPHQFQIPGRVKERKHIITDELTDLTKTFNEMSDELVIQYNRLEERVAERTRELEKAKIAAETANESKTLFIANISHELKTPLNGILGMCAVCMGEDDLPRIKRSLQTVYKSGDLLLHLLNDLLTFSRNQIDQAIRLEEKEFKLSDIRSQLQIIFQNQVQEKQISFSIKFCHPDTPPINDTPEVISRAPGPVYGPPGTAKLKDMVLWGDQHRILQILINLVGNSLKFTPEQGTVAIRIKCVGEEKNPSASPRPESRALSRWRSIGSSHASSRPKTSLDRPRDGGDEETTRPPNLRTLILQFEVEDTGPGIPQHLQNRVFEPFVQGDLRLNRKYGGTGLGLSICSQLARLMRGQIQLNSEQGRGTLFLVRIPLGFVKESPPSTASSMTSLAGSRTSSVFSLDDLASVTKAPSNHSVASQHESTKSNAEIQDSQPRLVGLSQPFFAPPVPQAKDNGLKKIRALVAEDNVVNQEVVLRYALLFRFVSCTDPCRMLALEDVYDVTVVKDGQEAYDTVKANMEEGKVFDLIFMDIQMPNLDGIESTRLIRQMGCSAPIVALSAFSEDSNIKDCMNSGMDMFISKPIRRPALKQVLRRFTPIPEEAEKPQM

SEQ ID NO: 6123 - DNA, 4122 bp, Candida albicans SC5314
  CDS (1)..(4122): transl_table=12
atgaggagattaaagattgggattcgaccccaattaatcataattgtttgttttgcatcgttgttttcattattgattttgggtattgtaacaggaatatattttagtgccaatttaaaaaacctacgattagaaagactactagttatatcccaattaaaaagaactcaagtacaacaagcaatacaatatattgcctatcaagtgatgacagtatcggaagtagattcattaacggttccattatcaaattatcgagctggtaataattccaaagcagttttcctggaagcacaaaattatttacaacaatatgtccttaccactgattcatttactgcagctagattatatgatttggatttacaagttgtagcatctagttttgataatatgactttaatttctgaaagtgctcaagatgtggtttatcctttacaaccaaatagatcaatgcctccggtattaggtactccactgggattatattttactggtcccattgccaataattcggataattttaattcaaggtattttatggggatcaccgtaccggtgctatcgaatagttcgattattttactgcagccatcaatttcagggtatctcaccattgtagcagcagcagaatccattcgttcagcattaaattctactagtgaagatgattatcaagctatggcagtacaaccagtatatggagatcctcaaaaggggatagataatctactgcaaaatgcttataatggagacaatgaagttattggattcaaattagttttcccagtggaaaatagtttattagaagctggtaccatatataatatcaattcatcttcatcgatgaaaactgcattagcatcaaattccggtacagcaactggcgtcaaatcattttttggtaaaaaagttgccattggattttcaagaataagtgttcaagataatttaaattggtcaattgttattgttcaatctaattctgttttcaatgggcccgctaataaactacgaaaaataactataggcgttgtcattggaattggagcattcatgtgttttgttacattcccgttggcagtttggtttatacggccgattacaaaattaaaagaggccacagaagccattaccaaatacaaaaaggaaaaattaaatagtgtcaacagtaatagccccacttctggttctggttctggttctggatctggttctggatcaagagctaattcagattcttcagcagaccaatcactactgttagatacggggaaacgaaatagtataaattcgtcatcattttcatcaagttattctacggggataagactaccggcaagaataccaagatcgaaaaaaatatttaaagatgaattgactgaattatcagaagcatttaatattatgacagaagaattagataaacaatatactcatttagaggatcgagtgaaattacgtacaaaagaattggaagcatctaaaattcaagccgaagcagctaatgaagctaaaactgttttcattgctaatatatctcatgaattacgtacacccttaaatggtatattaggtatgacctcaattgccatggaagaagaagatcctaatgtaattcatgattcattaaagttaattcatcgatctggagaattattattacatattttaactgaattattaacatattctaaaaatactttaaatcgatcaaaattagaaaaatctaatttccaaattttagaaattgtttatcaagttcgatcaatttttaataaattagctcatgatcaaagagttaattttaaaattttagtgaaaccaaatattttccgaaaattaatcatttatggagattctaatcgaattattcaaattgttatgaatttagtatctaattcattaaaatttactcctgtggatggatcagtatcggtttcatttaaattgttaggtgaatatgatcatgaaaggtctaaaaaattggattataaaaaagtttgtattttgaatgattctagtagtagtacagtagcagtgccacctccaacacctccatcagatactaaacctaacccaaaacctaaatccacacctacacctaaaccagatcccacaagactgcatttggttgatcataataatagactggccaatactacatcaccattaacacctgtacggaaaccaacaaatcaaaccaaaaataagagtattaccaataatgtaactaaacagaatatgaaaatcagaaagaaaaagaaaaccaacaaaaacctccacaacaacaacaataacaacaaaaatgataatagtgattttcttatgaatagaagattaagcggttcccataaatttaataataccaatgacgaagaattaagtcctacagcaatagaaaaaaatattgataaatatttaacttcatctgctgatagtgataatattagtgtaactacgttatcaactgtacaatatgaaaccaccatatttgaatcacaatttaaatcaaaaccattacctgctttgcccgtagatgcaaaaccacaagtatcgggaaaaatagatgagaatgacgttaatgacgaagaccctagtggtggcagtattaaggatgatgatagcgaggataccataaatgaaaagcaaggtattctgtcatcgccttcttcttcttcttcctccaatgaaaagcaagagaatctgcctcggtcaaatgattctacaacggtgactgttacacgaccacgtcataatatgatgcctctggctcaagatttcaaaagttatccaacatttgataaaaaaccagaatatgattctaatatgtctaataatgaaattgttaaaaataatcgagtatatagaattcgaaatatgtatcaaccaaaagtttgggtaattcagattgaagttacagatacagggccaggtattgaacccgcattacaagaaaaagtatttgaaccatttgttcaaggtgatcaaacattatcaagaagttatggtggtacgggattaggattaagtatatgtcgacaattagccacaatgatgcatggaactttaactttaaaatcaaccattggtaaaggttcaactttcacattaactttaccattaccacaaactggagaaattatggtacctcctgaagatatggcagaattttgtgaagatgaatttaacccagcagcaaaaattaatagaaaagttgcatttgaagatggtgatattgatactgagtcacaacaacaagaaaatccctcatcagaagaagatacgcaaggggatcgaaacgttcaatcatccacttcatcgtcaccaccaaattcttcatccactgattcagcattacctgcttcagactcgtctgatattggaggtaccaataaatctaaaacaacaagtcatggcaacaataaaaatatcaatgcaaagaaacgaatcataacaaattcttctgcatcttcaactaagggtaccaagagacacaccaataatgatggtggtggtggtgttaatggtaatcatagtgatgataataaagaccttacccttacaattgataaaccactgttatttactcgaggatcaactggtactgccaattccggtaccacttcatctcattccgataaaaaaatactttatccaacacctacaactactacaacaacaacaacaacaacagaccatactactgtattggatgatatatcacatttgagagttttagtagctgaagataatctggtgaatcaagaagttatttcacggatgttaaaacaagaaggaataactaatcttactatggcatgtaatggagctaaagccattgattttgttaaagaatcaattgaaaataatgaaaattttgatttaatatttatggatgttcaaatgcctgaagttgatggattaaaagctacaaaaatgattagaaaaaatttacaatataataaaccaattattgccttaacagcatttgctgatgaaagtaatgttaaagaatgtttgaattctggtatgagtggatttattacaaaaccaattagtaaaactaatataaagaaagttcttgttgaatttttatcaaatgaagtcgttacttcataa

SEQ ID NO: 6124 - protein, 1373 aa, Candida albicans SC5314
MRRLKIGIRPQLIIIVCFASLFSLLILGIVTGIYFSANLKNLRLERLLVISQLKRTQVQQAIQYIAYQVMTVSEVDSLTVPLSNYRAGNNSKAVFSEAQNYLQQYVLTTDSFTAARLYDLDLQVVASSFDNMTLISESAQDVVYPLQPNRSMPPVLGTPSGLYFTGPIANNSDNFNSRYFMGITVPVLSNSSIILSQPSISGYLTIVAAAESIRSALNSTSEDDYQAMAVQPVYGDPQKGIDNLSQNAYNGDNEVIGFKLVFPVENSLLEAGTIYNINSSSSMKTALASNSGTATGVKSFFGKKVAIGFSRISVQDNLNWSIVIVQSNSVFNGPANKLRKITIGVVIGIGAFMCFVTFPLAVWFIRPITKLKEATEAITKYKKEKLNSVNSNSPTSGSGSGSGSGSGSRANSDSSADQSLSLDTGKRNSINSSSFSSSYSTGIRLPARIPRSKKIFKDELTELSEAFNIMTEELDKQYTHLEDRVKLRTKELEASKIQAEAANEAKTVFIANISHELRTPLNGILGMTSIAMEEEDPNVIHDSLKLIHRSGELLLHILTELLTYSKNTLNRSKLEKSNFQILEIVYQVRSIFNKLAHDQRVNFKILVKPNIFRKLIIYGDSNRIIQIVMNLVSNSLKFTPVDGSVSVSFKLLGEYDHERSKKLDYKKVCILNDSSSSTVAVPPPTPPSDTKPNPKPKSTPTPKPDPTRSHLVDHNNRSANTTSPLTPVRKPTNQTKNKSITNNVTKQNMKIRKKKKTNKNLHNNNNNNKNDNSDFLMNRRLSGSHKFNNTNDEELSPTAIEKNIDKYLTSSADSDNISVTTLSTVQYETTIFESQFKSKPLPALPVDAKPQVSGKIDENDVNDEDPSGGSIKDDDSEDTINEKQGISSSPSSSSSSNEKQENSPRSNDSTTVTVTRPRHNMMPSAQDFKSYPTFDKKPEYDSNMSNNEIVKNNRVYRIRNMYQPKVWVIQIEVTDTGPGIEPALQEKVFEPFVQGDQTLSRSYGGTGLGLSICRQLATMMHGTLTLKSTIGKGSTFTLTLPLPQTGEIMVPPEDMAEFCEDEFNPAAKINRKVAFEDGDIDTESQQQENPSSEEDTQGDRNVQSSTSSSPPNSSSTDSALPASDSSDIGGTNKSKTTSHGNNKNINAKKRIITNSSASSTKGTKRHTNNDGGGGVNGNHSDDNKDLTLTIDKPSLFTRGSTGTANSGTTSSHSDKKILYPTPTTTTTTTTTTDHTTVLDDISHLRVLVAEDNSVNQEVISRMLKQEGITNLTMACNGAKAIDFVKESIENNENFDLIFMDVQMPEVDGLKATKMIRKNLQYNKPIIALTAFADESNVKECLNSGMSGFITKPISKTNIKKVLVEFLSNEVVTS

SEQ ID NO: 6125 - DNA, 3477 bp, Phaeosphaeria nodorum
  CDS (1)..(3477)
atgcggatccctattcgggagcaactgggctgtctggtgctgctggcttcgaccgttggccttgctgtcatcgccattgcaacatggatcaccaaccacagcttcgtgcttgggataagagcaacccgcctcacgttgactgcctcgctcaaagccgcccagctatcgtcgaacctctcgctcatgcaaatcctagtcgtacaggcagccaatcgcctctcgccgcagaccgcattggacaggttctacaaagggaattacagccaatcaaattggggtcgaactatggaagactacgatgctgtatttgctggtgatagcagtactcaggccgccatccaggcaggaatatatcaggccaactccactgcgtatcagatctttaaccgcacagcatacaacgtggccaacgttgttctgcccatcctcaagcctgatggaaataatgccaccttgggtgaccccgtctacggtttcattcccgagctctacccaaagctggacatcgagacgattgtggttaacaactcattcaactcatacagaggcagatacgacggtaggatcgtcgacaataccagctacctgttctctgggccatatcgcgtcaacgaaacattcagccttgtctccatcacgttgccgatcatcaacaacacctcaaatatagaaactttggggtggctgacgacggttctagatgcgagtctgattaccagcgtggtcaacgcgatcgaaggcctagaccaaaccggcctcactctgctgattggacctaacaacgtgaccaacaacttcccccctggctatctgtacacgcaatcggatcagcatgcgcctgaaaatgcccaggttcgatatttgatacctcccaccatcagaagcgacgtcaagcgacatgggcagtacgatacttcccttgacccgcctcccttcgattggacgaaatatcctgctatccgcaaaggctatacccaggccactggtgccgccgggaatgctggtagcattattgacacgcgaaacgaggatggagacagtgtcgccgtagggtatgccgttgtcaacagccccatggtagactggatgatcgtggtcgaacaggaacacaacgaagtttggggtcccatctaccatctgcgaaaagtcattcttgcctgtgtgtttggtaccatgggcgcaatgctgattgttatcttcccggtcgcccacttctcaagccgccccattcgccgactacgggacgccaccaggaagactgtagcgccgcagagtttcgacgacgaaagtttcggctcgcagaacgacggtgccaatgatgactctcaggaagaagttgcgcgcaaagaaggtttttttggctcggtcatacattaccgccggaatcagaaactcagccgcgcagaaaagaaagaggcagagcggaggagacaattccgcatcccgagcaaagtcaaggatcgcaaacatttcatacatgatgagctcactgatctcaccaaaactttcaacgaaatgacagacgagcttatgatgcagtacgagaaactcgaagaaagagtagcgcaaagaacggcggaactggaacacagcaaaaaggctgcagaagcagcgaacgagagcaagactttgttcattgccaacatctcgcacgagctcaaaacgcctctgaacggaatcttgggcatgtgtgcggtctgtatgggggaagatgacccagtgaagctgagacggtcactgggcatcatctacaagagtggcgacctattactaaatctgttgactgatctgttaacctttagcaaaaatcaagtcggccagcacctcagtcttgacgagaaggagtttaggttaagagatatttcccagcaaatcttggcaatatttgacaagcaggccaaagaaggcgagatcaaactggctgtcgaattcgaaggcatgtacgagaacaatctggacgacaacgggcgaccaaacgcattcggcgacttggggccgttcggtcttggcagactcaaggacatgatactgtacggcgatcagcacagaatcctccaggtcgtcatcaacctggtgtcgaacagtttgaagttcactccgccagggggtgctgtgacccttgttattcgatgcgtaggcgaggcgcacatgtccgacagccgaaaagcttctttgcagtcgcgacagagctcgacgcggaattcgaagacccgcttcaggacgtcaagctcggaagtgggctcagtatcgatcgcaccaagcaactacgacactgcgaacgtcatcaacgctttcgagaagcccagctcatacgccaacatgatggcacaggaacgagcagcgactccaccacccggccgctggctatcgtttgagttcgaggtcgaagatactggcccgggtattcccgacaatttgcatgccaagattttcgagccattcgtccagggcgaccttggcctcagcaagaagtacggtggcactggtcttggactgagcatctgttctcagcttgcaggcctgatgaaaggcaccatcggattgaagagcgaagtcggacaaggcagtgttttcacgatgcaaatccccttgaagcacctacaaagccgtgctgacagctcggcaagctcaagcaacaacgtacccttcgaaagcacgaccccacgtcgaagtgtcgaagacacacgggacgcaatgtcgggtctctctatgcattcaacaaccagcgctcacaataccaacacagcacccggcggccctgtggcatttgatgtagatacacaaccgcgtctggttggcctcagccaacctttctttgcatcaaacgctcctctcgaatcgccaaactcgcaggcagcagctgtacagcggatagaagcagaggctacaaagcgtggcggcaaggtcaaggtcctcgtcgccgaagacaacaaaacgaatcaagaggttgttctacgaatgttgaagctcgaagatgtgtacgacgtcaccgtcgccaaagacggccaagaagctctggacaaggtcagggagagtatggagcacaaggcaccatacaacctgatcttcatggacgtgcaaatgccgaatctcgatggtctgcaatccacgcgactcatccgagcatctggtttctcctcacccatcgttgccctgactgcctacgcggaagagagcaatgtcaaagaatgtctcgaatccggcatggacttcttcctctccaaacccatccgtcgccctgccctcaaacacgttctcaaaacctactgcccacccatcatcgaagaagaggaagaatcaacaacaccgcccggctcgagcacagccgcgccaacaccagccaacggccacatatcgcaatcacagccacaacgacccggactacttcatccgggtttcgcgccgttcaatacaggcgccaccagtaacgcacgcgaatctcccgctgtatcgcctggcactctacccccgtcgtaa

SEQ ID NO: 6126 - protein, 1158 aa, Phaeosphaeria nodorum
MRIPIREQLGCLVLLASTVGLAVIAIATWITNHSFVLGIRATRLTLTASLKAAQLSSNLSLMQILVVQAANRLSPQTALDRFYKGNYSQSNWGRTMEDYDAVFAGDSSTQAAIQAGIYQANSTAYQIFNRTAYNVANVVLPILKPDGNNATLGDPVYGFIPELYPKLDIETIVVNNSFNSYRGRYDGRIVDNTSYLFSGPYRVNETFSLVSITLPIINNTSNIETLGWLTTVLDASLITSVVNAIEGLDQTGLTLLIGPNNVTNNFPPGYLYTQSDQHAPENAQVRYLIPPTIRSDVKRHGQYDTSLDPPPFDWTKYPAIRKGYTQATGAAGNAGSIIDTRNEDGDSVAVGYAVVNSPMVDWMIVVEQEHNEVWGPIYHLRKVILACVFGTMGAMLIVIFPVAHFSSRPIRRLRDATRKTVAPQSFDDESFGSQNDGANDDSQEEVARKEGFFGSVIHYRRNQKLSRAEKKEAERRRQFRIPSKVKDRKHFIHDELTDLTKTFNEMTDELMMQYEKLEERVAQRTAELEHSKKAAEAANESKTLFIANISHELKTPLNGILGMCAVCMGEDDPVKLRRSLGIIYKSGDLLLNLLTDLLTFSKNQVGQHLSLDEKEFRLRDISQQILAIFDKQAKEGEIKLAVEFEGMYENNLDDNGRPNAFGDLGPFGLGRLKDMILYGDQHRILQVVINLVSNSLKFTPPGGAVTLVIRCVGEAHMSDSRKASLQSRQSSTRNSKTRFRTSSSEVGSVSIAPSNYDTANVINAFEKPSSYANMMAQERAATPPPGRWLSFEFEVEDTGPGIPDNLHAKIFEPFVQGDLGLSKKYGGTGLGLSICSQLAGLMKGTIGLKSEVGQGSVFTMQIPLKHLQSRADSSASSSNNVPFESTTPRRSVEDTRDAMSGLSMHSTTSAHNTNTAPGGPVAFDVDTQPRLVGLSQPFFASNAPLESPNSQAAAVQRIEAEATKRGGKVKVLVAEDNKTNQEVVLRMLKLEDVYDVTVAKDGQEALDKVRESMEHKAPYNLIFMDVQMPNLDGLQSTRLIRASGFSSPIVALTAYAEESNVKECLESGMDFFLSKPIRRPALKHVLKTYCPPIIEEEEESTTPPGSSTAAPTPANGHISQSQPQRPGLLHPGFAPFNTGATSNARESPAVSPGTLPPS

SEQ ID NO: 6127 - DNA, 3240 bp, Aspergillus oryzae
  CDS (1)..(3240)
atgtcgagtagatcgcaagggcttgaactcgtcgcgaccatcaaagcgagtcagattgcctcgagcctcgagctcctcgaagtgacctgcaaaaccatctccacgcggcttctggtacaatcggcgctacgacgctattatgccgggaatatatccgaggccaactgggcgacgtccatcaccgacgtgcaatcggcactcggcagtcggggatacctcagcacataccaggcgattctctactcgaagaacggacaaggcggtcgcgaacgattattgaacgttaccagtgattcggtaccggagatcacacttccttacacctacccgaatggtagctccgtgaagttgggggatgaaggacttggatacccctccgtcctctatccgaatttaacatacacacaatcctccgaaaagggcaacgctaccacggtgaatgccttttccgattacaccctagggttagcgtctgcattgctgctgggtcccatagcaatcaacagctccttttcccttctgtccctgaccctgcccatcgtcaataatacatcgaataccgatatcctggggttcatgacggttgtcgccagtgcggccaacgtgcaaagcgttgtcagctctcgcgacgggctggccaacaccgggcaagtcctgctactcggcccttctagacccgataaccgcttctccacggagtctgcaacagccacttcgtccccggatcgaccagcgcttaccgacgcccaagttcactacatctttgagcccacgcccctgccgtcccaagacagccgccaccggggcgtctccaccggtacctccttcgagctttccaagtaccccatggcactgaagttgatgaccgaatccgaggaaaatgagaatagatccgtcagcaagctctctaccaaaaacgaacaaggatacaatgtcgccgtgggcgcggttcggcccaaaacttccctggtcgaatggattcttctggtggaggaaacgcactccgaagccttctcgccggtggtccgcctacggaagatcattctagcctgtgtattcgggacggcgggtttcattatcctagttgttcctctgctagcacactgggccgtcgcccctattcgcaggatgcgggaggccgcgcgaaaatccatcgaaccagaggtgccgccaaccccgtctgcaggctacgttgaacatataaccgatggacatggagacacggtacaggccatcgaggaacatatggatgagaagggcgcgcctgtgtcgtgggtcaaacgcctgcgacggccattggagcgattcaacagctctcacagctttggcgatcgtagggatcctcggtcctccttccacattccttcgagggtaaaagagcggagatcctgcgtgacggatgaactcacagagctgactagcactttcaacgaaatgtcggacgaactggccatccaatacaatcgactggaagagcgcgtggtggagcggacaaaggagctccagaaggccaaattggcggcagaagcggccaacgagagcaagaccttgttcatcgctaatatttcgcacgagctcaagacgccgctcaatggaattttgggcatgtgcgcggtgtgcatgggagaggaggatctgcatcggattaagaagtcgctccaggttgtctacaaatcgggtgatcttctcctgcatctgctaaatgacttgttgactttcagcaggaatcagattgagcaggctattcatcttgaggagaaagaatttagactctctgacatccgttctcagctgtcaatcatattccaaaaccaggtgcatgagaagcatatcgatttcagtgtcaactacgttggtatcggtaatagtcaacctcggggtacgatgtgccaggaacgaggagttgaacggacacacccggctgttggtccaccgcagacgggcaggctcaaggatatggtgctctggggcgaccagcatcgcatcctgcaggtcctgatcaacttggttggcaatagtctcaaattcatacctgagaatggcaaggtcgaggtccgcatccggtgtgtggaggaagttccggacgccgaaagctccgtgacactggtccagggctcccagccgagctcgcaagcacgttcacggactccctcacggttgaccgcaacgccggtggacggtactaaccttctagacagccagctggagaaacagacgccggtaccgtccgacttgcggacactcatattccagtttgaggtcgaggataacggaccagggatcccagccaacatgcagagacgtgtgtttgaccccttcgtgcagggtgacctgggactcaacaggaaatacggaggaaccggtcttgggttgagtatctgtgctcagctatctcgacttatgggaggcgttattctactggatagtgaagaagggaacggggctctatttaccctgaagataccgttgaaatttgtcaaggaggcagcagctagcacacgaagttccagcattgccggctcaaggacaccgagtgtcgtgtcgctttcactggaagagttttccaatattgctcagacaccatcaaaccacagctctgtgggtaacaaggaaacactcaccaatggcttcgaaaagcccgatgtccaaccacgtctggttgggctcagtcagcccttcttcgctcctactgttccatcagccccttcttccccatctaagggtcaagagtcgaaccaaagctcatcggataatggttcgaagaagatccgtgtgttaatggccgaagataacaagatcaatcaggaagtagcccttcggtatgtccaaaatgcttataaaaataccctatcatctgctgaccttgacaggatgcttgcccttgaggaagtctacgatgtaacggtagtcaaggatggacaagaggcatacgatactgtcaaggctaacatggaagagggtaaagtattcgacctcatcttcatggacattcaggtaaagcaccttctacaccacatgcccatcctcgatggactccagagcacgcgactcatccgcgagatgggatactctgcgcctattgttgccctaagtgccttttcggaggatagcaatatcaaagactgcatggattccggaatggacatgttcattagtaaacctatccgacggcctatcttgaaacaggtgcttaacaagtttgcgaccattccagaagaatccgacgggagttcttcgtaa

SEQ ID NO: 6128 - protein, 1079 aa, Aspergillus oryzae
MSSRSQGLELVATIKASQIASSLELLEVTCKTISTRLLVQSALRRYYAGNISEANWATSITDVQSALGSRGYLSTYQAILYSKNGQGGRERLLNVTSDSVPEITLPYTYPNGSSVKLGDEGLGYPSVLYPNLTYTQSSEKGNATTVNAFSDYTLGLASALLLGPIAINSSFSLLSLTLPIVNNTSNTDILGFMTVVASAANVQSVVSSRDGLANTGQVLLLGPSRPDNRFSTESATATSSPDRPALTDAQVHYIFEPTPLPSQDSRHRGVSTGTSFELSKYPMALKLMTESEENENRSVSKLSTKNEQGYNVAVGAVRPKTSLVEWILLVEETHSEAFSPVVRLRKIILACVFGTAGFIILVVPLLAHWAVAPIRRMREAARKSIEPEVPPTPSAGYVEHITDGHGDTVQAIEEHMDEKGAPVSWVKRLRRPLERFNSSHSFGDRRDPRSSFHIPSRVKERRSCVTDELTELTSTFNEMSDELAIQYNRLEERVVERTKELQKAKLAAEAANESKTLFIANISHELKTPLNGILGMCAVCMGEEDLHRIKKSLQVVYKSGDLLLHLLNDLLTFSRNQIEQAIHLEEKEFRLSDIRSQLSIIFQNQVHEKHIDFSVNYVGIGNSQPRGTMCQERGVERTHPAVGPPQTGRLKDMVLWGDQHRILQVLINLVGNSLKFIPENGKVEVRIRCVEEVPDAESSVTLVQGSQPSSQARSRTPSRLTATPVDGTNLLDSQLEKQTPVPSDLRTLIFQFEVEDNGPGIPANMQRRVFDPFVQGDLGLNRKYGGTGLGLSICAQLSRLMGGVILLDSEEGNGALFTLKIPLKFVKEAAASTRSSSIAGSRTPSVVSLSLEEFSNIAQTPSNHSSVGNKETLTNGFEKPDVQPRLVGLSQPFFAPTVPSAPSSPSKGQESNQSSSDNGSKKIRVLMAEDNKINQEVALRYVQNAYKNTLSSADLDRMLALEEVYDVTVVKDGQEAYDTVKANMEEGKVFDLIFMDIQVKHLLHHMPILDGLQSTRLIREMGYSAPIVALSAFSEDSNIKDCMDSGMDMFISKPIRRPILKQVLNKFATIPEESDGSSS

SEQ ID NO: 6129 - DNA, 3513 bp, Cochliobolus heterostrophus
  CDS (1)..(3513)
atgcgcatccctatccgcgagcaattgggctgtttggtgctgctggcctcgaccataggcctggccgtcgtcgcagtcgcaacatggctcaccaaccacgatttcgtcctcaacatacgatcgactcgccttacgttaaccgcctcgctcaaagccgcacagctgtcctcgaacctggccctcatgcaaatcctcgtccaacaagcagcgaaccgtctttctcctcaggctgcgctcggtcgctactatcttggtaacaactcgatagagaactggtcccgcgtcgaggaagactacgatgccatcttctcgggcgatgtccggacccgcatcgctgtccaggcccagatctttcccttcaactcgtcggcccgcgcactcttccgccgtaccgccgtcacgatgatggatgtcgtgctccctgtccagaaaccagacggccaaaatgcaacactgggcgaccctgattatggctacatacctgaactctatcctaaatttactgtcgagtctattccgttcaactcgtctttcaacaccttcaaggcgcattttgaggggaggactatcgataacacgagttatctcttgctcggcccgtatcgcgtcaatgactctcttagcctcgtctccattaccgcgcccatcattaacaacacgtccaacatcgatacgctaggatggctcacgaccgttctggacgcctcgctcatttccaatgttgtggaggctattgatggcctagacaagagtgggctgactctcctttttggccccaacaacgttaccaacgtctttccatcaaactacatgtacgatgccccgaatccgacaccccccgaaaaaatgctggtacgttttcttgtaccgccaacgtacagagccggcatacagcgacatggcaaatacgataccgaacttgaactttctccttttgactggtccgaatacccggccatccgcaaaggcttcacccaggccaccggcgctactagtaatgctggtagcatcgttcctacggtgaatgaggtaggcgacaaggttgcagttggatacgctattgtccgcagccccatggtggattggatggttgtagttgagcagacgcgtaaggaggtctgggagcccatcaatcgtcttcggaatatcatcctcgcctgtgtttttggtactattggtgccatgctgattgctgcattccccgtcgcgcattattcgagtcagccaatccgacggctacgagatgctacgaagaagacggtctcgccttcggtgtttgaagatgacgactctagctcgcaccatgatggcgggcccgatggctcagatgacgcagcactggctcgcaaggaaggcttctttggccagattatccattatcgcagaaatgcaaaacttaacaaggcagaaagaaaggaggcagagaggcgtaggcagttccgcatcccgagtaaagtcaaggaccgcaagcactttatccacgatgaacttaccgacttgaccaccaccttcaacgagatgacggacgaactcatgatgcagtatgaaaagcttgaggagagagtagcacagagaacggcagagttggagcaaagcaaaagagctgcagaggctgcgaatgagagcaagactctcttcattgcaaacatttcgcacgaactcaagacgccgttgaacggtatcctgggtatgtgcgcagtctgcatgtcagaggacgacccggtcaagttgaaacggtctttgggtattatctacaagagcggagacttgctgctgaatctattgacggatctcttgacttttagcaagaaccaggtcggacagcagttgagcttggatgagaaggagttccgcttgcgagatgtcagctcacaggtcttggctattttcgacaagcaggcaagagaaggtggcatcaagttagccgtggaattcgaagggccgtacgaaaacaatctggatgacaacgggcggcccaatgagctacgcgatctcggtccttttgggcttggccggttgaaggacatgattctgtacggagatcagcatcgaatactgcaggtggtcatcaacctcgtgtccaacagtctcaagtttacgccacagggcggctcggtcacgctcacgatccgatgtcccggagaagcccgcatgccagacagccgcaaggcttcgatacagtcacggcaaagctcggcacgcaactcaaaggcgcgggtaagaacttcggcttcggaaattggatcggtgtcagtagccacgccgaatcgctacgatactgcaaacacaatcaacgtcacggacaagggaaatgcgtattcgcattacatgcttcaagagcgggctgcgacgccgccacctgggcgctggctgacgtttgagtttgaggttgaagacactggaccaggtatccctgaccatttgcattccaagatctttgaaccttttgtccagggcgacctgggcctgagcaagaagtttggaggcactggtttgggtttgagcatctgttcgcaactcgcgggcttgatgaagggcacgattggtctgaagagtgaagtcggccacggaagcgtgtttaccatggtcattccactgaagcacgtagccagccgcgcagacagcagcgctagttcgaggattgttaatacggaaactggaaccccgcggcggagcatgtcgatcgaggacaccccgcgtcgtcgatcccatgacgatgcacggtcggcccgctcgttgcgttccggggctaatagccctattagcgtcgctacttcggccgctaccgcaccaccgggtccagtgtcttttgagtcggacaaccaaccccgtcttgttggtctcagtcatcccttctttgcctcgaacaagccgttggagtcaccaaactcacaggtagcagccatgaagcgcgtcgaggccgaagcaacgaaacgcggtgataaggtcaaggttctcgtcgccgaggataacaaaaccaaccaagaagtcgtcttgcgcatgctcaagctcgaagacgtctacgacgtaaccgttgcaaaggacggccaggaagccctcgacaaggtcaaggaaagcatggaacgccaggccccttacaacctcatcttcatggacgtgcaaatgcccaacctcgacggtctccagtccacacgtctcatccgccaatccggcttctcggcccccattgtcgccctcaccgcctacgcggaagaaagcaacgtcaaagaatgtctcgactcgggcatggatttcttcctctccaagcctatccgtcgtccagcactcaaacacgtgctcaagacttactgccagacgattcccgaagaggcggaaactacgcccccgaattccgtagccgatctctcggccgcaaatgggactacaaaggccgtggcaaaaatggccgacgccaaaccgtttgctgccccgtcgtcgcgtgtggctaatggccttgttgctgcggatgccgatacgccgtcgcctatgacgtcgccgtcgcctgctgggtga

SEQ ID NO: 6130 - protein, 1170 aa, Cochliobolus heterostrophus
MRIPIREQLGCLVLLASTIGLAVVAVATWLTNHDFVLNIRSTRLTLTASLKAAQLSSNLALMQILVQQAANRLSPQAALGRYYLGNNSIENWSRVEEDYDAIFSGDVRTRIAVQAQIFPFNSSARALFRRTAVTMMDVVLPVQKPDGQNATLGDPDYGYIPELYPKFTVESIPFNSSFNTFKAHFEGRTIDNTSYLLLGPYRVNDSLSLVSITAPIINNTSNIDTLGWLTTVLDASLISNVVEAIDGLDKSGLTLLFGPNNVTNVFPSNYMYDAPNPTPPEKMLVRFLVPPTYRAGIQRHGKYDTELELSPFDWSEYPAIRKGFTQATGATSNAGSIVPTVNEVGDKVAVGYAIVRSPMVDWMVVVEQTRKEVWEPINRLRNIILACVFGTIGAMLIAAFPVAHYSSQPIRRLRDATKKTVSPSVFEDDDSSSHHDGGPDGSDDAALARKEGFFGQIIHYRRNAKLNKAERKEAERRRQFRIPSKVKDRKHFIHDELTDLTTTFNEMTDELMMQYEKLEERVAQRTAELEQSKRAAEAANESKTLFIANISHELKTPLNGILGMCAVCMSEDDPVKLKRSLGIIYKSGDLLLNLLTDLLTFSKNQVGQQLSLDEKEFRLRDVSSQVLAIFDKQAREGGIKLAVEFEGPYENNLDDNGRPNELRDLGPFGLGRLKDMILYGDQHRILQVVINLVSNSLKFTPQGGSVTLTIRCPGEARMPDSRKASIQSRQSSARNSKARVRTSASEIGSVSVATPNRYDTANTINVTDKGNAYSHYMLQERAATPPPGRWLTFEFEVEDTGPGIPDHLHSKIFEPFVQGDLGLSKKFGGTGLGLSICSQLAGLMKGTIGLKSEVGHGSVFTMVIPLKHVASRADSSASSRIVNTETGTPRRSMSIEDTPRRRSHDDARSARSLRSGANSPISVATSAATAPPGPVSFESDNQPRLVGLSHPFFASNKPLESPNSQVAAMKRVEAEATKRGDKVKVLVAEDNKTNQEVVLRMLKLEDVYDVTVAKDGQEALDKVKESMERQAPYNLIFMDVQMPNLDGLQSTRLIRQSGFSAPIVALTAYAEESNVKECLDSGMDFFLSKPIRRPALKHVLKTYCQTIPEEAETTPPNSVADLSAANGTTKAVAKMADAKPFAAPSSRVANGLVAADADTPSPMTSPSPAG

SEQ ID NO: 6131 - DNA, 3324 bp, Emericella nidulans
  CDS (18)..(3230)
gcggcaatcggtttccaatgcgcgttcctattgccgtgcagttggggctgctggtcctcttgacggcccttgctggtctggcggctctagccatcgcaacatggattaacaactacaacttcgtcgtcgacgtcaagtctcaaagccttcaactcgtcgctagcatcaagtctagtcagatcaccagcaatttggatctactcgaaacgacgtccaagacaatcatcactcgcattctcatacaatccgccttacagcgctattatgctggtaatacaaccgaggaaaatttcgcctcgtcgatcaccgacgtgcaatcagccctaggtagtcgcgggtatctcagcctctaccaagccagcatctatgcgagaaatgtcgagaacggagaatcaaaagcaaggcgattactcaacgtgaccagcgacgaggttcctgaaatcaggcttccctatgatcatccgaatggcacagcggtgatgcttggggatgaaggattgggatatccaccctcactctatccgaatctgacagaagatgcgaccacgaacaagttatacgcttttgatggtgtgccgataaccacgaaccagccgttacttctgggaccgctcgccacgaacgattctttctcgctgatttccttgtcgctgccgattatcaacaatacttcagctgcggatattctgggctatattactgtcgttgcgagcgccgcgaatctgcaggatgcgatgagctctcggcaagggcttggaagctccggtcaagtcctcctgcttgccccttctagaccggaaaatcgtttccctaccggctcccggcctgccacggcaacctcagaaccacagattgctggcttggacaaccaggaagtacggtacgtgttcaggccgactccgttgccagggaacaagagacggcacagtcccgctgtcgcttccggagcatctttccctttgcgcgattatcctatcgcgctcaaggtcttgaaccagccgtacgattcaatcaaccactcaatcaccgatctttcgtcaaagaatgagaatggcacccgtgtcgcggtcggtgcaattcagcagcgatccgacttggtggaatgggtgctaatcatcgaagagacccacggagaggcgtttgccccggtttcccgtcttcgaaaaatcattttggcttgcgtatttggcactgctggcgttattgctctgctcatcccgccgctcgcccatctttcagtagcgcctattcggagactccgcgaggcgactcgaaagtccgttaatcccacaattgggcccttaagtccgtcgttgtcaaccatggttgaccccattgaaatatcaatgcataatggcaacgaaaagagcgagaaaggcggattcttcaaccggctcaaacgaggcagaggcaatttagcaaccggtcatgatcgcgacaacgaaccgcatcagttccaaatccccggccgtgtcaaggagcgtaagcatatcattacggatgaactaaccgacctgacgaagacatttaacgaaatgtccgatgaactcgtgatccagtacaatcgtcttgaggagcgggtggcagagcgaacccgtgagcttgaaaaggccaaaatagcggcagagacagcgaatgagagtaaaactctctttatcgccaatatatctcatgagctcaaaacgccgctgaatgggattcttggtatgtgtgcggtctgcatgggtgaggacgatcttccgcggatcaaaaggtcgcttcagactgtatacaagtcgggcgatttgctgttgcatctattgaatgacctgctcacctttagccggaaccaaattgatcaggccattaggcttgaagaaaaagagttcaagctctcggatatccggtcgcagttacagattatctttcagaaccaggtccaggaaaagcagatatcattcagtatcaagttctgtcatccagacactcctccgatcaatgacactccagaagttatatctcgcgcacctggtccggtatatgggccgccgggaaccgccaaattgaaggacatggtcctatggggagatcagcaccggatcttacagatcctgatcaacctagtgggcaacagtctcaagttcacacctgagcagggcaccgtcgcgatccgcatcaagtgcgtcggcgaggagaagaacccttccgccagcccaagaccggagtcaagagctctctcgcgctggcgatctataggctcatcccatgccagctcgcgtcccaaaacctccctcgaccgtcccagggacggtggagacgaagagacaacacgcccaccgaacttgcgcacgctcatccttcaattcgaagttgaggacactggccccggaattccgcagcacctgcaaaaccgcgtctttgaaccgtttgtgcaaggtgacctccgtctaaatcgcaaatatggtggcacgggcttgggtttgagtatctgctcgcaactggccaggctcatgagaggtcagatacagctaaatagtgagcagggacggggcacgctatttttagtccggatcccgttgggttttgtcaaggaatctcccccaagcaccgccagctcgatgacgagtctagccgggtcgcggacgtcgagcgttttctcgttggatgacctggcgagtgtcactaaggcgccgtctaatcatagcgtcgcatctcaacatgaatcaacgaagagcaatgctgaaatacaggactcacagcctcgcttggttggcttgagtcaaccattctttgcgccgcctgttccgcaagctaaggacaatgggctgaagaagataagagcgttggtagctgaggataatgtggttaaccaggaagtggttctaagaatgctggcgttagaagacgtctatgacgtgactgtggtcaaagacggccaagaggcttatgacaccgtgaaagccaatatggaggagggcaaagtattcgatttgatttttatggatattcagatgccaaacctagacggcattgaaagcacccgtcttatccgtcaaatgggctgttcggcccccatcgtcgcgctgagcgcattctcagaagacagcaatatcaaagattgcatgaactcgggaatggacatgtttatcagcaaaccgattcgacggccggcattgaagcaggtattacggaggtttacccccattcctgaggaagcggagaaaccgcgagatgtgaattttgctctgtaacatatttgggtacattgtgtttttatagtgtttgcaacgcagatttgaagtaaatgaatgagaaatactcacttgcaaaaaaaaaaaaaaaaaa

SEQ ID NO: 6132 - protein, 1070 aa, Emericella nidulans
MRVPIAVQLGLLVLLTALAGLAALAIATWINNYNFVVDVKSQSLQLVASIKSSQITSNLDLLETTSKTIITRILIQSALQRYYAGNTTEENFASSITDVQSALGSRGYLSLYQASIYARNVENGESKARRLLNVTSDEVPEIRLPYDHPNGTAVMLGDEGLGYPPSLYPNLTEDATTNKLYAFDGVPITTNQPLLLGPLATNDSFSLISLSLPIINNTSAADILGYITVVASAANLQDAMSSRQGLGSSGQVLLLAPSRPENRFPTGSRPATATSEPQIAGLDNQEVRYVFRPTPLPGNKRRHSPAVASGASFPLRDYPIALKVLNQPYDSINHSITDLSSKNENGTRVAVGAIQQRSDLVEWVLIIEETHGEAFAPVSRLRKIILACVFGTAGVIALLIPPLAHLSVAPIRRLREATRKSVNPTIGPLSPSLSTMVDPIEISMHNGNEKSEKGGFFNRLKRGRGNLATGHDRDNEPHQFQIPGRVKERKHIITDELTDLTKTFNEMSDELVIQYNRLEERVAERTRELEKAKIAAETANESKTLFIANISHELKTPLNGILGMCAVCMGEDDLPRIKRSLQTVYKSGDLLLHLLNDLLTFSRNQIDQAIRLEEKEFKLSDIRSQLQIIFQNQVQEKQISFSIKFCHPDTPPINDTPEVISRAPGPVYGPPGTAKLKDMVLWGDQHRILQILINLVGNSLKFTPEQGTVAIRIKCVGEEKNPSASPRPESRALSRWRSIGSSHASSRPKTSLDRPRDGGDEETTRPPNLRTLILQFEVEDTGPGIPQHLQNRVFEPFVQGDLRLNRKYGGTGLGLSICSQLARLMRGQIQLNSEQGRGTLFLVRIPLGFVKESPPSTASSMTSLAGSRTSSVFSLDDLASVTKAPSNHSVASQHESTKSNAEIQDSQPRLVGLSQPFFAPPVPQAKDNGLKKIRALVAEDNVVNQEVVLRMLALEDVYDVTVVKDGQEAYDTVKANMEEGKVFDLIFMDIQMPNLDGIESTRLIRQMGCSAPIVALSAFSEDSNIKDCMNSGMDMFISKPIRRPALKQVLRRFTPIPEEAEKPRDVNFAL

SEQ ID NO: 6133 - DNA, 24 bp, Artificial sequence
  primer
atgcgatttggcctgccatcaaaa

SEQ ID NO: 6134 - DNA, 27 bp, Artificial sequence
  primer
tcatttgttatttttctttccctgata

SEQ ID NO: 6135 - protein, 1626 aa, Artificial sequence
  consensus sequence
  Variant (2)..(4): Xaa in position 2 to 4 is any amino acid
  Variant (7)..(13): Xaa in position 7 to 13 is any amino acid
  Variant (14)..(33): Xaa in position 14 to 33 is any or no amino acid
  Variant (35)..(41): Xaa in position 35 to 41 is any amino acid
  Variant (42)..(60): Xaa in position 42 to 60 is any or no amino acid
  Variant (62)..(64): Xaa in position 62 to 64 is any amino acid
  Variant (66)..(67): Xaa in position 66 to 67 is any amino acid
  Variant (69)..(88): Xaa in position 69 to 88 is any amino acid
  Variant (90)..(92): Xaa in position 90 to 92 is any amino acid
  Variant (93)..(93): Xaa in position 93 is any or no amino acid
  Variant (95)..(96): Xaa in position 95 to 96 is any amino acid
  Variant (98)..(102): Xaa in position 98 to 102 is any amino acid
  Variant (104)..(159): Xaa in position 104 to 159 is any amino acid
  Variant (160)..(187): Xaa in position 160 to 187 is any or no amino acid
  Variant (189)..(237): Xaa in position 189 to 237 is any amino acid
  Variant (238)..(265): Xaa in position 238 to 265 is any or no amino acid
  Variant (267)..(268): Xaa in position 267 to 268 is any amino acid
  Variant (270)..(273): Xaa in position 270 to 273 is any amino acid
  Variant (275)..(286): Xaa in position 275 to 286 is any amino acid
  Variant (287)..(331): Xaa in position 287 to 331 is any or no amino acid
  Variant (333)..(402): Xaa in position 333 to 402 is any amino acid
  Variant (403)..(442): Xaa in position 403 to 442 is any or no amino acid
  Variant (444)..(444): Xaa in position 444 is any amino acid
  Variant (446)..(455): Xaa in position 446 to 455 is any amino acid
  Variant (456)..(459): Xaa in position 456 to 459 is any or no amino acid
  Variant (461)..(473): Xaa in position 461 to 473 is any amino acid
  Variant (475)..(477): Xaa in position 475 to 477 is any amino acid
  Variant (479)..(480): Xaa in position 479 to 480 is any amino acid
  Variant (482)..(485): Xaa in position 482 to 485 is any amino acid
  Variant (487)..(498): Xaa in position 487 to 498 is any amino acid
  Variant (500)..(500): Xaa in position 500 is any amino acid
  Variant (502)..(506): Xaa in position 502 to 506 is any amino acid
  Variant (509)..(510): Xaa in position 509 to 510 is any amino acid
  Variant (512)..(513): Xaa in position 512 to 513 is any amino acid
  Variant (516)..(591): Xaa in position 516 to 591 is any amino acid
  Variant (592)..(665): Xaa in position 592 to 665 is any or no amino acid
  Variant (669)..(670): Xaa in position 669 to 670 is any amino acid
  Variant (673)..(673): Xaa in position 673 is any amino acid
  Variant (677)..(677): Xaa in position 677 is any amino acid
  Variant (679)..(680): Xaa in position 679 to 680 is any amino acid
  Variant (683)..(685): Xaa in position 683 to 685 is any amino acid
  Variant (687)..(688): Xaa in position 687 to 688 is any amino acid
  Variant (691)..(692): Xaa in position 691 to 692 is any amino acid
  Variant (694)..(695): Xaa in position 694 to 695 is any amino acid
  Variant (698)..(699): Xaa in position 698 to 699 is any amino acid
  Variant (702)..(703): Xaa in position 702 to 703 is any amino acid
  Variant (705)..(706): Xaa in position 705 to 706 is any amino acid
  Variant (709)..(709): Xaa in position 709 is any amino acid
  Variant (713)..(713): Xaa in position 713 is any amino acid
  Variant (716)..(716): Xaa in position 716 is any amino acid
  Variant (726)..(726): Xaa in position 726 is any amino acid
  Variant (736)..(736): Xaa in position 736 is any amino acid
  Variant (738)..(739): Xaa in position 738 to 739 is any amino acid
  Variant (741)..(741): Xaa in position 741 is any amino acid
  Variant (743)..(743): Xaa in position 743 is any amino acid
  Variant (745)..(750): Xaa in position 745 to 750 is any amino acid
  Variant (753)..(757): Xaa in position 753 to 757 is any amino acid
  Variant (760)..(760): Xaa in position 760 is any amino acid
  Variant (765)..(765): Xaa in position 765 is any amino acid
  Variant (767)..(768): Xaa in position 767 to 768 is any amino acid
  Variant (774)..(774): Xaa in position 774 is any amino acid
  Variant (776)..(781): Xaa in position 776 to 781 is any amino acid
  Variant (782)..(782): Xaa in position 782 is any or no amino acid
  Variant (784)..(787): Xaa in position 784 to 787 is any amino acid
  Variant (789)..(795): Xaa in position 789 to 795 is any amino acid
  Variant (797)..(799): Xaa in position 797 to 799 is any amino acid
  Variant (802)..(822): Xaa in position 802 to 822 is any amino acid
  Variant (823)..(856): Xaa in position 823 to 856 is any or no amino acid
  Variant (858)..(858): Xaa in position 858 is any amino acid
  Variant (861)..(862): Xaa in position 861 to 862 is any amino acid
  Variant (865)..(865): Xaa in position 865 is any amino acid
  Variant (867)..(869): Xaa in position 867 to 869 is any amino acid
  Variant (873)..(873): Xaa in position 873 is any amino acid
  Variant (875)..(875): Xaa in position 875 is any amino acid
  Variant (881)..(882): Xaa in position 881 to 882 is any amino acid
  Variant (884)..(884): Xaa in position 884 is any amino acid
  Variant (886)..(893): Xaa in position 886 to 893 is any amino acid
  Variant (895)..(952): Xaa in position 895 to 952 is any amino acid
  Variant (953)..(1211): Xaa in position 953 to 1211 is any or no amino acid
  Variant (1214)..(1214): Xaa in position 1214 is any amino acid
  Variant (1216)..(1216): Xaa in position 1216 is any amino acid
  Variant (1221)..(1222): Xaa in position 1221 to 1222 is any amino acid
  Variant (1223)..(1228): Xaa in position 1223 to 1228 is any or no amino acid
  Variant (1230)..(1230): Xaa in position 1230 is any amino acid
  Variant (1237)..(1238): Xaa in position 1237 to 1238 is any amino acid
  Variant (1240)..(1243): Xaa in position 1240 to 1243 is any amino acid
  Variant (1254)..(1254): Xaa in position 1254 is any amino acid
  Variant (1258)..(1259): Xaa in position 1258 to 1259 is any amino acid
  Variant (1261)..(1261): Xaa in position 1261 is any amino acid
  Variant (1263)..(1265): Xaa in position 1263 to 1265 is any amino acid
  Variant (1267)..(1267): Xaa in position 1267 is any amino acid
  Variant (1269)..(1270): Xaa in position 1269 to 1270 is any amino acid
  Variant (1272)..(1272): Xaa in position 1272 is any amino acid
  Variant (1274)..(1274): Xaa in position 1274 is any amino acid
  Variant (1275)..(1275): Xaa in position 1275 is any or no amino acid
  Variant (1277)..(1280): Xaa in position 1277 to 1280 is any amino acid
  Variant (1283)..(1337): Xaa in position 1283 to 1337 is any amino acid
  Variant (1338)..(1427): Xaa in position 1338 to 1427 is any or no amino acid
  Variant (1429)..(1432): Xaa in position 1429 to 1432 is any amino acid
  Variant (1434)..(1448): Xaa in position 1434 to 1448 is any amino acid
  Variant (1449)..(1486): Xaa in position 1449 to 1486 is any or no amino acid
  Variant (1493)..(1494): Xaa in position 1493 to 1494 is any amino acid
  Variant (1496)..(1496): Xaa in position 1496 is any amino acid
  Variant (1499)..(1500): Xaa in position 1499 to 1500 is any amino acid
  Variant (1502)..(1516): Xaa in position 1502 to 1516 is any amino acid
  Variant (1517)..(1518): Xaa in position 1517 to 1518 is any or no amino acid
  Variant (1521)..(1521): Xaa in position 1521 is any amino acid
  Variant (1524)..(1532): Xaa in position 1524 to 1532 is any amino acid
  Variant (1535)..(1536): Xaa in position 1535 to 1536 is any amino acid
  Variant (1538)..(1540): Xaa in position 1538 to 1540 is any amino acid
  Variant (1542)..(1553): Xaa in position 1542 to 1553 is any amino acid
  Variant (1558)..(1558): Xaa in position 1558 is any amino acid
  Variant (1560)..(1566): Xaa in position 1560 to 1566 is any amino acid
  Variant (1569)..(1570): Xaa in position 1569 to 1570 is any amino acid
  Variant (1573)..(1575): Xaa in position 1573 to 1575 is any amino acid
  Variant (1577)..(1578): Xaa in position 1577 to 1578 is any amino acid
  Variant (1581)..(1586): Xaa in position 1581 to 1586 is any amino acid
  Variant (1587)..(1587): Xaa in position 1587 is any or no amino acid
  Variant (1593)..(1593): Xaa in position 1593 is any amino acid
  Variant (1595)..(1598): Xaa in position 1595 to 1598 is any amino acid
  Variant (1601)..(1601): Xaa in position 1601 is any amino acid
  Variant (1603)..(1603): Xaa in position 1603 is any amino acid
  Variant (1605)..(1607): Xaa in position 1605 to 1607 is any amino acid
  Variant (1610)..(1611): Xaa in position 1610 to 1611 is any amino acid
  Variant (1613)..(1614): Xaa in position 1613 to 1614 is any amino acid
  Variant (1618)..(1618): Xaa in position 1618 is any amino acid
  Variant (1621)..(1621): Xaa in position 1621 is any amino acid
  Variant (1624)..(1625): Xaa in position 1624 to 1625 is any amino acid
QXXXLVXXXXXXXXXXXXXXXXXXXXXXXXXXXLXXXXXXXXXXXXXXXXXXXXXXXXXXLXXXAXXKXXXXXXXXXXXXXXXXXXXXRXXXXQXXLXXXXXGXXXXXXXXXXXXXXXXXXXXXXXXXXXXXXXXXXXXXXXXXXXXXXXXXXXXXXXXXXXXXXXXXXXXXXXXXXXXXXXXXXXXPXXXXXXXXXXXXXXXXXXXXXXXXXXXXXXXXXXXXXXXXXXXXXXXXXXXXXXXXXXXXXXXXXXXXXXXXXXXXXGXXTXXXXAXXXXXXXXXXXXXXXXXXXXXXXXXXXXXXXXXXXXXXXXXXXXXXXXXXXXXXXXXLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXAXGXXXXXXXXXXXXXXWXXXXXXXXXXXXXPXXXLXXIXXXXVXXXXXXXXXXXXPXAXXXXXPIXXLXXATXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXDELXXLTXTFNXMXXELXXXYXXLEXXVXXRTXXLEXXKXXAEXANEXKTXFIANISHELXTPLNGILGMXAXXMXEXDXXXXXXSLXXXXXSGXLLLHXLXXLLTFSXNXXXXXXXLXXXXFXXXXXXXQXXXIFXXXXXXXXXXXXXXXXXXXXXXXXXXXXXXXXXXXXXXXXXXXXXXXXXXXXXXXLXGDXXRIXQXXXNLVXNXLKFTPXXGXVXXXXXXXXEXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXEVXDXGPGIXXXXXXXXFXPFVQGDXXLXXXXGGTGLGLSICXQLAXXMXGXXXLXSXXGXGXXFXXXXPLXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXVXXXXPXXXXXXXXXXXXXXXXXXXXXXXXXXXXXXXXXXXXXXXXXXXXXXXXXXXXXLVAEDNXXNXEVXXRXXXXXXXXXXXXXXXXXMLXLEXXXXXXXXXDGXXAXXXVXXXXXXXXXXXXIFMDXQXXXXXXXMPXXDGXXXTXXIRXXXXXXXPIVALXAXXXXSNXKXCXXXGMXXFXXKPIXRPXLKXXL

SEQ ID NO: 6136 - protein, 58 aa, Artificial sequence
  protein pattern
  Variant (2)..(7): Xaa in position 2 to 7 is any amino acid
  Variant (8)..(9): Xaa in position 8 to 9 is any or no amino acid
  Variant (12)..(12): Xaa in position 12 is any amino acid
  Variant (13)..(13): Xaa in position 13 is Glu or Gln
  Variant (15)..(15): Xaa in position 15 is Glu or Gln
  Variant (16)..(16): Xaa in position 16 is any amino acid
  Variant (17)..(17): Xaa in position 17 is Ala or Ser
  Variant (19)..(19): Xaa in position 19 is any amino acid
  Variant (20)..(20): Xaa in position 20 is Ala, Glu or Gln
  Variant (23)..(23): Xaa in position 23 is Ala, Ser or Thr
  Variant (27)..(27): Xaa in position 27 is Ala or Ser
  Variant (30)..(30): Xaa in position 30 is Leu or Val
  Variant (40)..(40): Xaa in position 40 is Lys or Arg
  Variant (47)..(47): Xaa in position 47 is Leu or Met
  Variant (50)..(50): Xaa in position 50 is Cys or Thr
  Variant (51)..(51): Xaa in position 51 is Ala or Ser
  Variant (52)..(52): Xaa in position 52 is Ile or Val
  Variant (53)..(53): Xaa in position 53 is Ala, Cys or Ser
  Variant (55)..(55): Xaa in position 55 is Ala, Glu, Gly or Ser
  Variant (57)..(57): Xaa in position 57 is Asp, Glu, Asn or Thr
LXXXXXXXXRTXXLXXXKXXAEXANEXKTXFIANISHELXTPLNGIXGMXXXXMXEXD

SEQ ID NO: 6137 - protein, 38 aa, Artificial sequence
  protein pattern
  Variant (2)..(2): Xaa in position 2 is Glu or His
  Variant (3)..(3): Xaa in position 3 is Leu or Pro
  Variant (8)..(8): Xaa in position 8 is Asp or Glu
  Variant (9)..(10): Xaa in position 9 to 10 is any amino acid
  Variant (12)..(12): Xaa in position 12 is Asn or Ser
  Variant (13)..(13): Xaa in position 13 is Lys or Arg
  Variant (14)..(14): Xaa in position 14 is any amino acid
  Variant (15)..(15): Xaa in position 15 is Phe, His or Tyr
  Variant (26)..(26): Xaa in position 26 is any amino acid
  Variant (29)..(29): Xaa in position 29 is any or no amino acid
  Variant (31)..(31): Xaa in position 31 is any amino acid
  Variant (32)..(32): Xaa in position 32 is any or no amino acid
  Variant (34)..(34): Xaa in position 34 is any amino acid
  Variant (35)..(35): Xaa in position 35 is any or no amino acid
  Variant (37)..(37): Xaa in position 37 is any amino acid
  Variant (38)..(38): Xaa in position 38 is Ile, Leu or Met
FXXFVQGXXXLXXXXGGTGLGLSICXQLXAXXMXXGXX

SEQ ID NO: 6138 - protein, 35 aa, Artificial sequence
  protein pattern
  Variant (5)..(5): Xaa in position 5 is Ser or Thr
  Variant (7)..(7): Xaa in position 7 is Phe or Tyr
  Variant (8)..(8): Xaa in position 8 is Ala, Asn or Ser
  Variant (9)..(10): Xaa in position 9 to 10 is Asp or Glu
  Variant (11)..(11): Xaa in position 11 is Glu or Ser
  Variant (13)..(13): Xaa in position 13 is Ala, Ile or Val
  Variant (15)..(15): Xaa in position 15 is any amino acid
  Variant (17)..(17): Xaa in position 17 is any amino acid
  Variant (18)..(18): Xaa in position 18 is Asp, Glu or Asn
  Variant (19)..(19): Xaa in position 19 is Ala or Ser
  Variant (22)..(22): Xaa in position 22 is Asp, Asn or Ser
  Variant (23)..(23): Xaa in position 23 is any amino acid
  Variant (25)..(25): Xaa in position 25 is Ile or Leu
  Variant (26)..(26): Xaa in position 26 is Ala, Pro or Ser
  Variant (30)..(30): Xaa in position 30 is any or no amino acid
  Variant (32)..(32): Xaa in position 32 is Pro or Ser
  Variant (33)..(33): Xaa in position 33 is any amino acid
  Variant (35)..(35): Xaa in position 35 is His or Lys
IVALXAXXXXXNXKXCXXXGMXXFXXKPIXRXXLX

SEQ ID NO: 6139 - protein, 59 aa, Artificial sequence
  protein pattern
  Variant (2)..(2): Xaa in position 2 is any or no amino acid
  Variant (4)..(4): Xaa in position 4 is any amino acid
  Variant (5)..(5): Xaa in position 5 is Thr or Val
  Variant (7)..(7): Xaa in position 7 is any amino acid
  Variant (8)..(8): Xaa in position 8 is Glu or Gln
  Variant (10)..(10): Xaa in position 10 is Ile, Met or Val
  Variant (11)..(11): Xaa in position 11 is any amino acid
  Variant (12)..(12): Xaa in position 12 is Lys or Arg
  Variant (15)..(16): Xaa in position 15 to 16 is any amino acid
  Variant (18)..(18): Xaa in position 18 is any amino acid
  Variant (19)..(19): Xaa in position 19 is Ile, Leu or Val
  Variant (20)..(21): Xaa in position 20 to 21 is any amino acid
  Variant (22)..(22): Xaa in position 22 is Ile, Leu or Val
  Variant (23)..(23): Xaa in position 23 is any amino acid
  Variant (24)..(24): Xaa in position 24 is Ile, Leu, Met or Val
  Variant (25)..(25): Xaa in position 25 is Ala or Val
  Variant (26)..(26): Xaa in position 26 is any amino acid
  Variant (27)..(27): Xaa in position 27 is Asp or Asn
  Variant (29)..(30): Xaa in position 29 to 30 is any amino acid
  Variant (32)..(32): Xaa in position 32 is any amino acid
  Variant (33)..(33): Xaa in position 33 is Ala, Asp or Glu
  Variant (34)..(34): Xaa in position 34 is any amino acid
  Variant (36)..(36): Xaa in position 36 is any amino acid
  Variant (37)..(37): Xaa in position 37 is Ala, Glu or Ser
  Variant (38)..(44): Xaa in position 38 to 44 is any amino acid
  Variant (45)..(45): Xaa in position 45 is Phe or Tyr
  Variant (46)..(46): Xaa in position 46 is Asp, Asn or Ser
  Variant (47)..(47): Xaa in position 47 is Leu, Met or Val
  Variant (48)..(48): Xaa in position 48 is Ile or Val
  Variant (52)..(52): Xaa in position 52 is Ile or Val
  Variant (56)..(56): Xaa in position 56 is any amino acid
  Variant (57)..(57): Xaa in position 57 is Leu, Met or Val
DXNXXNXXVXXXMLXXEXXXXXXXXXXGXXAXXXVXXXXXXXXXXXXXFMDXQMPXXDG

SEQ ID NO: 6140 - protein, 40 aa, Artificial sequence
  protein pattern
  Variant (2)..(3): Xaa in position 2 to 3 is any amino acid
  Variant (4)..(5): Xaa in position 4 to 5 is any or no amino acid
  Variant (7)..(7): Xaa in position 7 is Gln or Ser
  Variant (8)..(8): Xaa in position 8 is any amino acid
  Variant (11)..(11): Xaa in position 11 is Ile or Leu
  Variant (13)..(13): Xaa in position 13 is Ile or Val
  Variant (14)..(14): Xaa in position 14 is Ile, Leu or Val
  Variant (15)..(15): Xaa in position 15 is Ile or Met
  Variant (19)..(19): Xaa in position 19 is Gly or Ser
  Variant (21)..(21): Xaa in position 21 is Ala or Ser
  Variant (25)..(25): Xaa in position 25 is any amino acid
  Variant (27)..(27): Xaa in position 27 is any amino acid
  Variant (28)..(28): Xaa in position 28 is Asp, Gly, Asn or Gln
  Variant (30)..(30): Xaa in position 30 is any amino acid
  Variant (32)..(32): Xaa in position 32 is Ala, Asp, Glu, Asn, Gln, Ser or Thr
  Variant (33)..(33): Xaa in position 33 is Ile, Leu or Val
  Variant (34)..(34): Xaa in position 34 is any amino acid
  Variant (35)..(35): Xaa in position 35 is Phe, Ile or Met
  Variant (36)..(36): Xaa in position 36 is Lys or Arg
  Variant (37)..(37): Xaa in position 37 is any amino acid
  Variant (38)..(38): Xaa in position 38 is Leu, Pro or Val
  Variant (39)..(39): Xaa in position 39 is Glu or Gly
LXXXXDXXRIXQXXXNLVXNXLKFXPXXGXVXXXXXXXXE

SEQ ID NO: 6141 - protein, 31 aa, Artificial sequence
  protein pattern
  Variant (2)..(2): Xaa in position 2 is any amino acid
  Variant (3)..(4): Xaa in position 3 to 4 is any or no amino acid
  Variant (7)..(8): Xaa in position 7 to 8 is any amino acid
  Variant (9)..(9): Xaa in position 9 is Ile, Leu or Val
  Variant (10)..(10): Xaa in position 10 is Phe or Tyr
  Variant (11)..(11): Xaa in position 11 is Lys or Arg
  Variant (14)..(14): Xaa in position 14 is Asp or Glu
  Variant (18)..(18): Xaa in position 18 is any amino acid
  Variant (19)..(19): Xaa in position 19 is any or no amino acid
  Variant (21)..(21): Xaa in position 21 is any amino acid
  Variant (22)..(22): Xaa in position 22 is Asp or Glu
  Variant (25)..(25): Xaa in position 25 is Ser or Thr
  Variant (28)..(28): Xaa in position 28 is Lys or Arg
  Variant (29)..(29): Xaa in position 29 is Asn or Ser
  Variant (30)..(30): Xaa in position 30 is any amino acid
  Variant (31)..(31): Xaa in position 31 is Ile, Leu or Val
KXXXSLXXXXXSGXLLLXXLXXLLXFSXXXX

SEQ ID NO: 6142 - protein, 29 aa, Artificial sequence
  protein pattern
  Variant (2)..(5): Xaa in position 2 to 5 is any amino acid
  Variant (6)..(12): Xaa in position 6 to 12 is any or no amino acid
  Variant (16)..(16): Xaa in position 16 is Ser or Thr
  Variant (17)..(17): Xaa in position 17 is Asp or Glu
  Variant (20)..(20): Xaa in position 20 is any amino acid
  Variant (24)..(24): Xaa in position 24 is Ala, Asp, Glu or Thr
  Variant (26)..(26): Xaa in position 26 is Ser or Thr
  Variant (27)..(27): Xaa in position 27 is Asp or Glu
  Variant (28)..(28): Xaa in position 28 is Ala or Glu
PXXXXXXXXXXXDELXXLTXTFNXMXXXL

SEQ ID NO: 6143 - protein, 28 aa, Artificial sequence
  protein pattern
  Variant (2)..(4): Xaa in position 2 to 4 is any or no amino acid
  Variant (6)..(9): Xaa in position 6 to 9 is any amino acid
  Variant (10)..(10): Xaa in position 10 is Ala, Asp, Glu or Ser
  Variant (11)..(11): Xaa in position 11 is Ala, Pro or Val
  Variant (12)..(14): Xaa in position 12 to 14 is any amino acid
  Variant (15)..(15): Xaa in position 15 is Ile, Leu or Val
  Variant (16)..(17): Xaa in position 16 to 17 is any amino acid
  Variant (18)..(18): Xaa in position 18 is Ile or Leu
  Variant (19)..(20): Xaa in position 19 to 20 is any amino acid
  Variant (21)..(21): Xaa in position 21 is Gly, Ile or Val
  Variant (22)..(22): Xaa in position 22 is any amino acid
  Variant (23)..(23): Xaa in position 23 is Ile, Leu or Val
  Variant (24)..(24): Xaa in position 24 is any amino acid
  Variant (25)..(25): Xaa in position 25 is Ala, Cys, Gly or Thr
  Variant (26)..(26): Xaa in position 26 is Ala, Ile or Val
  Variant (27)..(27): Xaa in position 27 is any amino acid
  Variant (28)..(28): Xaa in position 28 is Gly or Val
VXXXEXXXXXXXXXXXXXXXXXXXXXXX

SEQ ID NO: 6144 - protein, 40 aa, Artificial sequence
  protein pattern
  Variant (2)..(2): Xaa in position 2 is any amino acid
  Variant (3)..(4): Xaa in position 3 to 4 is any or no amino acid
  Variant (6)..(7): Xaa in position 6 to 7 is Ala or Ser
  Variant (8)..(8): Xaa in position 8 is Gln or Arg
  Variant (9)..(9): Xaa in position 9 is Ile, Leu or Val
  Variant (10)..(10): Xaa in position 10 is Ala, Asp, Ser or Thr
  Variant (11)..(12): Xaa in position 11 to 12 is any amino acid
  Variant (13)..(13): Xaa in position 13 is Ile or Leu
  Variant (14)..(15): Xaa in position 14 to 15 is any amino acid
  Variant (16)..(16): Xaa in position 16 is Ile, Leu or Met
  Variant (17)..(22): Xaa in position 17 to 22 is any amino acid
  Variant (23)..(23): Xaa in position 23 is Ala, Ile or Leu
  Variant (24)..(24): Xaa in position 24 is any amino acid
  Variant (25)..(25): Xaa in position 25 is Asn, Ser or Thr
  Variant (27)..(28): Xaa in position 27 to 28 is any amino acid
  Variant (29)..(29): Xaa in position 29 is Ile, Leu, Pro or Val
  Variant (31)..(32): Xaa in position 31 to 32 is any amino acid
  Variant (34)..(34): Xaa in position 34 is any amino acid
  Variant (35)..(35): Xaa in position 35 is Asp, Asn, Arg or Ser
  Variant (36)..(38): Xaa in position 36 to 38 is any amino acid
  Variant (39)..(39): Xaa in position 39 is Gly or Thr
  Variant (40)..(40): Xaa in position 40 is Ala, Gly, Asn or Ser
AXXXKXXXXXXXXXXXXXXXXXXXXRXXXQXXLXXXXXXX

SEQ ID NO: 6145 - protein, 17 aa, Artificial sequence
  protein pattern
  Variant (2)..(3): Xaa in position 2 to 3 is any amino acid
  Variant (4)..(4): Xaa in position 4 is Ala, Ser or Val
  Variant (5)..(5): Xaa in position 5 is Ser or Val
  Variant (6)..(6): Xaa in position 6 is any amino acid
  Variant (9)..(9): Xaa in position 9 is any or no amino acid
  Variant (11)..(11): Xaa in position 11 is any or no amino acid
  Variant (13)..(14): Xaa in position 13 to 14 is any amino acid
  Variant (17)..(17): Xaa in position 17 is Asp, Glu, Lys or Arg
AXXXXXPIXRXLXXATX

SEQ ID NO: 6146 - protein, 26 aa, Artificial sequence
  protein pattern
  Variant (2)..(2): Xaa in position 2 is any or no amino acid
  Variant (4)..(5): Xaa in position 4 to 5 is any amino acid
  Variant (6)..(6): Xaa in position 6 is any or no amino acid
  Variant (8)..(8): Xaa in position 8 is any amino acid
  Variant (9)..(9): Xaa in position 9 is Ile, Leu or Val
  Variant (10)..(10): Xaa in position 10 is any amino acid
  Variant (11)..(11): Xaa in position 11 is Asp or Glu
  Variant (12)..(12): Xaa in position 12 is Ile or Val
  Variant (13)..(14): Xaa in position 13 to 14 is any amino acid
  Variant (16)..(17): Xaa in position 16 to 17 is any amino acid
  Variant (18)..(18): Xaa in position 18 is any or no amino acid
  Variant (21)..(21): Xaa in position 21 is Asp, Gly or Gln
  Variant (22)..(23): Xaa in position 22 to 23 is any amino acid
  Variant (24)..(24): Xaa in position 24 is Ala, Cys or Val
  Variant (25)..(25): Xaa in position 25 is any amino acid
  Variant (26)..(26): Xaa in position 26 is Asp or Glu
LXEXXXFXXXXXXXQXXXIFXXXXXX

SEQ ID NO: 6147 - protein, 12 aa, Artificial sequence
  protein pattern
  Variant (2)..(2): Xaa in position 2 is Phe or Val
  Variant (4)..(5): Xaa in position 4 to 5 is any or no amino acid
  Variant (7)..(7): Xaa in position 7 is Asn, Ser or Thr
  Variant (9)..(9): Xaa in position 9 is Pro or Ser
  Variant (12)..(12): Xaa in position 12 is Ala, Asp or Pro
EXEXXDXGXGIX

SEQ ID NO: 6148 - protein, 26 aa, Artificial sequence
  protein pattern
  Variant (2)..(3): Xaa in position 2 to 3 is any amino acid
  Variant (4)..(5): Xaa in position 4 to 5 is any or no amino acid
  Variant (7)..(7): Xaa in position 7 is Leu or Met
  Variant (8)..(9): Xaa in position 8 to 9 is any amino acid
  Variant (10)..(10): Xaa in position 10 is Ala, Ile or Leu
  Variant (12)..(12): Xaa in position 12 is any amino acid
  Variant (13)..(13): Xaa in position 13 is Phe, Ile, Leu or Val
  Variant (14)..(14): Xaa in position 14 is Ala, Thr or Val
  Variant (15)..(17): Xaa in position 15 to 17 is any amino acid
  Variant (18)..(18): Xaa in position 18 is Ala, Cys, Gly or Ser
  Variant (20)..(20): Xaa in position 20 is Ala, Gly, Ile or Leu
  Variant (21)..(21): Xaa in position 21 is Ala, Ile, Leu or Val
  Variant (22)..(22): Xaa in position 22 is Ile, Leu or Val
  Variant (23)..(23): Xaa in position 23 is Ala, Gly or Ser
  Variant (24)..(24): Xaa in position 24 is Ile or Val
  Variant (25)..(25): Xaa in position 25 is any amino acid
  Variant (26)..(26): Xaa in position 26 is Thr or Val
IXXXXQXXXXVXXXXXXXLXXXXXXX

SEQ ID NO: 6149 - protein, 21 aa, Artificial sequence
  protein pattern
  Variant (2)..(2): Xaa in position 2 is any amino acid
  Variant (4)..(5): Xaa in position 4 to 5 is any amino acid
  Variant (7)..(7): Xaa in position 7 is any amino acid
  Variant (9)..(9): Xaa in position 9 is Ala, Ser or Thr
  Variant (10)..(10): Xaa in position 10 is any amino acid
  Variant (12)..(12): Xaa in position 12 is any amino acid
  Variant (13)..(13): Xaa in position 13 is Phe, Leu, Met or Val
  Variant (14)..(14): Xaa in position 14 is any amino acid
  Variant (15)..(15): Xaa in position 15 is Ile, Leu or Val
  Variant (18)..(20): Xaa in position 18 to 20 is any or no amino acid
LXSXXGXGXXFXXXXPLXXXK

SEQ ID NO: 6150 - DNA, 1122 bp, Saccharomyces cerevisiae
  CDS (1)..(1122)
atggctgccgtcacattacatctaagagctgaaactaaacccctagaggcacgtgctgccttaacacctaccacggttaaaaaactgatagctaagggcttcaaaatatatgtagaggacagtccacaatctactttcaatattaacgaatatcgtcaagcaggtgccattatagtgcctgcaggttcatggaaaaccgctccacgcgacagaatcattataggtttgaaggaaatgcctgaaaccgatactttccctctagtccacgaacacatccagtttgctcactgctacaaagaccaagctgggtggcaaaatgtccttatgagatttattaagggacacggtactctatatgatttggaatttttggaaaatgaccaaggtagaagagttgctgcctttggattttacgctgggttcgcaggtgcagcccttggtgtaagagactgggcattcaagcaaacgcattctgacgatgaagacttgcctgcagtgtcgccttaccccaatgaaaaggcattggttaaagatgttaccaaagattataaagaagccttagccaccggagccagaaagccaaccgtgttaatcattggtgcgctaggaagatgtggttccggtgccatcgatctgttgcacaaagttggtattccagatgctaacatattaaaatgggatatcaaagaaacttcccgtggtggtccctttgacgaaattccacaagctgatatttttatcaattgtatatatctatcgaagccaattgctcctttcactaacatggagaaactgaataatcctaacagaagactaaggaccgtggtggacgtatcagcagacactaccaaccctcacaaccccatcccaatatacactgtggctactgtgtttaacaaacctaccgttctggtacctaccactgccgggcctaaattatctgtcatctctattgatcacttgccttctttgctgccaagagaagcttcagaatttttctctcatgatctcttaccatctttagagctcctacctcaaagaaaaactgctcctgtctgggttagagccaagaaattgttcgatagacattgcgctcgtgttaaaagatcttcaagattgtag

SEQ ID NO: 6151 - protein, 373 aa, Saccharomyces cerevisiae
MAAVTLHLRAETKPLEARAALTPTTVKKLIAKGFKIYVEDSPQSTFNINEYRQAGAIIVPAGSWKTAPRDRIIIGLKEMPETDTFPLVHEHIQFAHCYKDQAGWQNVLMRFIKGHGTLYDLEFLENDQGRRVAAFGFYAGFAGAALGVRDWAFKQTHSDDEDLPAVSPYPNEKALVKDVTKDYKEALATGARKPTVLIIGALGRCGSGAIDLLHKVGIPDANILKWDIKETSRGGPFDEIPQADIFINCIYLSKPIAPFTNMEKLNNPNRRLRTVVDVSADTTNPHNPIPIYTVATVFNKPTVLVPTTAGPKLSVISIDHLPSLLPREASEFFSHDLLPSLELLPQRKTAPVWVRAKKLFDRHCARVKRSSRL

SEQ ID NO: 6152 - DNA, 1110 bp, Streptomyces avermitilis MA-4680
  CDS (1)..(1110): transl_table=11
atgacccagctccacttgtggctgcgccacgagtcccgtacgaccgagcggcgcacgcccgtcgtaccgtccgacgcccgacggctcgtcgagagcggggtgcggctgaccgtggaggactcaccgcagcggatctttccgaccgaggcgtacgaggcggtgggctgcgagatcgccgaggcgggctcatgggtgtcggcgccaccggacgccgtgatcgtcggcctcaaggaactcccggacgagcccgccgaactggttcaccggcatgtcttcttcgggcacgcgtacaagcggcagcccggagccgaggcgctgctgcgcaggttcgcggccggcggcggggccctgttcgacctcgagtacctggtggacgacgacggacgccggctggccgcgttcggctactgggccggatacctgggggcggcgctcgccgtgctccaccaccggggcggcctcggcaccccgctgcggccgacgtcgaaggaggagctggaggcggaactccgctcctccgagggtgagttgacggcgctggtcatcggggccctgggccgcagcggccggggcgcccgcgtggccctcggcgaggccggcgtcgaacccacctgctgggacctggccgagacgcgcgatctcgaccgaccggttctcctggagcacgagttgctggtcaacaccgtgctcaccacccggccgatcccgccgttcctcacggacaaggacctggacgagccgggccgtcggctgcggacgctcgcggacgtcaccgtcgacgtcggatcgcccctgaacgtcctgccggtctacgacacgaccaccgactgggcgcaccccgtccgccgcctccgcgaggcgccgccgctcgacctcatcgcgatcgacaacctgccgtccctgctgccccgggaggcgagcacggacttctcggcggcactgctgccgtcgctgctcgacttcggcaccgctgaatcccggggacggtccggcggacccggggtacggtccggcggaccgtggggacggtgcctggaccgcttccacgaggcctgccgtgaactcggcatcgaactcggcaccgacgacacggaggtccgcgatgtctga

SEQ ID NO: 6153 - protein, 369 aa, Streptomyces avermitilis MA-4680
MTQLHLWLRHESRTTERRTPVVPSDARRLVESGVRLTVEDSPQRIFPTEAYEAVGCEIAEAGSWVSAPPDAVIVGLKELPDEPAELVHRHVFFGHAYKRQPGAEALLRRFAAGGGALFDLEYLVDDDGRRLAAFGYWAGYLGAALAVLHHRGGLGTPLRPTSKEELEAELRSSEGELTALVIGALGRSGRGARVALGEAGVEPTCWDLAETRDLDRPVLLEHELLVNTVLTTRPIPPFLTDKDLDEPGRRLRTLADVTVDVGSPLNVLPVYDTTTDWAHPVRRLREAPPLDLIAIDNLPSLLPREASTDFSAALLPSLLDFGTAESRGRSGGPGVRSGGPWGRCLDRFHEACRELGIELGTDDTEVRDV

SEQ ID NO: 6154 - DNA, 1098 bp, Magnaporthe grisea 70-15
  CDS (1)..(1098)
atgtcgtccattctgcacttgcggtcagagaccaagccattggagcaccggtccgccctaactcccactaccaccaaggccttgattgaggccggttacaccgtcaatgtcgagcgcagtcccgtccgcatcttcgacgacgccgagttcgaggctgttggcgcaaccctcgtccccgagggcagctgggagcagattcccaaggaccacatcgtcattggactgaaggagttggaggagaaggacttccctttgaagcacacacacatccagttcgcccactgctacaagaaccaaggaggctgggacaaggtcctccggaggtatcacgatggcgagggaatgctcctcgacattgagttcctcgagaaggacggccgtcgtgttgctgctttcggctactgggccggctttgccggtgccgcgctggcccttcagaactgggcctggcagctgaccaacagcggcgagcccctgccgagcgtcgagagccgccctaacgaggctgccttggtcggcgacatcaaggaggctcttgctgggggcaaggaaaaggccggcaggctgccccgcgtcatcgtcatcggtgccctgggccgctgcggtcgtggtgccgtcgacatgtgcaagaaggccggcataccggatgagaacatcctcaagtgggatatggaggagacggcccccggtggaccgttcaaggagattgtcgagagtgacatctttgtcaactgcatctacctgaacaagcagatcccgccgtttgtgaccatggagtcgctcaacacgccagagcgcaagctctccgtcatcaacgactgctcggctgacacgaccaacccctttaaccctgttcccgtgtacactgtggccacgactttcgacaagcccactgtgccggtcgatggcttgagccatggcccgcccctgagcgttatcagcatcgaccacctgccgagtctgctcccgcgggaggcttcggagtcgttcagcaacgacttgttgccatatctcctgaagctgaaggactggaagagtgacccggtgtgggctggcgccgagaagctgttccacgagaaggtcaagaccctgccgtag

SEQ ID NO: 6155 - protein, 365 aa, Magnaporthe grisea 70-15
MSSILHLRSETKPLEHRSALTPTTTKALIEAGYTVNVERSPVRIFDDAEFEAVGATLVPEGSWEQIPKDHIVIGLKELEEKDFPLKHTHIQFAHCYKNQGGWDKVLRRYHDGEGMLLDIEFLEKDGRRVAAFGYWAGFAGAALALQNWAWQLTNSGEPLPSVESRPNEAALVGDIKEALAGGKEKAGRLPRVIVIGALGRCGRGAVDMCKKAGIPDENILKWDMEETAPGGPFKEIVESDIFVNCIYLNKQIPPFVTMESLNTPERKLSVINDCSADTTNPFNPVPVYTVATTFDKPTVPVDGLSHGPPLSVISIDHLPSLLPREASESFSNDLLPYLLKLKDWKSDPVWAGAEKLFHEKVKTLP

SEQ ID NO: 6156 - DNA, 1152 bp, Gibberella zeae PH-1
  CDS (1)..(1152)
atgtctcaatacccccacatcctcctgcgcgctgaggagaagcccctcgagcaccgatctttctctccctcaattatcaagactcttgtcgacgctggatatcccgtctctgtcgagcgatcatctacagaccccaagttcaagcgcatctttgaagactccgagtatgaggctgctggtgcgcgcctcgtcaacgagggcacctggcccaacgccgaagccggaactttgattctgggcctcaaggagattcccgaggaagactttcctctcaagaacgaccacattaaccaaggtggatgggaaaaggtcctcggccgcttccctcaaggaagcagcgttctatacgatttggagttccttgtcgatgagcaaggacgccgagtttctgctttcggtttccacgctggattcgctggcgctgccctcggtatcaagactcttgcccaccagcttcaggacccctcctccaagctcccctcagtggagacattcaccgatggtcgtggatactacctaaacgaggaggagctcgttaaccagatccgagaagaccttgccaaggccgagaagtctcttggacgcaagcccactgctctcgtcctcggtgctcttggacgatgtggtaagggtgccgttgacctgttcctcaaggctggcatgcccgacgagaacatcacccgctgggacttgaacgagaccaaggaccgagatggtccttatgaggagattgcccaggccgatgtcttccttaacgccatctacctttccaagcccatccctcctttcatcaacgaggagcttctcgccaagtctggccgcaacttggctgttgttatcgatgtctcctgcgacaccaccaaccctcacaaccccatccccatctactctatcaacaccacattcgaggagcccaccgtccccgtcgagatcaagaacgaccagaactctctccctctatcagttattagcatcgaccatctcccctcaatgctgccccgtgaggctagtgaggcctttagcgagggcctcaaggagtctctccttacactcaaggaccgcaagacttcgcgagtgtgggccgacgccgagaagctcttcaacgagaaggttgctctgcttcccgagtccctgcgaaccaagagagtttaa

SEQ ID NO: 6157 - protein, 383 aa, Gibberella zeae PH-1
MSQYPHILLRAEEKPLEHRSFSPSIIKTLVDAGYPVSVERSSTDPKFKRIFEDSEYEAAGARLVNEGTWPNAEAGTLILGLKEIPEEDFPLKNDHINQGGWEKVLGRFPQGSSVLYDLEFLVDEQGRRVSAFGFHAGFAGAALGIKTLAHQLQDPSSKLPSVETFTDGRGYYLNEEELVNQIREDLAKAEKSLGRKPTALVLGALGRCGKGAVDLFLKAGMPDENITRWDLNETKDRDGPYEEIAQADVFLNAIYLSKPIPPFINEELLAKSGRNLAVVIDVSCDTTNPHNPIPIYSINTTFEEPTVPVEIKNDQNSLPLSVISIDHLPSMLPREASEAFSEGLKESLLTLKDRKTSRVWADAEKLFNEKVALLPESLRTKRV

SEQ ID NO: 6158 - DNA, 1119 bp, Kluyveromyces lactis NRRL Y-1140
  CDS (1)..(1119)
atgagtgttacactacatttaagagcagaaactaagcccttagaggctcgtacagccttgacaccaactactaccaagaagttgttggataaagggttcaagattttcgttgaagagagttcccaatctgcctttgatatcgaagaatataagaaggtcggtgccactattgttccagaaggatcttggaagaccgctccacgcgatcgtattatcattggcttgaaagaaatgccagagactgatactttcccgttagttcacgaacacatccagtttgctcattgttacaagaaccaagctggttgggaagatgttttgagccgtttcaagagaggtaatggtgttttgtacgaccttgaattcttggaaaatgaccaaggtagaagagtagctgcatttgggttctatgctggttttgccggcgcagcagtcggtatcagagactgggctttcaagcaaacccactcagattctgagaatttgggagctattgaaccatacgaaaacgaagaagctatgatcaaggatgttcgcagagactaccaattagctttgaagagaggtgccagaaagcctaaggttttgattattggtgccttgggtagatgtggttctggtgctgctgatttactacgtaagtgtggattgccagaagaaaatatcatcaaatgggatatgaaggagactgctcgtggtggtcccttccaagaaatcgccgatgccgatgttttcatcaactgtatatacttatcaaagcctattcctcctttcatcaacaatgaactattgaataagccaaccagaagattgagaactgttgttgacgtttctgctgataccactaatcctcataaccctgttccaatttacaccatcaacactacgtttgatgcaccaacagtacaagttccaaccactgttggtccaaaattgtccgtgtgttctattgatcatttgccttcattgttaccaaaggaagcctcagaatctttctctcgtgatctattaccatccttggagcagttacctcaaagagctactgcttctgtgtgggtcaaggctagaaacctatatgaaaagttcgctgctaaggttggtagaacatctaagctatag

SEQ ID NO: 6159 - protein, 372 aa, Kluyveromyces lactis NRRL Y-1140
MSVTLHLRAETKPLEARTALTPTTTKKLLDKGFKIFVEESSQSAFDIEEYKKVGATIVPEGSWKTAPRDRIIIGLKEMPETDTFPLVHEHIQFAHCYKNQAGWEDVLSRFKRGNGVLYDLEFLENDQGRRVAAFGFYAGFAGAAVGIRDWAFKQTHSDSENLGAIEPYENEEAMIKDVRRDYQLALKRGARKPKVLIIGALGRCGSGAADLLRKCGLPEENIIKWDMKETARGGPFQEIADADVFINCIYLSKPIPPFINNELLNKPTRRLRTVVDVSADTTNPHNPVPIYTINTTFDAPTVQVPTTVGPKLSVCSIDHLPSLLPKEASESFSRDLLPSLEQLPQRATASVWVKARNLYEKFAAKVGRTSKL

SEQ ID NO: 6160 - DNA, 1113 bp, Debaryomyces hansenii CBS767
  CDS (1)..(1113)
atgtcaagccctgttactttacatttaagagccgaaaccaagccattggaagctagagctgctttaactccctcaactactaagcaattattagatgctgggtttaaggtatatgttgaaaagagttcccaatcaacatttgatgctgatgaatatgaaaaggttggtgctaccattgtaccagaaggatcttggaaggaagctcctaaagacagaataatttttggattaaaggaattaccagaagacgaaaccttcccattagtacatgaacacattcaatttgctcattgttataaagaccaaggtggatggaaagatgttttaaggaggtttccagaaggtaaaggtaccttatatgatttagaatttttggaaaatgatcaaggtagaagagttgcagcctttggattttacgcaggctttgcaggtgctgccattggggtaatggattgggctttcaagcaaacccactctgataatgaagatttacgtggagtcaccccatacccaaatgaagatgaattaattgctgatgtcaagaaggtgctagatgaagcattgaaaaagaatggaggtgaatacccacaatgtttagtcattggtgctttaggtagatgtggatctggtgctcttgacttcttcaagaaggttggcattccagatgaaaagctcattaaatgggatatgaaagaaactgctaaaggtggaccattccaagaaattgttcaatctgacatattcgtcaactgtatttacttatcccaaccaattccaccatttatcgattacgaaggcttaaatgttcctgacagaaaattgagaaccatcgttgatgtctctgctgatactactaaccctcacaacccaattcctgtctacagtattgcaactgtctttaatgatccaacagtcccagttgaaactagtgccggtccaaaattgtccgtctgctcaattgaccacttaccttcattgttaccaagagaagcctcagaattctttgctaaggacttaatgccttcattgctagaattaccaaatagagatacttctcctgtttgggtcagagctaagcaattgtttgacaaacacgttgccagattagattga

SEQ ID NO: 6161 - protein, 370 aa, Debaryomyces hansenii CBS767
MSSPVTLHLRAETKPLEARAALTPSTTKQLLDAGFKVYVEKSSQSTFDADEYEKVGATIVPEGSWKEAPKDRIIFGLKELPEDETFPLVHEHIQFAHCYKDQGGWKDVLRRFPEGKGTLYDLEFLENDQGRRVAAFGFYAGFAGAAIGVMDWAFKQTHSDNEDLRGVTPYPNEDELIADVKKVLDEALKKNGGEYPQCLVIGALGRCGSGALDFFKKVGIPDEKLIKWDMKETAKGGPFQEIVQSDIFVNCIYLSQPIPPFIDYEGLNVPDRKLRTIVDVSADTTNPHNPIPVYSIATVFNDPTVPVETSAGPKLSVCSIDHLPSLLPREASEFFAKDLMPSLLELPNRDTSPVWVRAKQLFDKHVARLD

SEQ ID NO: 6162 - DNA, 3081 bp, Aspergillus nidulans FGSC A4
  CDS (1)..(3081)
atgggttccaacaagatctggctgcgcgctgagaccaagcctgccgaggcacggtctgctttgacaccgaccacttgcaaggctcttattgatgctggatatgaggtgacggttgagcgatctactcagcgtatcttcgatgatgacgaattcgcaaaggttggcgctcctcttgttgaggaaggttcttgggtcaaggatgcacccaaggacgcttacattctaggtctgaaggaacttcctgaggatgactttcctctcgagcacgttcacatctcttttgcgcactgctacaaggagcaggccggctgggagaaggtgctgagccggtggcctcgtggtggcggtgttctcctggacttggagttcctcaccgatgatgctggtcgtcgggttgctgccttcggtttctctgctggctatgctggtgctgccttggccgtcaagaactgggcctggcaattgacgcatcccgagggcgagcctctcgccggcgaaaagccttatgccaaccaagaccttctgattcagtcagtcaaggagtcactccaggcgggtcagaagcagtctggcaagtccccaaagatacttgtcatcggtgctctgggacgttgtggtaagggtgctgtgcaattggcgaaggacgtcggcattcccgagtctgatatcattcagtgggatatggaggaaaccaagaagggtggccctttcaaggagattgttgaggatgctgacatcttcgtgaactgcatttacctgtcttccaagatccctcacttcgttaatgttgagagcctttccacccctagccgtcgtttgtctgtcatttgcgacgtgagcgctgatactaccaaccccaacaacccaattcctgtctacaacatcaccaccacctttgacaagcccacagtacccgttactctgcccaatggcactcaaggcacgcctctcagtgtgatcagcattgaccacctcccgtcgcttctcccgcgtgaaagctccgagatgtttagtgaagcgctgatgcccagcttgcttcagctcaaggaccgtgagaacgctcgggtctggaagcaggccgaggatctgttcaaccagaaggttgccactctgcctcaaacggccgagctggccttgaaacagaaggatgtggggacgccgacggagggccggtcgctagtcttggttcgtgaaatccgcagtttgatgcaggaaaaaccaactacggtcgccgcgtatgcggctggagcatccctagcggccgttgctctgttctatgtctttgggccgaattacaccatcgatggagatgaggcaggagggaaccgcaaaaagagcatcgtgggcctctcgaatcccgcgaatgactgtttcatcaactccgtgctccaggcacttgccggtctgggcgatctacggttatatttgatccgcgagctccatcggcgggagctggacgggcctgaaatctacaaccagctgcccgggccagaggaggctgaccaattgcgtgagaagagaccggacaggatccgggagcttcagcagggtaccattaccagggcgctgaaggagatgctggatcggttaaacgagcggccaatttataagaagacgatctcggcgcgggcattcatccaggccttggagtttgcatatcgcactcgcattagtcgcaaccagcaggacgcgcaggagttcctgcagattgtggctgaaagactgtccgacgagtaccatgctggtgtgaaagcacgtcaaagggcggagaaatcaatcgaattcaatccctaccaagagcgcgaggaggcgccgtctgagattgaagtgcgactggatgacggcacagagaatggtcttccggccataatagacaccaagctcaaggagatcgacaacgagtatggctttccttttgaaggcaagttggagtcccagattgaatgccaattctgccactacaagtacaagccgaaccaaacttcatttgtcaatttgacactgcaagtcccgcagaggagctctaccacactcaatgcttgctttgacggccttctcaagaccgaatatatcgacgacttccgatgcgacaagtgccggttgttacacgcgattgaggtaaaatcaaatgcgctagtcaaggctggttccgcaaccgacaggcagcgcctagaagcagaaattgagaagattcaactcgctctctccagtgatccggaaaatgctctggacggggttacactgccacctgcagaacttgctccgaagcgcagaattgctcggcatatgcggatcacagtcttccccaaaatcatcgccattcatctttcacgatccatgttcgaccggagcggctccacaaagaatgctgcaaaggtcgctttccctgaacggctcccgctcggtgggatcttgagccaaaagtggttcaaactgctagctattgtctgccacaagggcagtcataacagcgggcattatgaatctttccggcgcaaccacctctaccctccatactcaacacccagcgtattcagctcctatgcacagagccgcgcagccagcgagaacccctcgcgtgtggcaagcccccgtcttcctgcgagtagcagcagtaccgagccgccagctctaaatatttcaccaccggcctcaacttctactaactcaccgttgtctctaacacctgattctccatctagacccccatcagcaaccgatctcaagagcccccgtccaacaacatccagctctcgtgtttccttccaaagcacacactcgtcctctaaacagactatttctcccacttctgcagcacgcaactcttcatcacttgataccgctcgtctcagcagccccgcctcgagaagctcacttgcagaacgcaacgcctcggcaacagacacagaagccagtgcaagcgcaagtcttgcatcgcgaatccggcgacgtcgcaagacagctgataggtggtggcggatctcggacgagaagatcaaagagtgcaagacctcggacgtgctgggcatgcagaaggaggtgtatcttttgttctatgagatcgagaagtcaggctcttaa

SEQ ID NO: 6163 - protein, 1026 aa, Aspergillus nidulans FGSC A4
MGSNKIWLRAETKPAEARSALTPTTCKALIDAGYEVTVERSTQRIFDDDEFAKVGAPLVEEGSWVKDAPKDAYILGLKELPEDDFPLEHVHISFAHCYKEQAGWEKVLSRWPRGGGVLLDLEFLTDDAGRRVAAFGFSAGYAGAALAVKNWAWQLTHPEGEPLAGEKPYANQDLLIQSVKESLQAGQKQSGKSPKILVIGALGRCGKGAVQLAKDVGIPESDIIQWDMEETKKGGPFKEIVEDADIFVNCIYLSSKIPHFVNVESLSTPSRRLSVICDVSADTTNPNNPIPVYNITTTFDKPTVPVTLPNGTQGTPLSVISIDHLPSLLPRESSEMFSEALMPSLLQLKDRENARVWKQAEDLFNQKVATLPQTAELALKQKDVGTPTEGRSLVLVREIRSLMQEKPTTVAAYAAGASLAAVALFYVFGPNYTIDGDEAGGNRKKSIVGLSNPANDCFINSVLQALAGLGDLRLYLIRELHRRELDGPEIYNQLPGPEEADQLREKRPDRIRELQQGTITRALKEMLDRLNERPIYKKTISARAFIQALEFAYRTRISRNQQDAQEFLQIVAERLSDEYHAGVKARQRAEKSIEFNPYQEREEAPSEIEVRLDDGTENGLPAIIDTKLKEIDNEYGFPFEGKLESQIECQFCHYKYKPNQTSFVNLTLQVPQRSSTTLNACFDGLLKTEYIDDFRCDKCRLLHAIEVKSNALVKAGSATDRQRLEAEIEKIQLALSSDPENALDGVTLPPAELAPKRRIARHMRITVFPKIIAIHLSRSMFDRSGSTKNAAKVAFPERLPLGGILSQKWFKLLAIVCHKGSHNSGHYESFRRNHLYPPYSTPSVFSSYAQSRAASENPSRVASPRLPASSSSTEPPALNISPPASTSTNSPLSLTPDSPSRPPSATDLKSPRPTTSSSRVSFQSTHSSSKQTISPTSAARNSSSLDTARLSSPASRSSLAERNASATDTEASASASLASRIRRRRKTADRWWRISDEKIKECKTSDVLGMQKEVYLLFYEIEKSGS

SEQ ID NO: 6164 - DNA, 1173 bp, Ustilago maydis 521
  CDS (1)..(1173)
atgtctacaagccgccaacccctctacctccgatgcgagatgaagccggccgagcaccgtgccgcgctcaccccaaccaccgccaaggcactcattgacgctgggttcgacatcacggtcgagtccgaccctcaacgtatctttgacgacaaagagtacaccgaggtagggtgcaagcttgcccctcacaacacgtttcactccctgcccgccgacatccccatcatcggtctcaaggagcttgaggagcctggtccggatctgcctcacacccacattcagtttgctcactgctacaagaagcaggccggttgggcggatgttctgggtcgattcaagcgcggaggcggaaagctctacgatttggagtttttggaggacaagaacggccgtcgtgtagccgcgtttggttggcacgccggctttgcaggcgctgcacttggtctgttggctttggctgaacaggtgcaaggtgaagaccaaaggctgggtgctcaaaaggcttaccccaacgagcaggcgctcatcgcacacgccaagcagcagattgagttcatcaagaaatcgcgctcggacggcaaagtgaaggcgctcgtcgtcggagctttgggacgatgtggtcgtggagccattgactttttcgaaaaggccggcgtcgcttctgaggacattgtccgctgggacatccaggagacctcagccaagcacggtccctaccaagagctgctcgacgtagacatctttgtcaactgcatctacctcacctctaaaatcccgcctttcctcgaccaacctacgatccaagccgctggtccctcgcgtcgtctcggcgtcgtcgtcgacgtatcgtgcgacactaccaaccccaacaaccctctccccatctacgacatcaacaccacctttgacaaacctaccgtcgacgtcaacacgggcaaaggtaacccgagcttgaccgtcatctcgatcgaccatctgcccactctgctgcctagggagagctccgagggtttcagcaacgacctgttgcccagtctgttgcagttgccctacgtgctcggtaaggacaccaccaagctcgacacgttggacgaaggaaagggagccgtctggcagagagccgaaaagctcttccataagcacttggcagaggctgagcagcacacagcttga

SEQ ID NO: 6165 - protein, 390 aa, Ustilago maydis 521
MSTSRQPLYLRCEMKPAEHRAALTPTTAKALIDAGFDITVESDPQRIFDDKEYTEVGCKLAPHNTFHSLPADIPIIGLKELEEPGPDLPHTHIQFAHCYKKQAGWADVLGRFKRGGGKLYDLEFLEDKNGRRVAAFGWHAGFAGAALGLLALAEQVQGEDQRLGAQKAYPNEQALIAHAKQQIEFIKKSRSDGKVKALVVGALGRCGRGAIDFFEKAGVASEDIVRWDIQETSAKHGPYQELLDVDIFVNCIYLTSKIPPFLDQPTIQAAGPSRRLGVVVDVSCDTTNPNNPLPIYDINTTFDKPTVDVNTGKGNPSLTVISIDHLPTLLPRESSEGFSNDLLPSLLQLPYVLGKDTTKLDTLDEGKGAVWQRAEKLFHKHLAEAEQHTA

SEQ ID NO: 6166 - DNA, 1053 bp, Silicibacter pomeroyi DSS-3
  CDS (1)..(1053): transl_table=11
atgacgcatctgtgggtccgggccgaacagcgcccgaacgaggaacgggtcgggctgaccccggaaggcgccgccgccctgatcgccgccggtctccgggtcacggtcgaggaaagctcggttcgcgccattccgctcgacggctatcgcgacgcgggctgtcagatcgcgcccgagaacagctggccggatgcgccaggtgacgccatcatctttgggctcaaggaactgcccgaggatggcacccccctgccgcaccgccacatcatgttcggccatgccttcaaggggcagcattcgggtcgccggttgctggaacggttcaaggccgggggcggcacgctatacgatctggaatatctggtggacgagaacggtcgccgggtcgcggcattcggctattgggctggctatgccggcgcggcggtcacgctcaaggcctgggccgcgcagcagcagggcggcatctgcggcccggtcggagtctatcccggcaaggatacgctgaacgcggcgcttgccgcggaactcgacgccaccggcgccccgcgcccgcgtgccatcgtgatcggcgcgctgggccgggtcggcaccggggccgccgatctctgcaccgcaatgggggtcgaggtcaccaaatgggacatggccgaaaccgcaagcggtgggccgttccccgagattctcgcccatgacatctttctaaactgcatctttgcccgccccggcacgccggtctttgtaccgcgcgaggcgctgagcgcgccgcgcgccctgaccgccatcggcgacgtggcctgcgaccccgacagcgattacaacccggtgccggtctatgaccgtgccaccagctgggacgcgcccgtactgcgggtggccgaggcgccagtgcttgacgtgatggcgatcgacaacctgccctcgatgctgccggtggaaagcagcgaggactatgccgcgcaactgctgccctcgctgctgacgctgactgatctggatgcaggcgtctggggccgggcacgggccaccttccttggccatgtggaggggtga

SEQ ID NO: 6167 - protein, 350 aa, Silicibacter pomeroyi DSS-3
MTHLWVRAEQRPNEERVGLTPEGAAALIAAGLRVTVEESSVRAIPLDGYRDAGCQIAPENSWPDAPGDAIIFGLKELPEDGTPLPHRHIMFGHAFKGQHSGRRLLERFKAGGGTLYDLEYLVDENGRRVAAFGYWAGYAGAAVTLKAWAAQQQGGICGPVGVYPGKDTLNAALAAELDATGAPRPRAIVIGALGRVGTGAADLCTAMGVEVTKWDMAETASGGPFPEILAHDIFLNCIFARPGTPVFVPREALSAPRALTAIGDVACDPDSDYNPVPVYDRATSWDAPVLRVAEAPVLDVMAIDNLPSMLPVESSEDYAAQLLPSLLTLTDLDAGVWGRARATFLGHVEG

SEQ ID NO: 6168 - DNA, 1056 bp, Rhodobacter sphaeroides 2.4.1
  CDS (1)..(1056): transl_table=11
atgacgcatctgtgggtccgggccgagcagcggccgaacgaggaacgggtcgggctgacgcccgagggcgccgcggcgctgatcgcacggggcctccgggtgaccgtcgaggccagccgcccgcgcgccctctcgatcgagggctatgccgccgcgggctgtgcgatcgcgcccgagaattcctggcccacggccccggccgatgccatcgtcttcggcctgaaggagctgcccgaggacggcacgccgctgcggcaccgccatatcctgttcggccacgcctacaagggccagcccgccgggcgcatcctgctcgagcggttccgggccggcggcggcacgctctacgatctcgagtcgctcgtggatgagagcgggcgccgcgtcgcggccttcggctactgggcgggctatgccggcgccgcggtggcgctgaaatgctgggcggcgcaggcacggggcgggatctgcgcccccgtgacgacctggcccggacgcgagggcctgctggccgacctcggagccgagctcacgtccgccggcgcccgccagccgcgcgccctcgtgatcggggcccgcggcagggtcggcaccggcgccgccgacctctgcgagtcgatgggcctcgccgtcacccgctgggacatggaggagacggcccacggcggccccttccccgaggtgctcgcgcacgagatcttcctgaactgcatccttgcccgccccggctgcccggtcttcgtgcccgccgaggcgctcgaggcgccgcgcgcgctgcgggtgatcggagacatcgcctgcgatccgacctccgacttctcgccggtcaaggtctacgaccgcacgacgagctggaccgccccggccctgcgggtccatgacgatccgatgctcgacgtgatggccatcgacaacctgccctcgctcctgccggtcgagagcagcgtggattacgcggcccagcttctgccctcgctcctcaccctcgaccggatcgaggagggcgtctggggccgcgcgaaggccgagttcgaccggcacatgaccccggcctga

SEQ ID NO: 6169 - protein, 351 aa, Rhodobacter sphaeroides 2.4.1
MTHLWVRAEQRPNEERVGLTPEGAAALIARGLRVTVEASRPRALSIEGYAAAGCAIAPENSWPTAPADAIVFGLKELPEDGTPLRHRHILFGHAYKGQPAGRILLERFRAGGGTLYDLESLVDESGRRVAAFGYWAGYAGAAVALKCWAAQARGGICAPVTTWPGREGLLADLGAELTSAGARQPRALVIGARGRVGTGAADLCESMGLAVTRWDMEETAHGGPFPEVLAHEIFLNCILARPGCPVFVPAEALEAPRALRVIGDIACDPTSDFSPVKVYDRTTSWTAPALRVHDDPMLDVMAIDNLPSLLPVESSVDYAAQLLPSLLTLDRIEEGVWGRAKAEFDRHMTPA

SEQ ID NO: 6170 - DNA, 1053 bp, Silicibacter sp. TM1040
  CDS (1)..(1053): transl_table=11
atgacacatctctgggtccgggccgaacagcgcctgaacgaggatcgcgtggggctgacgcctgcaggggccaaggcgcttctggaagcgggtattcgcgttaccgtcgaagaaagcagcagccgcgccatcccgcttcagggctacatcgatgcaggctgcgaaattgcgccagaaaacgcctggcccgatgcgccgcgtgacgccatcatctttggcctcaaggagctgcccgacgacggcaccccactgccccatcgccacatcatgtttggtcacgctttcaaaggccagcactccggcaaggaactgctgcgccggttccgcgagggcggcgggacgctttatgatctggagtatctggtggatccgtccggccgcagggtcgccgcctttggctattgggccgggtatgcaggtgctgctgtcacgctcaaggcctgggccgcacagcagcgcggcgaaacctgcgggccggttggggtctacaagaacaaggacgcgcttctggccgatctcggccgcgagttggacgccaccggtgcagaccgtcccaaggccattgtcatcggcgctctgggtcgggtgggcactggcgctgcggatctctgcgaggcgatgggtgttgccgtcaccaaatgggatatgaacgagaccgcgagcggcggaccgttcccggaaatcctcgaccatgatctgttcctgaactgcatctttgcccgccccggtacgcccgtttttgtgcccaaagaggcgctcacggccgcgcgcaaccttaccgcaatcggggatgtagcctgtgatccggacagcgattacaatcccgtccccgtctattcccgcgcaaccacatgggatgcgccggttgtacgtgttgccaatgatccagtcctggacgtaatggcgatcgacaacctcccctcgatgcttcctgccgaaagctccgaggattacgcggatcagcttctggcaagccttctgaccctgtccgatctggatgcgggcgtctggggccgggccaaggcggtctttgacgaacatgtggcgggctga

SEQ ID NO: 6171 - protein, 350 aa, Silicibacter sp. TM1040
MTHLWVRAEQRLNEDRVGLTPAGAKALLEAGIRVTVEESSSRAIPLQGYIDAGCEIAPENAWPDAPRDAIIFGLKELPDDGTPLPHRHIMFGHAFKGQHSGKELLRRFREGGGTLYDLEYLVDPSGRRVAAFGYWAGYAGAAVTLKAWAAQQRGETCGPVGVYKNKDALLADLGRELDATGADRPKAIVIGALGRVGTGAADLCEAMGVAVTKWDMNETASGGPFPEILDHDLFLNCIFARPGTPVFVPKEALTAARNLTAIGDVACDPDSDYNPVPVYSRATTWDAPVVRVANDPVLDVMAIDNLPSMLPAESSEDYADQLLASLLTLSDLDAGVWGRAKAVFDEHVAG

SEQ ID NO: 6172 - DNA, 1056 bp, Sulfitobacter sp. EE-36
  CDS (1)..(1056): transl_table=11
atgaccgcgccacatctatgggttcgcgccgaacagcgcgacaatgaaacccgcgtcggcatcacgcctcaaggggttaccgcgttgatggaacaggggtttcgcgtcaccgtcgaagcctcggacagccgcgtgatcgcgaccgatgcctatgcggccacgggctgcaccatcgcgccacagaacagctggcccgacgcgcctgccgatgcgatcatctttggcctgaaggaactgccagaggacggcacaccgctggtgcaccggcacatcatgttcggtcacgcctacaaaggtcaatctgcggggcgtatcctgttacaacgtttcaaggcgggcggcggcaccttgctggaccttgagtatctgaccgacgagacaggccgacgcgtcgccgcctttggctattgggcggggttcgcgggggcggcggtggccgtcaaatgctgggccgcccaaacccgtgggcaagctgtcgcccccatcacgccctatcctaacgccgatgcgctgacccgcgaccttacggcagagatcgacgggctcgccacgcccgacgctttggtcatcggtgcacttggtcgggtgggcagcggtgccgccgatctttgcggccgtctggggatcaaggtcaccgggtgggatatgaaggagaccgcccacggcggccccttccccgagattttgcagcatgtgctgtttttcaactgcattctggcggggccgcagacaccggttttcgtgcccaaaagcgcgctggacagggatcgcgcgctgcgggtgatcggcgatatcgcctgcgatcccgacagcgacttcaaccccgtaccggtctatgaccgcgcgaccgcatgggaagagcccgcgttacgcgtgcatgacaccccacctctggatgtcaccgcgatcgacaacctgccgtcgatgctgccgttggaaagctctgaagactacgccgcgcagctgctgccgacgctctcggcactggcggaagatgcctcgcccgtctgggcgcgggcccatgcgctgttccaagaacacagcgccgccgtgtga

SEQ ID NO: 6173 - protein, 351 aa, Sulfitobacter sp. EE-36
MTAPHLWVRAEQRDNETRVGITPQGVTALMEQGFRVTVEASDSRVIATDAYAATGCTIAPQNSWPDAPADAIIFGLKELPEDGTPLVHRHIMFGHAYKGQSAGRILLQRFKAGGGTLLDLEYLTDETGRRVAAFGYWAGFAGAAVAVKCWAAQTRGQAVAPITPYPNADALTRDLTAEIDGLATPDALVIGALGRVGSGAADLCGRLGIKVTGWDMKETAHGGPFPEILQHVLFFNCILAGPQTPVFVPKSALDRDRALRVIGDIACDPDSDFNPVPVYDRATAWEEPALRVHDTPPLDVTAIDNLPSMLPLESSEDYAAQLLPTLSALAEDASPVWARAHALFQEHSAAV

SEQ ID NO: 6174 - DNA, 1044 bp, Roseovarius nubinhibens ISM
  CDS (1)..(1044): transl_table=11
atgacacatctctgggttcgggccgagcaacgccccaatgaatgccgcgttggcctgacgcccgagggggcggcagcgctgcgcgcggcggggatgcgcgtcaccgtcgaggaaagtgcgacgcgggccattggaatcgacggctatcgcgcggcgggctgcgagattgcggcggagggcagctggcccgaggcgccgcaggaggcgatcatctttgggctcaaggagttgccggaggatggcacgcccctgccccatcgccatatcatgtttggccatgcctataagggccagcattcggggcgggcgcttctcgaccggttcaaggccgggggcgggacgctctatgatctcgagtatctggtggatgagacgggacgccgggttgcggcgttcggctattgggcgggctatgccggggcggcggtgtcggcactggcctatgcggcgcaggcgcgtggtgggatttgccccgaggttaccggctggacggataaatcggcacttttgtcggatgtgggcgcggcgctggaagcggcaggcgatctgcccactgcgctggtcatcggggcgctcggccgggtcggcagcggggcggccgatttgtgcgaggcgttgggcatcggggtgacacgctgggacatggccgagacggcgcatggcgggccctttcccgagatcctcgcgcatgggattttcatcaacgcgatctttgcccggcccggcacgccggtcttcgtcggccccgaagaggcggctgcggcgcgggcgctgcgggtgatcggcgatgtggcttgcgatccggacagcgattacaacccggtgcctctttactcagaggcgacaagctggtccgcgccggtggtgcgggtggccgaggcgccgagcctcgacatcatggcaattgacaacctgccgtcgctcttgccgcgcgaaagctcggaggattatgccggccagctcttgccggtgctgcgcgatctgggggcgatcgaccagggcgtctgggcccgggccgaggccacattccgcaaatatctctga

SEQ ID NO: 6175 - protein, 347 aa, Roseovarius nubinhibens ISM
MTHLWVRAEQRPNECRVGLTPEGAAALRAAGMRVTVEESATRAIGIDGYRAAGCEIAAEGSWPEAPQEAIIFGLKELPEDGTPLPHRHIMFGHAYKGQHSGRALLDRFKAGGGTLYDLEYLVDETGRRVAAFGYWAGYAGAAVSALAYAAQARGGICPEVTGWTDKSALLSDVGAALEAAGDLPTALVIGALGRVGSGAADLCEALGIGVTRWDMAETAHGGPFPEILAHGIFINAIFARPGTPVFVGPEEAAAARALRVIGDVACDPDSDYNPVPLYSEATSWSAPVVRVAEAPSLDIMAIDNLPSLLPRESSEDYAGQLLPVLRDLGAIDQGVWARAEATFRKYL

SEQ ID NO: 6176 - DNA, 1164 bp, Phaeosphaeria nodorum
  CDS (1)..(1164)
atgtctttccccaccctccacgcacgcgccgaggccaagccgctggagcaccgatccgccctcacgcccaccacagcgaagaagctcctcgacgccggctacccagtcctggtcgagcgcagccccaaggaccccaactacgctcgcatattcaaagacgaagagttcgagcaggcaggtgcgaccctgattgaagaaggtgcatacaagacggcgcccaaagaccggattatcatcggactgaaggagctccccgaggatgagttcccgctcgagcacacatttgtccacttcgcccattgctacaagcagcaaggcggttgggagaaggtcctggcccgcttcccccgcggtggaggaacactgtacgacctcgagttcctccaagacacaactggcaggcgcgttgctgcgtttggctaccacgctggcttcgttggcgctgctcttgccatcaagacctgggcctggcaactcacacaccccaacggcgagccactcccgggtgtcgagaccttcaccgacggacgcggatactacaacaacgagagcgagctgattactcagctcaaggaggacgttgccgctggcgagaaggttgccggccacaagccatcgagcttggttctgggcgcactgggccgctgcggttcaggcgcagtcgaccttctcgagaagattggctgccccgagatcaagaagtgggacttgcccgagaccaaggagcgtgacggaccgtaccccgagatcatcgagtcggacatcttcgtcaactgcatctacctctccaagcccatcccgccattcgtcaacaaggagagcctgaagtcgcccaagcgcaagcttagtgtcgtctgcgatgtgagctgcgacaccacaaacccacacaaccccattcccatctacgacatcaacaccaccttcgacaagccgaccgtcggggttgatgtcgagggcgacggaccgagattgtccgtcatctccatcgaccatctcccgtctgcgctgccacgagagtcctcagaagcattcagcaatgcccttctgcccagcttgatggcgctgaaggaccgtgcgaccacaccggtatggcaaggagcggagaagctcttccaggaaaaggtacagacgcttcctggcggtgtaccgaagaaggaagtatag

SEQ ID NO: 6177 - protein, 387 aa, Phaeosphaeria nodorum
MSFPTLHARAEAKPLEHRSALTPTTAKKLLDAGYPVLVERSPKDPNYARIFKDEEFEQAGATLIEEGAYKTAPKDRIIIGLKELPEDEFPLEHTFVHFAHCYKQQGGWEKVLARFPRGGGTLYDLEFLQDTTGRRVAAFGYHAGFVGAALAIKTWAWQLTHPNGEPLPGVETFTDGRGYYNNESELITQLKEDVAAGEKVAGHKPSSLVLGALGRCGSGAVDLLEKIGCPEIKKWDLPETKERDGPYPEIIESDIFVNCIYLSKPIPPFVNKESLKSPKRKLSVVCDVSCDTTNPHNPIPIYDINTTFDKPTVGVDVEGDGPRLSVISIDHLPSALPRESSEAFSNALLPSLMALKDRATTPVWQGAEKLFQEKVQTLPGGVPKKEV

SEQ ID NO: 6178 - DNA, 1119 bp, Ashbya gossypii
  CDS (1)..(1119)
atgtcagcaatattgcacctacgagcggagaccaagcccatggaagcgcgggcagcgctgacgccgacgactgtgcgcacactggtgtcccacgggttcaagatatatgtggaggagagcgcgcagtcggtgttcgaggctgcggagtacgcggcggccggcgcggaggtcgtggcgacggggagctggcgcggggcgccgcgcgagcgcatcatcgtggggctcaaggagctgcctgaagaggacacgtttccgctggagcacacgcacatccagtttgcgcactgctacaagaaccaatccgggtggcgggaggttctggggcggttccagagcggcggcggactgctgtacgacttggagttcctgcaggacgaccggggacggcgggtggccgcgttcgggtactacgcggggtttgccggcgcggcgctcgggctgcgcgactgggcgtggaagcagacgcacacggatgcagaggacctgccggccgtggcgccgtacgagaacgagcaggcgctcgtgagcgaggtggcggcggcgtgcgaggaggcgtacaagaagggcgcgcgcaagccgcgcgtgctggtgattggcgcgctgggtcgctgcggcagcggcgcggtggagctgctgcgccagtgtgggctgcacgacaagcatatcatacgctgggacatcgcggaaaccgcacgcggggggccgtttccggagattgcagctgcggacatattcatcaactgtatctatctgtcgcagcccattgcgccgtttattaacatggagctgctggaccggcccgaccgcaaactgaggacgattgtcgacgtgtcggcagacaccacgaatccacacaaccccgtgccggtgtataacgttgccactgttttcagcagccccaccgtggttgttccgacctcgcagggtcccaagctgtccgtcatttccatagaccacctgccctcgctcctgcctcgggaagcctcggaggcgtttgcgtctgacctgctgccatcgctgttgcagctgccagagagggacacggcgcctgtatggctcagggccaaggagctcttccaacagcactgcgagcggctgtcaaaagaggcgaggttataa

SEQ ID NO: 6179 - protein, 372 aa, Ashbya gossypii
MSAILHLRAETKPMEARAALTPTTVRTLVSHGFKIYVEESAQSVFEAAEYAAAGAEVVATGSWRGAPRERIIVGLKELPEEDTFPLEHTHIQFAHCYKNQSGWREVLGRFQSGGGLLYDLEFLQDDRGRRVAAFGYYAGFAGAALGLRDWAWKQTHTDAEDLPAVAPYENEQALVSEVAAACEEAYKKGARKPRVLVIGALGRCGSGAVELLRQCGLHDKHIIRWDIAETARGGPFPEIAAADIFINCIYLSQPIAPFINMELLDRPDRKLRTIVDVSADTTNPHNPVPVYNVATVFSSPTVVVPTSQGPKLSVISIDHLPSLLPREASEAFASDLLPSLLQLPERDTAPVWLRAKELFQQHCERLSKEARL

SEQ ID NO: 6180 - DNA, 1119 bp, Candida glabrata
  CDS (1)..(1119)
atgtccgtgactttacatttaagaggtgaaactaaaccgctagaacatcgtgctgccttgacacctactaccgtcaagcacctaatcggcaaaggcttcaagatatatgtcgaggaatcaccacaatccatatttaaaatcgacgaatacagaagagctggtgctattatcgtaccatttggctcctggatcagtgctcctcgtgacagaataattattggtttgaaagaaatgccagaagaagacaagttcccattggtgcacgaacacatccaatttgctcattgttataaagatcaagcaggctggaaagacgttctgcgtagattcataaacggtaacggtaccttatatgacttggaatttctagaggacgacaacggcagaagagttgctgcttttggattttatgcaggttttgctggtgcagcacttggtttggcagattgggccttcaaacaaacacataaggacagcgaagacttgccagctgtctccccatacccaaacgaaaaggctttgatcaaagatattggcaaggcttacaaaaatgcattgaagactggtgccaaaaagccaaaggtactaataattggcgctttaggaagatgcggttccggtgcaattgatttcttgaagaaggttggccttccagaggaaaatatcattaagtgggatattcaggaaacttcaagaggtggcccattccctgaaatagcagcttctgatatcttcatcaactgtatttacctttccaaaccaattgcaccttttatcaattacgaactactaaacaaacctgacagaaagctaagaacagttgttgatgtgtccgccgacacaactaatccacacaaccctattccaatatataacatcgctactgtcttcaacaagccaacagtcaaggtaaataccagttcaggtccaaaactatctgtcatttcaatcgaccatttgccttccctattaccaagagaagcttctgaattcttcgcacacgacctattaccttccctagaacaactaccaagcagacatgtttctccagtatgggtaagagctgagaaattattcaacagacattctgcccgtgctattagagaatctaaattatga

SEQ ID NO: 6181 - protein, 372 aa, Candida glabrata
MSVTLHLRGETKPLEHRAALTPTTVKHLIGKGFKIYVEESPQSIFKIDEYRRAGAIIVPFGSWISAPRDRIIIGLKEMPEEDKFPLVHEHIQFAHCYKDQAGWKDVLRRFINGNGTLYDLEFLEDDNGRRVAAFGFYAGFAGAALGLADWAFKQTHKDSEDLPAVSPYPNEKALIKDIGKAYKNALKTGAKKPKVLIIGALGRCGSGAIDFLKKVGLPEENIIKWDIQETSRGGPFPEIAASDIFINCIYLSKPIAPFINYELLNKPDRKLRTVVDVSADTTNPHNPIPIYNIATVFNKPTVKVNTSSGPKLSVISIDHLPSLLPREASEFFAHDLLPSLEQLPSRHVSPVWVRAEKLFNRHSARAIRESKL

SEQ ID NO: 6182 - DNA, 1107 bp, Schizosaccharomyces pombe
  CDS (1)..(1107)
atggttgctcctcatctttggttacgtgctgaaaccaaacctttagaagagcgcagtgctttgactcctagaactgccaagatactcgccgatgctggatttcaaattaccattgagcgctcttcccaacgtgctttcaaggacaaagaatttgagcgccttggtttccccatggttcctgagggctcatggcgacatgcacctaaggacgcgtacattattggtctcaaagagcttccggaaaatgataacagtcctttgaagcatactcatattcaatttgctcattgctacaaaaaccaggaaggttggcgtgaagtcttgtcccgattccccgctggcaatggtcttctatatgatttggaatttttgcaagatgacaatggcagacgtgttgccgcttttggttaccacgctggttttgctggatcagctatctcatgtttagtttgggcacatcaattattgcatcctaacaaacaattccctgctatccgtccgttccccaacgaaaaatctttggttcgccatgttgctcgtcaagtacgtttagctttgaaaaagaataacaaccagtatcctcgtattctggttattggggctcttggtcgttgtggtactggagcgtgcgatttagcatcaaagattggtattcccttcgataacattcttcgctgggacattaatgaaactaagaagggtggtccctttaccgaaattacggaatcagacatatttgttaactgcatttatctgagcatgcctattcccaaattctgtaccgtcgagtcgttaaatgtacctaaccgtaaattgcgtgttgtttgtgatgttagctgtgacactaccaatcctaacaatcctattccaatttataatgtaaacactacatttgatcatcctacagttgaggttaaaggtgtcacaactcctcctcctttagaggtcatttctattgatcatcttcctactttattgccaagggaatcttccgaagcatttagtgaagctctaattcctagtcttttggctttgaaggacgtcgacaatgctcccgtttgggtcagagctaaaaaactttatgaaaccatggttcaaaagctttaa

SEQ ID NO: 6183 - protein, 368 aa, Schizosaccharomyces pombe
MVAPHLWLRAETKPLEERSALTPRTAKILADAGFQITIERSSQRAFKDKEFERLGFPMVPEGSWRHAPKDAYIIGLKELPENDNSPLKHTHIQFAHCYKNQEGWREVLSRFPAGNGLLYDLEFLQDDNGRRVAAFGYHAGFAGSAISCLVWAHQLLHPNKQFPAIRPFPNEKSLVRHVARQVRLALKKNNNQYPRILVIGALGRCGTGACDLASKIGIPFDNILRWDINETKKGGPFTEITESDIFVNCIYLSMPIPKFCTVESLNVPNRKLRVVCDVSCDTTNPNNPIPIYNVNTTFDHPTVEVKGVTTPPPLEVISIDHLPTLLPRESSEAFSEALIPSLLALKDVDNAPVWVRAKKLYETMVQKL

SEQ ID NO: 6184 - DNA, 1110 bp, Yarrowia lipolytica
  CDS (1)..(1110)
atgaccgcaccagtgaagctccatctccgagccgagaccaagcctctcgagcaccgatctgctctcacgcctactaccacccgaaagctgcttgatgctggattcgaggtctttgtggagaagtctccccttcgaatcttcgacgaccaggagtttgtcgatgtcggagccactcttgtcgaggagggctcttgggtctctgcccccgaggaccgaatgattattggtcttaaggagctgcctgaggaatctttccctctgtctcacgagcacatccagtttgctcactgctacaaggatcagggcggatggaaggacgttctgagccgattccccgcaggaaacggaactctgtacgaccttgagttcctggaggatgacaatggacgacgagttgccgcctttggcttccacgctggattcgccggtgccgccatcggtgtcgagacttgggccttccagcagacccaccccgacagcgaaaacctgcccggtgtctctgcctatcccaatgagaccgagcttgtcgacaagattaagaaggatcttgccgctgctgttgagaagggctccaagctccctaccgtcctggtgattggtgctcttggccgatgtggatccggtgccattgatctggcccgaaaggtcggtatccccgaagagaacatcattcgatgggacatgaacgagaccaagaagggtggacccttccaagagattgctgacgcggatatcttcatcaactgcatctacctgtctcagcccattcctcctttcatcaactacgatctgctcaacaaggagacccgaaagctcagtgtcattgtcgacgtctctgctgacaccaccaacccccacaaccctgtccccgtgtacacaattgctaccacgttcgaccatcccaccgtgcctgttgagaccactgctggccccaagctgtccgtgtgctcgatcgaccacctgccctctcttctgccgcgagaggcttccgaggccttttctgaggctctgctgccttctctcctgcagcttcctcagcgagacactgctcctgtctggacccgagctaaggctctgttcgacaaacacgttctgcgaattggcgagtaa

SEQ ID NO: 6185 - protein, 369 aa, Yarrowia lipolytica
MTAPVKLHLRAETKPLEHRSALTPTTTRKLLDAGFEVFVEKSPLRIFDDQEFVDVGATLVEEGSWVSAPEDRMIIGLKELPEESFPLSHEHIQFAHCYKDQGGWKDVLSRFPAGNGTLYDLEFLEDDNGRRVAAFGFHAGFAGAAIGVETWAFQQTHPDSENLPGVSAYPNETELVDKIKKDLAAAVEKGSKLPTVLVIGALGRCGSGAIDLARKVGIPEENIIRWDMNETKKGGPFQEIADADIFINCIYLSQPIPPFINYDLLNKETRKLSVIVDVSADTTNPHNPVPVYTIATTFDHPTVPVETTAGPKLSVCSIDHLPSLLPREASEAFSEALLPSLLQLPQRDTAPVWTRAKALFDKHVLRIGE

SEQ ID NO: 6186 - DNA, 24 bp, Artificial sequence
  primer
atggctgccgtcacattacatcta

SEQ ID NO: 6187 - DNA, 26 bp, Artificial sequence
  primer
ctacaatcttgaagatcttttaacac

SEQ ID NO: 6188 - protein, 389 aa, Artificial sequence
  consensus sequence
  Variant (2)..(3): Xaa in position 2 to 3 is any amino acid
  Variant (5)..(5): Xaa in position 5 is any amino acid
  Variant (7)..(8): Xaa in position 7 to 8 is any amino acid
  Variant (10)..(10): Xaa in position 10 is any amino acid
  Variant (12)..(12): Xaa in position 12 is any amino acid
  Variant (14)..(14): Xaa in position 14 is any amino acid
  Variant (15)..(15): Xaa in position 15 is any or no amino acid
  Variant (19)..(23): Xaa in position 19 to 23 is any amino acid
  Variant (25)..(27): Xaa in position 25 to 27 is any amino acid
  Variant (29)..(32): Xaa in position 29 to 32 is any amino acid
  Variant (35)..(35): Xaa in position 35 is any amino acid
  Variant (37)..(49): Xaa in position 37 to 49 is any amino acid
  Variant (50)..(54): Xaa in position 50 to 54 is any or no amino acid
  Variant (56)..(63): Xaa in position 56 to 63 is any amino acid
  Variant (65)..(66): Xaa in position 65 to 66 is any amino acid
  Variant (67)..(67): Xaa in position 67 is any or no amino acid
  Variant (70)..(70): Xaa in position 70 is any amino acid
  Variant (72)..(73): Xaa in position 72 to 73 is any amino acid
  Variant (75)..(75): Xaa in position 75 is any amino acid
  Variant (80)..(80): Xaa in position 80 is any amino acid
  Variant (83)..(85): Xaa in position 83 to 85 is any amino acid
  Variant (86)..(86): Xaa in position 86 is any or no amino acid
  Variant (89)..(89): Xaa in position 89 is any amino acid
  Variant (91)..(91): Xaa in position 91 is any amino acid
  Variant (94)..(94): Xaa in position 94 is any amino acid
  Variant (96)..(96): Xaa in position 96 is any amino acid
  Variant (98)..(98): Xaa in position 98 is any amino acid
  Variant (101)..(101): Xaa in position 101 is any amino acid
  Variant (103)..(108): Xaa in position 103 to 108 is any amino acid
  Variant (110)..(110): Xaa in position 110 is any amino acid
  Variant (113)..(114): Xaa in position 113 to 114 is any amino acid
  Variant (116)..(116): Xaa in position 116 is any amino acid
  Variant (118)..(118): Xaa in position 118 is any amino acid
  Variant (120)..(120): Xaa in position 120 is any amino acid
  Variant (124)..(124): Xaa in position 124 is any amino acid
  Variant (126)..(128): Xaa in position 126 to 128 is any amino acid
  Variant (129)..(129): Xaa in position 129 is any or no amino acid
  Variant (138)..(139): Xaa in position 138 to 139 is any amino acid
  Variant (142)..(142): Xaa in position 142 is any amino acid
  Variant (147)..(152): Xaa in position 147 to 152 is any amino acid
  Variant (154)..(167): Xaa in position 154 to 167 is any amino acid
  Variant (168)..(182): Xaa in position 168 to 182 is any or no amino acid
  Variant (184)..(193): Xaa in position 184 to 193 is any amino acid
  Variant (194)..(202): Xaa in position 194 to 202 is any or no amino acid
  Variant (204)..(205): Xaa in position 204 to 205 is any amino acid
  Variant (214)..(214): Xaa in position 214 is any amino acid
  Variant (216)..(216): Xaa in position 216 is any amino acid
  Variant (219)..(219): Xaa in position 219 is any amino acid
  Variant (221)..(225): Xaa in position 221 to 225 is any amino acid
  Variant (227)..(231): Xaa in position 227 to 231 is any amino acid
  Variant (232)..(234): Xaa in position 232 to 234 is any or no amino acid
  Variant (237)..(238): Xaa in position 237 to 238 is any amino acid
  Variant (241)..(242): Xaa in position 241 to 242 is any amino acid
  Variant (243)..(244): Xaa in position 243 to 244 is any or no amino acid
  Variant (247)..(248): Xaa in position 247 to 248 is any amino acid
  Variant (251)..(255): Xaa in position 251 to 255 is any amino acid
  Variant (256)..(256): Xaa in position 256 is any or no amino acid
  Variant (258)..(258): Xaa in position 258 is any amino acid
  Variant (262)..(267): Xaa in position 262 to 267 is any amino acid
  Variant (269)..(269): Xaa in position 269 is any amino acid
  Variant (271)..(275): Xaa in position 271 to 275 is any amino acid
  Variant (277)..(279): Xaa in position 277 to 279 is any amino acid
  Variant (280)..(282): Xaa in position 280 to 282 is any or no amino acid
  Variant (284)..(284): Xaa in position 284 is any amino acid
  Variant (286)..(289): Xaa in position 286 to 289 is any amino acid
  Variant (292)..(293): Xaa in position 292 to 293 is any amino acid
  Variant (295)..(299): Xaa in position 295 to 299 is any amino acid
  Variant (302)..(302): Xaa in position 302 is any amino acid
  Variant (304)..(304): Xaa in position 304 is any amino acid
  Variant (306)..(308): Xaa in position 306 to 308 is any amino acid
  Variant (310)..(313): Xaa in position 310 to 313 is any amino acid
  Variant (315)..(317): Xaa in position 315 to 317 is any amino acid
  Variant (319)..(323): Xaa in position 319 to 323 is any amino acid
  Variant (324)..(328): Xaa in position 324 to 328 is any or no amino acid
  Variant (330)..(330): Xaa in position 330 is any amino acid
  Variant (332)..(333): Xaa in position 332 to 333 is any amino acid
  Variant (336)..(336): Xaa in position 336 is any amino acid
  Variant (340)..(340): Xaa in position 340 is any amino acid
  Variant (343)..(343): Xaa in position 343 is any amino acid
  Variant (345)..(345): Xaa in position 345 is any amino acid
  Variant (348)..(352): Xaa in position 348 to 352 is any amino acid
  Variant (354)..(354): Xaa in position 354 is any amino acid
  Variant (358)..(359): Xaa in position 358 to 359 is any amino acid
  Variant (361)..(366): Xaa in position 361 to 366 is any amino acid
  Variant (367)..(380): Xaa in position 367 to 380 is any or no amino acid
  Variant (383)..(384): Xaa in position 383 to 384 is any amino acid
  Variant (386)..(388): Xaa in position 386 to 388 is any amino acid
LXXRXEXXPXEXRXXLTPXXXXXLXXXGXXXXVEXSXXXXXXXXXXXXXXXXXXGXXXXXXXXWXXXAPXDXXIXGLKEXPEXXXXPLXHXHIXFXHXYKXQXXXXXXLXRFXXGXGXLXDLEXLXXXXGRRVAAFGXXAGXAGAAXXXXXXAXXXXXXXXXXXXXXXXXXXXXXXXXXXXXLXXXXXXXXXXXXXXXXXXXPXXLVIGALGRXGXGAXDXXXXXGXXXXXXXXWDXXETXXXXGPXXEIXXXXXXFXNCIXXXXXXPXFXXXXXLXXXXXXRXLXXXXDVXXDXXXXXNPXPXYXXXTXXXXPXXXVXXXXXXXXXXLXVXXIDXLPSXLPXEXSEXXXXXLXPSLXXLXXXXXXXXXXXXXXXXXXXXVWXXAXXXF

SEQ ID NO: 6189 - protein, 40 aa, Artificial sequence
  protein pattern
  Variant (2)..(2): Xaa in position 2 is Ala or Gly
  Variant (4)..(4): Xaa in position 4 is Ala or Cys
  Variant (5)..(5): Xaa in position 5 is Phe or Tyr
  Variant (7)..(7): Xaa in position 7 is any amino acid
  Variant (9)..(10): Xaa in position 9 to 10 is any or no amino acid
  Variant (12)..(14): Xaa in position 12 to 14 is any amino acid
  Variant (15)..(16): Xaa in position 15 to 16 is any or no amino acid
  Variant (18)..(18): Xaa in position 18 is any amino acid
  Variant (21)..(22): Xaa in position 21 to 22 is any amino acid
  Variant (24)..(24): Xaa in position 24 is any amino acid
  Variant (26)..(26): Xaa in position 26 is any amino acid
  Variant (28)..(28): Xaa in position 28 is any amino acid
  Variant (32)..(32): Xaa in position 32 is any amino acid
  Variant (34)..(34): Xaa in position 34 is any amino acid
  Variant (35)..(35): Xaa in position 35 is Asp or Asn
  Variant (36)..(37): Xaa in position 36 to 37 is any amino acid
FXHXXKXQXXGXXXXXLXRFXXGXGXLXDLEXLXXXXGRR

SEQ ID NO: 6190 - protein, 37 aa, Artificial sequence
  protein pattern
  Variant (2)..(2): Xaa in position 2 is any amino acid
  Variant (4)..(4): Xaa in position 4 is any amino acid
  Variant (5)..(5): Xaa in position 5 is Ala, Thr or Val
  Variant (6)..(6): Xaa in position 6 is Ile or Val
  Variant (7)..(7): Xaa in position 7 is any amino acid
  Variant (9)..(9): Xaa in position 9 is Cys or Val
  Variant (10)..(10): Xaa in position 10 is Ala or Ser
  Variant (11)..(11): Xaa in position 11 is Ala or Cys
  Variant (13)..(13): Xaa in position 13 is Pro or Thr
  Variant (14)..(14): Xaa in position 14 is Asp or Thr
  Variant (15)..(15): Xaa in position 15 is Asn or Ser
  Variant (16)..(16): Xaa in position 16 is Asp or Pro
  Variant (17)..(17): Xaa in position 17 is any amino acid
  Variant (20)..(20): Xaa in position 20 is Ile, Leu or Val
  Variant (22)..(22): Xaa in position 22 is Ile, Leu or Val
  Variant (24)..(24): Xaa in position 24 is Asp, Asn, Ser or Thr
  Variant (25)..(25): Xaa in position 25 is any amino acid
  Variant (26)..(26): Xaa in position 26 is Ala, Asn or Thr
  Variant (28)..(28): Xaa in position 28 is Ser, Thr or Val
  Variant (29)..(29): Xaa in position 29 is Phe or Trp
  Variant (30)..(30): Xaa in position 30 is Asp, Glu, Asn or Ser
  Variant (31)..(31): Xaa in position 31 is any amino acid
  Variant (33)..(33): Xaa in position 33 is any or no amino acid
  Variant (35)..(35): Xaa in position 35 is any amino acid
  Variant (36)..(36): Xaa in position 36 is any or no amino acid
RXLXXXXDXXXDXXXXXNPXPXYXXXTXXXXPXVXXV

SEQ ID NO: 6191 - protein, 34 aa, Artificial sequence
  protein pattern
  Variant (2)..(2): Xaa in position 2 is Asp, Glu, Ser or Thr
  Variant (4)..(5): Xaa in position 4 to 5 is any or no amino acid
  Variant (7)..(8): Xaa in position 7 to 8 is any or no amino acid
  Variant (10)..(10): Xaa in position 10 is any amino acid
  Variant (13)..(13): Xaa in position 13 is Ser or Thr
  Variant (14)..(14): Xaa in position 14 is any amino acid
  Variant (17)..(17): Xaa in position 17 is any amino acid
  Variant (19)..(19): Xaa in position 19 is Ala or Ser
  Variant (22)..(22): Xaa in position 22 is any amino acid
  Variant (23)..(23): Xaa in position 23 is Phe or Tyr
  Variant (24)..(24): Xaa in position 24 is Ala or Ser
  Variant (25)..(25): Xaa in position 25 is any amino acid
  Variant (26)..(26): Xaa in position 26 is Ala, Asp, Gly or Gln
  Variant (28)..(30): Xaa in position 28 to 30 is any amino acid
  Variant (32)..(33): Xaa in position 32 to 33 is any amino acid
LXVXXIXXDXLPXXLPXEXSEXXXXXLXXXLXXL

SEQ ID NO: 6192 - protein, 19 aa, Artificial sequence
  protein pattern
  Variant (4)..(4): Xaa in position 4 is Phe, Trp or Tyr
  Variant (5)..(5): Xaa in position 5 is any amino acid
  Variant (8)..(8): Xaa in position 8 is Phe or Tyr
  Variant (13)..(13): Xaa in position 13 is Ile, Leu or Val
  Variant (14)..(14): Xaa in position 14 is Ala, Gly, Ser or Thr
  Variant (15)..(15): Xaa in position 15 is Ala, Ile, Leu or Val
  Variant (16)..(16): Xaa in position 16 is any amino acid
  Variant (17)..(17): Xaa in position 17 is Ala, Cys, Asp, Asn or Thr
  Variant (18)..(18): Xaa in position 18 is any amino acid
AFGXXAGXAGAAXXXXXXA

SEQ ID NO: 6193 - protein, 23 aa, Artificial sequence
  protein pattern
  Variant (2)..(2): Xaa in position 2 is Ile or Leu
  Variant (3)..(3): Xaa in position 3 is any amino acid
  Variant (4)..(4): Xaa in position 4 is Ala, Asp, Glu or Gln
  Variant (5)..(5): Xaa in position 5 is any amino acid
  Variant (6)..(6): Xaa in position 6 is Asp, Gly or Val
  Variant (7)..(7): Xaa in position 7 is Ile, Leu or Val
  Variant (9)..(9): Xaa in position 9 is Phe, Ile, Leu or Val
  Variant (11)..(11): Xaa in position 11 is Ala or Cys
  Variant (13)..(16): Xaa in position 13 to 16 is any amino acid
  Variant (17)..(18): Xaa in position 17 to 18 is any or no amino acid
  Variant (20)..(20): Xaa in position 20 is any amino acid
  Variant (21)..(22): Xaa in position 21 to 22 is any or no amino acid
EXXXXXXFXNXIXXXXXXPXXXF

SEQ ID NO: 6194 - protein, 16 aa, Artificial sequence
  protein pattern
  Variant (2)..(3): Xaa in position 2 to 3 is any amino acid
  Variant (4)..(4): Xaa in position 4 is Ile or Leu
  Variant (5)..(5): Xaa in position 5 is Ile or Val
  Variant (6)..(6): Xaa in position 6 is Ile or Leu
  Variant (12)..(12): Xaa in position 12 is Cys or Val
  Variant (14)..(14): Xaa in position 14 is any amino acid
PXXXXXGALGRXGXGA

SEQ ID NO: 6195 - protein, 24 aa, Artificial sequence
  protein pattern
  Variant (4)..(4): Xaa in position 4 is any amino acid
  Variant (5)..(5): Xaa in position 5 is Gly or Thr
  Variant (6)..(6): Xaa in position 6 is Ala, Cys, Thr or Val
  Variant (7)..(8): Xaa in position 7 to 8 is any amino acid
  Variant (10)..(10): Xaa in position 10 is any amino acid
  Variant (11)..(11): Xaa in position 11 is Ala, Asp, Glu, Gly or Ser
  Variant (12)..(12): Xaa in position 12 is any amino acid
  Variant (14)..(15): Xaa in position 14 to 15 is any amino acid
  Variant (16)..(16): Xaa in position 16 is Ile or Val
  Variant (17)..(17): Xaa in position 17 is any amino acid
  Variant (18)..(18): Xaa in position 18 is Ile or Val
  Variant (20)..(20): Xaa in position 20 is any or no amino acid
  Variant (22)..(23): Xaa in position 22 to 23 is any amino acid
  Variant (24)..(24): Xaa in position 24 is Asp, Gln, Arg or Ser
LTPXXXXXLXXXGXXXXXEXSXXX

SEQ ID NO: 6196 - protein, 15 aa, Artificial sequence
  protein pattern
  Variant (2)..(2): Xaa in position 2 is Glu or Pro
  Variant (3)..(3): Xaa in position 3 is any amino acid
  Variant (4)..(4): Xaa in position 4 is Asp, Glu or Gly
  Variant (5)..(6): Xaa in position 5 to 6 is any amino acid
  Variant (8)..(8): Xaa in position 8 is Phe, Ile, Leu or Val
  Variant (13)..(13): Xaa in position 13 is Ile, Leu or Met
  Variant (15)..(15): Xaa in position 15 is Asp or Glu
AXXXXXIXGLKEXPX

SEQ ID NO: 6197 - protein, 14 aa, Artificial sequence
  protein pattern
  Variant (2)..(2): Xaa in position 2 is His or Trp
  Variant (3)..(3): Xaa in position 3 is Ala, Leu or Val
  Variant (5)..(5): Xaa in position 5 is any amino acid
  Variant (7)..(7): Xaa in position 7 is Ala, Gln, Ser or Thr
  Variant (8)..(8): Xaa in position 8 is Lys or Arg
  Variant (9)..(10): Xaa in position 9 to 10 is any amino acid
  Variant (12)..(12): Xaa in position 12 is any amino acid
  Variant (14)..(14): Xaa in position 14 is Ala, Ser, Thr or Val
LXXRXEXXXXEXRX

SEQ ID NO: 6198 - DNA, 1548 bp, Saccharomyces cerevisiae
  CDS (1)..(1548)
atgaaagcgtacgcaaagaaacgtatctcttacatgccatcgtcaccatcacaaaatgttattaactttgaagaaatcgaaactcaaaaagaaaacattcttcccctgaaggaaggcagatcagcagcggcactctcgaaagcgatacatcaaccactggtggaaataaaccaagttaaatcaagcttcgaacaaagactgatagatgagctccctgcattaagcgacccaattactttgtatcttgaatacataaagtggctgaacaacgcctatccacaaggcggtaattccaaacaatctggaatgctcacccttttggagcgatgtttatctcacttaaaggatttggagagatatcgcaatgatgttaggtttcttaaaatatggttttggtacatagaactttttaccagaaattcattcatggaaagcagagacattttcatgtatatgttaagaaatggaattggttccgagttagcgtcattttatgaagaatttacgaatctattaattcagaaagaaaaatttcaatatgccgtgaaaattctacagctaggaatcaaaaataaggctaggcctaataaggttttagaagaccggttaaaccatctcctgagagaactgggggagaacaatattcagctaggaaatgaaatatcgatggactcattagagtctacagtacttgggaaaaccagatctgaatttgtcaatagactagagcttgcaaatcaaaatggcacatcaagtgacgtcaatttaacaaaaaacaacgtatttgtagatggagaagagtctgatgtagaactattcgaaactccgaatagaggtgtttatagagatggctgggaaaattttgacttaaaggcagaaaggaacaaagaaaacaaccttcgaatatcattgctagaagcaaataccaatttgggtgagcttaaacaacatgagatgttatcgcaaaaaaagagaccatatgatgaaaaactaccgatctttagagattctataggtagaagtgaccctgtttatcaaatgattaatacaaaggaccagaaaccagaaaaaattgactgtaattttaaactgatttattgtgaagatgaggaatctaaaggtggtagactagaattttcgctagaagaagtcttggcaatttctagaaacgtttataaaagggttaggacaaataggaaacatccaagagaagcaaatttagggcaagaagaaagcgcaaatcaaaaagaagctgaagcacaatcgaaaagaccaaaaataagtagaaaagccttagtctccaagtcgttgaccccctcaaaccagggaagaatgttttctggcgaagagtacataaactgccctatgacgccaaagggacgaagcactgagacgtctgatatcatctcagctgtcaagccgcggcagttaaccccaattttagaaatgagagaatcaaattctttttctcaaagcaaaaattctgagatcatttcagatgatgacaagtcgagttcgtctttcatatcgtacccaccacagcgttga

SEQ ID NO: 6199 - protein, 515 aa, Saccharomyces cerevisiae
MKAYAKKRISYMPSSPSQNVINFEEIETQKENILPLKEGRSAAALSKAIHQPLVEINQVKSSFEQRLIDELPALSDPITLYLEYIKWLNNAYPQGGNSKQSGMLTLLERCLSHLKDLERYRNDVRFLKIWFWYIELFTRNSFMESRDIFMYMLRNGIGSELASFYEEFTNLLIQKEKFQYAVKILQLGIKNKARPNKVLEDRLNHLLRELGENNIQLGNEISMDSLESTVLGKTRSEFVNRLELANQNGTSSDVNLTKNNVFVDGEESDVELFETPNRGVYRDGWENFDLKAERNKENNLRISLLEANTNLGELKQHEMLSQKKRPYDEKLPIFRDSIGRSDPVYQMINTKDQKPEKIDCNFKLIYCEDEESKGGRLEFSLEEVLAISRNVYKRVRTNRKHPREANLGQEESANQKEAEAQSKRPKISRKALVSKSLTPSNQGRMFSGEEYINCPMTPKGRSTETSDIISAVKPRQLTPILEMRESNSFSQSKNSEIISDDDKSSSSFISYPPQR

SEQ ID NO: 6200 - DNA, 1143 bp, Candida glabrata CBS 138
  CDS (1)..(1143)
atgccagctcaaaaagttaccaggtttgaggatattgaagttgaaaaagaaaatatagctcctttacgccatggaagatcagctcatcggcttgtgtctgcattgagccagaacgatgatgagatcaagagaatacgggcaagctttgaatcatcattgttggttaaaattgaggatcatgacgatcctttggtcctttatctagactatattgattggattaatcatgcttttcctcaagggggttcctcaagatcaagtggaatgctggacgttattgaacggtgcataacatacttcaaggatagcgaaagatatagagatgacgaaaggtacgtgaagatatggctgtggtatatggagctcttttctgataagtataaatctgattgtaaggatctgtttatattcatgcttcgcaacagaatagggagtaaagtgccattaatgtatgaagagctgagttcacttttatatgaattgaaagaatacaaatatgctatatctgttattaatctcggattaaaagaatgtaaatatgggaataaatcattagttgataagaggcaattgttgctcgagaaacttggagatgatgctaaagttatcgatgattcagtagaaatgctagatggagctgagcgagttatattaggtaagaagcagtcagaacttagagaaaaggctaaatctaataaaacttcagatagagaaactaaaatgagtagttcgatttacacagatagtcaagatcctgaagttcacgacgagccgttgtcatgtttacgaaattgggatatatttgagatcttacatagtagaaacaaagagaaccgaatattggcagaacctctaatattaaatgaactagataggacttttagtggtgatcaattgaaaggagggaagaagatgatactatttcaagataatttagggcgatcggaacctgtgtataagctaattaagaataacagtggaaaattagaaaaaattgattacaatacaaatttactcatatatgaagggagggaaatatgtttggaagagatattgactatgatgaagagtaacactcaaaataacaaaaggcggagggaatatgatgattcaaagaatttgcatataaaaaagcagcggtaa

SEQ ID NO: 6201 - protein, 380 aa, Candida glabrata CBS 138
MPAQKVTRFEDIEVEKENIAPLRHGRSAHRLVSALSQNDDEIKRIRASFESSLLVKIEDHDDPLVLYLDYIDWINHAFPQGGSSRSSGMLDVIERCITYFKDSERYRDDERYVKIWLWYMELFSDKYKSDCKDLFIFMLRNRIGSKVPLMYEELSSLLYELKEYKYAISVINLGLKECKYGNKSLVDKRQLLLEKLGDDAKVIDDSVEMLDGAERVILGKKQSELREKAKSNKTSDRETKMSSSIYTDSQDPEVHDEPLSCLRNWDIFEILHSRNKENRILAEPLILNELDRTFSGDQLKGGKKMILFQDNLGRSEPVYKLIKNNSGKLEKIDYNTNLLIYEGREICLEEILTMMKSNTQNNKRRREYDDSKNLHIKKQR

SEQ ID NO: 6202 - DNA, 2880 bp, Kluyveromyces lactis NRRL Y-1140
  CDS (1)..(2880)
atgggtccaatccatttcgatgaattggaggcacagaaagagaatataatatcgctacctcaaggacgatctgcgacacgcgtcacttctgctatgaacaaatctctgagttctatatatgatacaaggctcgccttcgaacgtgatatccatgatacattggatgaacttgatgatccattgcaattgtttttagagtatatcaactggattcacgataactatccttctcccaccacaagacaatctggcttaccagagataatggaaagatgtatagagtactgcaagaatattgaaacgtacaaaaacgatgtacgatacttgaagttgtggttacagtatattgatctatttgccgtcaaattggatgaaaaaagagaaatgttcgtctacatgatgagacttgaaatcggagatagattagcattgtattacgaaagtttctcccagttgttgatcaatatggatgcatccggagacgcactagatttgattgaccgagggatagaaaaaaaagcaaggccactgcggcgacttgaacaattcaaactaagtgtccaacaagcaatacaaactcgtggtctaacggagcaggaactaccgcgaagcttttcaacattcgaaatccatggtgatcttgtccttggaagatatagaagtgagataaatgatactcgcaataattctattagccgcaataatgataatagcatgtctgaaagatcgcagaactcgttgaaatccactggaaaattgcaagtatttgctgataatgaagaagaactgcaaaatgataaatttatgttgaggcaggacctccctaccttgccaccatataaaacccgaaataaagagaatcatacgccggccataccttttaaatcaggatctacgatagcgccattgaaacaatctaacagcttttcgcaaacagatttggataaaataccagtattcagagatgatctcggacgggctacgccggtttataaactgatagaagttcctggtcggaagccagaaaaaatacaaacaaattttgaattactataccctacagcggatgaggagtattgtattgaagaagttttggcactagcaagaaactgctactataaggaaaaaaattccagtgtcaaacgacatttggaagaaaataatcacgagaattccaaacccatgaagaaaagaggtctgcaaccaaaatctcccgagtatcataaggtaactacaacttcaatccttcctttaaaaggagacattgaaccagatggtttaaccggacattctgatggtaagtcaaagtctccgacagtaactatgttctccaaagatgccatgaatgaagtatattcaatgttcaatcaaagttatcatgacatgaaaaattactctgaccatgacgatacaactagtggtaagttcaccatgtatgaaaactttcaagaagatctaacaggtaaaaactctgaagacttaacagaagtcaaacagccgatggaaagtaaaaacttaagtgccagtaccagtgccaatgcaacaccttccagagatcaaaagcaagaaactactacccccactttcaaaagtaaactacaggattatatgacaccaattcaggaaagaactgaacccaatttcaagaccctactgtcgcaagatgacgatatcactggtgaatctagaaggaagagtacaaattcagttaatacggcggaatcttcgccttttcttacacaacctcagcgattacttgacccctcaccttcacaccagattgttgagaatccattaagtttggagctaagaagagagttattggaatcgttggatccagctttagcatcatacccaacatattatgaatattcgcaacagttgaaaatgagctctttattgaagcggattcagaaagtgtcaaaaaatatgaacaaaaatccgatagtcgatttcaagaaaaccaacgatttgtattgtatcagaagggaacttggagaaggaggatatgcaacagtatatctcgcagaatctagcacaggccaattaagtgctttgaaggtagaaaaaccggcaagtgtatgggaattctatatactaaaacagatagaaagaagagtgccagacgaagcaatactaaaatccataataaatgtaagtgcattgcattgcttccaggacgaaagctatcttgtgttaaattatgctaaccagggaacaattttagatctagttaattgggaacgcgagagaaatggaggtgcattagatgagtgcctctgcatgttcataactgtagagttgatgagagttttagaatgtattcacgatgtgggaattatccacggcgatattaagccagataattgcatgatcagatttcagaaagtgtctcatttgggtaagtattttgcaaatggagaaaatggatggaatagaaagggaatttatctcattgattttggaagatctttcgatctttcattattcccactgggaaccaaattcagatctaactggaagactgaccaacaggattgccctgaaatgagagagcaacgtccatggagctacgaagctgattattatgggcttgctggggtgatattttgcatgctattcggacattacatcgaaacagtaaaagtagcgtccaacagataccagttgaaaagccctttgaaacgttactggcagcaggatatttggaatccactttttgatttattaataaatagtggagcacatgacagcacacttgtttcaaaacttcgccattatagggagcgtatggaatcgtaccttgaaagagaatcggcattgaagctcagaaatgtcgtccttagtcttgaagcggatctcgagcatttgagaaaatga

SEQ ID NO: 6203 - protein, 959 aa, Kluyveromyces lactis NRRL Y-1140
MGPIHFDELEAQKENIISLPQGRSATRVTSAMNKSLSSIYDTRLAFERDIHDTLDELDDPLQLFLEYINWIHDNYPSPTTRQSGLPEIMERCIEYCKNIETYKNDVRYLKLWLQYIDLFAVKLDEKREMFVYMMRLEIGDRLALYYESFSQLLINMDASGDALDLIDRGIEKKARPLRRLEQFKLSVQQAIQTRGLTEQELPRSFSTFEIHGDLVLGRYRSEINDTRNNSISRNNDNSMSERSQNSLKSTGKLQVFADNEEELQNDKFMLRQDLPTLPPYKTRNKENHTPAIPFKSGSTIAPLKQSNSFSQTDLDKIPVFRDDLGRATPVYKLIEVPGRKPEKIQTNFELLYPTADEEYCIEEVLALARNCYYKEKNSSVKRHLEENNHENSKPMKKRGLQPKSPEYHKVTTTSILPLKGDIEPDGLTGHSDGKSKSPTVTMFSKDAMNEVYSMFNQSYHDMKNYSDHDDTTSGKFTMYENFQEDLTGKNSEDLTEVKQPMESKNLSASTSANATPSRDQKQETTTPTFKSKLQDYMTPIQERTEPNFKTLLSQDDDITGESRRKSTNSVNTAESSPFLTQPQRLLDPSPSHQIVENPLSLELRRELLESLDPALASYPTYYEYSQQLKMSSLLKRIQKVSKNMNKNPIVDFKKTNDLYCIRRELGEGGYATVYLAESSTGQLSALKVEKPASVWEFYILKQIERRVPDEAILKSIINVSALHCFQDESYLVLNYANQGTILDLVNWERERNGGALDECLCMFITVELMRVLECIHDVGIIHGDIKPDNCMIRFQKVSHLGKYFANGENGWNRKGIYLIDFGRSFDLSLFPLGTKFRSNWKTDQQDCPEMREQRPWSYEADYYGLAGVIFCMLFGHYIETVKVASNRYQLKSPLKRYWQQDIWNPLFDLLINSGAHDSTLVSKLRHYRERMESYLERESALKLRNVVLSLEADLEHLRK

SEQ ID NO: 6204 - DNA, 2787 bp, Debaryomyces hansenii CBS767
  CDS (1)..(2787)
atgctgagccaaacagatgcttcgcttatagaacatgataaagagaatatacagcctttacccgaggggaggtcagcttctaaattagcattgaatttcaaaaacgcatcaaaatcggtacttaagtacaaagaacaacaacaaaaaagaaaagaacaatttgagttacaattagaaaattcagaagaattagatgatccattacaggtattcttagattatataaattggactcatgatacatttcctcaaggctccaatactgagagtggattattggctttattggaaagatgtacttcatgctttcgagacgtagcacattacaagaatgacccacggtatttgaaagtatggttggaatataccaactactccgattctccgaaagatatttttgtttacttggccaaaaaggaaataggcaccgaattagcattgtattatgaagaatttgcaaaatacttggagcttaatgagaagtttcaagatgcaactcagatatatgaaatgggggttgaatataaggcaaggcctttggttcgacttgaacgatcatttatgcaattcaacgaaagaatgcatgatccggccaggagaacagatcgaggtgaatcgtccataaaaaatgttctcgctgtgaagagaggagattcagctgttccaattggaatgacggatgcccaagcaacaagaaagagacccaaattgcaagtgttcgtggaagacgaggacaagaaccaggacattttgaacactctatttgatgggctggccaatccacctgaacttgggcctattaaaacaagggtaaaagaaaacatcttaacatcaaagccatggtgcggtgaaactatcaagcagaagttagagccaaccaaacctgagtctaagatcacagtattcaaagatgttgcccatgatacagatggcgcagtacctatacaaacaatcgaagaagacgaaaacggattaatgcatactttaataagacacccaggaaaaaaccaagaaaaagttagtttaaatatggatttattatatccagaacagggagacgaatattgcttggatgagattttagccctaaccagaaagctaagtaaagtttcattaggctacgaagagcagcaaaatttaatacctgaagaaaaaacaccacttaagccgcataataacatagtagatgaaagtactttctctaaggatattactttcacaattccgttgaaagatggaggtcttcatgaggacgatgatactcatttaccttttaaacacagaccgaattcacctacaatgacgatgttttctcgtatggcaactaatgaagtactcactatgtttaatgatgcaggtcagaatttgaatacagatgacgaggaggaaaaaactgaaggtgaaaatactacgaattttgatggatttgtcacagaaacaattcatgcaataaaacccgaagaaaaagaattaaaacaacaaatttcaaatgaaacaggacattctaatgaaggaaatttggagaagactataacacctacgagggatactaatgtccagggagatagtgttcagagttccccctttatagagagaccctcatcctcagtaatagataaggaactgaatatatttgacccagtagacgagtctttaagggaacgattactagacgatttggcgacacccatatcttcgtattctgggttttgcaattattgctataccaagattaataagataaagagatttcacgagataacaaacaataaaactaaaataattactaaaggttctaaaaattcaataattgactattgtggggatgagatttattgcttaagatatgagttggggcatggcggatacggtgtagtttatctcgttgaaacggaaatggggaagttaaaggcattgaaggtggagtctccatcatcaaaatgggagtattatattctaacccaaattcatcaaagactaactatatttgattgtgatattagggaaatgatagtcaaacccgaggcactcttcttctttcaggatgaaagttacttattaatgaattatgtgaaccaaggcactattttggatgtggtaaatatttataaaaacagaggatcaactgttgatgaagtgttgtgtatatatttaacagtcgaattgttaaaaattatcgaagttctccatagcataggtattattcatggtgatctaaaatctgataactgcatgatcaggtttagccattccaaggagtggagtgacacttacagccgttacggaagtgatggctggtttaataaaagcataaccttgatagattttggaagagccatagatatgacattattcaaccaaaatgcccaattcgtttccaactgggaaacggaccagcaggattgcccacagatgaataagcatgaaccttggagctttgaagcggactactacggcctcgccagtattatttataccatgctatttggaaagtatatagagatcaaagaatctaccactggtagcgtatttctcagtcatactctaaagaggtactggcaacttgacttgtggaatccattattcaacttgttgcttaatccatattctcgatcagacgattctaatatcaaattaccgattacagaggaactcaagttccaaaggcatcgccttgagaattggttggatgctaacggctcaaaaaagaatcttaagagctcaatacacgatatcgaagaggaattgaataatgataataagaagttgttcaatagccttcgttag

SEQ ID NO: 6205 - protein, 928 aa, Debaryomyces hansenii CBS767
MLSQTDASLIEHDKENIQPLPEGRSASKLALNFKNASKSVLKYKEQQQKRKEQFELQLENSEELDDPLQVFLDYINWTHDTFPQGSNTESGLLALLERCTSCFRDVAHYKNDPRYLKVWLEYTNYSDSPKDIFVYLAKKEIGTELALYYEEFAKYLELNEKFQDATQIYEMGVEYKARPLVRLERSFMQFNERMHDPARRTDRGESSIKNVLAVKRGDSAVPIGMTDAQATRKRPKLQVFVEDEDKNQDILNTLFDGLANPPELGPIKTRVKENILTSKPWCGETIKQKLEPTKPESKITVFKDVAHDTDGAVPIQTIEEDENGLMHTLIRHPGKNQEKVSLNMDLLYPEQGDEYCLDEILALTRKLSKVSLGYEEQQNLIPEEKTPLKPHNNIVDESTFSKDITFTIPLKDGGLHEDDDTHLPFKHRPNSPTMTMFSRMATNEVLTMFNDAGQNLNTDDEEEKTEGENTTNFDGFVTETIHAIKPEEKELKQQISNETGHSNEGNLEKTITPTRDTNVQGDSVQSSPFIERPSSSVIDKELNIFDPVDESLRERLLDDLATPISSYSGFCNYCYTKINKIKRFHEITNNKTKIITKGSKNSIIDYCGDEIYCLRYELGHGGYGVVYLVETEMGKLKALKVESPSSKWEYYILTQIHQRLTIFDCDIREMIVKPEALFFFQDESYLLMNYVNQGTILDVVNIYKNRGSTVDEVLCIYLTVELLKIIEVLHSIGIIHGDLKSDNCMIRFSHSKEWSDTYSRYGSDGWFNKSITLIDFGRAIDMTLFNQNAQFVSNWETDQQDCPQMNKHEPWSFEADYYGLASIIYTMLFGKYIEIKESTTGSVFLSHTLKRYWQLDLWNPLFNLLLNPYSRSDDSNIKLPITEELKFQRHRLENWLDANGSKKNLKSSIHDIEEELNNDNKKLFNSLR

SEQ ID NO: 6206 - DNA, 25 bp, Artificial sequence
  primer
atgaaagcgtacgcaaagaaacgta

SEQ ID NO: 6207 - DNA, 23 bp, Artificial sequence
  primer
tcaacgctgtggtgggtacgata

SEQ ID NO: 6208 - DNA, 2472 bp, Saccharomyces cerevisiae
  CDS (1)..(2472)
atgaacttcaatacacctcaacaaaacaaaacgcccttttcgttcgggactgccaacaataactctaacaccaccaatcagaattcctctactggtgcgggcgccttcggaacaggtcaatcaacatttggtttcaacaattctgcgccaaataacacgaacaatgcaaactcttcaatcacacctgcatttggtagcaataacactggtaatactgcattcggtaacagtaaccccacaagtaacgtttttggcagcaacaattctacgactaatacatttggtagtaatagtgcagggacatccctttttggatcttccagtgctcaacaaacgaagagcaatggaactgctggaggaaatacatttggttcttcatccttattcaataacagtactaatagcaatacgacaaaacctgcgttcggcggtttgaattttggcggcggcaataacacaactcctagctcgaccggtaatgctaacacaagtaataacttatttggcgctaccgcaaatgcgaataagccagccttttcctttggtgcaaccactaacgacgataaaaaaacagaaccagacaagcctgctttctcctttaattcaagtgtcggtaataagacagacgctcaagctcccactacaggattttcctttggttcacaactaggtggaaacaaaacggttaacgaggctgcaaagccttccctttcatttggttcaggatcagctggtgctaacccagctggagcttcgcaacccgaacctacaactaatgaaccagcaaaaccagccctctcttttggtactgcaacatccgacaataagacaactaacacaaccccaagtttttcgtttggtgctaaatcggatgaaaataaagctggtgctacttctaagcctgccttctcattcggtgctaagccagaagaaaagaaggatgataattcctcaaaaccagctttctcatttggtgccaaatcaaatgaagacaagcaagatggaacggctaagccagcattttcctttggtgccaagcccgcggagaagaataacaatgaaacctccaagccggcattctcttttggagcaaagtctgatgagaaaaaggatggtgatgcctctaaacctgccttctcttttggcgctaaaccggatgaaaataaagctagtgctacttctaagcctgccttctcattcggcgctaagccagaagaaaagaaggatgataattcctcaaaaccagctttctcatttggtgccaaatcaaatgaagacaagcaagatggaacggctaagccagcattttcctttggtgccaagcccgcggaaaagaataacaatgaaacttccaagccggcattctcttttggagcaaagtccgatgagaaaaaggatggcgatgcctctaaacctgccttctcatttggtgctaaatcggatgaaaaaaaggacagtgattcttcgaagcctgccttctcatttggtactaaatcgaatgaaaaaaaggacagtggttcttcgaagcctgccttctcattcggtgctaaacccgatgaaaagaagaatgatgaagtctccaagcctgccttctcattcggagcaaaggctaacgaaaagaaagaaagtgatgaatcaaaatcagccttttcatttggttctaagcctacaggaaaggaggaaggcgatggggcgaaggctgccatttcctttggtgctaaacccgaagaacagaaatccagtgatacgagcaagccagcgtttacttttggtgctcaaaaagataatgagaagaaaacagaggaatcttctacggggaagtcaaccgcagatgtcaaatcaagtgatagcttgaaattaaattctaaaccagtagaattgaagccagtttctctcgacaataaaacactggacgatttagtaacgaaatggactaaccaactaacagaatcggcctctcattttgaacagtataccaaaaaaattaatagttgggatcaggtactagtgaaaggaggtgaacaaattagtcagttatactcagatgctgtgatggcggaacatagtcaaaacaaaatagatcaatctctacaatatatcgagaggcaacaggatgaattagaaaacttcttagacaattttgaaaccaagacagaggcacttctgtccgatgttgtgtctacaagttcaggtgctgcggccaacaataatgaccaaaaaagacaacaggcctataagacagcccagactttggacgaaaatttaaactcgttgtcatccaatctttcttctctaatagtagaaatcaacaatgttagtaatacattcaacaaaaccactaacatcgatataaacaatgaagacgaaaatattcaactaatcaaaatcttgaattcacatttcgacgctttaaggtcactagacgataactccacctctctggaaaaacaaatcaactcgataaagaaatga

SEQ ID NO: 6209 - protein, 823 aa, Saccharomyces cerevisiae [sequence omitted]

SEQ ID NO: 6210 - DNA, 2220 bp, Arabidopsis thaliana
  CDS (1)..(2220)
atgtcggggtttccatttggtcaatccaattccgttggaggattctcattcggatcttcttctgcaactaattcctcttctgcttcatctaccacttctccgttatctttctcctttaaccaatcttcaaaccctagctccaccggattcggtttcggatcctccgtatcatcaactcctgcttcctccactactccatcgtttggattcggagcttcctctactccttccttcggattcggttcttctgcttcttcatcgactccatcgttcggattcggatcttctgcctccgtgactcctgcttccacaactccatcgtttggatttggaaccgccgcttcttcatctgctcctgctccgtcgctgtttggttcatctaccaccaatgcttcttcagctgctcctggttcttctcctttcggatttgtaacttcctcggcctcttccaccgcaactccatcgtcatctctatttggagctcccgcttcttccgccgcaactccatcgtcatctccattcggagctgctccagccagtggttcaacacctctctttggatcttccccttccttattctctgctccttcatctgcctccgcctctaattcttctctcttcggagcatcctcatccgccgctacttcaacatctcctcttttcggcgcgccatcatcagccaccggcgcaacaccgtcctttagcgtggcctcatcagcacctggctcctcatcatccatctttggagctaccggctcgtcaccttccttcagtgttgcctcatcagcctctggctcctcaccgtcaatctttggagctaccggttcttcaccgttctttggttcgtcttcttcagccggttcaactccgtctctctttgcatcttcctcgtcaggcgcaacaacttcttcaccatccccgtttggagtatccaccttcaattcctcatctacatccaatacctcgaatgcctcagcttctccattctccgcttctaccgggttctctttcttgaaaagcactgcaagttcgaccaccagctccaccactccttctgctcctccacaaacggcttcatcttcgtcctccttctcatttggtacatccgccaattcaggttttaacctttcaaccggaagctccgcagcacctgcatctagcacatccggagcagtgttttccattgcaaccaccactactacttcttcttcgactccggctgctactagtgcaccagcttcttcagctcccgcttctacaatggctttcccttcttttggtgtgacttcatctgcaaccaacaccactccggctagctccgctgctacattcagtactacaggatttggtttggctagctcgactcctgccactggatctacgaactcttttactgggtttgctgtaccgaagacatcaacacctgcatcatcttcacaaccacaaactactagtcctgcattctcattcagtctcccatcttcgacttctactactgctcctgctactagttctgctactacaacacagacaactcttgttgttccttcaagtagtgggacgagcacagctgttgctccagtggctggttctccaaagttgccatctgaaataactggcaaaactgttgaggagattatcaaggagtggaatactgagctacaagagcgcacagggagattccggaaacaggcaaatgcaatagcagagtgggataagcggatcttgcaaaaccgtgatgttcttttgagacttgagattgaagttgcaaaagtggttgaaacccaatctagcttggaacgacagctggaattaatcgagactcatcagcaagaggttgacaaggctttgcaaagcatggaggaagaggctgagcgtatatataatgacgagcggaaatcacttctggacgatgaagcagcatcaactagagatgcaatgtatgaacagtctgagctagtagaaagagaactggagcatatgactgaacaaatcagatcgattatacaatccgtaaatgcaaaccagggtggagaacttgaagcgatagatgggatgagtccacttgatgtagttgtcagaatcttgaacaatcaactcagttccttaatgtggattgatgagaaagcagaggaattctcttctcggattcaaaaaatcgcattgcaaggttcgggtggagatcgtgaattgatggctccaaagcactggatgtcttga

SEQ ID NO: 6211 - protein, 739 aa, Arabidopsis thaliana
MSGFPFGQSNSVGGFSFGSSSATNSSSASSTTSPLSFSFNQSSNPSSTGFGFGSSVSSTPASSTTPSFGFGASSTPSFGFGSSASSSTPSFGFGSSASVTPASTTPSFGFGTAASSSAPAPSLFGSSTTNASSAAPGSSPFGFVTSSASSTATPSSSLFGAPASSAATPSSSPFGAAPASGSTPLFGSSPSLFSAPSSASASNSSLFGASSSAATSTSPLFGAPSSATGATPSFSVASSAPGSSSSIFGATGSSPSFSVASSASGSSPSIFGATGSSPFFGSSSSAGSTPSLFASSSSGATTSSPSPFGVSTFNSSSTSNTSNASASPFSASTGFSFLKSTASSTTSSTTPSAPPQTASSSSSFSFGTSANSGFNLSTGSSAAPASSTSGAVFSIATTTTTSSSTPAATSAPASSAPASTMAFPSFGVTSSATNTTPASSAATFSTTGFGLASSTPATGSTNSFTGFAVPKTSTPASSSQPQTTSPAFSFSLPSSTSTTAPATSSATTTQTTLVVPSSSGTSTAVAPVAGSPKLPSEITGKTVEEIIKEWNTELQERTGRFRKQANAIAEWDKRILQNRDVLLRLEIEVAKVVETQSSLERQLELIETHQQEVDKALQSMEEEAERIYNDERKSLLDDEAASTRDAMYEQSELVERELEHMTEQIRSIIQSVNANQGGELEAIDGMSPLDVVVRILNNQLSSLMWIDEKAEEFSSRIQKIALQGSGGDRELMAPKHWMS

SEQ ID NO: 6212 - DNA, 2025 bp, Magnaporthe grisea 70-15
  CDS (1)..(2025)
atgtccacgcccttcagcttcggcacgcccggtgccacgccgggcacttcggccccggcatcaggtgggttgtttggggcagcagcagcagcaggagcaagcagcaccccatccttcagtttcggcaacaaatcatcaactccagccaccggagccggcgctgctcagccaagtaccggcggcgggctctttggcaactcgagctctaccacgacagcacagacaccgtccattttcggcgccaaacctgcaagcacaacaacggcaacagcagccacgtccggtgcgccgttgtttggcggagtcagcaataccggtagcagcggcggcctctttggaaatgcctccaagccagctcagacaggagggctttttggttcggcagcaactccgcctgctacaacaaatctctcatctaccccgatgtttggcggcgccgcgggtgctgcctcaactactccctcaacgggaggcctctttgctggaacaaactctggtgctactctgggttcgacgacaccttcaaagccactgttccccatgccctcgacgacacctgccggcccccctcccagtgcagctgcgaaaccaggcctgtttggagctgcaccggcatcatcaggcgccacgcaagctccgtcgttaacatttggagctcccaaagccagtgctgcaccggctgcttccagcacaccctcgtcgcaacccgcagcttcggcggcacctctgtttggtggcgcaagtcagccaagtagcacggggccctcgttgtttggcggtgcttcggcagcacctgctgcgtccggtggcttgtttggaaacaagccagcctcaacagaagccccggtctcgggcggcctcttcggcgcgaagagtgccacaccttccacccagcccgcagcgactggcggtctatttggcgccgcttctgctccatctaccaccccagccagcaccgccgcagccactgcaactcccgcggccgctccttctggtctgtttggcgccgccgctaaaccgctcactacgactgctgcatcggcggctccagctaccacaacgacaacttcgtcgacgccgtcactgttcggttcagctgcggcgccagcgaccacaacggcagctgcttccaagccatcattatttggttcgggggcgacggcgccagccaccacaacagcagccgcggctactccatcattgtttggctcagcggcagcgccagcagcttctacagctacttctgcggactcgaccggtcttggcgggctcaagcctgcgactgcagctgatgcgactaagagtaccacaggcactgccggccaacccgctgcatctgctctgaatacttcaaccatgggacccacctcatcactgccgagactgaagaacaagactatggatgagattatgacacgatgggcaaccgacctcaacaagtatcaaaaggagttcaaggaccaggcatccaaggtggcagcttgggatcggctccttgttgaaaatggagagaagattcagaaactgtacttggagacatatgaggctgagcgtgccagcaacgagatcgaacggcaactgcagtctgtcgagagccagcaagatgagcttgcatcttggcttgaccgttacgagcaggaagtcaacgatatgttttcccgacaagttggcaaggatgagcaacttgcagggcccgaccaggagcgtgagcgcacatacaagctcgcagaacgccttactgaccgcctagacgagatgggcaaggatctgggcaagatgatcaaggagatcaacgaaatctctggcacaatcagcaagggcagcaaacctgatgatcccttggcgcaaattgttcgcgtgctcaacggacacctcagccaactacaatggatcgacacgaacgcatcggctcttcaagccaaggttgcggcggctcaaaagtctggaaacagcactggtggacatggtggcgacgatggtgatgcgactgacagcttctatcgctcgtacatgggccgtcgttag

SEQ ID NO: 6213 - protein, 674 aa, Magnaporthe grisea 70-15
MSTPFSFGTPGATPGTSAPASGGLFGAAAAAGASSTPSFSFGNKSSTPATGAGAAQPSTGGGLFGNSSSTTTAQTPSIFGAKPASTTTATAATSGAPLFGGVSNTGSSGGLFGNASKPAQTGGLFGSAATPPATTNLSSTPMFGGAAGAASTTPSTGGLFAGTNSGATLGSTTPSKPLFPMPSTTPAGPPPSAAAKPGLFGAAPASSGATQAPSLTFGAPKASAAPAASSTPSSQPAASAAPLFGGASQPSSTGPSLFGGASAAPAASGGLFGNKPASTEAPVSGGLFGAKSATPSTQPAATGGLFGAASAPSTTPASTAAATATPAAAPSGLFGAAAKPLTTTAASAAPATTTTTSSTPSLFGSAAAPATTTAAASKPSLFGSGATAPATTTAAAATPSLFGSAAAPAASTATSADSTGLGGLKPATAADATKSTTGTAGQPAASALNTSTMGPTSSLPRLKNKTMDEIMTRWATDLNKYQKEFKDQASKVAAWDRLLVENGEKIQKLYLETYEAERASNEIERQLQSVESQQDELASWLDRYEQEVNDMFSRQVGKDEQLAGPDQERERTYKLAERLTDRLDEMGKDLGKMIKEINEISGTISKGSKPDDPLAQIVRVLNGHLSQLQWIDTNASALQAKVAAAQKSGNSTGGHGGDDGDATDSFYRSYMGRR

SEQ ID NO: 6214 - DNA, 2130 bp, Gibberella zeae PH-1
  CDS (1)..(2130)
atgtcgttcagtttcggcaacacaagctcttcgggcgcatccaacaataacacaacatcgactgcgccggcatcgggaaatctctttggtgctgctactggaagccccggcttctcattcggctcgatcggtggttccgccgccggcaacaactcaacacctgccagcaacagttcaagcaacttgtttggtggtcaacaaagcggcgcaacagctcagaagccccctgggggcctgtttggtggcggcgcgaccgcgtccaataccactactactccgaactccagcggaatcttcggcggtggcggctctactactcctgcgacaggcggcctttttggaggaggtgcttctacaacacccgcagcaaccacagctccttcaagcggcggaatgtttggcggcggcggcgccgctagttctactgcaccggcttccggaggactgtttggaaacgcaggaaacaacgcaagcaagcctgcggccggtcttttcggaggcggtggctcttctactcctgctagcagcggtggtggtctgttcggtcagaacaacgccaaccaagcctcgacagcgacctcctcagctgcaccagcatcaggtttgttcggaaatgccactactggagctgctactcctgccaaacctaccttttctttgccgtctacgacaccagctggagcaccccctaccgatgccgccaagcctgccggaggactgttcggcaacacaggtgcccaagcatcttctggagcatctggcctttttggaaatggagccaaaccggctgcgacttcagcttcttctgcccagcccagcacaactgcctcagcaacacccggtggcctttttgggggaggtgcacagtctggaagcagcgctcctgctggaggactctttggtgctaagccagcatctgctcccgctcccgctcctacctctggtggactgttcggagcaaagcctgagggtgctgcccctgctacgacccagggaggaagctcaactcctgctgccactacgacttccctgttcggtgctaagcctgcagcttctgcaacctcgaccccaagctcagcaccatctggtggtctcttcggcggcggcgcaacaacttctgctgcacccgcaagttccacgacaacgacaaccggaggactattcggagccaagcccgcgactaccacagcttctgcaacaactcctgctgcaactacaaccgctggtggtttattcggagctgctgctagcagccaagcaacaggctcggcagctaccaccactgcagccactggtgcatcgacgaccacttccgccccagcatcaagctctgcccctgcttcagctagcagtttgttcggcgcgaagccagccacagatgccagcaaggacgccagcaaggacgcagctaaacccgcgactaccagtaccactcccggtcctctaggcgcttccaccactggcccaacatcccagatggcgcgcctcaagaacaagactatggaagatattgtaacaagatgggcatcggacctttccaagtaccagaaggaattcaaggagcaggcaaccactgtgtccaagtgggacagaagtcttgtggacaacggcgaaaagattcagaagctataccttgatacttttgaagccgagcgagcaagccacgaaatcgagcgacagcttgctgccgttgagagtcaacaggacgagctcgaggcatggttggatcgatacgagtctgaggtccaggatatgtttgccaaacagctgggtcctggcgaacaattggccggacctgaccaggagcgtgagcgtacgtacaagctcgcagagaaacttacacaacaattggacgagaagtcgcgcgatctgtccaagatggttaaggagattaacgacatctctggtacattgaacaagggtgccaaacccgaggaccctctgagccaaatcgttcgtgttctcaacggccacctcacacagctgcaatggatcgatgctaatgcctcatcgttgcaagccaaggtggccgctgctcagaaatcaagcagtaacctaggaagtcactatgctggctcggataatgatgcggcggagagcttctatcgctcatacatgggacgacgatga

SEQ ID NO: 6215 - protein, 709 aa, Gibberella zeae PH-1
MSFSFGNTSSSGASNNNTTSTAPASGNLFGAATGSPGFSFGSIGGSAAGNNSTPASNSSSNLFGGQQSGATAQKPPGGLFGGGATASNTTTTPNSSGIFGGGGSTTPATGGLFGGGASTTPAATTAPSSGGMFGGGGAASSTAPASGGLFGNAGNNASKPAAGLFGGGGSSTPASSGGGLFGQNNANQASTATSSAAPASGLFGNATTGAATPAKPTFSLPSTTPAGAPPTDAAKPAGGLFGNTGAQASSGASGLFGNGAKPAATSASSAQPSTTASATPGGLFGGGAQSGSSAPAGGLFGAKPASAPAPAPTSGGLFGAKPEGAAPATTQGGSSTPAATTTSLFGAKPAASATSTPSSAPSGGLFGGGATTSAAPASSTTTTTGGLFGAKPATTTASATTPAATTTAGGLFGAAASSQATGSAATTTAATGASTTTSAPASSSAPASASSLFGAKPATDASKDASKDAAKPATTSTTPGPLGASTTGPTSQMARLKNKTMEDIVTRWASDLSKYQKEFKEQATTVSKWDRSLVDNGEKIQKLYLDTFEAERASHEIERQLAAVESQQDELEAWLDRYESEVQDMFAKQLGPGEQLAGPDQERERTYKLAEKLTQQLDEKSRDLSKMVKEINDISGTLNKGAKPEDPLSQIVRVLNGHLTQLQWIDANASSLQAKVAAAQKSSSNLGSHYAGSDNDAAESFYRSYMGRR

SEQ ID NO: 6216 - DNA, 2601 bp, Candida glabrata CBS 138
  CDS (1)..(2601)
atgagtgccttcggtaacagtggtggaggttctttcagcttcggcaacaattcatcgtctgcatttggagcggctgccaacgctggctctaacaatactggtggaagctcggccttttcttttggggccaatcagaatgcatccacaccatttggtggagctgcaacgaacaactcggcaaacaatggtggtgctaacaacactgcgtccccattcggaatgaacgcaaaccagaataagccattgtttggtggagcaacagctggccagtctagtagcccatttggtgcagcaagcaacaatactggtgcaaccccaggacagacaaataacacaagtgcttcacaaggcctatttggaagtaactcgaacaacgtctcacagaaacctgcctttggatttggcgcatcaaacacacaagctacacccagtttcggtggcttcggctcagcacaaaatggtagttcaaataatactactggtgctagtgcttttggggctgctacttcaaatacacaaaacacaacaccagcagctactaacacggggagtgcaatcggatcaacaccagcattcggtttcaatagtgccaacaataataacaacaacgcacaaaataataagccagccttctcctttggatcaacacaaccacaatccaataatacgctaggcacagcagcaggtacaaactccaacccaggcagctcaggcaaacctgcattctcctttggcgcttccaatacaaccagtactaccggaacagcaggtgcggtcggtaatacctctaatactcctgtacctccctcaggaagcactccaaaaccagcatttggaactagtgcatctactacaccagctccaggcgctggctctttttcattcggttcttcaattggcacagatgctaacaaaacagatgcagcaaagccatctctgtttggcggcttgaacaaacctgcggatgctgcatcgaaaccaaccctttcatttggtagcactgctccttcatcaaatactacaaatgacaaacctgctagtgacgcaaaacctgccttttcttttggcaatagtagcaccacaaataacggcccttctctattttcacaagcaaaaccagctgatgaagaaaaaaagacaaccccagctttgaactttggatcagctagccagtcaggtgaaaagacagaagaaaagaaacctgctttttcctttggtgctgcagcaacaggctcgacaactcaatctaaaccatcactgtcttttggaagtacaacaaaagaagaaaacaaatccagctctacaccagctttctcttttggttccaaaccagcaaatgacgacaagaaagatactccagaaacttctaataagccagaggcatcgaagccaagcttttctttaaatctaagtgcaggtacctctgaaaagaaggatgaaaattcaactaagcctttttcatttggaaccaaaactgctgaaaaagatgaaacgaagacagataaacctgccttttcttttggaaagacaactacagatactaacgagtccaaacccgccctttcgtttggaggcaagaatgagaactcggataaaaaatcgacactaacgtttggctctcaatcggagaagaaggaagattcaggtgctaaaccagctttctcctttggatctaaatctgataagaaagatgaacctccaaagccagcattttctctcggtactaagactgataaaactgaaatttctgaaagtaaacctggtttctcctttggcgctaaaacagacaaaccatcaactactacagacgttaacaaaactgaaacgccgaaagctggattttctttgaagtcggatagtaaagcggatgacaaatcaaaaaacttcagttttggcacatctaaggatggcaaaaatacttctgagaccgacaagactgaatctgcaaaatcaaatttaggaacagaggcatctagtcaacagaaactcgagtccaaaccagtggaagtaaaacctgtatcacttgataataaaacacttgatgacctggtgaccaaatggacaaaccaactctcatccgcttcgaagcactttgatcaatattccaagagaattacggattgggatcgtattcttgtagatggagggaaacaaattagccaactatacactgaagcagttaatgcagaacaagcacaaaacaaaatagatcaatctttacaatatatcgaaaggcagcaggaagaacttgagacattcctggataattatgaaagtagaacagaagcacttctttctgatattctaccatctaattcgggtgtgccaggcaataataatgatcaaaaacgtctacaagcttacaagactgccgaatcattggatgaaaatctaaatgctctttcggctaacttaagctctttaatcgatgaagtaaatgatgtcagcaacacatttaacaacgtaactagcataaacctgaacaacaaagacgaaagtgcccagctaatcaaattgctgaatgttcacctagatgctttgaagtctttggataataacgctcttctattggagaataagatcgattcaatccaaaaataa

SEQ ID NO: 6217 - protein, 866 aa, Candida glabrata CBS 138
MSAFGNSGGGSFSFGNNSSSAFGAAANAGSNNTGGSSAFSFGANQNASTPFGGAATNNSANNGGANNTASPFGMNANQNKPLFGGATAGQSSSPFGAASNNTGATPGQTNNTSASQGLFGSNSNNVSQKPAFGFGASNTQATPSFGGFGSAQNGSSNNTTGASAFGAATSNTQNTTPAATNTGSAIGSTPAFGFNSANNNNNNAQNNKPAFSFGSTQPQSNNTLGTAAGTNSNPGSSGKPAFSFGASNTTSTTGTAGAVGNTSNTPVPPSGSTPKPAFGTSASTTPAPGAGSFSFGSSIGTDANKTDAAKPSLFGGLNKPADAASKPTLSFGSTAPSSNTTNDKPASDAKPAFSFGNSSTTNNGPSLFSQAKPADEEKKTTPALNFGSASQSGEKTEEKKPAFSFGAAATGSTTQSKPSLSFGSTTKEENKSSSTPAFSFGSKPANDDKKDTPETSNKPEASKPSFSLNLSAGTSEKKDENSTKPFSFGTKTAEKDETKTDKPAFSFGKTTTDTNESKPALSFGGKNENSDKKSTLTFGSQSEKKEDSGAKPAFSFGSKSDKKDEPPKPAFSLGTKTDKTEISESKPGFSFGAKTDKPSTTTDVNKTETPKAGFSLKSDSKADDKSKNFSFGTSKDGKNTSETDKTESAKSNLGTEASSQQKLESKPVEVKPVSLDNKTLDDLVTKWTNQLSSASKHFDQYSKRITDWDRILVDGGKQISQLYTEAVNAEQAQNKIDQSLQYIERQQEELETFLDNYESRTEALLSDILPSNSGVPGNNNDQKRLQAYKTAESLDENLNALSANLSSLIDEVNDVSNTFNNVTSINLNNKDESAQLIKLLNVHLDALKSLDNNALLLENKIDSIQK

SEQ ID NO: 6218 - DNA, 2343 bp, Kluyveromyces lactis NRRL Y-1140
  CDS (1)..(2343)
atgagtttcaattcaaaccccactttcaacttttctacagcgggaaatgcttccggtgggaacagcaattccaatttgtttgccggtactggatcaggacaaaatgtatctaccacaggaaacaccagtaccagcacaggtgcttcctctctctttggcaatactggaggccagaccagtggcaatgcttttgcaagtttcggttcagctgctggtagctctaatacgcagcagggaaatgcattttcagcgtttggagcgaccactaccaatgacaatggacaaacaaaacctgcattcggaggctttggtatgaatacacaacagggcgctaatgcagtcaagccagcagcttcgccattttcgtttggtgcctctaatacaactgctggtacaggcgatgcaccaaaacctgcttttggaggttttaacgcaaacgatgctgccagcaatgcgaacaataacaacagcaacaccacgaatacaagcgcagcaaaaccaacatttggtggctttggctccgtaggagcagcaggaagtagctcttcgctatttggcgggtcgcaacaggctaaagacactcaacccaagagtggattctcatttggtacacaacctgaacaaaagaccgatgcaaagcccgcttttaatttcggactatctggaaataatgcaatgactacaactccgagtgtcaatgcctctaaaccaatatttggtgccaatacaacttcaacatcaagcttcacaacttccgctaaaccaactgaaacctcgaaacctaatacaaatgccacatcactctttggtgggaaccacactgatacaaaaccagccggtgctacttcagggttcaactttggttctgccgctggagatgccaacaagccaagtttttcgctaagtctgggatcaaaacctgaagaaaaaacctcaggcgcaaagacaggattctcatttggttcaaaaacggaggacaagcctacagatgctaaaccagcattttctttcggagcaaagccctctgggacagaacaagccggtaagccagccttcagctttggatcaaaaccagtggctcctgaaccctctaaaccttccaatgacaaaccagaaagtaaacagggttttgcattcaatgttaaatctggcaacagtaaagaggagaccaaaagtggattttctctgggatctaaaacagaagaatctaaacctgcctctaaaatgggattttctctgggatccttgaacacgaatgctgacgataccgaatccaagcctgggttttcttttggcaataagactgaagataccaagtcagcttccaaagcggccttttcgttcgataacaagactgacgggtcaaagtcagaatcaaaaccatcttttgctttagggtccaacacctcagaaaataaagccgatcctagccccgcattctcgttaggagcgaaacctaccgatagcaaatcatctgatactaaggacgattcgaagcctgcatttagctttggaagtaaacctgccgatagcagaacatctgacactaaggttgattcaaagcctgcttttagctttggaagtaaacctgcggaaactaccgcttccaaagacacgaaaactgaagctccttccttttctttgggcggtctgaaaccggatactaccaaagaaacaactgaaagtgctaagcaggaaactacaactggaacaaagacatctactaaacccgttactatcgaacctgtttccctcgacaataagactttggatgacttagtatcaaaatggacctcccaactttctggaaccgcagatcactttgagagttacgccaagaagataaatcagtgggacaaagtattaatgcaaggtggtgaacaaataagtcggttgtactctgatacattaactgctgaacaatctcaaaatagagtagatcagtctctctcatatatcgaaagacaacaatctgaacttgagtatttcctcgattcttatgaacaaaaggctgaagatctgctatctgaggtgctttcttcgagcaacaataacaacacaagcaaaacgaatgatcaaaagagacaacaagcctatcatacagtggaaatgcttgacgacaacctaaactctttgtcactaaatctttcctcgttgattaccgaaataaacgaagttagcgaaacgttcaataaggctacaaactcaagcttccctaataaggaagaaaacgctcagttgatccagttattaaattctcacctagatgctcttaagtcgctagagaacaactctcagcaacttgaaggaaaactcaagacgttgacgaagtctcagaaatga

SEQ ID NO: 6219 - protein, 780 aa, Kluyveromyces lactis NRRL Y-1140
MSFNSNPTFNFSTAGNASGGNSNSNLFAGTGSGQNVSTTGNTSTSTGASSLFGNTGGQTSGNAFASFGSAAGSSNTQQGNAFSAFGATTTNDNGQTKPAFGGFGMNTQQGANAVKPAASPFSFGASNTTAGTGDAPKPAFGGFNANDAASNANNNNSNTTNTSAAKPTFGGFGSVGAAGSSSSLFGGSQQAKDTQPKSGFSFGTQPEQKTDAKPAFNFGLSGNNAMTTTPSVNASKPIFGANTTSTSSFTTSAKPTETSKPNTNATSLFGGNHTDTKPAGATSGFNFGSAAGDANKPSFSLSLGSKPEEKTSGAKTGFSFGSKTEDKPTDAKPAFSFGAKPSGTEQAGKPAFSFGSKPVAPEPSKPSNDKPESKQGFAFNVKSGNSKEETKSGFSLGSKTEESKPASKMGFSLGSLNTNADDTESKPGFSFGNKTEDTKSASKAAFSFDNKTDGSKSESKPSFALGSNTSENKADPSPAFSLGAKPTDSKSSDTKDDSKPAFSFGSKPADSRTSDTKVDSKPAFSFGSKPAETTASKDTKTEAPSFSLGGLKPDTTKETTESAKQETTTGTKTSTKPVTIEPVSLDNKTLDDLVSKWTSQLSGTADHFESYAKKINQWDKVLMQGGEQISRLYSDTLTAEQSQNRVDQSLSYIERQQSELEYFLDSYEQKAEDLLSEVLSSSNNNNTSKTNDQKRQQAYHTVEMLDDNLNSLSLNLSSLITEINEVSETFNKATNSSFPNKEENAQLIQLLNSHLDALKSLENNSQQLEGKLKTLTKSQK

SEQ ID NO: 6220 - DNA, 2403 bp, Debaryomyces hansenii CBS767
  CDS (1)..(2403)
atgtcaggatttagctttggaaataataataatcccaacgcaggatcattttcgtttggtggtaacaataaccaacaaagtagtgggtttggatcgtctaatacgggaggatcaggattctcgtttggatcaaaccaaaataacaataccagtggcaatgctaatgaagcatcacagccggtttttgggtccaattccaacacgtctaatacgggcgcaccagcattctcattgaataacaacaacggcagcggatccggcttaggctcgaatgcaaatgcatcatctagtccttttggtgctcctaagcaacaggaagggggactttttgggaataaagcggccacatccaattcgtcgaacttatttggcaagaacgataatcaatctagcaatacattcggatctaataatggtggtcagtcagcgtttggttctagcaattcatccacgccagcaccggcattcaatttaggtgcttcaaagccagaagataaacaaatagagaagccatcgggtggactatttggtggttctaatgattcaaagccggcatctggaggtctttttggttccaatgacaacaaaccagctacaggtggcttatttggatctaatggaacccaaacctcgtctggtgggtcatttggtgctaagaaggatgacagcagtgcgccttccgcccccaaacccacatctggagcgttatttggttctagtgagtcgaaaccggcctctggtggattatttggagctaaaattgatgataaaccggtttcaacacaaccttcaactggtggattatttggtgctaagaaagatgacagtagtgcgtcttctacaccaaaaccagtaactggaggcttgtttggttctagtgagtcgaaaccagcctctggtggattatttggatctaatggaacacaagcttcttctggtgggctatttggtgctaagaaggacgaagacaaaagagatgataaacctgcttcaggattctcatttggcgctaagaagaacgaagacaaaaaagaagacaaacctgccccaggattctcgttcggtgctaagaaggacgaagacaaaaaggatgacaagcctgccccaggattctcgttcggtgctaagaaggatgaagacaaaaaagatgacaagccagctccaggattctcatttggcgcaaagaaggatgaagacaaacctgctccaggattcacgtttggcgcaaagaaggaagaagacaaacctgctcctggattcacgtttggtgcaaagaaggatgaagacaaacctgctcctggattcacgttcggcgcaaagaaggatgataagaaagacgacaagcctgcttcaggattctcgtttggtgctaagaaggatgaagacaaaaaagatgacaagcctgcttcaggattctcgtttggtgctaagaaggatgaagacaaaaaagatgataagcctgcttcaggattctcattcggtgctaagaaggatgaagacaaaaaagatgacaaacctactacaggattatcgttcggtgctaagaaggacgaagacaaaaaagatgacaagcctgcttcagggttctcatttggtgctaagaagggtgacgataaaaaggatgagaaatcactcgccactactactgcttctaccaccaaacaagagccaaacttaaaacctaccaagattgaaccacaagcagtatctattgataacaagaccatggatgacttaataattaaatggtcaaaacaactatccacaacgtcaaatatctttgaatcatatacctctaaagtaaagcaatgggatcaacatttagtcaagagtggtgacgaaatatccaaattacatcaagacacgttggaggctgaatcgttacagaataaaatcgaccagcatttgttatttgttgaaaaccagcaagatgaattggatcaaatattagataactatgaagcacaagctgatattttgttgaataatatcgagctaaacaattcgactaatgacagtttcaacagcggcttatcaaatttctcgaatggagggtcaaatggtggtttaagtgttactgataaattgcgtgaaaaagcttaccataatgcagaactattagacgaaagattggataatatgggcgataacttgacaacattaatcaatgagattaactccgtgagtgatgttttcaacaaaaacttattaaatgacatatcgaatacgaatgatcagaataatgaaaccaaacaagttaagcaatcacaggaaaaccctgtagaggagatagtcaaattgttgaatttgcatttagaaaatttaaagtatattgaaaaatctgaagctacattaaaggaagaattgtctaagatcaatcgtaccaagaagatccaattttga

SEQ ID NO: 6221 - protein, 800 aa, Debaryomyces hansenii CBS767
MSGFSFGNNNNPNAGSFSFGGNNNQQSSGFGSSNTGGSGFSFGSNQNNNTSGNANEASQPVFGSNSNTSNTGAPAFSLNNNNGSGSGLGSNANASSSPFGAPKQQEGGLFGNKAATSNSSNLFGKNDNQSSNTFGSNNGGQSAFGSSNSSTPAPAFNLGASKPEDKQIEKPSGGLFGGSNDSKPASGGLFGSNDNKPATGGLFGSNGTQTSSGGSFGAKKDDSSAPSAPKPTSGALFGSSESKPASGGLFGAKIDDKPVSTQPSTGGLFGAKKDDSSASSTPKPVTGGLFGSSESKPASGGLFGSNGTQASSGGLFGAKKDEDKRDDKPASGFSFGAKKNEDKKEDKPAPGFSFGAKKDEDKKDDKPAPGFSFGAKKDEDKKDDKPAPGFSFGAKKDEDKPAPGFTFGAKKEEDKPAPGFTFGAKKDEDKPAPGFTFGAKKDDKKDDKPASGFSFGAKKDEDKKDDKPASGFSFGAKKDEDKKDDKPASGFSFGAKKDEDKKDDKPTTGLSFGAKKDEDKKDDKPASGFSFGAKKGDDKKDEKSLATTTASTTKQEPNLKPTKIEPQAVSIDNKTMDDLIIKWSKQLSTTSNIFESYTSKVKQWDQHLVKSGDEISKLHQDTLEAESLQNKIDQHLLFVENQQDELDQILDNYEAQADILLNNIELNNSTNDSFNSGLSNFSNGGSNGGLSVTDKLREKAYHNAELLDERLDNMGDNLTTLINEINSVSDVFNKNLLNDISNTNDQNNETKQVKQSQENPVEEIVKLLNLHLENLKYIEKSEATLKEELSKINRTKKIQF

SEQ ID NO: 6222 - DNA, 1608 bp, Yarrowia lipolytica CLIB122
  CDS (1)..(1608)
atgagcagcggattctcgtttggagccaacactggtaaaactggcggaggattcaacctgggcaacaatgcctcttctggtaccaccggatcgggatccaccggcttctcgtttggagctggtaacaacaacaacaaaaccacaaacaacaccaacacatccggaggcactggcggtctttttggaggaggtgccgcagctggaggagctgccaagccctcgttattcagtgcctctggcgcttctggagctggagctggagctggagctggagctggagcgtcatctgctcccaagtttagtttcggtgccactccttctgcttctactcctgctgcatcgtcgactgccgcccctgcggcctctggaggtctgtttggaggaggagccgcttcttccaagccctcgtttggaggattcggtgctgctaagaccgacgataagcctgctgctcctgccgcatctactggaggattctcgtttggagccaagcctgccgacgctgctgccgcgcctaagccttcctttggaggttttggagcaaccaagacggaagacaagcccgctgctgcttctactgactctgctgcaaagcccagcttcagctttggaggagccaccaagactgaggctcccaaacctgctgccaccggaggattttcttttggtgcaaaaaccgaagagaagaaggatgaagctcccaagcctgcagcaacgggcggtttctctttcggaggtgccaagactgaggagaagaaggatgatactgctaagcctgctctaagctttggaggagccaccgctggagctcccgccgccggtactactgccgctggcaccacaggtaccgctgctcccgctgctcccgctgctggaggcctatttggagccaaaaaggacgataagaaggaggacggaaagaccttgccttctttaactgctgctcctgccacctctgctgcttctatggcttccaagacccccgtggcgtcggctcagcccgtgtccacctccaacctcaagaacaagtcaatggaagatatcatttccaagtggaccacagagctgtcaacccagtcggaagagttcagacagcaggctcaggatatcatggagtgggacaaggtgcttgtagacaacggcgacaagatctccgacatttatgccaaggtgatccagacagaacagacacagaccaaggtggaccaactgttgcagtacgtcggcaagcagcaggacgatctggagagcctgctaacaggttacgaggaggaggcttctcgtctactgggcgatctggctggcactgatggtcttcagcccgtggaccaggagcgtgagaacgcttacaaccttgctgaggatctgggtatcaagctggagagcatgggtggcaacctttcttctgtgattgaagaggtgaacaagatttccaacgacatcaacaacttccatcgagatgatgctctgacccagattgtcaagattctcaactcccatctctcgtctctgcagtggatcgactccaacacccagagtttggagcagaatattgaggccatcaagctgctggagaagcaggtcaactctcgaatgtacggtagatag

SEQ ID NO: 6223 - protein, 535 aa, Yarrowia lipolytica CLIB122
MSSGFSFGANTGKTGGGFNLGNNASSGTTGSGSTGFSFGAGNNNNKTTNNTNTSGGTGGLFGGGAAAGGAAKPSLFSASGASGAGAGAGAGAGASSAPKFSFGATPSASTPAASSTAAPAASGGLFGGGAASSKPSFGGFGAAKTDDKPAAPAASTGGFSFGAKPADAAAAPKPSFGGFGATKTEDKPAAASTDSAAKPSFSFGGATKTEAPKPAATGGFSFGAKTEEKKDEAPKPAATGGFSFGGAKTEEKKDDTAKPALSFGGATAGAPAAGTTAAGTTGTAAPAAPAAGGLFGAKKDDKKEDGKTLPSLTAAPATSAASMASKTPVASAQPVSTSNLKNKSMEDIISKWTTELSTQSEEFRQQAQDIMEWDKVLVDNGDKISDIYAKVIQTEQTQTKVDQLLQYVGKQQDDLESLLTGYEEEASRLLGDLAGTDGLQPVDQERENAYNLAEDLGIKLESMGGNLSSVIEEVNKISNDINNFHRDDALTQIVKILNSHLSSLQWIDSNTQSLEQNIEAIKLLEKQVNSRMYGR

SEQ ID NO: 6224 - DNA, 1875 bp, Aspergillus nidulans FGSC A4
  CDS (1)..(1875)
atggcgttcaatttcggtaaacagaactcctcgggggggtcaaatggtggattgtttggatccgctggaacgtcctcgaatactggttcaagcggcggtctctttggaaatgctggagcaaccacaggcggcacttcttcatcaccgtttggagccgcggccgcttccaatcagggctcgtctatattcggtgctggagctggtagcggcagcagtactcctaaattcagctttggtggtgcgacatcctcacaaacacccaacaagccgacagagtcgcccgcgtcggggtcatcgggcaccggactgtttggcggtgccagtaaacctggcggtggcctctttggagccgctacagcaactcctgcgtcttctggcacgaacacactcttcggcggccagccatccactactcctgctggtcctccgccgcagggaggcgctcccgcacaaggccaatctctgttcgggcagcaaaagtctggcggcctcttcggattaaaaacaacgtcgtctgggtccgattcaacccccgctacatcggccccgtcgctttttggaggtggccagtctaccggcagcagcttgttcaaaactactacgcaggagagtactccatcatctactgctactagcggtaacttattttccaatctcggcgcaaacaaaccagctgaatcaacaaaaccgacgacaaccgcagagaatacctcgaagtcgctgacttcaaatgcccctgcctcgggcacacaaactccctcgctatttgcggctccatcctctggcactgacgcagcatctaaaaatacccagacaaccacatcttctgctacaccccagaagccccttttctctcttggtggagcaacatcctccgctacaccctcttttactcctgcagctgctccttctggcggtctgtttgggggtctgggtacatcaaaacccgcggaaacctcgacgacgaagcctgcagcctcgacagggagcctgtttagcaagcccgctgagacagcgaccacgcaagctccaagcacgtctgcggaagctactacaatcggtactggcgccaagccagcgctgactgcgacatccggacctactacgaccgcaactgcagcaacctccggtacgagtggtaccaccacggccggcggtcctgctctcggcgcatcgaccgctggtccacctccaccggctcaatcacgccttaagaataagacgatggatgaaatcattactcgatgggcgactgacttaaccaagtaccagaaagaattccgggagcaagccgagaaggttgccgagtgggatagaatgatagtcgagaatggcagcagggttcaaaaactgtatggcagtacagtggacgctgaacgtgccacccaggagatcgaacgccagcttgcctccgttgaggggcagcaagacgaactgagctcctggctggatcgctatgaacgcgaagtcgacgagatgatgtccaagcaggttggacctggcgaaagtctacaagggcctgaccaggagcgtgaacgaacctacaaacttgccgagaaactttccgaacgtctagacgacatgggcagggatctctccagcatgatcgaggaagtcaacaacgcctcgtcgacgctcagcaaaacaaacaaggctgacgaaccgatttcccaaattgttcgcatcctcaattcgcatctctctcagttgcagaccatcgatatgggcaccactgaactccagacaaaggtcgccgcggcgcagaaggctgggcagagcatgtcagcgcgcttcgggcatggactcagtatgtcaggggctggaagtgcaaatgctgcggatgacttttaccgttcttacatgggacgtcggtaa

SEQ ID NO: 6225 - protein, 624 aa, Aspergillus nidulans FGSC A4
MAFNFGKQNSSGGSNGGLFGSAGTSSNTGSSGGLFGNAGATTGGTSSSPFGAAAASNQGSSIFGAGAGSGSSTPKFSFGGATSSQTPNKPTESPASGSSGTGLFGGASKPGGGLFGAATATPASSGTNTLFGGQPSTTPAGPPPQGGAPAQGQSLFGQQKSGGLFGLKTTSSGSDSTPATSAPSLFGGGQSTGSSLFKTTTQESTPSSTATSGNLFSNLGANKPAESTKPTTTAENTSKSLTSNAPASGTQTPSLFAAPSSGTDAASKNTQTTTSSATPQKPLFSLGGATSSATPSFTPAAAPSGGLFGGLGTSKPAETSTTKPAASTGSLFSKPAETATTQAPSTSAEATTIGTGAKPALTATSGPTTTATAATSGTSGTTTAGGPALGASTAGPPPPAQSRLKNKTMDEIITRWATDLTKYQKEFREQAEKVAEWDRMIVENGSRVQKLYGSTVDAERATQEIERQLASVEGQQDELSSWLDRYEREVDEMMSKQVGPGESLQGPDQERERTYKLAEKLSERLDDMGRDLSSMIEEVNNASSTLSKTNKADEPISQIVRILNSHLSQLQTIDMGTTELQTKVAAAQKAGQSMSARFGHGLSMSGAGSANAADDFYRSYMGRR

SEQ ID NO: 6226 - DNA, 2157 bp, Candida albicans SC5314
  CDS (1)..(2157): transl_table=12
atgtttggaggtcaacagaataatagtggcaccaatgcctttagtgggtttaccgcaaataacaacaccaacagtaataccagcaataataccagcagccaacaaggtggcacatctgtatttggagcatcaaagtcagccgaatccaatgcgtttggagcttctaacagtacttctaaaccactcttcagttcaggagctcaacagcaatcatcgtcaactccagcatttggggcccccaaatccagttctccgtttggaaatgctagtaccaatcaacccaacgcatttggatcagcatttggtgctgctcctaaaacagggggattatttggagccaacacagctaactcaacagctcaatcaggttcaatatttggacaaaagaaagatgatgctacttccggttctactggaacgaccagtactggattatttggagctaatcccgcttctaacaatcagtcgaccggcgttacttttggtgctcctacatcgaccacctccaatgaaaagacagaagaacccaaatcaactggccctttcggttccaaaccagcagatagtacaacaagtacaggcacaacaggggtatcttttggtactcaaaaccaaacaactagtgcaactagcggtggaggcttatttggggccaagaaagatcaatctccagcaccaacgggaggattattcggctctacaacaacaagtcaggatgccaaaccagcaaatgataccgccacaagtagtgaactgaaacctgctattaatatgtttggttctagtagcactacagccgataataagttgggcagcgggagctcttttggttctaacaataatccactctttggtggtaagaaggatgataacaaatcttctgcatttacgcttggatcgaaaccagaaaataatgaaggaccaaaagcacctttttttgcagctaacaatgacacaagtaaaccggctactagtggattcttgtttggggctaaaaaggatgaggataaaccagctagtggtggatttttgcttagtgttaagaaggacgacgataaagacaaacctaccaccagtggattgtcatttggtgctaaaaaggatgacaataaaccagctagtggtggattttcatttggtgctaagaaagacgaagataaggctgccagtggcggcggatttacatttggtgctaaaaaggatgacgataaagacaaaccagctagtggtggattttcttttggccaaaaatccgatgataagaaagaagataaaagtggttccggaaatgccacatctgctactacagcttcaacggcaaccactactactaccacagctcaaccaaatttgaaaccgacaaaaattgaaccaattcctgtttcaattgataacaaaacacttgatgacttgattgtcaaatggtctaagcagttgacgacaactacaaaagtttttgattcatacactactaaggtcaaggaatgggaccagaaattggtagaaagtggagatgatattaccaaactaaaccaagaatcattggaggcagagacgttgcaaagcaaaataaaccagcagttgctttttgttgaaaaccaacaagatgaattagagaagatattagataattacgagcaacaggcagacattttgttgaacaacatggaattgaacaataacgaagttgtcaatgccccatcatccttgattcatgctgttgacggaagcaataaagataccaactccaaagatgctagtgctagtgtttcctcttcaaatccagcagcctctggcgggtcatcctcatctttgagtatcactgataaattacgtgaaaatgcttatcacaatgctgagttgttagatgaaagattggataacctaggtgccaacttaggaactttgatcaatgaaatcaattcagtcagtgatgttttcaacaagaatttgatcaatgagttagctaacaaagccgatgcaagagattctaccagtaagaaggatgatataaaaccagatgagaataatccatttgaagagattgtgagattattgaatttacatttggaaaacttgaaatacattgaaaatgcagaagaagagttgaaaagcaagttggagaaattgaacaaaaccaaaaaattaaatcattaa

SEQ ID NO: 6227 - protein, 718 aa, Candida albicans SC5314
MFGGQQNNSGTNAFSGFTANNNTNSNTSNNTSSQQGGTSVFGASKSAESNAFGASNSTSKPLFSSGAQQQSSSTPAFGAPKSSSPFGNASTNQPNAFGSAFGAAPKTGGLFGANTANSTAQSGSIFGQKKDDATSGSTGTTSTGLFGANPASNNQSTGVTFGAPTSTTSNEKTEEPKSTGPFGSKPADSTTSTGTTGVSFGTQNQTTSATSGGGLFGAKKDQSPAPTGGLFGSTTTSQDAKPANDTATSSESKPAINMFGSSSTTADNKLGSGSSFGSNNNPLFGGKKDDNKSSAFTLGSKPENNEGPKAPFFAANNDTSKPATSGFLFGAKKDEDKPASGGFLLSVKKDDDKDKPTTSGLSFGAKKDDNKPASGGFSFGAKKDEDKAASGGGFTFGAKKDDDKDKPASGGFSFGQKSDDKKEDKSGSGNATSATTASTATTTTTTAQPNLKPTKIEPIPVSIDNKTLDDLIVKWSKQLTTTTKVFDSYTTKVKEWDQKLVESGDDITKLNQESLEAETLQSKINQQLLFVENQQDELEKILDNYEQQADILLNNMELNNNEVVNAPSSLIHAVDGSNKDTNSKDASASVSSSNPAASGGSSSSLSITDKLRENAYHNAELLDERLDNLGANLGTLINEINSVSDVFNKNLINELANKADARDSTSKKDDIKPDENNPFEEIVRLLNLHLENLKYIENAEEELKSKLEKLNKTKKLNH

SEQ ID NO: 6228 - DNA, 2046 bp, Ustilago maydis 521
  CDS (1)..(2046)
atgtcgttcggcggcggaaacttctcgtttggtggtgcctctggcaacaacaatacaaacaacgctgcaggcagcaccgctaaaacgccattctcctttggaggtgcgtctaccacgaccggtggctcactgtttggctctccagcaggcacaggcaccaacactgcttctaactcgacgccagcttccagcgcgggactttttggatcgagcaacaccaactcatctacctccggtggtagtggcttctcctttggaagtgcagcagcaaaaccagctgcaggtggattctcttttggcaccgctgcttcctcctccacgccatcttcgtcaacacctgcaccttccacgggtggattcaactttggtggtgcagcagcagcaaacaaagcaactgccaatgcgaccgcttctccagcacctgcctcctctgcctctaccggcaccttctcttttggcaacaacaacaacaccaccaataatacgacagcagccaagccagcaggcagcgcaacgttctcatttggtggcagctcgactcccgctgctgctggtgcaacctcgtccactccttcggcagctggagctggtggagctggtggaagcggtggaggcggcttgagcggatttggatcgttcacgctcggtggtgccagcaccaacacctcttctacgacgccagcatctaccagtggttcgggctcggcggcgccagccgcgggagcctccctgtttggcggtggcggtgcatccaagccggcattcggcggcttctcgtttggcacagcacccgcagctacttcttccacttccacatccacatccacatccactccaagcgctgcgcctgcctccacgggggctggattcacgttcggcaatgcttcagccagttctgcgccagctgcttctggtactgccgctgctactcaagccaagcctgcacttggaggcctatcttttggtactagcacaccagcaacaagcgccacaacaccggctgcttcggatgccgaggctaagtctgctgctgctgcagctcctgctgcaccagcgggtaccggtggattctcgttcggtaagccggccgcatccgcatccgccgctgcacctactgctactgctactgctgctactactgctccgtcgacttcgacttcaacgaatgcgcccaccgctgctccagctacaggcggcttctccttcggcaaggcggcaacgaatacgactgctgctccagctgcgtctggcgcacccaccgctgcttcgagtcaagccgcagcgaaacccgcgggcggattttcgtttggatccgcggctgctactgcctcccagcctgcgtcttgctcgaccaacggcgctgcacaaaccactagtggtgtggcttctggcgtggctgtgcctcgaaacggcgctgcacccgccatcggcgcggtggctacgccctcgctattacgcggtaaatcaatggacgaaatcctgaatcgttggtcggtatcgctcgactcttcgatcaaggaattctctcgtcaagctgccgaagtagcggcatgggacaaggtgctgctaaaaggtggagatgaaatctcggcgcttgtcagcgcgcttggcgcggccgaagaaaaacaggctgggatcgagcgtacgctggactacctggaatcatcgcagtcggacctgacgtctttggtgacagactacgaggcgcagatcgaatcgctgctgccgggcttgacaagccagatcaacctgacgagcgcggatgtcgagagggaacgcgcattcagtctggctgaaacgctcaatggacagttggacgatgtgtccaagaacctcagtgctatgatcggtgagctgaacagcgtgaatgccaacgcagctggatcaagtggcgatagagagaaggacgagtcgctcgatcgcgatggaagcatcgcccacattgtcgccatcctcaacgcgcacctcggcagcctcaagtggatcgaccagagtgcaggtgcgttgagagcaaagctcgacggcttaaggagaggtcagttgtaa

SEQ ID NO: 6229 - protein, 681 aa, Ustilago maydis 521
MSFGGGNFSFGGASGNNNTNNAAGSTAKTPFSFGGASTTTGGSLFGSPAGTGTNTASNSTPASSAGLFGSSNTNSSTSGGSGFSFGSAAAKPAAGGFSFGTAASSSTPSSSTPAPSTGGFNFGGAAAANKATANATASPAPASSASTGTFSFGNNNNTTNNTTAAKPAGSATFSFGGSSTPAAAGATSSTPSAAGAGGAGGSGGGGLSGFGSFTLGGASTNTSSTTPASTSGSGSAAPAAGASLFGGGGASKPAFGGFSFGTAPAATSSTSTSTSTSTPSAAPASTGAGFTFGNASASSAPAASGTAAATQAKPALGGLSFGTSTPATSATTPAASDAEAKSAAAAAPAAPAGTGGFSFGKPAASASAAAPTATATAATTAPSTSTSTNAPTAAPATGGFSFGKAATNTTAAPAASGAPTAASSQAAAKPAGGFSFGSAAATASQPASCSTNGAAQTTSGVASGVAVPRNGAAPAIGAVATPSLLRGKSMDEILNRWSVSLDSSIKEFSRQAAEVAAWDKVLLKGGDEISALVSALGAAEEKQAGIERTLDYLESSQSDLTSLVTDYEAQIESLLPGLTSQINLTSADVERERAFSLAETLNGQLDDVSKNLSAMIGELNSVNANAAGSSGDREKDESLDRDGSIAHIVAILNAHLGSLKWIDQSAGALRAKLDGLRRGQL

SEQ ID NO: 6230 - DNA, 2253 bp, Cryptococcus neoformans var. neoformans B-3501A
  CDS (1)..(2253)
atggccgccccaaaccccttcgccggcttcggctcaaagccccaaccctccgcttccggcacctcactgtttggaaacacttcgtctcaacctgcttctggtagcggcttattcggctcgtcatccactacaaacaactcctctgctacccctgccgcctcggggggcggcttatttggcggtggggcacagacttctggcggtttgttcggaaataacaccaccggtgccaataataacaataacaactcaaacgcggcagctgcaaacagctcgactcctgcagcgccctctggaggtagtctatttggaggatttggaactggaggatttggaacgaacaatacggcgactgggtccacgactccagcttctaaacctgcttttggtggctttggtcaatccactacaccggccgcacctcctccagctagtacagggacaagcttatttggaggcgctgctaccggcacaagcacaggtggtggcttgtttggtgctaaacctgcagaaggcactggagcacctggcgcagcgtcaacaacgggtggatttacagggtttggagcaaagcctgccggcaccacatctgcgcctgcaacaggtggactttttggttcaaagcctgcagaatctacccctgctgcttcttcttctcctgcgccctcatccggtggtggcctcttttcattcggtgctaaacccgcctccactactacacctgctgctccttcacttttcggctctgctcctgccaaggatgcttcttcatcaactcctacatctggcacaccacccaccacttctggaggcggaccctttgggggtggggggctttttggtgccaagcccgctgctcctgctacagaggctcctaaagctgacaccgccaccactgccccggctgccccaaccagtggtttgtttgggggagtaggtgcctcaaaacccgctgaagcacctaagcctgctgctggagggttctccttcggtaacttgggagccaaacctgctactccttctaccactgaagctcccaaaacgggaggcttcagctttggagcttctgccccaagcgctgataagaaggacgagatgccggctgaagcgcccaagacgggaggcttcagttttggcgcccccgctgctgccgcttccaacgaagaaaaaaagactgataagcctgcagaggctcccaaaccgggtggattcagctttggtaacattggtacatccgcaacaacggcctctggagacgataaaggcaaggcgcctgaagctcctaaggctggcgggttcagttttggcggtcttggtgcaaagacagatggtgacaaggataaggctccagctgcgcctacgcctgctgcgcctgctgctggtggcttgtttggagccaagcctgccgatgctggtcaaagcagtaccgccgccccttcagctagcggtggtctctttggtgccaatcccaacactaccgcggcggcttctaccactacacctgctgtaccaaccgcccccattgcttccgccccagccaatgtggagaagcccagcgaacccgttcccaaccttcttcgtggcaaagccttggatgatatagtggaaggatggaataaggatttagaggagcaagtgaaggagtttgagaggcaggctggtgaggtgagggagtgggataagattttggtcaggaatggtaaccaaattacagctcttagaagacaagtgttggaggctcagcagacccaagctgctgttgatgaaccgttgaactactttgaggctcagcaaaatcagctggaaagtatgttggatgtgtatgagaaggagattgcaaaaatgtcaaacgacagcaccaggccgttggcggcgaaaatgccggctgatcgagagcgggagaaggcttacacacttgccgaggatcttaataaacagctcgatgacctgtctcgtaacctgtcacagatgattgaacaagtaaacaaaatttcgacctcccaatcatccctcgacgcaagcacgtcctctctcacgaaccgtcctgggacaccctccgcgtctgctgctgacgcagcttcacaaatgccagatgacccagttagccagctttctgctattcttggtgcgcacttgagggcattgagctcaatcgactccagtgcgggcaaactatctaccaaggttggagagttggaaaccaagatgggcagtagcgggtctgcccggggatggggattgccaaggagatga

SEQ ID NO: 6231 - protein, 750 aa, Cryptococcus neoformans var. neoformans B-3501A
MAAPNPFAGFGSKPQPSASGTSLFGNTSSQPASGSGLFGSSSTTNNSSATPAASGGGLFGGGAQTSGGLFGNNTTGANNNNNNSNAAAANSSTPAAPSGGSLFGGFGTGGFGTNNTATGSTTPASKPAFGGFGQSTTPAAPPPASTGTSLFGGAATGTSTGGGLFGAKPAEGTGAPGAASTTGGFTGFGAKPAGTTSAPATGGLFGSKPAESTPAASSSPAPSSGGGLFSFGAKPASTTTPAAPSLFGSAPAKDASSSTPTSGTPPTTSGGGPFGGGGLFGAKPAAPATEAPKADTATTAPAAPTSGLFGGVGASKPAEAPKPAAGGFSFGNLGAKPATPSTTEAPKTGGFSFGASAPSADKKDEMPAEAPKTGGFSFGAPAAAASNEEKKTDKPAEAPKPGGFSFGNIGTSATTASGDDKGKAPEAPKAGGFSFGGLGAKTDGDKDKAPAAPTPAAPAAGGLFGAKPADAGQSSTAAPSASGGLFGANPNTTAAASTTTPAVPTAPIASAPANVEKPSEPVPNLLRGKALDDIVEGWNKDLEEQVKEFERQAGEVREWDKILVRNGNQITALRRQVLEAQQTQAAVDEPLNYFEAQQNQLESMLDVYEKEIAKMSNDSTRPLAAKMPADREREKAYTLAEDLNKQLDDLSRNLSQMIEQVNKISTSQSSLDASTSSLTNRPGTPSASAADAASQMPDDPVSQLSAILGAHLRALSSIDSSAGKLSTKVGELETKMGSSGSARGWGLPRR

SEQ ID NO: 6232 - DNA, 2106 bp, Phaeosphaeria nodorum
  CDS (1)..(2106)
atgtcgtttcagttcgggcagcagagcagcagcaacacgccaaacaagccattgtttggcgctgctagcaacacgtcgggtggaactgctccgtctctctttggaaccgccaacactgggagcactggcacaagcacccccgccggctcaggtctatttggtggaggtgcgactaccggcacatcgagcatcttcggcggcggcgcttcgaacacacctgcaagcaagccgggcgggctgtttggtggcggcggagctacatcaggcgcgtcaacatcgagcctgtttggcagtagcctcagcaagcctgctggcgatgcggcgaagccggcgtcggtctttggtagtggattcggagctcctgcgagcggtgcaacatcttcatcgacggcgccttcctttggttttggcactgcaacctcgtccacacccgcagccacacctgcaacgaacaagttcctcccgtcgacgacgcctgccggcgctcccccaggtcccagtctgttcggcgcgcagaacacacaagcagccggaaacactcaaaccagctcgtcgctgttcggcgcacaaaagccccaggcgggcggaggtacacaggctggatcagggctgtttggcggacagaatcaatccagcggctcgaaccagccaagcccgtctctgttcggcggaaatccagccacgacatctgcctcgcctgctcccggactctttggtggtgcagctgcaggcaagcctttgggaaactctacgcccacttccggcctatttggtgggaacaaagacacttcggccggtgcagacaaaggcgcaaccccggcgtcttcagcaccctcaggtctctttggaggtggaggcggagcgacagctggtgcacaaggccagggagctgccaaaccatcgctgtttacacctcaaaccacctcgtcaacaccagccagcaaaccccccaccttcagcctcggtacaaactcagcggctccaacatcttcacagcctccatcgagtctgggcggcttcagcttgggcggaaaaacagacgcgccaaagtcatctgctgctccagcctccagtatgtttgccagtataggcaccccaacctcttcagctcctggtgctacgccgccaacaagtggagctactaccacagcaggaagctctggcataaccacagcagccactccagctccctcgctgttcgcaggagttggtagcggaagctcggcgcctcccacatctggtctcggcgcacctacaagcggtggatcaggtggactatttggaggaaaaactgcaacatccactacacaaccgtcgacatcgaccagccagccggcagccacccttggaagtgcggccaacgatgcgacgaagactggcgggcttgccaactccaccgctgggcccccaccatctgcgcagtctcgtctgaagaacaagagcatggacgagattattacgcgatgggcagctgatctatcaaagtatcagaaagaattccagacccaagctgagacagtcgcaaagtgggaccgagcattggtcgaaaattccgataaggtccgccagttgtattccaagaccttccaggcagagcgagatgctgctgaggttgagcgacagttgacgatgatggaggagaaccagcaggaacttgactcgtatcttgatcgctacgagaaggagattgagaacctgatgaaaatgcatggtgtcagcggaaagtctgatggtctgaggggtcctgatcaagagcgagagagaacatacaaacttgccgagaaactctcggacaggctcaacgagctcaacaaggacctgacagagatgatcgaggagatcaacagcacttcacagacactcagcaagactggcaagccagatgatccgttgaccaaggtcgttcgcgtcctcaacactcagctttcgcagctccaactcatcgatgccggcaccgctcagctcaaggaaaagattaatcagacacagaaggaaactcagcgcgtcggtgcgaatggctggaacggacttggttcggacccgtcagatgacttcatgcggagcttccgtggtggacgaactgagcggttcggcggtgtatcatag

SEQ ID NO: 6233 - protein, 701 aa, Phaeosphaeria nodorum
MSFQFGQQSSSNTPNKPLFGAASNTSGGTAPSLFGTANTGSTGTSTPAGSGLFGGGATTGTSSIFGGGASNTPASKPGGLFGGGGATSGASTSSLFGSSLSKPAGDAAKPASVFGSGFGAPASGATSSSTAPSFGFGTATSSTPAATPATNKFLPSTTPAGAPPGPSLFGAQNTQAAGNTQTSSSLFGAQKPQAGGGTQAGSGLFGGQNQSSGSNQPSPSLFGGNPATTSASPAPGLFGGAAAGKPLGNSTPTSGLFGGNKDTSAGADKGATPASSAPSGLFGGGGGATAGAQGQGAAKPSLFTPQTTSSTPASKPPTFSLGTNSAAPTSSQPPSSLGGFSLGGKTDAPKSSAAPASSMFASIGTPTSSAPGATPPTSGATTTAGSSGITTAATPAPSLFAGVGSGSSAPPTSGLGAPTSGGSGGLFGGKTATSTTQPSTSTSQPAATLGSAANDATKTGGLANSTAGPPPSAQSRLKNKSMDEIITRWAADLSKYQKEFQTQAETVAKWDRALVENSDKVRQLYSKTFQAERDAAEVERQLTMMEENQQELDSYLDRYEKEIENLMKMHGVSGKSDGLRGPDQERERTYKLAEKLSDRLNELNKDLTEMIEEINSTSQTLSKTGKPDDPLTKVVRVLNTQLSQLQLIDAGTAQLKEKINQTQKETQRVGANGWNGLGSDPSDDFMRSFRGGRTERFGGVS

SEQ ID NO: 6234 - DNA, 1797 bp, Schizosaccharomyces pombe
  CDS (1)..(1797)
atgtctttcaacccaggtaataaccagaattcagggttttcatttgggaaacctgcgcagccgaattcagctgcgcaaggagcagcaactcctgcggcgactggcttgtttggaaacacaaataataatacctcttctacagcgccgtctggaggcttatttggttctaataacgcgagtaacaccagtgctcccagtaccttttcttttggtaaagcagcgactacaggcaactcaacaaatgcatcaacgagttcacctttttcgtttgggtctactaataccaacaatactgctggggctaaacctcttttcggaggtttaggaagtaccgggtctgctaactctactggtgataaaagtaaaaacaccgcttcttctgctacaggtgcagcaactactaatccttcaggtagtacttttaattttggaagttcaaataattcttttaatttcggtaaacccgcttctacgactaatacgacgactccggcagccgctagtactggttctttgtttgggaagcctgctgctacagggactacaagcaatgcccctccagcttcttctacttctacgacacctgctactggaagcggaggttttagctttggaaaacctgctagtttaggctctactaataatgcatccacttcaaccactgctaattcaggctttagcttcggaaagcctgcaactacttcagctccaggatctaacactactgtcacccccagtagctccattacgggaaccaatgactcaaagcctgctgcatctaacactggttctgctccaactactggtttctcttttggtaagcctgcgggccaagcagcttcaaccgcaacggacaaaggtactaccaccacatcttcagctggtactggatttagttttggaaaacctgcaactacagaggatactaataaacctactgctcccaactcagcttttacaaaaccggctacttcaactggtgataataagccaacattttcttttggaaacacttcaaaacctacggaaaatactagcacaacagcaacttcagctccgccactttcgaacaatacgaaacctgcagaaggtgcgaatcagactagctctggattttcatttggtaaacctgcaactgatactacaacatctacttcaaaaaccggtcccctttttggtaataaacctgccgatcccagcgccaagccgggcgctactgcctccactactccttctgagcctcctccatcttctatcaaacacaaaactcttcaggaaatccttaataaatggtctactgatttgactacgcaaactgaagtttttaataagctttgtgaccaggtttctgactgggatagaactttagtagacaatggtgctttaatatcgaaattatacactgaaactgttgaagcagaacagatgtcaaaccgcattgatgacggattggaatatgtatcttccagccagcaagagctatttaaattgctggattcttatgaaactcagttggagacctttgatggtcgtgcaacttcagcacttaacgtcgaacgtgagcgcgcttttggtgttgctgatgatattttgagtagattggatcgattgggtgaagaccttggtactgtcataaaccaaatgaatgatttttctaaacccgatgattcaatttccgaaattgtgaaggttttgaatgcacagttggcaagtctcggatgggttgaaaatagaatatttcaaatggaagaaaagttggatacaataaaaaaaaagaattctgacgttttgttctaa

SEQ ID NO: 6235 - protein, 598 aa, Schizosaccharomyces pombe
MSFNPGNNQNSGFSFGKPAQPNSAAQGAATPAATGLFGNTNNNTSSTAPSGGLFGSNNASNTSAPSTFSFGKAATTGNSTNASTSSPFSFGSTNTNNTAGAKPLFGGLGSTGSANSTGDKSKNTASSATGAATTNPSGSTFNFGSSNNSFNFGKPASTTNTTTPAAASTGSLFGKPAATGTTSNAPPASSTSTTPATGSGGFSFGKPASLGSTNNASTSTTANSGFSFGKPATTSAPGSNTTVTPSSSITGTNDSKPAASNTGSAPTTGFSFGKPAGQAASTATDKGTTTTSSAGTGFSFGKPATTEDTNKPTAPNSAFTKPATSTGDNKPTFSFGNTSKPTENTSTTATSAPPLSNNTKPAEGANQTSSGFSFGKPATDTTTSTSKTGPLFGNKPADPSAKPGATASTTPSEPPPSSIKHKTLQEILNKWSTDLTTQTEVFNKLCDQVSDWDRTLVDNGALISKLYTETVEAEQMSNRIDDGLEYVSSSQQELFKLLDSYETQLETFDGRATSALNVERERAFGVADDILSRLDRLGEDLGTVINQMNDFSKPDDSISEIVKVLNAQLASLGWVENRIFQMEEKLDTIKKKNSDVLF

SEQ ID NO: 6236 - DNA, 25 bp, Artificial sequence
  primer
atgaacttcaatacacctcaacaaa

SEQ ID NO: 6237 - DNA, 27 bp, Artificial sequence
  primer
tcatttctttatcgagttgatttgttt

SEQ ID NO: 6238 - protein, 530 aa, Artificial sequence
  consensus sequence
  Variant (2)..(139): Xaa in position 2 to 139 is any amino acid
  Variant (140)..(291): Xaa in position 140 to 291 is any or no amino acid
  Variant (293)..(300): Xaa in position 293 to 300 is any amino acid
  Variant (302)..(304): Xaa in position 302 to 304 is any amino acid
  Variant (306)..(311): Xaa in position 306 to 311 is any amino acid
  Variant (313)..(321): Xaa in position 313 to 321 is any amino acid
  Variant (324)..(325): Xaa in position 324 to 325 is any amino acid
  Variant (327)..(329): Xaa in position 327 to 329 is any amino acid
  Variant (331)..(335): Xaa in position 331 to 335 is any amino acid
  Variant (337)..(342): Xaa in position 337 to 342 is any amino acid
  Variant (345)..(353): Xaa in position 345 to 353 is any amino acid
  Variant (355)..(357): Xaa in position 355 to 357 is any amino acid
  Variant (359)..(360): Xaa in position 359 to 360 is any amino acid
  Variant (362)..(363): Xaa in position 362 to 363 is any amino acid
  Variant (365)..(367): Xaa in position 365 to 367 is any amino acid
  Variant (369)..(370): Xaa in position 369 to 370 is any amino acid
  Variant (373)..(386): Xaa in position 373 to 386 is any amino acid
  Variant (387)..(434): Xaa in position 387 to 434 is any or no amino acid
  Variant (436)..(437): Xaa in position 436 to 437 is any amino acid
  Variant (439)..(441): Xaa in position 439 to 441 is any amino acid
  Variant (443)..(444): Xaa in position 443 to 444 is any amino acid
  Variant (447)..(447): Xaa in position 447 is any amino acid
  Variant (449)..(451): Xaa in position 449 to 451 is any amino acid
  Variant (453)..(458): Xaa in position 453 to 458 is any amino acid
  Variant (460)..(462): Xaa in position 460 to 462 is any amino acid
  Variant (464)..(466): Xaa in position 464 to 466 is any amino acid
  Variant (468)..(469): Xaa in position 468 to 469 is any amino acid
  Variant (471)..(482): Xaa in position 471 to 482 is any amino acid
  Variant (483)..(512): Xaa in position 483 to 512 is any or no amino acid
  Variant (515)..(516): Xaa in position 515 to 516 is any amino acid
  Variant (518)..(519): Xaa in position 518 to 519 is any amino acid
  Variant (521)..(529): Xaa in position 521 to 529 is any amino acid
GXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXKXXXXXXXXWXXXLXXXXXXFXXXXXXXXXWDXXLXXXGXXXXXLXXXXXXAEXXXXXXXXXLXXXEXXQXXLXXXLXXYEXXXXXXXXXXXXXXXXXXXXXXXXXXXXXXXXXXXXXXXXXXXXXXXXXXXXXXXXXXXXXXDXXRXXXYXXAEXLXXXLXXXXXXLXXXIXXXNXXSXXXXXXXXXXXXXXXXXXXXXXXXXXXXXXXXXXXXXXXXXXLNXXLXXLXXXXXXXXXL

SEQ ID NO: 6239 - protein, 55 aa, Artificial sequence
  protein pattern
  Variant (2)..(7): Xaa in position 2 to 7 is any amino acid
  Variant (8)..(8): Xaa in position 8 is Gly, Ser or Val
  Variant (9)..(20): Xaa in position 9 to 20 is any amino acid
  Variant (22)..(26): Xaa in position 22 to 26 is any or no amino acid
  Variant (28)..(29): Xaa in position 28 to 29 is any amino acid
  Variant (30)..(30): Xaa in position 30 is Ala, Gln, Ser or Thr
  Variant (31)..(32): Xaa in position 31 to 32 is any amino acid
  Variant (33)..(33): Xaa in position 33 is Ile or Val
  Variant (34)..(34): Xaa in position 34 is Asp, Glu or Asn
  Variant (35)..(35): Xaa in position 35 is Asp, Gln or Arg
  Variant (36)..(36): Xaa in position 36 is any amino acid
  Variant (38)..(39): Xaa in position 38 to 39 is any amino acid
  Variant (40)..(40): Xaa in position 40 is Ile, Leu, Met or Val
  Variant (41)..(41): Xaa in position 41 is Glu, Gly or Ser
  Variant (42)..(42): Xaa in position 42 is any amino acid
  Variant (43)..(43): Xaa in position 43 is Asn, Gln or Ser
  Variant (45)..(45): Xaa in position 45 is Asp, Glu, Gln or Ser
  Variant (46)..(46): Xaa in position 46 is Asp or Glu
  Variant (48)..(50): Xaa in position 48 to 50 is any amino acid
  Variant (51)..(51): Xaa in position 51 is Leu or Val
  Variant (52)..(52): Xaa in position 52 is Asp or Thr
  Variant (53)..(53): Xaa in position 53 is any amino acid
  Variant (54)..(54): Xaa in position 54 is Phe or Tyr
DXXXXXXXXXXXXXXXXXXXAXXXXXEXXXXXXXXXLXXXXXXQXXLXXXXXXXE

SEQ ID NO: 6240 - protein, 37 aa, Artificial sequence
  protein pattern
  Variant (2)..(3): Xaa in position 2 to 3 is any amino acid
  Variant (4)..(4): Xaa in position 4 is Ala or Thr
  Variant (5)..(5): Xaa in position 5 is Phe or Tyr
  Variant (6)..(7): Xaa in position 6 to 7 is any amino acid
  Variant (8)..(8): Xaa in position 8 is Ala or Val
  Variant (9)..(9): Xaa in position 9 is Asp, Glu or Gln
  Variant (10)..(10): Xaa in position 10 is any amino acid
  Variant (11)..(11): Xaa in position 11 is Ile or Leu
  Variant (12)..(14): Xaa in position 12 to 14 is any amino acid
  Variant (16)..(16): Xaa in position 16 is Asp, Glu or Asn
  Variant (17)..(17): Xaa in position 17 is any amino acid
  Variant (18)..(18): Xaa in position 18 is Leu, Met or Val
  Variant (19)..(19): Xaa in position 19 is Gly, Asn or Ser
  Variant (20)..(20): Xaa in position 20 is any amino acid
  Variant (21)..(21): Xaa in position 21 is Asp or Asn
  Variant (23)..(23): Xaa in position 23 is Gly, Ser or Thr
  Variant (24)..(24): Xaa in position 24 is any amino acid
  Variant (25)..(25): Xaa in position 25 is Leu, Met or Val
  Variant (27)..(27): Xaa in position 27 is any amino acid
  Variant (28)..(28): Xaa in position 28 is Glu or Gln
  Variant (29)..(29): Xaa in position 29 is Ile, Leu, Met or Val
  Variant (31)..(32): Xaa in position 31 to 32 is any or no amino acid
  Variant (34)..(36): Xaa in position 34 to 36 is any amino acid
  Variant (37)..(37): Xaa in position 37 is Asp, Asn, Ser, Thr or Val
RXXXXXXXXXXXXXLXXXXXXLXXXIXXXNXXSXXXX

SEQ ID NO: 6241 - protein, 26 aa, Artificial sequence
  protein pattern
  Variant (2)..(4): Xaa in position 2 to 4 is any or no amino acid
  Variant (7)..(8): Xaa in position 7 to 8 is any amino acid
  Variant (9)..(9): Xaa in position 9 is Phe or Leu
  Variant (10)..(10): Xaa in position 10 is Ala, Asp, Glu, Gly, Ser or Thr
  Variant (11)..(11): Xaa in position 11 is Ala, Asn, Gln or Ser
  Variant (13)..(14): Xaa in position 13 to 14 is any amino acid
  Variant (15)..(15): Xaa in position 15 is Ile, Leu or Val
  Variant (16)..(16): Xaa in position 16 is Asp or Glu
  Variant (17)..(21): Xaa in position 17 to 21 is any amino acid
  Variant (22)..(22): Xaa in position 22 is Phe, Leu or Met
  Variant (23)..(25): Xaa in position 23 to 25 is any amino acid
  Variant (26)..(26): Xaa in position 26 is Ile, Leu or Val
IXXXLNXXXXXLXXXXXXXXXXXXXX

SEQ ID NO: 6242 - DNA, 396 bp, Saccharomyces cerevisiae
  CDS (1)..(396)
atgacacttgtagtatatctaactcggttttcttccactagaagcctcaaattctttgttgttggtatcacatcattcaaaaactgcagatggccgtcagaagagtgcacaattgcggcagagatgtcatcgtacgacagcgtgagttcatctgggagcggcggtacctgttgttgttgctgctgctgttgcctatgtagggactcatgtgtcagcacctggacgaagaattctgtagcaaacgctgtggctacgaatgcgtcatccgaagtgtccatatattctggatcattcttggctattctctgcactttttctacaggtaacttgggcgaacacagaggtgcagacgccgtttctttaccactagtctcgttgttcattgtgttagcctga

SEQ ID NO: 6243 - protein, 131 aa, Saccharomyces cerevisiae
MTLVVYLTRFSSTRSLKFFVVGITSFKNCRWPSEECTIAAEMSSYDSVSSSGSGGTCCCCCCCCLCRDSCVSTWTKNSVANAVATNASSEVSIYSGSFLAILCTFSTGNLGEHRGADAVSLPLVSLFIVLA

SEQ ID NO: 6244 - DNA, 26 bp, Artificial sequence
  primer
atgacacttgtagtatatctaactcg

SEQ ID NO: 6245 - DNA, 24 bp, Artificial sequence
  primer
tcaggctaacacaatgaacaacga

SEQ ID NO: 6246 - DNA, 351 bp, Saccharomyces cerevisiae
  CDS (1)..(351)
atgagtaaaaaaaggaaacgaaaatatgtcctaattgtcttcgtcaacactcaccactttatgcttcacctggggactggaacccttggaggtagtggtggtagtaatgtctaccgtgccatcgtcaaagtagattttttcagttttgacggtgctgggttttgcatcattggaatccttcgtggtactaatggactgtgcccttccaacaattttcttggatccatctgcagaagcatattcagcatcgttgcccagatgcaagtcgtcccaattcaacatgaggtcttctggagttctagccagaggctctacggcagtgctcctagtcttgattctttgtttttgtag

SEQ ID NO: 6247 - protein, 116 aa, Saccharomyces cerevisiae
MSKKRKRKYVLIVFVNTHHFMLHLGTGTLGGSGGSNVYRAIVKVDFFSFDGAGFCIIGILRGTNGLCPSNNFLGSICRSIFSIVAQMQVVPIQHEVFWSSSQRLYGSAPSLDSLFL

SEQ ID NO: 6248 - DNA, 28 bp, Artificial sequence
  primer
atgagtaaaaaaaggaaacgaaaatatg

SEQ ID NO: 6249 - DNA, 26 bp, Artificial sequence
  primer
ctacaaaaacaaagaatcaagactag

SEQ ID NO: 6250 - DNA, 2622 bp, Saccharomyces cerevisiae
  CDS (1)..(2622)
atggcaaacactgtaggaggaattctgtcgggtgtaaatccgttccactacaactccagttcgccgcttacattatttctctttcaagcatgtctcatactactggtatgcaatttaattcacattcccttttcaatgatgaggcagcctaaagtcatttcagaagttatatctggtgttattttggggcctactatatttggtcaaattccaaactatacaaacacaattttccctacatcatcgatcccggggctaaatttagtggcgaatttgggaataatactgtttatgttttttttaggtttagaagtggatattgctttcatcaagaaacacctaaagaaagcactcgtgataggtatagtcactttagcagtgccattcggttttggttgtctgctggcgattcctttatttcacacttatgcaaacaaaacagaaggcgaaaggcatattaaattctctgtcttcatggtatttatagctgtttccatctccgttacggcttttccagttttatgtcgtattttaaatgaattgcgcttgatcaaggatagagcaggtatcgttgtccttgcggcgggtatcattaacgatataatgggatggattttgttagcattaagtattattctttctagtgcagaagggagccctgtcaataccgtttatattctgcttatcacgtttgcatggtttttgatttatttctttcccttaaaatacctattaagatgggtgctcataaggacccatgaattggacagaagcaagccttcaccgttggcaacgatgtgcattctattcatcatgttcatttctgcttattttacggatattattggagttcatcctatttttggcgccttcattgctggcttagtagttcctagagatgatcactacgttgttaaattaacagaaaggatggaagatattcctaacattgttttcattccaatctactttgctgttgcaggattaaatgtcgatttgactctattaaatgagggaagagattggggctatgttttcgccacaatcggcatcgccattttcaccaaaattatttcaggtactcttacagctaaacttactggcttattttggagagaagccactgcagccggtgttttgatgtcatgcaaaggtatcgttgaaatcgttgtcttaactgttggtttgaatgcgggcattatcagtagaaaaatatttggtatgtttgtgttgatggcattagtttctacttttgtcactactcctctgactcagcttgtttacccagattcataccgggatggtgttcgcaaatccttatctacacctgcagaagatgatggtgcagcagatggtctcgattctgagggtgtggacaagactgaaattaacactcaacttaattcattggcagatgttagcaaatatagaattggtgaactgaccacggtgataaacactacagaagcgatctctccatctctaaagctgctaaattacctgtctttaggggtatctcccaagcctaagaataataaacataagaacgaaacctccttgagcagaatgacaacagctactgattccacattgaaatctaacacattcaaaataaaaaagatggttcatatctggtctaaaagcgttgacgatgtggataccaatttaagtgttatagatgaaaaattgaccccgtttgagggagtcggtgcattgagggccattcatttacgattgctcactgaacggacaactgatctgctgcaatcatcttctctatataatgatgatccccactttaccgcaaatacagattcactattacaaatttttgatatattttcaaacctgagcaaaataccattttcaagtgaagtcatattttctacaatgcgtgaaaaggcagctaatatagcgacgatgaaaatggattccacagatctgatcttattgccattaaaaggggcctcgtatgagtatagagggagcccagtcttcattgatgaaaaatacgcaaactttgatcacatttattctcatctcctaggtctgaatgaactatcatctactttcttcaagtctattttccagtcactcaaggcaaattttgccgttcaaatttcaaatacctatggcagattaaatgctgatcgctttaagaggaaacggttcaatttattacttccaaaaccatacctgacacaatccgattatcttggactatatcttctcttattgatatgctatagagatggctataataatgataatgcatcctgtagtatatttattaacagcaagaatattgatttcgcaaaagatttgtcaactgcatttgctgagcatgactggctaaacgaatctaccattaaaattgtggatatcccctttgaaacgaaagttccagaagaagcaattgaaaagccgtcctttatagagactgtgcttgatgttggtttatcagatactgctttagctgatatagaggagactacctttattattggagaggaccttcctgatgaaagtgagcccttcagcgaagaggtgaggactgtaatatttgaagggtcgaatcgtcgttttgacacccttattgtgcaccatttttcgtctgaataa

SEQ ID NO: 6251 - protein, 873 aa, Saccharomyces cerevisiae
MANTVGGILSGVNPFHYNSSSPLTLFLFQACLILLVCNLIHIPFSMMRQPKVISEVISGVILGPTIFGQIPNYTNTIFPTSSIPGLNLVANLGIILFMFFLGLEVDIAFIKKHLKKALVIGIVTLAVPFGFGCLLAIPLFHTYANKTEGERHIKFSVFMVFIAVSISVTAFPVLCRILNELRLIKDRAGIVVLAAGIINDIMGWILLALSIILSSAEGSPVNTVYILLITFAWFLIYFFPLKYLLRWVLIRTHELDRSKPSPLATMCILFIMFISAYFTDIIGVHPIFGAFIAGLVVPRDDHYVVKLTERMEDIPNIVFIPIYFAVAGLNVDLTLLNEGRDWGYVFATIGIAIFTKIISGTLTAKLTGLFWREATAAGVLMSCKGIVEIVVLTVGLNAGIISRKIFGMFVLMALVSTFVTTPLTQLVYPDSYRDGVRKSLSTPAEDDGAADGLDSEGVDKTEINTQLNSLADVSKYRIGELTTVINTTEAISPSLKLLNYLSLGVSPKPKNNKHKNETSLSRMTTATDSTLKSNTFKIKKMVHIWSKSVDDVDTNLSVIDEKLTPFEGVGALRAIHLRLLTERTTDLLQSSSLYNDDPHFTANTDSLLQIFDIFSNLSKIPFSSEVIFSTMREKAANIATMKMDSTDLILLPLKGASYEYRGSPVFIDEKYANFDHIYSHLLGLNELSSTFFKSIFQSLKANFAVQISNTYGRLNADRFKRKRFNLLLPKPYLTQSDYLGLYLLLLICYRDGYNNDNASCSIFINSKNIDFAKDLSTAFAEHDWLNESTIKIVDIPFETKVPEEAIEKPSFIETVLDVGLSDTALADIEETTFIIGEDLPDESEPFSEEVRTVIFEGSNRRFDTLIVHHFSSE

SEQ ID NO: 6252 - DNA, 2373 bp, Oryza sativa (japonica cultivar-group)
  CDS (1)..(2373)
atggctcctgaggcggcggcggcggccttgaagccgatgaaggcaacgtcggacggcgtgttccagggggaggaccccctggaagcggccctgcctctggccatcgtgcagatttgcatcgtcgtcgtgctcacccgcgtgctcgccttcttcctccgcccgctccggcagccgcgcgtcatcgcggagatcatcggcggcatcatgctcggcccgtccgcgatcggccggaacagcgcgttcatcaacacggtgttccccaagcagagcctcacggtgctcgacaccctcgccaacatcggcctcctcttcttcctcttcctcgtcggcctcgagctcgacctccgcgccatccgccgcacgggagctggcgcgctcgccatcgccgtcgccggcatctccctccccttcgtcctcgggatcggcacctccgtcgtcctccagaacaccgtcaaccgcggcgtccccacggggcccttcctcgtcttcatgggcgtcgccctctccatcaccgcgttcccggtgctggcgcgcatcctcgccgagctcaagctgctcaccaccgacctcggccgcatggccatgtccgcggcggccgtgaacgacgtcgccgcgtggatactcctcgcgctcgccatcgcgttgtcgggctccggctcgcctttcgtgtcgctctgggtgctcctcagcggcgtcggcttcgtcctctcgtcgttcttcttcatccggccgctgctctcgtggatggcgcggcgatcccccgagggcgagcccgtgaaggagctatacatatgcacgacgctcaccatcgtgctcgccgccggcttcatcaccgacaccatcggcatccacgcgctgttcggcgccttcatcgtcggcatcatcgtgcccaaggaagggcccttcgctggcgtcctcctggagaaggtggaggacctcatctctggcctcttcctgccgctctacttcgtgtcgagtggcctcaagaccaacgtcctgaccatcaagggcggggactcgtgggggctcctcgtgctcgtcgtcgcgacggcgtgcatcggcaagatcggcggcacagtgctcgcgtcgctcatcgtgcgtgtgccgctccgtgaggcggtgacgctcggggtgctgatgaacaccaaggggctcgtggagctcatcgtgctcaacatcggcaaggaccggcacgtcctcaacgacgagaccttcgccatcctcgtgctcatggcgctcataaacaccttcatcaccacgccgctggtgatggccatctacaagccggcgcggcgcgcccccccgtacaagaaccgcgccgtccagcgcccgaaccccgacgacgagctccgcatgatggtgtgcttccacagcacgcgaaacatccccaccatgatcaacctcatggagtcgtcgcgtgggacgcggcggcgcggcatcaccgtgtacgccatgcacctcgtcgagctctcggagcggtcgtccgccatcaacatggtccacaaggcgcggcgcaacgggatgccgttctggaaccggcggcgcaacggggacggcgaccagctcgtcgtcgcgttcgagacgtaccagcagctgagccacgtgtccattcgcgccatgacggccatctccgacctccacaccatccacgaggacgtggtcaccagcgcgcaccagaagcgcgccgcgctcatcgtgctccccttccacaagctccaccagatggacggccacatggagtccctcggcgacgagtaccagcacatcaaccagcgggtgctccaccacgcgccgtgctccgtcggcatcctcgtcgaccgcggcctcggcggcgccgcgcaggtcgccgccagcgacgtgtcctacaacatcgtcgtcctcttcttcggcggccgggacgaccgcgaggccctctcctacgccacgcgcatggtcgagcacccgggcatcgcactccacgtgatacgcttcgtcccagagtccggcggcggcggcgcgaacgacaaagccgcggcggacgatgcgttcctcgcagagttccgcggcaaagtcgccggcgggaacgactccatccggtacgaggagaggacgtccagagggaaggcggacgtggtggaggcgatcaaggcgatgggtccgaccaacctgttcctcgttggacaggggtcgccgtgcgcgccgctgatggaaccgagcgctgagtgcccggagctcgggccggtggggagctacctggcgatgccggacttctcgacggtggcgtcggtgctggtgatgaagcagtacgacccgacggcggagcactacgaactcgtcgaggaggtcgcggacaccgccgtggacatcgacacaccggggcctcgtagagggtga

SEQ ID NO: 6253 - protein, 790 aa, Oryza sativa (japonica cultivar-group)
MAPEAAAAALKPMKATSDGVFQGEDPLEAALPLAIVQICIVVVLTRVLAFFLRPLRQPRVIAEIIGGIMLGPSAIGRNSAFINTVFPKQSLTVLDTLANIGLLFFLFLVGLELDLRAIRRTGAGALAIAVAGISLPFVLGIGTSVVLQNTVNRGVPTGPFLVFMGVALSITAFPVLARILAELKLLTTDLGRMAMSAAAVNDVAAWILLALAIALSGSGSPFVSLWVLLSGVGFVLSSFFFIRPLLSWMARRSPEGEPVKELYICTTLTIVLAAGFITDTIGIHALFGAFIVGIIVPKEGPFAGVLLEKVEDLISGLFLPLYFVSSGLKTNVLTIKGGDSWGLLVLVVATACIGKIGGTVLASLIVRVPLREAVTLGVLMNTKGLVELIVLNIGKDRHVLNDETFAILVLMALINTFITTPLVMAIYKPARRAPPYKNRAVQRPNPDDELRMMVCFHSTRNIPTMINLMESSRGTRRRGITVYAMHLVELSERSSAINMVHKARRNGMPFWNRRRNGDGDQLVVAFETYQQLSHVSIRAMTAISDLHTIHEDVVTSAHQKRAALIVLPFHKLHQMDGHMESLGDEYQHINQRVLHHAPCSVGILVDRGLGGAAQVAASDVSYNIVVLFFGGRDDREALSYATRMVEHPGIALHVIRFVPESGGGGANDKAAADDAFLAEFRGKVAGGNDSIRYEERTSRGKADVVEAIKAMGPTNLFLVGQGSPCAPLMEPSAECPELGPVGSYLAMPDFSTVASVLVMKQYDPTAEHYELVEEVADTAVDIDTPGPRRG

SEQ ID NO: 6254 - DNA, 2475 bp, Oryza sativa (japonica cultivar-group)
  CDS (1)..(2475)
atggcggcgagcggaggcagctgcccggcggcgatgaaggcgacgtcgcagggggcgttccagaaggagaacccgctggacttcgcgctgccgctcatcatcctccagatctgcctcgtcgtcgtcgtcacccgcgtcctcgcctacctcctccgccccctccgccagccccgcgtcatcgccgagatcatcaaattgcttaagcaagaaaaagagtacagatttagtgctaaatttatcacaaaactacaatttaagggtggtatccttcttgggccgtcagcgctgggccggagcagcaagttcttgcacaacgtgttcccgccaaagagcatgaccgtcctggacacgctggccaacctcggcctcctcttcttcctcttcctcgtcggcctcgagctcgacatctccgccatccgccgcaccggcaagaaggccctcgccatcgccctcgccggcatctccgcccccttcgcgctcggcatcggcacctccttcgcgttccgcgccaccatcgtcaagggcgccccgcaggcgccgttcctggtgttcatgggcgtcgcgctctccatcaccgcgttcccggtgctcgcccgcatcctcgccgagctcaagctcctgaccaccgacctcggccgcatggccatgtcagccgcggcggtcaacgacgtcgccgcgtggatcctgctggcgctcgccgtcgcgctctccggctccggctcgccgatcatctcgctctgggtgctcctcaccgccgccggcttcgtcgccgccatcttcctgttcctccgccccgcgctggcgtggatggcgcggcggtcaccggagggggagcccgtcaaggagctgtacatttgtgccaccctcgccatcgtcctcgccgccggcttcgtcaccgacaccatcggcatccatgcgctgtttggtgcgttcctcgtcggcatcgccgtccccaaggacgggccgttcgccggcgtgctcatcgagaaggtggaggacctcatctccggcctcttcctgccactctacttcgtctccagtggcctcaagaccaatgtggccaccatacgtggagccaagtcatgggggttgcttgtgctcgtcatcgtcaatgcctgccttggcaagatcggcggcacggtgatcacgtcgttgctcgtcaagatccctgtccgggaggccgtcacgctggggttcctgatgaacaccaaggggctcgtcgagctcatcgtcctcaacatcggcaaggatcgcaaggtgctcaacgacgaggcgttcgccatcatggtgctcatggcgctgttcaccacgttcatcacgacgccgatcgtcatggccatctacaagccggcgcggccgacggcgccgtacaagcgccgcaccgtggacggcggcgaggccgacggcgagctgcgcgtgctggcctgcttccacaccaaccgcaacatcccgacgctgctcaacctcgtcgagtcgtcgcggggcaccgggcgcggccgcctcgtgatgtacgccatgcacctcgtggagctctcggagcggtcgtcggcgatcaccctggtgcagcgcgcccgccgcaacggcatgccgttcttcaactccggcgacaaggccgagcagatggtggtggcgttcgaggcgttccagcagctgagctcggtgcgggtgcgccccatgacggccatctccgacctggacaccatccaccgcgacgtcatcgacagcgccaccgccaagcgcgccgccatcgtcgtcatgccgtaccacaagatgctccagcacgacggcacgttccagtccctcggctccgcgtaccacgccatcaacaagcgcgtcctccgcgaggcgccctgctccgtcgccgtcctcgtcgaccgcggcctcggcggccacgcccaggtgtccgccaagaacgtggccttctccgtggcggcgctcttcttcggcgggcccgacgaccgcgaggccctggcgtacgcgacgcggatggcggagcaccctggtgtcgccgtgacgctggagcggttcaggccgagtcgcgcgcagcccgacgaggaggacgccgccgacgaggcggcggtggaggcgttcaagtcgaaggtgggcatggtgaaggacgggtcggtgcggttcgacgagcggccggcgcagagcaaggcggaggtgatggaggcgatcaactcgctgtccatgttcagcgtgttcgtggtggggaggatgccgccgacggcgccgctggtggagaagcccgacgagctgggccccgtggggagctacctggcgtcgccggagttcaggacgtcggcgtcggtgctggtcgtcaagaggtacgacccggcggcgaacccggcgagcaagaggtacgaccccaaggcgaggccacccgccgcgacggaggaggacgccctcgacgagctcaccggcgccgccgttgtcccggtggcgcattcaccgatgaaccacgacattgtatga

SEQ ID NO: 6255 - protein, 824 aa, Oryza sativa (japonica cultivar-group)
MAASGGSCPAAMKATSQGAFQKENPLDFALPLIILQICLVVVVTRVLAYLLRPLRQPRVIAEIIKLLKQEKEYRFSAKFITKLQFKGGILLGPSALGRSSKFLHNVFPPKSMTVLDTLANLGLLFFLFLVGLELDISAIRRTGKKALAIALAGISAPFALGIGTSFAFRATIVKGAPQAPFLVFMGVALSITAFPVLARILAELKLLTTDLGRMAMSAAAVNDVAAWILLALAVALSGSGSPIISLWVLLTAAGFVAAIFLFLRPALAWMARRSPEGEPVKELYICATLAIVLAAGFVTDTIGIHALFGAFLVGIAVPKDGPFAGVLIEKVEDLISGLFLPLYFVSSGLKTNVATIRGAKSWGLLVLVIVNACLGKIGGTVITSLLVKIPVREAVTLGFLMNTKGLVELIVLNIGKDRKVLNDEAFAIMVLMALFTTFITTPIVMAIYKPARPTAPYKRRTVDGGEADGELRVLACFHTNRNIPTLLNLVESSRGTGRGRLVMYAMHLVELSERSSAITLVQRARRNGMPFFNSGDKAEQMVVAFEAFQQLSSVRVRPMTAISDLDTIHRDVIDSATAKRAAIVVMPYHKMLQHDGTFQSLGSAYHAINKRVLREAPCSVAVLVDRGLGGHAQVSAKNVAFSVAALFFGGPDDREALAYATRMAEHPGVAVTLERFRPSRAQPDEEDAADEAAVEAFKSKVGMVKDGSVRFDERPAQSKAEVMEAINSLSMFSVFVVGRMPPTAPLVEKPDELGPVGSYLASPEFRTSASVLVVKRYDPAANPASKRYDPKARPPAATEEDALDELTGAAVVPVAHSPMNHDIV

SEQ ID NO: 6256 - DNA, 2436 bp, Arabidopsis thaliana
  CDS (1)..(2436)
atgggtactttggtcaacggtactattccggcgatgaagtgtcccaagaatgtggcgatgatgaagacaacgtctaacggagtgttcgatggagagagtccattagatttcgcttttcctcttgtcattcttcagatttgccttgtcgtcgccgtcactcgctctttggccttccttctccgtcccatgagacaaccacgtgttgtcgccgagatcattggcgggattcttcttggcccgtcggctctcggtagaatcacgtcgtacaagaattcaattttcccggcgagaagtctaacggtgctcgacactctagcaaacctcggcctccttctcttccttttcctcgtcggactcgagatcgatctgacatctctccgacgtaccggcaaaaaagcgatttccatcgccgccgccggaatgcttctccccttcggtatgggcattgtcacctccttcgctttccctgaagcttcttcttctggcgacaatagcaaagtacttccgttcatcattttcatgggagtcgcgctctcgatcactgctttcggagttttggcgagaatactcgctgaattaaagctactcacaaccgatctcggccggatttcaatgaacgccgccgcaattaacgacgtcgcggcttgggttctcctagctctcgctgtatctctctccggcgataggaattctccgcttgttcctctctgggttctgttaagtggaatcgcgtttgtgatcgcgtgttttttaatcgtaccgcgaattttcaaattcatctctcggcgttgcccagaaggcgaacccataggcgaaatgtacgtttgcgtcgccctttgcgcggttctactcgcgggtttcgcgacagacgccattgggattcacgcgattttcggtgcgtttgtgatgggcgttttgtttcccaaaggacatttctcagacgcgattgtggagaagattgaagatcttgtaatgggtcttcttctaccactgtacttcgttatgagcggtttgaaaacggatataactacgattcaaggtgtgaaatcgtggggacgactcgcgttggtgattgttacggcttgttttggcaaaatcgttgggactgtgagtgttgccttgttatgcaaggtaaggctccgtgaatcggttgttcttggggttttaatgaacacaaagggtttagtggagctaattgttctcaacattggcaaagacagaaaggttttgagcgatcagacttttgcaattatggttctcatggcgatattcacaacattcatcacaacgccaatagtcttggcgttatacaaaccaagcgagacaacacaaacacatagtagcgtcagctacaagaaccgcaaacatagacgcaagattgagaatgatgaagaaggcgagaagatgcagcagcttaaggttttggtatgtcttcaaagcagtaaagatattgatcccatgatgaaaataatggaagctactcgtggaagcaacgaaaccaaagaaagattttgcgtttacgttatgcatttaactcaactctccgagagaccttcttctattcgaatggttcaaaaggtgagaagcaacggtttgcccttttggaacaagaaaagagagaattctagtgccgttacggtcgcgttcgaggcgtctagtaagctaagtagcgtttcggtgcgttctgtgaccgcgatttcaccgttgtcaacaattcatgaggatatatgtagctctgctgatagtaaatgcacagcgtttgtgattttgccgttccataagcaatggagatctctggagaaagaatttgaaacggtgagatcggagtatcaggggattaacaaaagagttcttgagaattcaccgtgttctgttggaattttggttgatcgtggtctcggcgacaacaattctccggtagcttcgagcaacttttcactttccgtcaatgttctgttctttggcggttgcgatgatcgtgaagctttggtttacgggttacgaatggctgaacatccgggcgttaacttgaccgttgtggttatctctggtccggagagcgcaaggtttgataggcttgaagcgcaagaaacatcactatgttccttagacgagcaattccttgcagcaatcaagaaaagggccaatgcagctagatttgaagagaggacggtgaattcaacggaggaagtggttgagattatccgccaattttacgagtgcgatattttattggtgggaaaatcttccaaaggacctatggtttcaagattaccggttatgaagatagagtgtccagaactgggaccggtcggaaacttgatcgtgtcaaatgagatttctacttcagtgtctgttttggtggttcaacaatacaccgggaaaggtccttctgtggtgggttccgtctctgtcccggtggtggagacgccatga

SEQ ID NO: 6257 - protein, 811 aa, Arabidopsis thaliana
MGTLVNGTIPAMKCPKNVAMMKTTSNGVFDGESPLDFAFPLVILQICLVVAVTRSLAFLLRPMRQPRVVAEIIGGILLGPSALGRITSYKNSIFPARSLTVLDTLANLGLLLFLFLVGLEIDLTSLRRTGKKAISIAAAGMLLPFGMGIVTSFAFPEASSSGDNSKVLPFIIFMGVALSITAFGVLARILAELKLLTTDLGRISMNAAAINDVAAWVLLALAVSLSGDRNSPLVPLWVLLSGIAFVIACFLIVPRIFKFISRRCPEGEPIGEMYVCVALCAVLLAGFATDAIGIHAIFGAFVMGVLFPKGHFSDAIVEKIEDLVMGLLLPLYFVMSGLKTDITTIQGVKSWGRLALVIVTACFGKIVGTVSVALLCKVRLRESVVLGVLMNTKGLVELIVLNIGKDRKVLSDQTFAIMVLMAIFTTFITTPIVLALYKPSETTQTHSSVSYKNRKHRRKIENDEEGEKMQQLKVLVCLQSSKDIDPMMKIMEATRGSNETKERFCVYVMHLTQLSERPSSIRMVQKVRSNGLPFWNKKRENSSAVTVAFEASSKLSSVSVRSVTAISPLSTIHEDICSSADSKCTAFVILPFHKQWRSLEKEFETVRSEYQGINKRVLENSPCSVGILVDRGLGDNNSPVASSNFSLSVNVLFFGGCDDREALVYGLRMAEHPGVNLTVVVISGPESARFDRLEAQETSLCSLDEQFLAAIKKRANAARFEERTVNSTEEVVEIIRQFYECDILLVGKSSKGPMVSRLPVMKIECPELGPVGNLIVSNEISTSVSVLVVQQYTGKGPSVVGSVSVPVVETP

SEQ ID NO: 6258 - DNA, 2466 bp, Arabidopsis thaliana
  CDS (1)..(2466)
atggcgacaagtgaagaacctagtacggatgcctccataatatgttatgcgccaagcatgatcaccaccaatggtgtttggcaaggcgataatcctctcgacttttcgctacctctctttgttcttcagctaactttggttgttgtcgtcactcgtttcttcgtctttatcctcaaaccctttcgccaacctcgtgtcatctccgagatccttggcggaattgttcttggaccatcggtgctagggcgctccacaaaatttgcacacactattttccctcaaagaagtgtgatggtacttgaaacaatggctaatgtgggtttactttacttcctattcttggtgggtgtagagatggacattatggttgtacgtaagacagggaagcgagccctaaccatcgctattggtggtatggttttaccattcctcattggtgctgccttctctttctctatgcatagatcagaagaccacttagggcaaggcacctatatacttttccttggtgttgcactctccgttactgcattcccggttcttgcaagaattcttgctgagctcaagctcatcaataccgagattgggcggatatcgatgtctgcagctttagttaacgacatgttcgcttggattcttttggccttagctattgcattggctgagagtgacaaaacttcatttgcctctctttgggttatgatctctagtgcagttttcattgccgtttgtgtttttgttgtgagaccaggcattgcttggatcatacgtaaaacccctgaaggagagaatttcagtgagttccacatatgcctaatcttgacaggagttatgatctccggtttcattactgatgcaatcggaacacattcagtctttggtgcttttgtgtttggtcttgtgattcccaatggacctcttggtctaaccctcattgagaagcttgaagatttcgtctctggccttctcctacctctcttctttgccataagtggtctcaagactaatatagctgccattcaaggccctgccacgtggttaactctgtttcttgtcattttcctcgcttgtgctggaaaggtcatcggtacagttattgttgcgtttttccatggaatgccagttcgtgaaggaatcactcttggactactcttgaacactaaaggtcttgttgaaatgattgtacttaatgttggaaaagaccaaaaggttttggatgatgagacatttgctactatggtacttgtggccttggttatgactggagtcattactcctattgtaacaatcctttacaagccagtgaagaaatctgtttcatacaagagacgaacaatccaacaaacgaagccagacagcgagcttcgggtattggtttgcgttcacacaccgcgtaatgttcctactataattaaccttcttgaagcttcacatcccacaaagagatctcctatatgcatctacgttctccaccttgttgagctcacgggccgcgcatccgcgatgttgattgtccacaacactcgtaagtcaggacgacccgcgcttaacagaactcaagctcaatcagatcatatcatcaacgcctttgagaactatgaacaacacgctgcctttgtcgctgtacaacctttaacagctatttcaccttactcaacaatgcatgaagatgtttgtagcttagcagaggacaaacgtgtctccttcataatcataccatttcacaaacaacaaacagttgatggaggaatggaatcaaccaacccggcctaccgtttagtcaaccaaaacctactcgaaaactcgccttgttcggtcggaatactcgtggatagaggactcaatggagcgacaagactcaactcaaacactgtttctcttcaagttgctgttctgtttttcggcggtccagacgatagagaagctttggcttatgcatggagaatggctcaacatcctggcatcactctaactgttttacggttcattcatgatgaagatgaagcagacacagcttcaacacgagcgaccaatgacagtgacctaaagataccaaagatggaccatagaaaacaaagacaacttgatgatgactacattaatctctttagggcagaaaatgcggaatacgagtcaattgtgtatatagaaaaactagtgagcaatggggaagagactgttgcagcagtgagatcaatggacagttctcatgatttgtttatagttggaagaggagaaggaatgtcgtctcctcttaccgcgggtttaactgattggagtgagtgtcctgagcttggtgccattggagatttgcttgcttcatcagactttgcagctactgtgtcggttcttgtggttcaacagtatgttgggtcatgggcacaagaagatgatatggattttcctgagagtccagtacattcacatgaaacaaaagtcacatatggtttagagaatccacgttag

SEQ ID NO: 6259 - protein, 821 aa, Arabidopsis thaliana
MATSEEPSTDASIICYAPSMITTNGVWQGDNPLDFSLPLFVLQLTLVVVVTRFFVFILKPFRQPRVISEILGGIVLGPSVLGRSTKFAHTIFPQRSVMVLETMANVGLLYFLFLVGVEMDIMVVRKTGKRALTIAIGGMVLPFLIGAAFSFSMHRSEDHLGQGTYILFLGVALSVTAFPVLARILAELKLINTEIGRISMSAALVNDMFAWILLALAIALAESDKTSFASLWVMISSAVFIAVCVFVVRPGIAWIIRKTPEGENFSEFHICLILTGVMISGFITDAIGTHSVFGAFVFGLVIPNGPLGLTLIEKLEDFVSGLLLPLFFAISGLKTNIAAIQGPATWLTLFLVIFLACAGKVIGTVIVAFFHGMPVREGITLGLLLNTKGLVEMIVLNVGKDQKVLDDETFATMVLVALVMTGVITPIVTILYKPVKKSVSYKRRTIQQTKPDSELRVLVCVHTPRNVPTIINLLEASHPTKRSPICIYVLHLVELTGRASAMLIVHNTRKSGRPALNRTQAQSDHIINAFENYEQHAAFVAVQPLTAISPYSTMHEDVCSLAEDKRVSFIIIPFHKQQTVDGGMESTNPAYRLVNQNLLENSPCSVGILVDRGLNGATRLNSNTVSLQVAVLFFGGPDDREALAYAWRMAQHPGITLTVLRFIHDEDEADTASTRATNDSDLKIPKMDHRKQRQLDDDYINLFRAENAEYESIVYIEKLVSNGEETVAAVRSMDSSHDLFIVGRGEGMSSPLTAGLTDWSECPELGAIGDLLASSDFAATVSVLVVQQYVGSWAQEDDMDFPESPVHSHETKVTYGLENPR

SEQ ID NO: 6260 - DNA, 2403 bp, Arabidopsis thaliana
  CDS (1)..(2403)
atggcaagcaccaacgttacagggcaatgcccgggtccaatgaaggctacctccaatggagccttccaaaacgaaagccctcttgatttcgcgcttcctcttatcatcctacaaatcgtcttggtggttgtgtttacaaggctcttagcttactttcttaagcctctcaaacagccccgagtcattgctgagatcattggagggatactgcttggaccttctgcactagggagaagcaaggcctatcttgacaccatcttcccaaagaagagcttgaccgttttagacacactcgccaacattggtcttctgtttttcttgttcctagttgggcttgagcttgactttgcagcaataaaaaaaactggaaagaaatcactattgatagccatagctgggatctcacttccttttatagtgggtgtaggcacatcttttgttctcagtgccaccataagcaaaggagtcgatcagcttccttttattgtcttcatgggtgttgccttatcaatcactgccttccctgtgcttgctcgtatactagctgagctaaagcttctaacaactgacattggacgtatggcaatgtctgcagcgggagtaaacgatgttgcagcttggatactccttgcgcttgctattgctctctcaggagatgggacttctcctcttgtatctgtttgggttcttctctgtggaactggattcgtgatctttgcagttgtggcaatcaaacctctgcttgcttatatggctagacgctgtcctgagggagagcctgtaaaggaactctatgtttgtgtcactctaaccgtggttttagcagcaagctttgtgacagacactattgggatacacgcgctgttcggggcgtttgtggtaggtatagtagctcctaaagaaggaccattttgcaggattttgactgagaagatagaggatcttgtttcggggcttcttctacctctgtattttgcggctagcggtctcaaaactgatgtaacaacgatcaggggagcacagtcatggggacttctagttcttgtcattctcaccacttgtttcgggaagattgtaggaacagttggttcctcgatgctctgcaaggttcctttcagagaagccgtgacacttggattccttatgaataccaaaggtttagtagagctcattgttcttaacattggcaaggaccggaaggtgctgaatgatcaagcatttgcgatcttagtcctaatggcattgttcacaaccttcatcacaactccaattgtgatgcttatttacaagcctgcaagaaaaggagcaccgtacaagcacagaaccatccaaagaaaagatcatgattctgagctaaggatacttgcttgcttccacagtacccgtaacatccccacattgatcaatctgatcgaatcatcaagaggaacaggcaaaaagggacgcctctgcgtttacgcgatgcatctgatggagctttctgaacggtcatcagcgatcgcgatggttcacaaagctcgaaacaatggtctcccaatctggaataagatcgagagatcaacggaccagatggtgattgccttcgaggcttaccagcatctacgagcagtagcggttagacccatgactgcaatctctggcctcagcagcatccacgaggacatatgcacaagcgcgcatcagaaacgagtagcgatgatactgcttccgtttcacaagcatcagagaatggacggagcgatggagtcaataggacataggttccatgaagtgaaccaacgggtcttgcaacgagctccttgctcagtcgggattcttgtggacagaggactcggaggaacctcacaggttgtagccagcgaagtggcttacaaagtcgtgattccattctttggaggcctcgacgaccgagaagctctcgcatacgggatgaaaatggtggaacatccaggaatcacactaactgtttacaaatttgtagctgcgagaggaacattgaagagattcgagaagagtgaacacgacgaaaaggagaaaaaagagaaagagactgacgaagagtttgtgagggagttgatgaatgatccaagaggaaatgagtcattggcttacgaggaaagagtcgttgagagcaaagacgatatcatcgcgacacttaaatcgatgagtaaatgcaatctcttcgtcgttggaagaaatgcagctgttgcatcgttggttaagagtacagactgtccagagttaggaccagttggacgcttgttgtcgtcatcagagttttccaccaccgcgtcggtgctcgtcgttcagggatatgatccagcagcagatacacgaccgctcgttgaggaagatgcagagtacgatcagtcttccagagatatttcagacttaactgcctga

SEQ ID NO: 6261 - protein, 800 aa, Arabidopsis thaliana
MASTNVTGQCPGPMKATSNGAFQNESPLDFALPLIILQIVLVVVFTRLLAYFLKPLKQPRVIAEIIGGILLGPSALGRSKAYLDTIFPKKSLTVLDTLANIGLLFFLFLVGLELDFAAIKKTGKKSLLIAIAGISLPFIVGVGTSFVLSATISKGVDQLPFIVFMGVALSITAFPVLARILAELKLLTTDIGRMAMSAAGVNDVAAWILLALAIALSGDGTSPLVSVWVLLCGTGFVIFAVVAIKPLLAYMARRCPEGEPVKELYVCVTLTVVLAASFVTDTIGIHALFGAFVVGIVAPKEGPFCRILTEKIEDLVSGLLLPLYFAASGLKTDVTTIRGAQSWGLLVLVILTTCFGKIVGTVGSSMLCKVPFREAVTLGFLMNTKGLVELIVLNIGKDRKVLNDQAFAILVLMALFTTFITTPIVMLIYKPARKGAPYKHRTIQRKDHDSELRILACFHSTRNIPTLINLIESSRGTGKKGRLCVYAMHLMELSERSSAIAMVHKARNNGLPIWNKIERSTDQMVIAFEAYQHLRAVAVRPMTAISGLSSIHEDICTSAHQKRVAMILLPFHKHQRMDGAMESIGHRFHEVNQRVLQRAPCSVGILVDRGLGGTSQVVASEVAYKVVIPFFGGLDDREALAYGMKMVEHPGITLTVYKFVAARGTLKRFEKSEHDEKEKKEKETDEEFVRELMNDPRGNESLAYEERVVESKDDIIATLKSMSKCNLFVVGRNAAVASLVKSTDCPELGPVGRLLSSSEFSTTASVLVVQGYDPAADTRPLVEEDAEYDQSSRDISDLTA

SEQ ID NO: 6262 - DNA, 2529 bp, Arabidopsis thaliana
  CDS (1)..(2529)
atgcccttcaacataacctccgtgaaaacctcatctaacggagtatggcaaggcgacaatcctttaaacttcgcttttccgttactcatcgtccaaacggcgttaatcatcgccgtcagtcgcttcctcgccgtcttattcaaacctctccgtcaacccaaagtcatcgccgagattgtcggagggattttgttaggaccatcggctttaggtagaaacatggcgtacatggaccgtatatttccgaaatggagtatgccgatactcgaatccgtcgcgagcataggacttctcttcttcctcttcctcgtcggtctagaactcgatttatcatcgatccgacgaagcggcaaacgcgctttcggaatcgcagtcgctggaattacactaccgtttatcgccggcgtcggagtcgcgtttgtgatccgtaacactctctacaccgccgcggataaaccaggttacgccgagtttctcgttttcatgggagtcgcactctcgatcacagcttttccggtacttgcgcgtattttagcagagctcaagcttttaacgactcagataggagaaaccgcgatggctgcagccgcttttaacgatgtagccgcgtggattttactcgctttagcggttgcgttagcgggtaatggcggtgagggaggtggagagaaaaagagtccgttagtgtcgttgtgggttttgttatcgggcgctgggtttgtggtttttatgttggttgtgatccgacccggaatgaaatgggtcgcgaaacgtggatctcctgaaaacgacgtcgtacgcgagtcttacgtgtgtttgacgttagccggtgttatggtttccggtttcgcgacggatttaattgggattcattcgatttttggagcgtttgttttcggtttgactataccgaaagatggagagtttggtcagcgattgattgaacgaattgaggattttgtttccggtttactcttaccgctttatttcgctacgagtggtttgaagactgacgtggctaagattagaggagctgagtcgtgggggatgttgggtcttgttgttgttacggcttgtgccgggaagatagtcggaacttttgttgtggcggtgatggttaaagttccggcgagagaggcgttgacacttggtttcttgatgaatactaaaggtttagtggagctcattgtactcaacataggcaaggagaaaaaggtactaaacgacgagacgtttgcaatactagtgctaatggcactcttcacaacgttcataacgacgcctactgtaatggccatttacaagccggcacgtggcacccaccgcaaactaaaagacttgtcggcgagccaagactccaccaaggaagagcttcgcatcctagcctgcctccacggcccagccaatgtctcctccctcatctctctcgtcgagtccatccgaaccaccaagatactacggctaaagctgtttgtgatgcatctgatggaactaacggaacggtcttcgtcaatcataatggtgcaaagagcccgtaaaaacggacttcctttcgttcaccgttaccgtcatggtgagcgtcacagcaacgtcataggaggcttcgaagcctatcgtcaactaggccgggtcgcagtccggcccatcaccgcagtctctccattacccacaatgcacgaagacatttgccacatggcagataccaagagggtcacaatgatcattttacctttccacaaacgatggaacgctgatcatggtcatagccaccaccaccaagacggaggaggagatggaaacgtaccggaaaacgttggtcatggttggcgattggttaaccaaagggttttgaagaatgcgccgtgttcggtggcggttcttgtagaccgtggacttgggtccattgaggcccaaactttgagcttagatgggtcgaatgtggttgaaagggtttgtgtgattttctttggtgggcctgatgaccgtgagtctatagagctcggcgggagaatggctgagcatccggccgttaaagttaccgttattaggtttttggtaagagaaacgttgaggagtaccgccgtcactttacgaccggcaccgtctaaaggcaaggagaagaactatgcctttttaacaaccaacgtggatccagaaaaagaaaaggaattagacgaaggggcattggaagacttcaagagcaaatggaaagaaatggtggagtacaaagaaaaggaaccaaacaacatcattgaagaaatactgtcaataggacagagtaaagactttgatctaatagtggttggaagagggaggataccgtcggccgaggtggcggcattagctgagcgtcaagctgaacatcctgagttaggtcctatcggagacgtgctcgcctcttcgatcaaccacatcattccatcaatccttgtggttcaacaacacaacaaagctcatgtagaggatattacggtttccaaaattgttagtgagtcttctctaagtattaacggagacacaaatgtatga

SEQ ID NO: 6263 - protein, 842 aa, Arabidopsis thaliana
MPFNITSVKTSSNGVWQGDNPLNFAFPLLIVQTALIIAVSRFLAVLFKPLRQPKVIAEIVGGILLGPSALGRNMAYMDRIFPKWSMPILESVASIGLLFFLFLVGLELDLSSIRRSGKRAFGIAVAGITLPFIAGVGVAFVIRNTLYTAADKPGYAEFLVFMGVALSITAFPVLARILAELKLLTTQIGETAMAAAAFNDVAAWILLALAVALAGNGGEGGGEKKSPLVSLWVLLSGAGFVVFMLVVIRPGMKWVAKRGSPENDVVRESYVCLTLAGVMVSGFATDLIGIHSIFGAFVFGLTIPKDGEFGQRLIERIEDFVSGLLLPLYFATSGLKTDVAKIRGAESWGMLGLVVVTACAGKIVGTFVVAVMVKVPAREALTLGFLMNTKGLVELIVLNIGKEKKVLNDETFAILVLMALFTTFITTPTVMAIYKPARGTHRKLKDLSASQDSTKEELRILACLHGPANVSSLISLVESIRTTKILRLKLFVMHLMELTERSSSIIMVQRARKNGLPFVHRYRHGERHSNVIGGFEAYRQLGRVAVRPITAVSPLPTMHEDICHMADTKRVTMIILPFHKRWNADHGHSHHHQDGGGDGNVPENVGHGWRLVNQRVLKNAPCSVAVLVDRGLGSIEAQTLSLDGSNVVERVCVIFFGGPDDRESIELGGRMAEHPAVKVTVIRFLVRETLRSTAVTLRPAPSKGKEKNYAFLTTNVDPEKEKELDEGALEDFKSKWKEMVEYKEKEPNNIIEEILSIGQSKDFDLIVVGRGRIPSAEVAALAERQAEHPELGPIGDVLASSINHIIPSILVVQQHNKAHVEDITVSKIVSESSLSINGDTNV

SEQ ID NO: 6264 - DNA, 2463 bp, Arabidopsis thaliana
  CDS (1)..(2463)
atgggaacaaacggtacaacatgtccaggaccaatgaaagcaacctctaatggagtctttcaaggagagaatcctctggaacacgcgttgcctcttctcatactccagatctgtatcgttcttcttctcactcgtcttcttgcttttctcctccgtcctctccggcagccacgtgtcatcgccgagattgtcggtggaatattacttggaccatcagcacttgggaaaagcactaagtttatcaacacagttttcccaccaaagagtctaacggttttagacacacttgcaaacttaggactcatcttcttcctcttcctcgttggtctcgagctcgatcccaaatctcttaagcgaaccggaaagagagctctctctatcgctctcgccggaatcactcttcctttcgtattaggcattggaacttcttttgctctccgcagttccatagctgatggagccagcaaagctcctttccttgtcttcatgggtgttgctctctccatcacagcgtttcccgtcttggcccgaatactcgctgagattaagcttctaaccactgatatcggaaagattgctttgtccgctgctgcggtcaatgacgtggctgcttggattctccttgctctcgcggtggctctttctggagaggggagctctccgcttacttctctttgggtgtttctctcgggttgcggttttgtcttgttctgtatctttgttgtgcaaccagggattaagttgattgctaaacgttgccctgaaggagaaccggtaaatgaactttacgtgtgttgcacgttaggtattgttcttgcagctagcttcgtcacagactttattgggattcatgcgctgtttggtgcttttgtgatcggggttattttccctaaagaaggcaatttcgcgaatgctttagttgagaaagttgaggatctcgtgtcaggtcttttcttgccgctctacttcgtctcaagtggtttaaagaccaatgttgcgacgatccaaggagctcagtcttggggactcttggttttggttatatttaatgcttgtttcggtaaaatcatcggtacagtcctagtttccctttactgcaaagttccgcttgaccagtctttagcgcttggtttcttgatgaacacgaaaggtcttgttgagctcatcgtcctcaacattggtaaagacagaggggttctgaatgatcaaattttcgctataatggttctaatggcgatattcaccacattcatgacgactcctctagttctggcagtgtacaaaccgggtaaatccttaaccaaagctgattataagaaccgaacggtggaggagacgaaccgttcaaacaaaccgctctgcctcatgttctgtttccagagcataatgaacatccccacgatcgtcaacctcatagaagcatcccgaggcataaaccgtaaagaaaatctatcagtctacgcgatgcatcttatggagctttcagagagatcatcggctatactcatggcacacaaggtcaggagaaacggtcttcccttctggaacaaagacaaatctgagaacaatagttcttcttccgacatggttgtggtcgcattcgaggctttccgaagactcagccgtgtctcagtgcgtcccatgacagcgatctcaccgatggcgactatacatgaggatatttgccaaagcgcggaacgcaaaaaaaccgctatggtgattcttccgtttcataagcacgttaggctggacagaacatgggagacgactaggaatgactaccgttggattaacaagaaggttatggaggaatctccatgttctgttgcgattttggttgatcgtggacttggtggtacgacacgtgtcgcgtctagtgatttctcgttgactataacagttttgttttttggagggaatgatgatcgtgaggcgttagcgtttgcggtgcgaatggctgaacatcccgggataagcttaaccgttgttcggtttatccctagcgatgaattcaaaccggaaaacgtgaggatcgagataaccgaagatcagctctgttcaggggcaactagattgattgatattgaagctataaccgaacttaaagcaaagattaaagaaaaagaaagttctcgttctaattcggattctgaatctcatatcatttacgaagagaaaatcgtgaaatgttacgaggaagttatcgaagttattaaagagtattctaaaagcaaccttttcttggtggggaagtcaccggaaggttctgtagcgtcagggataaacgtaagaagcgacacgcctgagcttggaccgatcgggaatttgttaacggaaagcgaaagtgtttcgacggtggcatcagtgttggtggtgcaacagtatatagcaagccgtccggtcggaatttcgaagaacgtcacgactgaagagtcgctggttgaggattctgagagtccttag

SEQ ID NO: 6265 - protein, 820 aa, Arabidopsis thaliana
MGTNGTTCPGPMKATSNGVFQGENPLEHALPLLILQICIVLLLTRLLAFLLRPLRQPRVIAEIVGGILLGPSALGKSTKFINTVFPPKSLTVLDTLANLGLIFFLFLVGLELDPKSLKRTGKRALSIALAGITLPFVLGIGTSFALRSSIADGASKAPFLVFMGVALSITAFPVLARILAEIKLLTTDIGKIALSAAAVNDVAAWILLALAVALSGEGSSPLTSLWVFLSGCGFVLFCIFVVQPGIKLIAKRCPEGEPVNELYVCCTLGIVLAASFVTDFIGIHALFGAFVIGVIFPKEGNFANALVEKVEDLVSGLFLPLYFVSSGLKTNVATIQGAQSWGLLVLVIFNACFGKIIGTVLVSLYCKVPLDQSLALGFLMNTKGLVELIVLNIGKDRGVLNDQIFAIMVLMAIFTTFMTTPLVLAVYKPGKSLTKADYKNRTVEETNRSNKPLCLMFCFQSIMNIPTIVNLIEASRGINRKENLSVYAMHLMELSERSSAILMAHKVRRNGLPFWNKDKSENNSSSSDMVVVAFEAFRRLSRVSVRPMTAISPMATIHEDICQSAERKKTAMVILPFHKHVRLDRTWETTRNDYRWINKKVMEESPCSVAILVDRGLGGTTRVASSDFSLTITVLFFGGNDDREALAFAVRMAEHPGISLTVVRFIPSDEFKPENVRIEITEDQLCSGATRLIDIEAITELKAKIKEKESSRSNSDSESHIIYEEKIVKCYEEVIEVIKEYSKSNLFLVGKSPEGSVASGINVRSDTPELGPIGNLLTESESVSTVASVLVVQQYIASRPVGISKNVTTEESLVEDSESP

SEQ ID NO: 6266 - DNA, 2433 bp, Arabidopsis thaliana
  CDS (1)..(2433)
atggctacaaattctacaaaagcttgtcctgctccgatgaaagcaacctctaatggagttttccaaggagataaccctatagactttgcgttacctcttgcgattctgcagatagttattgttatagttctcactcgtgttcttgcttaccttttaagacctttgagacagcctcgtgttattgctgaagttattggtgggattatgcttggaccttctcttcttggtcgttccaaggcttttctagacgctgtgttcccgaagaaaagcttgactgttcttgaaactctggctaatctcggccttctcttcttccttttccttgctggtctagagattgataccaaagcccttcgtcgcaccgggaaaaaggctttgggaattgccttggctggaataaccctcccgtttgctcttggcattggttcttcattcgttttaaaagcaacaatctccaaaggagtgaatagtaccgcgtttctcgtcttcatgggtgtggcactctctatcactgcattccctgtgttggcccgtatcttagcggagctaaagcttctaactactgagataggacgacttgctatgtcggcagctgccgttaacgatgtggcagcttggattctacttgctctagccattgctctctcgggatccaatacctctccccttgtctctctctgggttttcctttccgggtgtgcttttgttatcggtgcgtctttcatcattccaccaatctttagatggatttcccggaggtgccacgagggagaacctatcgaggaaacctacatctgtgccactttggctgtagttcttgtttgtggattcataactgatgccattggaatccactccatgtttggtgcctttgtggtgggtgttttgattccaaaggaaggaccttttgctggtgcactagttgagaaggtggaagatcttgtatccggtctcttcctgccgctttactttgtggcaagtggtctgaaaactaatgtggcaacgatccaaggagctcagtcttggggtcttctggttttagtcaccgccacagcttgtttcggtaagatattgggcactctcggtgtttccctcgccttcaagatacctatgcgagaagcaataacattaggattcctcatgaacactaaaggattggtcgaactcatcgtcctcaacatcggaaaagatcgaaaggttcttaatgatcagacatttgccataatggttctaatggctctcttcacaaccttcatcaccacaccagtcgtaatggcagtctacaaaccagcgagaagagcgaagaaagaaggagaatacaaacacagggcagtagaacgagagaacacaaacacacagcttcgaatcctcacatgtttccacggagcaggaagcattccttcaatgataaacctcctagaagcatcaagaggtatcgaaaaaggcgaagggctctgcgtttacgctctccacttacgggaactatcagagagatcatcagctattctaatggttcataaagttcggaaaaacggaatgccgttttggaacagaagaggagtaaacgcagacgctgatcaagtagtagttgctttccaagcttttcaacagctaagcagagtcaatgtccgaccaatgacagcaatctcttcaatgtctgatattcatgaagatatctgcacaacagctgtaagaaaaaaagcagccattgtgattcttccgtttcacaagcatcaacagcttgatggttcgttagagactacacgtggcgattaccgttgggttaaccggagagttttgcttcaagctccttgttcggttggtatattcgttgaccgtggactcggaggttcaagtcaagtctcagctcaagatgtttcttactctgttgttgttctgttcttcggtggtcctgatgatcgtgaagcgttggcttatggattacgtatggcggagcatcccggaattgttttgactgttttccgatttgtggtatcgccggagagagtcggagagattgttaatgttgaagtgagtaacaataacaacgagaatcagagtgtgaagaatctgaaatcggatgaggagattatgtctgagataaggaagatatcttcggtggacgaatcggttaagttcgtggagaaacagattgaaaacgccgccgtggatgttagatcggcgattgaggaagtgcggcggagcaatttgtttttggttggtagaatgccaggtggagaaattgcattggcgattagggagaatagtgaatgtccggagcttggacctgtaggaagcttgttgatttcgccggaatcttcgacaaaagcatcggttttggtgattcagcagtacaacggcaccggaatagctccggatttgggtgcggctgagacggaggtattgacttctacggataaagactctgattga

SEQ ID NO: 6267 - protein, 810 aa, Arabidopsis thaliana
MATNSTKACPAPMKATSNGVFQGDNPIDFALPLAILQIVIVIVLTRVLAYLLRPLRQPRVIAEVIGGIMLGPSLLGRSKAFLDAVFPKKSLTVLETLANLGLLFFLFLAGLEIDTKALRRTGKKALGIALAGITLPFALGIGSSFVLKATISKGVNSTAFLVFMGVALSITAFPVLARILAELKLLTTEIGRLAMSAAAVNDVAAWILLALAIALSGSNTSPLVSLWVFLSGCAFVIGASFIIPPIFRWISRRCHEGEPIEETYICATLAVVLVCGFITDAIGIHSMFGAFVVGVLIPKEGPFAGALVEKVEDLVSGLFLPLYFVASGLKTNVATIQGAQSWGLLVLVTATACFGKILGTLGVSLAFKIPMREAITLGFLMNTKGLVELIVLNIGKDRKVLNDQTFAIMVLMALFTTFITTPVVMAVYKPARRAKKEGEYKHRAVERENTNTQLRILTCFHGAGSIPSMINLLEASRGIEKGEGLCVYALHLRELSERSSAILMVHKVRKNGMPFWNRRGVNADADQVVVAFQAFQQLSRVNVRPMTAISSMSDIHEDICTTAVRKKAAIVILPFHKHQQLDGSLETTRGDYRWVNRRVLLQAPCSVGIFVDRGLGGSSQVSAQDVSYSVVVLFFGGPDDREALAYGLRMAEHPGIVLTVFRFVVSPERVGEIVNVEVSNNNNENQSVKNLKSDEEIMSEIRKISSVDESVKFVEKQIENAAVDVRSAIEEVRRSNLFLVGRMPGGEIALAIRENSECPELGPVGSLLISPESSTKASVLVIQQYNGTGIAPDLGAAETEVLTSTDKDSD

SEQ ID NO: 6268 - DNA, 2664 bp, Gibberella zeae PH-1
  CDS (1)..(2664)
atgtcgtcttcgccgacgacgacggctgcggccgtcacgagtgcccatccccaaggaggcatcatcgaaggcctcaacccaattgtgtacaaccccaaagaccccatcactctcttcattgtccaagctttcgttatcatcatcttctgtcgtcttcttcaatggcctctctccaaattcggccaaccgcgcgtcatcgcagaagttattggaggcattgtcctcggtccttccgtcatgatgcgcattcccggcttcaaggagaacatcttccctactgagtcaatgcccgtcctgtccaatgtcgctacaattggtctcctgctcttcttgtttctcgttggactcgaagttgatacacgcatgttcaagtccaattggcgtgtcgctgttagtgttggtcttgccagcatgatgcttccttttggtctcggtgtcgctgttgcttggggtctgtacgaagaatacggaagtgagggaactatgaaggatatggagtttggcacctttgcgctcttcattggaactgcgctcgccattactgccttccctgttctttgtcgtattctctctgagcttcagcttctcagcacttctgtcggtgtcacagtccttgctgccggtatcggaaacgatgtcgtcggttgggttctgctcgctctcagtgtcgctctggtcaacaatgccaatggcctcacagcgctgtatgtattcttgactgcagtcgcatgggtccttttccttgtctacgcagtgcgccctgtctttctctgggtattgcgccggacggacagtatccagaacggcccatctcaaggcatcactaccttgactctgcttctggtcctggcctcttcttggttcactgccgccatcggtgttcacgctatttttggtgccttcctcattggtcttatatgtcctcacgatggtggttttgccatcaaactgactgaaaagattgaggatctcgtgggatcaattctcttgcctctctactttgcactctctggcctcaacaccaatctgggcctgcttgatgatggtactacttggggatacgtcgttgcaattatcgcatgcgctttctttggcaagatcattgccggtacccttgccgcgcgcttgaccaagtgtctttggcgagagagttttaccattggtgcccttatgagttgtaagggtcttgtcgagctgattgtcttgaacatcggtcttcaagctggcattctttcgccacgaaccttcacaatgtttgtcgtcatggcagtggtcactaccgtcacaacatcaccactcaccagatggctctaccctctctcgtaccgcctcaaggtcgagaagtggcgccgaggagagatcgactgggatggaaaccctcttcaaaccgaggctcagagttctgaacataagatggaagaggctcttgataagtctcagaccaaccgtctcatcctccacctccgcctcgatgcccttcctggcctgttcaacctcgtctcacttcttggtggatcccgaaaacaaactgttcctgccatcactcccacaaccaacgatgtcaacgcagatgctactcctgctgaggaaaagacccaggtcattcccagtcgcccgttcgaggttcgtggtgttcggcttatggagctgaccgatcgaacttcgtcggttatgcaatctgccgaactcgatgagttcgcttctcgcgacgccgtcttctccgctttccagactttctctcgtctcaacggtgtcgccgtagctggccaagtatccatcatcccaaccaacgcctacgccgaaactattgtcaagtttgccgaagaagccaggtctgacttcatgatcattccttggagcacatatggtggtatcgctgaggaaagctccactgccgccttgatcgagactggcaacatcaacgatcgtttctttagtagaacttacatcgattatgtccagaacgctatcgagcgatcaacttgcaccactggtattttcatcaaccgcgtccctcacgacgttttgaccaggaagcccacccttacacgaactcgcaccggtctgtctgttcacagcgcccatgatggcgcagtcgttcaaaggcctgttgatcagcgccagattatcttcgtgcccttcatcggtggcaaggatgatcgcgccgccctactctttgctcttcagctcgcacacaacccccacgtctccatccacgtcgtccatctgcactttagcgaagacgatcacgaagcactcaatgcatcgcctgacagcgatccttccacgggtaacgaccttggaaagaacgccgttgacttcccatctgcgagtgacatggacctcctgagcacagcaaagaacaacgctgccggtaaactcgaaggccgcgtcacattcctcgagatccctgttgattcagtccgcaacctgcctgatcttgctgtagctcatgcccgtgaactcgttggcaagtcccgctacagcgtcggcgatttaatcatcgctggccgttcgcacccactgtttgacaatcttcttgtggaggactttggagtggagagagacttccagcgcacaattggtgtgcttggagataggtttgctagagcaggcgttgatgctgggctgttggttattgacgacaagcaagccaaggcgtaa

SEQ ID NO: 6269 - protein, 887 aa, Gibberella zeae PH-1
MSSSPTTTAAAVTSAHPQGGIIEGLNPIVYNPKDPITLFIVQAFVIIIFCRLLQWPLSKFGQPRVIAEVIGGIVLGPSVMMRIPGFKENIFPTESMPVLSNVATIGLLLFLFLVGLEVDTRMFKSNWRVAVSVGLASMMLPFGLGVAVAWGLYEEYGSEGTMKDMEFGTFALFIGTALAITAFPVLCRILSELQLLSTSVGVTVLAAGIGNDVVGWVLLALSVALVNNANGLTALYVFLTAVAWVLFLVYAVRPVFLWVLRRTDSIQNGPSQGITTLTLLLVLASSWFTAAIGVHAIFGAFLIGLICPHDGGFAIKLTEKIEDLVGSILLPLYFALSGLNTNLGLLDDGTTWGYVVAIIACAFFGKIIAGTLAARLTKCLWRESFTIGALMSCKGLVELIVLNIGLQAGILSPRTFTMFVVMAVVTTVTTSPLTRWLYPLSYRLKVEKWRRGEIDWDGNPLQTEAQSSEHKMEEALDKSQTNRLILHLRLDALPGLFNLVSLLGGSRKQTVPAITPTTNDVNADATPAEEKTQVIPSRPFEVRGVRLMELTDRTSSVMQSAELDEFASRDAVFSAFQTFSRLNGVAVAGQVSIIPTNAYAETIVKFAEEARSDFMIIPWSTYGGIAEESSTAALIETGNINDRFFSRTYIDYVQNAIERSTCTTGIFINRVPHDVLTRKPTLTRTRTGLSVHSAHDGAVVQRPVDQRQIIFVPFIGGKDDRAALLFALQLAHNPHVSIHVVHLHFSEDDHEALNASPDSDPSTGNDLGKNAVDFPSASDMDLLSTAKNNAAGKLEGRVTFLEIPVDSVRNLPDLAVAHARELVGKSRYSVGDLIIAGRSHPLFDNLLVEDFGVERDFQRTIGVLGDRFARAGVDAGLLVIDDKQAKA

SEQ ID NO: 6270 - DNA, 2631 bp, Candida glabrata CBS 138
  CDS (1)..(2631)
atggctgaaatcggcggtgttttgtctggagtaaacccatttcattataacccagggtcaccgataacactgtttttatttcaagtatgtctcatattagctacgtgcaacttggtacatataccgttttcaaagctgaggcagccgaaggtgatatcagaagttacagcaggtgtaatattgggcccaactgtttttggacaaataccaaattacacagaaactgtcttcccccaatcttctattccaggcttaaacttgacggccaatctcggaattattttatttatgttttttttgggactggaggttgatattgcatttataagaaagcatttaaagtctgcaatttccattggccttgtaacattagcagttccatttggatgtggttgcctaatagccattccactatactcaaactatgcaaataaagatccaaatgcgagacatattaaatttaccgtatttatggtatttatagctgtttctatggcagtaactgcatttcctgtattatccagaattctgaatgaattacggttgattaaagaaagacctggcattattgttcttggggctgggattatcaatgatattttaggttggattttgttggcattaagtgttattttgtcaagtgccgagtcaagtccagttaatactgtctacattctgctaataacattaggctggttcctaatatatttttacccactgaaatacattgttcgttgggcactaattaaaacacatgaattagatagaagcaaaccatcaccgatagccaccatgtgcattcttttcataatgtttatttctgcttactttactgatattattggtgtgcatgctatctttggagcatttatagctggtcttattgttcctagagaaaatcactatgttgtgaaattgacagaaaggatggaagatataccaaacattgttttgattccaatctactttgctgtagctggtctaaatgtagatttgacacttttaaataaaggaaaagattggggttacgtattcttatccatcgcagtagcaattgcaagtaaagtagtatcaggcactgccatggctaaattgcatgggttgtattggagagaatcaatggcaattggcgttttgatgtcttgtaaaggtattgtcgagattgttgtattaactgttggtctaaatgctggcatcataagtcacaagatttttggcatgtttattttaatggctttggtatcaacttttgtcacaacaccattaacacaattagtttatccaaattcttaccgagagcaattaaaaaaagaacagccatctgataacgaatctaccgttttaattcagaaggacgattcgacggactgtgactatcaaaataaaatgaactggcatgaattaaaacaatattctataccaagagtaattaatgtcatcaatacgccagagataatatcatcatcactagaatttttaaactttttcctatttaaaggaaatgtggataaacagccaaggtcatcgaacaaagacctgctgatcagcagagtatctactggttcaacaattaaatcttcatctaaattaaaaaaattaacacattctctaaaacgtatgaatgaggagtcaaatgagaaaatggcgacgataggagaatatccaactggttttagtaacatgtctacgttgagagcaatccatctaagattactaacagaaagaacaaccgacttacttcaatcttcctcattgtataacgatgacccactcttcactgcaaactccgattacattctcaatatttttgaaatcttctcaaatctaagtaaggtaccatttacaagtgaagttattttttccaccatgcgtgagaaaggcgtaaatgccactagattacaaatgatgccaaatgaactagttctctttcctttgaagggagcttcttatgaacataaaggaagtcctggcttgagtgacgaaaagtattccagttttgaccatttcttgtcgcatattattggcctaaatgagctcccatctatttttttccagacgttagctagtgatttgaaaacaaattttgctatgctaatatcgaatacatgtggaagattgagcatagagagattcaagaagaaacatttcattctattactacctaatcccaatatgacacactctgattttctaggcttgtatatccttttgaagctttgctataacgactccttgagccatgaaaataatatattcagcatttactataataacatgaacaccagatttgaagaagagtttcaaaatctgatagccgaccaatattggtttgatgatgtgaatttaaaaatctccagtattactgctagcataaaaactgagggtgattacagaacgaaaccatttgtcgaatcagtgctagaaaaaggtctcagttcagaggaactggaagacctagaagaaagcacatttattattgctgaaaataaatttgataggaatgaaccatttgaaaatgatgtcaagagtactatatatgatgctgctaataaacgcttcaatgtcctcattgttcattattttaatcgcgtgaacttcccacataaaagctcttttatatcaaccgaatag

SEQ ID NO: 6271 - protein, 876 aa, Candida glabrata CBS 138
MAEIGGVLSGVNPFHYNPGSPITLFLFQVCLILATCNLVHIPFSKLRQPKVISEVTAGVILGPTVFGQIPNYTETVFPQSSIPGLNLTANLGIILFMFFLGLEVDIAFIRKHLKSAISIGLVTLAVPFGCGCLIAIPLYSNYANKDPNARHIKFTVFMVFIAVSMAVTAFPVLSRILNELRLIKERPGIIVLGAGIINDILGWILLALSVILSSAESSPVNTVYILLITLGWFLIYFYPLKYIVRWALIKTHELDRSKPSPIATMCILFIMFISAYFTDIIGVHAIFGAFIAGLIVPRENHYVVKLTERMEDIPNIVLIPIYFAVAGLNVDLTLLNKGKDWGYVFLSIAVAIASKVVSGTAMAKLHGLYWRESMAIGVLMSCKGIVEIVVLTVGLNAGIISHKIFGMFILMALVSTFVTTPLTQLVYPNSYREQLKKEQPSDNESTVLIQKDDSTDCDYQNKMNWHELKQYSIPRVINVINTPEIISSSLEFLNFFLFKGNVDKQPRSSNKDLLISRVSTGSTIKSSSKLKKLTHSLKRMNEESNEKMATIGEYPTGFSNMSTLRAIHLRLLTERTTDLLQSSSLYNDDPLFTANSDYILNIFEIFSNLSKVPFTSEVIFSTMREKGVNATRLQMMPNELVLFPLKGASYEHKGSPGLSDEKYSSFDHFLSHIIGLNELPSIFFQTLASDLKTNFAMLISNTCGRLSIERFKKKHFILLLPNPNMTHSDFLGLYILLKLCYNDSLSHENNIFSIYYNNMNTRFEEEFQNLIADQYWFDDVNLKISSITASIKTEGDYRTKPFVESVLEKGLSSEELEDLEESTFIIAENKFDRNEPFENDVKSTIYDAANKRFNVLIVHYFNRVNFPHKSSFISTE

SEQ ID NO: 6272 - DNA, 2346 bp, Kluyveromyces lactis NRRL Y-1140
  CDS (1)..(2346)
atggctaataccgtgggaggtgtgctttcgggggtcaatcctttcatatataactctggttcaccaataacgtttttccttattcaagcagcgttaattctagtacttacgaatgttttgcatgtgtttatttcgaaacttaggcaaccgaaagttatctctgaggttattgcaggtatcatactagggcctaccgtgtttggacagatcccaaattatctcacaaccattttccctgctggctcagtgactggtttgaaccttgtagctaatttgggaatcattttgttcatgtttttcttggggatggaagtcgatattagcttcgtgaagagaaatgccaaggcagctatctcgattggattggcgacgttaattgtaccattcgggtttgggtgtttgtttgcattacccttatataatgcttatatggacggacatggtattgaattcaaagtctttatggtattcattgccgtttctctatcgattacggcttttccagtcttgtgtcgtattcttaccgagttgagattggtgaaagaaagagtaggtatcattgttttgacttctggtaccatcaatgacgttgtaggctggattcttctagccttgtgtattattctttccaactctcagtcagacccagtgaatgtcgtgtacattttgttatgcacttttggctggttcctattctgttgttatccagtcagacttacattgaagtgggggttcaatagattccatgaatttgaaagggatagcccttccacttttgccactctattgattcttgtgattgtactactaagtgcttactttacagatattattggtgttcatccgatttttggggcttttattgcaggtattatcgttcctagagaaaacaattacgtgtcgaaattaacggcacgcatggaagatatacccaacttacttatgataccaatctatttcactattgctggtttgaacgttgatttaactcttttgaataaaggttctgattggggatacatctttgcaagtattggtattgccgttgcaacgaaggttgtttctggtgctcttttatctaaaataaatggattatgctggagagaatctttggctgttggtgtcttgatgtcatgtaagggtattgtggaaattgttgtcttaacaactggtttgaacgctggtataatcaccaagaaggtttatgcaatgttcattttcatggcacttatttcaacttttataaccaccccattgacgttgtggattttccctgatcattatcgtaatgaattgaaaagacaacgaactgacggtagtacttcagaaatagtacccaacacggtcggcaagacaaaggacttgaaacacatgcatttctctaccgttgaattggtgattaataatgccaaagctgttgcgttgtccttatggttcatcaaagcgtttagttctgggcaggaagaatggaaagaaatgtttacttctgattcgggagatttagagaagaaacatttgaagaaagtactttcgacagatacagaagcactaacagtagtttctgatgatgacgaatccccgttattggtcaatgctaggaatttgaagttgatgtcagatagaactgctgaaattcttgaactgaccagtttatacaatagcctgacatctgcagataatggtcttgaaatgttacgtgtgttctcatctttgtttggattgaaattcaagggcgaggtcatgttctcatcactgggagaaaaggttggctatattggaaagattccagttgcaaataacaccacgctcttgataccactaaactatcctaacggtgaacaaagtgagtccatctcaaggattttgtcattcaatgatttacctgaagacttcttcagtacgctttcttccaaaatatcttcatccctcgttcttcttttcggaactgttgttcatcaacaacccacatcagttcttgtatatctactaaattcaactttaactggttctgactatatggccttgttcttgggattagtgatgggattacatgccaagactatcaaaattgttaccgtttcagagcatctggttgctcttggagaactgcaagagattctcagatcctccattctgataaaattggatattacaactatatcgactaacgaaactgattccgcagttgcgagtgttgatgtcttcaatgacatcgaacttaataataagagtttggtggtattaccacaagattctataaagtctacatgtttagacgattattctaaagtgcttgtaacgaaagcttctaaaagtggttctacggtagccatctgtcataggtga

SEQ ID NO: 6273 - protein, 781 aa, Kluyveromyces lactis NRRL Y-1140
MANTVGGVLSGVNPFIYNSGSPITFFLIQAALILVLTNVLHVFISKLRQPKVISEVIAGIILGPTVFGQIPNYLTTIFPAGSVTGLNLVANLGIILFMFFLGMEVDISFVKRNAKAAISIGLATLIVPFGFGCLFALPLYNAYMDGHGIEFKVFMVFIAVSLSITAFPVLCRILTELRLVKERVGIIVLTSGTINDVVGWILLALCIILSNSQSDPVNVVYILLCTFGWFLFCCYPVRLTLKWGFNRFHEFERDSPSTFATLLILVIVLLSAYFTDIIGVHPIFGAFIAGIIVPRENNYVSKLTARMEDIPNLLMIPIYFTIAGLNVDLTLLNKGSDWGYIFASIGIAVATKVVSGALLSKINGLCWRESLAVGVLMSCKGIVEIVVLTTGLNAGIITKKVYAMFIFMALISTFITTPLTLWIFPDHYRNELKRQRTDGSTSEIVPNTVGKTKDLKHMHFSTVELVINNAKAVALSLWFIKAFSSGQEEWKEMFTSDSGDLEKKHLKKVLSTDTEALTVVSDDDESPLLVNARNLKLMSDRTAEILELTSLYNSLTSADNGLEMLRVFSSLFGLKFKGEVMFSSLGEKVGYIGKIPVANNTTLLIPLNYPNGEQSESISRILSFNDLPEDFFSTLSSKISSSLVLLFGTVVHQQPTSVLVYLLNSTLTGSDYMALFLGLVMGLHAKTIKIVTVSEHLVALGELQEILRSSILIKLDITTISTNETDSAVASVDVFNDIELNNKSLVVLPQDSIKSTCLDDYSKVLVTKASKSGSTVAICHR

SEQ ID NO: 6274 - DNA, 2469 bp, Debaryomyces hansenii CBS767
  CDS (1)..(2469)
atggcagtcgagactcatacagtggcaggcatagttgcccaaagaaacccattggaatacctgaaatcatcaccctatactattttcctttttcaagcagtgttggttatattgttatgccagttaatatactatccaattcgtaaactacaacaacctaaggttattgctgaggtcgttacagggataattctagggccatcggtaatgggtcacattcccaacttcactaagaattgctttccagaagaatccattcctgggttgacgttaatggctaatatagggattatcttatttttatttattatcggactagaagtggatatttcatttatcaagaagaatatgaaggttgcaatcagtgttgggatgataaatatggctattccgtttgctttgggatgtggtattgcaaagggtatttacactacgtatagaatggattcaactgaactaccaccaatggagtttactacatatatggtatttattgcggttgccatgtgtattacagcattccctgttttagcccgtatcttaacagagttgaatttaatcactgatagagtaggcacaattgtattggcggcgggaattacaaatgatttgacaggatggattttactagcactagtggttacattggccaatgcttctaatgctgtgaacacggtttatattttactattaaccgtagcatggtttctatttttatgttttccagtaaggttggcaatgaaattttgtttgcggagattcaccaatgatttgatttctggagaaccttcacaaattctgatgttatttattttaacatcggtattcatatcagctttttttactgatattattggtgttcaccccatctttggggcgtttatggtaggagttattgtacccaggacaaatggatatgtgataaaaattacagaaaaattagaagatttagtacatattgtgttgattcctatttatttcgctttagctggactaaatgtgaatataggattattgaacagaggtattgattgggcatatacaataggtataattttattggcaatggtaggcaagatttttggaggttttattgctggaaaactaaataaattgctttggcgggaatcattagcaatcggtgttttgatgtcatgtaaaggaattgttgaaattgttgtattaactgtaggcttgaatgctggaattattacccaaagggtatactcaatgtttattgtgatgacgttagttaccacctttttgaccactccattgactttgctagtctaccccgttgaatataggcttagagttgaaaaattcttacaaggtgaagcaaccttagatggtaccccaataataaaagaagggtcatcggattcaggactcattacctcggggaatagctcaaacgaatttcgttcgttagaaaatgttgatattgaccaattaggtcattttaggatttcaaagatagtattgttattacgagatgtacattcaatttcgcatttaatgtcgttcacgcatgatatatcgctgcttggtgataattcagatgataattacaatattgatataaaggcagtacatttgcgagaatttacttcaaggacatcacatttactagaagcatcatatcaaaacagttacgaagaagattccataactaatttcaatgaaaacgaactccataaatcttcttcgcttcttacaattatgaagatgttcaatgaactactagggaatcactttgcatcgagatctgtattatctacatttaagaatcatatctttactattaacgatcagatttctgaaccttctgaattactaatttgtactattaataaaaacgaattagccagaagcttttccaatagcaataatattaacggcgaagactctgaacgtgtattatatgggaaactatttcattcatgtaattcgcattttggattgtttataaccaatgaaaagaaaaaaacgtctttgaacgagattaaggaagataaggtatgcatcacgaactttttcgagaatgaagaaccaagatcaatcttcggtattgactcggttaaccttatcttacatcatgataactttttgagcgcaagtgatttgttatccttacatgttgtctataaattggcctttaatctattattcgtcaatatttttatcaatacgtcatcgtcactgtcgtctggatttgaagaaaaaattagatccttatttctgcctaatacgaaagctcacttgtcaattcattatactaaagaagatagtttgaaagatgacatcttaaaggctaacactcgttcaagtaatgaaatgtttgtcgttcctaataacttggctaagaatgaagaggatgaaatgttttcaggtgccgttaatcaattaattgatataagcgaaactgaagggttcaatgtcttggttgtgaaagctgcatctttttga

SEQ ID NO: 6275 - protein, 822 aa, Debaryomyces hansenii CBS767
MAVETHTVAGIVAQRNPLEYLKSSPYTIFLFQAVLVILLCQLIYYPIRKLQQPKVIAEVVTGIILGPSVMGHIPNFTKNCFPEESIPGLTLMANIGIILFLFIIGLEVDISFIKKNMKVAISVGMINMAIPFALGCGIAKGIYTTYRMDSTELPPMEFTTYMVFIAVAMCITAFPVLARILTELNLITDRVGTIVLAAGITNDLTGWILLALVVTLANASNAVNTVYILLLTVAWFLFLCFPVRLAMKFCLRRFTNDLISGEPSQILMLFILTSVFISAFFTDIIGVHPIFGAFMVGVIVPRTNGYVIKITEKLEDLVHIVLIPIYFALAGLNVNIGLLNRGIDWAYTIGIILLAMVGKIFGGFIAGKLNKLLWRESLAIGVLMSCKGIVEIVVLTVGLNAGIITQRVYSMFIVMTLVTTFLTTPLTLLVYPVEYRLRVEKFLQGEATLDGTPIIKEGSSDSGLITSGNSSNEFRSLENVDIDQLGHFRISKIVLLLRDVHSISHLMSFTHDISLLGDNSDDNYNIDIKAVHLREFTSRTSHLLEASYQNSYEEDSITNFNENELHKSSSLLTIMKMFNELLGNHFASRSVLSTFKNHIFTINDQISEPSELLICTINKNELARSFSNSNNINGEDSERVLYGKLFHSCNSHFGLFITNEKKKTSLNEIKEDKVCITNFFENEEPRSIFGIDSVNLILHHDNFLSASDLLSLHVVYKLAFNLLFVNIFINTSSSLSSGFEEKIRSLFLPNTKAHLSIHYTKEDSLKDDILKANTRSSNEMFVVPNNLAKNEEDEMFSGAVNQLIDISETEGFNVLVVKAASF

SEQ ID NO: 6276 - DNA, 2652 bp, Aspergillus nidulans FGSC A4
  CDS (1)..(2652)
atggccgacagctcgactgagaatcgtgctccgcctcaaggtggtatccttgagggcggcgacccgtcccagtatgacagcaaaaacccaatcgtcatctttataatccaggccttcataatcatagttctctgtcgcatgctccattggccgctgtccaagattcgccaacctcgcgttatcgcagaagtcatagccggtattatacttggtccttcagtaatgggccgtgttcccaatttcacagattccattttcccgccagaatcaattccaagtctaaacctgttcgcaaatgttgggttggtcttgtttctctttctcgttggtctcgagaccaacctgcgcttccttgtcagtaactggcgggtggctagcagtgtttcagctgcgggaatgatcctgccttttggactgggagctggtgtctcttatggtttgtatcacgagtttcatgacgaagaaggtctaaagccaattgattttggcacttatttactcttcattggtattgccatggccattaccgcatttccggtcttgtgtcgtatccttaccgagttgaaactgctcgggacaaatgttggtgtcatcgtgctgtccgccggcgttggcaatgatgtcgttggctggattttgctcgcactctgcgtcgcccttgtcaatgcaggaagtggtctcacagcgctgtgggtgtttctcgtctgcgttggctacgtcacatttctggtcgtgattttccgcccattgttcctacgcttcctcaactatactggaagcttgcagaaaggtcccagccagtcagtggtcacgattaccattctaatcgccttggcgtcgtccttcttcacccaggtaataggagtacatgccatttttggtggtttccttatcggcttgctctgccctcacgaaggaggcttcgctattaagttgacggagaagatcgaagacctggtaacggcgcttttcctgccattgtactttacgctttccggcctgcaaacagacttggggctgctggacacgggaatcgtatggggctatgttgttgccgttatttcaatcgcgttccttgctaaggttgccggaggggcgcttgcgtcaagagcttgcggccttctctggcgggagagcttcgcgattgggacgttgatgagttgcaaaggcttagtagaacttattgtcctgaatattgggctacaagcagaaatcttgagtcatcgaaccttcaccatatttgtggttatggcactcgtgacgacatttgcgactactccattgaccacatatatataccccaaatggtaccaggacaaagtcgatcggtggcgccgcggcgaaatcgactgggatggaaccccaatccaaccaagcgataataacagcattgccgccgccaccaaagagcaacttcagtctcgccaagttcggaggcttttggcctatctgcgtctcgacggactttctagtatttgcacacttgcagcactcctcagtccaaaccgacctccaactccaaaggtccatcctgagaaagcccagagtacaaaagcgccggaagctgcagctgaggagtctggagctgacattcagcctgattcatcactccaagtgcatggaatacgtttaatggagctaacagatcgagactctagtgtgatgaaagtgtccgaggtcgacgaacattccttgtgggatccggttattaataccttccgcgcattcggccaatggcacgacatctcaattatggctggtgtgtcggtggtgcccgagcactcatacgcagatactgtgcttggaatggcgcgcgagggcaccactgatctccttctcatcccctggagcgagaccggtgctttaagtgagcaccaaggcgggttagacgtggatgagagaaatcggtttgccaacgggccctatactgctttcgtgtctagcatactaaacgaaagttcctgcaacgttggcgttctcgtcgagcgcagcatgtacactcgcaatgccaaagcccgccccgatttgcaaagaaccctaagcgctagaagcgttggaagtgcaatgtgggttagccctgcagctacccgctctcatcacattgtcctgccttttttcggagggtacgacgaccgatatgcgcttcagtttgtccttcagctagcgcaaaatgaccaggtaacagctacaatcatccatatagaactccctgtcccgaccaatcagacaagcaaagttattgcccagcctaaacagcacgaatctcgctcggatactcaattcgatagcttcaacccagagtcagaccttgtcttctttgcaaccctccgcgattccctaccagatgcattatcctcacgtgtggttttcaagagtgtcaacccgaaggacaaggctgccgctgtccagattgcaatcgacgccgttaaagacgaaatggcccagtcggcctcgaaaccggggaacgtcaccgtagtcggacgacgcaacaactacgtggatcagacactagacatcgatccagcgtcatctgatgaagttagtcctgaggcacgttgggtactaggagcagttgctgaggcaatggtgcgcaccgaaaacagaactgtcggcaacgtactcgttctacacgccgcttccagacataactag

SEQ ID NO: 6277 - protein, 883 aa, Aspergillus nidulans FGSC A4
MADSSTENRAPPQGGILEGGDPSQYDSKNPIVIFIIQAFIIIVLCRMLHWPLSKIRQPRVIAEVIAGIILGPSVMGRVPNFTDSIFPPESIPSLNLFANVGLVLFLFLVGLETNLRFLVSNWRVASSVSAAGMILPFGLGAGVSYGLYHEFHDEEGLKPIDFGTYLLFIGIAMAITAFPVLCRILTELKLLGTNVGVIVLSAGVGNDVVGWILLALCVALVNAGSGLTALWVFLVCVGYVTFLVVIFRPLFLRFLNYTGSLQKGPSQSVVTITILIALASSFFTQVIGVHAIFGGFLIGLLCPHEGGFAIKLTEKIEDLVTALFLPLYFTLSGLQTDLGLLDTGIVWGYVVAVISIAFLAKVAGGALASRACGLLWRESFAIGTLMSCKGLVELIVLNIGLQAEILSHRTFTIFVVMALVTTFATTPLTTYIYPKWYQDKVDRWRRGEIDWDGTPIQPSDNNSIAAATKEQLQSRQVRRLLAYLRLDGLSSICTLAALLSPNRPPTPKVHPEKAQSTKAPEAAAEESGADIQPDSSLQVHGIRLMELTDRDSSVMKVSEVDEHSLWDPVINTFRAFGQWHDISIMAGVSVVPEHSYADTVLGMAREGTTDLLLIPWSETGALSEHQGGLDVDERNRFANGPYTAFVSSILNESSCNVGVLVERSMYTRNAKARPDLQRTLSARSVGSAMWVSPAATRSHHIVLPFFGGYDDRYALQFVLQLAQNDQVTATIIHIELPVPTNQTSKVIAQPKQHESRSDTQFDSFNPESDLVFFATLRDSLPDALSSRVVFKSVNPKDKAAAVQIAIDAVKDEMAQSASKPGNVTVVGRRNNYVDQTLDIDPASSDEVSPEARWVLGAVAEAMVRTENRTVGNVLVLHAASRHN

SEQ ID NO: 6278 - DNA, 2856 bp, Cryptococcus neoformans var. neoformans B-3501A
  CDS (1)..(2856)
atggccgcgttcctcaccaccatatcaggcgcacccacgcacttcgcaagcctcctctccacccgcgcagtatcatccaatgtcatatcaggcgcagatcccaccgaggtcgacccttccaaccccatcaccctgttcatcatccagcttgtgatcatcattgtcttcacccaaagtctaggatgggcgtttagctatatgaaacaacccaaggtcatcgccgaaatcatcggtggcgttatccttggtcccaccgtcttcggccgtgtcccacactttaccgaacacatttttcctgctgcttcattgagttatctcaacttgatatccacaattggtctggttctgtttcttttcctcgtcggcgttgaagtcgatgtcggagtcatgaagaagcatggaaaagcaagcggtatcatctctgcggcgggcatgatcttgccctttggtttgggagcagccattgcggtgcccgtgtaccacaattttgttgacacggagaatgtctcctttggtcactttttactgttcgttggcgtcgccatggcgatcacagctttccccgtcttatgtcgaatcttgacgtccaccaaactcattgacacccgtgtgggagtgatggtcctggcagcgggtgtgggtaatgatgtggttggctgggtccttcttgctcttacccttgccctcgttaactctcaatcgggtgcgactgcggtatacgtcttgctctgcgctgtcggatgggcggtcatcctgctttggcccaccaggaaactctttgtctaccttgtaaagcggacgggaagcttggagcatggaccaactccaggaatgatggtactgaccctgttgattgtttttgtttcagcttttgtcactgatatcatcggagtgcatcctatctttggagggttcatcgcaggattaatcattcctcacgaaggtggtttcgccatcgccgttgttgagaagattgatgatttggtgtccatgcttttcttgcccatttatttcgtcctttctgggctccaaaccaacctcgggctccttgatactggccgtatctggggatacgtgatacttctttgtgttgttgctttctgcggaaaattctttggatgtgcaggtgctgccttggcaatgaaatatcccatgagggagagcatagccattggcttgttgatgagttgcaaaggtcttgtcgaactcattgtcctcaacgtcggcctttctgccggtattatcgaccagcaacttttttcaatgtttgttgtcgaagcggtcgtcctcactttcttgaccacaccttgcacactcgccgtttaccctgaacgtgtccgtgtacgcatcagtgaccttcgtaaaggcgatcagggtgtcgattctgagaagcaagttggcggttcgaatattgccggtgcatcgggtgggcgtgagcacaccagcaggttcttggtcatcttgcaaaagctcgaacacctttcggctgtcatgctcctcacacagatgctcgagcctcctgtgcctgaagcaagggagccatgggatgcggcagaacattccgcaaaagaggccaggaagggtaaaaaatcaatcagtgatgacgagtctatcaactcccattccaataccgtcaccactcttcaccactctcatcaccatagcgatagcaagcacaatatcctgcaccgagtcggacatgttactcacccctcaggagaccttcctcgtctcgacgctctcaagctcgttgagctcactggtcgtacattctccgtcatgcaatctgccgagaaggatcagctgcttcactcggataatgccttgcaactctatcgccaattcggtcgattacgaggtttggaaatctcaccacacatctctatcgtgggacaagattctttctcccaagcggtggcagactacgcgacggatctaggtagcgagctagtcattcttccttggaccgtccctactcaagggggtaaccctgagcttatcgatccctctgttggaagcagcagcagcactacggtctcccagtttgataccatctttggctctgaatccgctggttcccccatgtactctcactttgtccgtcgcgtattttccgaatgtccgagcgatgtcgccctatttgtcgataggggctttggaggcgcctctagcttcaaacctggctctgggcaacacattttcatgccattttttggcgggcctgatgacagacttgcgttgaggtttgtggtacaactgtgcggtcacgcgggtgtaactgctactgttgtcagagttcagaaggaagaaggggatggagaagatgaagaggttagccgcggtttggatggtgacaagtcgaatgtcgcattacatcaagctgctttgcagtctaatcagctcactgtcggcggcgcaactcaataccccgagactcaagctcgtcttcaatcagatactgccgactctctcgcttggtcgtgcttttcatcaccttccgtctccccttctcgtcctcttcacctcgaaacggctctttcccgcatttcattccactccaccacctctcaccagcctcttacatatgcttttacctgtgccgagagcgccatgcgagccacatccgcgcacgccaagacttggagacccatgttgattgttgctggacgtggacgacgcggagccgctatcagccacgaaacagaactgaacagggtgctggctgcaaaatcgctcaaccccagtattggtgcggaactgaggaagacggtcggtgacgttgctgccgggatgattcttggtggaagtgcgcctggtacggcgagttacttgatcatgggagctggaaaacgatga

SEQ ID NO: 6279 - protein, 951 aa, Cryptococcus neoformans var. neoformans B-3501A
MAAFLTTISGAPTHFASLLSTRAVSSNVISGADPTEVDPSNPITLFIIQLVIIIVFTQSLGWAFSYMKQPKVIAEIIGGVILGPTVFGRVPHFTEHIFPAASLSYLNLISTIGLVLFLFLVGVEVDVGVMKKHGKASGIISAAGMILPFGLGAAIAVPVYHNFVDTENVSFGHFLLFVGVAMAITAFPVLCRILTSTKLIDTRVGVMVLAAGVGNDVVGWVLLALTLALVNSQSGATAVYVLLCAVGWAVILLWPTRKLFVYLVKRTGSLEHGPTPGMMVLTLLIVFVSAFVTDIIGVHPIFGGFIAGLIIPHEGGFAIAVVEKIDDLVSMLFLPIYFVLSGLQTNLGLLDTGRIWGYVILLCVVAFCGKFFGCAGAALAMKYPMRESIAIGLLMSCKGLVELIVLNVGLSAGIIDQQLFSMFVVEAVVLTFLTTPCTLAVYPERVRVRISDLRKGDQGVDSEKQVGGSNIAGASGGREHTSRFLVILQKLEHLSAVMLLTQMLEPPVPEAREPWDAAEHSAKEARKGKKSISDDESINSHSNTVTTLHHSHHHSDSKHNILHRVGHVTHPSGDLPRLDALKLVELTGRTFSVMQSAEKDQLLHSDNALQLYRQFGRLRGLEISPHISIVGQDSFSQAVADYATDLGSELVILPWTVPTQGGNPELIDPSVGSSSSTTVSQFDTIFGSESAGSPMYSHFVRRVFSECPSDVALFVDRGFGGASSFKPGSGQHIFMPFFGGPDDRLALRFVVQLCGHAGVTATVVRVQKEEGDGEDEEVSRGLDGDKSNVALHQAALQSNQLTVGGATQYPETQARLQSDTADSLAWSCFSSPSVSPSRPLHLETALSRISFHSTTSHQPLTYAFTCAESAMRATSAHAKTWRPMLIVAGRGRRGAAISHETELNRVLAAKSLNPSIGAELRKTVGDVAAGMILGGSAPGTASYLIMGAGKR

SEQ ID NO: 6280 - DNA, 2556 bp, Medicago truncatula
  CDS (1)..(2556)
atgccagttaatataacagcaatcaaaacttcctccgatggaatctggcaaggcgataatcctctcgattacgctttccctctcctcattattcaaactgtcttagtcctcgtcgtcagccgctccctcgctttcggcttcaaacctctccgccaacctaaagtcatagctgagatcatcggtggaattctgttaggaccatcggcgttaggaaggaacacaagctacctgcaccgcttattccctgaatggagtatgccgacgctagaatccgtcgcaagcataggtcttctattctttctcttcctcgttggactcgagttagatctaaactcgattcgccgtagcggtaaaagagcattcagtatagcagcttgtggaatcactcttcctttcgtctgcggcataggcgttgccattgtcctccgcaaaaccgtcgacggcgcagacaaagccggattcggccaattcatcgttttcatgggagttgcgctttctataaccgcattccccgtcttagcacgaatcctcgctgaactcaaactcctcacaacacgcgtaggagaaaccgccatggcagccgctgcgttcaacgacttagccgcgtggattcttctcgctttagcaattgcgttagccggaaacggagccgacggcggagacaaaaagagccctctcgtttccgtttgggtgcttctctccggagtcgctttcgttgctttcatgatgattgttataagtcctgtgatgaatcgtgtggcacaaagatgctccgtggagaatgaagctgttgatgaagtttatatttgtttgactctagctggtgtaatggtttcaggattcataactgatttcatagggattcatgcgatttttggggcgtttgtttttggattaactattccaaagacaggtagttttgctgagaggttgatagagagaatagaggattttgttttgggtttgttgcttccactttactttgcttcaagtgggttgaaaactgatgtgactaagattagtggtggaaaagcttgggggctattggttttagtgattgcaactgcttgtgctgggaagattctggggacttttgttgttgctatgatgtgtaggatgccagttagagagtcaattacacttggagtgctgatgaacaccaaaggacttgttgaactcattgtgctcaacattggaaaagagaaaaaggttttaaatgatgaaatatttgcaatcttggtccttatggcactcttcacaaccttcatcacaaccccagtggtgatggcaatctacaatccagctcgtggaatcgcaagcaagacaattcgaaagctaggtgacatgtcctcccactctaaagaaagcaacaatgtggtgaatactcttcgagtcctagcttgcatccacggtccaaccaacattccctctatcatcaacctcattgagtcaacacgtagcacccaaaaatcacttctcaaagtcttcatcatgcaccttgttgaactcacagaacgttcatcttcaatcatcatggttcaacgcgctcgcaaaaacggttttccattcttcaaccgtttcaaccgcgatgaatggtataaccgtcttgctggggcttttcaggcctatagtcaattgggccgggtcatagtccggtccactacagccatatcttcgctatctacaatgcacgaggatatatgccatgcagcagaggaaaagagagtgacaatgatcatattacccttccacaaacattggaggatggaagttgatgatgaaaatgacaaagaggctcatgaggtgttggagaatgctgggcatggatggagaggtgtgaaccaaagggtacttaagaatgctccatgctctgttgctgtgcttgtagatagaggatatgggcttgggttgaagaatttgggctcagatggtagagtggcccaaagaatatgcatcgtgttttttggtgggcctgatgaccgcgaggctcttgagttggggaagaaaatggttgaacacccggcagttgtagtgaccgttgtaaggttcgttgagcaaaatgaattgagtggtaacaactttgttttacgccaatcacctggcaaaagtaccgaagaaaactatagcttctccatcgcaaaaattaatcgacaaaaagaacaggtgttggatgaaaatgcaatggaggagtttcgaagcaagtgtggtgaaacagtgaagtatatcgaaaagggtagtggcaacgttgttgaggaggtgatagcattaggagaaagtgcggattacgatctcattgttgttgggaagggtcggtttccgtcgactatggtggcagaactagcagagagggaagcagagcatgcagagttaggtcccataggagatatacttacatcctcaatgggtcacaagatggcgtcatcagtttttgttattcaacaacatgatgtagcattgacagaggatgtaccaatgtacaaggttaaggtgcatgatgagaatgttgctgaggtttcatctggaaggcatgagatctctgtagcaaatgctgtgtaa

SEQ ID NO: 6281 - protein, 851 aa, Medicago truncatula
MPVNITAIKTSSDGIWQGDNPLDYAFPLLIIQTVLVLVVSRSLAFGFKPLRQPKVIAEIIGGILLGPSALGRNTSYLHRLFPEWSMPTLESVASIGLLFFLFLVGLELDLNSIRRSGKRAFSIAACGITLPFVCGIGVAIVLRKTVDGADKAGFGQFIVFMGVALSITAFPVLARILAELKLLTTRVGETAMAAAAFNDLAAWILLALAIALAGNGADGGDKKSPLVSVWVLLSGVAFVAFMMIVISPVMNRVAQRCSVENEAVDEVYICLTLAGVMVSGFITDFIGIHAIFGAFVFGLTIPKTGSFAERLIERIEDFVLGLLLPLYFASSGLKTDVTKISGGKAWGLLVLVIATACAGKILGTFVVAMMCRMPVRESITLGVLMNTKGLVELIVLNIGKEKKVLNDEIFAILVLMALFTTFITTPVVMAIYNPARGIASKTIRKLGDMSSHSKESNNVVNTLRVLACIHGPTNIPSIINLIESTRSTQKSLLKVFIMHLVELTERSSSIIMVQRARKNGFPFFNRFNRDEWYNRLAGAFQAYSQLGRVIVRSTTAISSLSTMHEDICHAAEEKRVTMIILPFHKHWRMEVDDENDKEAHEVLENAGHGWRGVNQRVLKNAPCSVAVLVDRGYGLGLKNLGSDGRVAQRICIVFFGGPDDREALELGKKMVEHPAVVVTVVRFVEQNELSGNNFVLRQSPGKSTEENYSFSIAKINRQKEQVLDENAMEEFRSKCGETVKYIEKGSGNVVEEVIALGESADYDLIVVGKGRFPSTMVAELAEREAEHAELGPIGDILTSSMGHKMASSVFVIQQHDVALTEDVPMYKVKVHDENVAEVSSGRHEISVANAV

SEQ ID NO: 6282 - DNA, 2343 bp, Oryza sativa
  CDS (1)..(2343)
atgaaggcgacgtcggagggggcgtggcagggggacaacccgctgcggttctcgctgccgctgctgatcgtgcagatctgcctcgtcgtcgtcttcacccgcggcctcgcctacgccctccgccctctccgccagcctcgcgtcatcgccgagatcatcggcggcatcctcctgggcccgtcggcgcttgggcggaacaagcgattcctcgacaatgtcttccccaaggacagcctcaccgtgctcgacacgctcgccaacgtcggcttgctcttcttcctcttcctcgtcggcctcgagctcgacccggcctcgctccgccgcaccggccgcaccgccctcgccgtcgccgccgccgggatctcgctcccgtttgctctcggcgtcggcgcctcgctcgtgctccgcgccgccatcgcccccgacgccccccgtggcccgctcatcgtgttcatgggcgtcgcgctgtcgatcaccgcgttccccgtcctcgcgcgcatcctcgccgagctcaagctcctcaccaccgacatcggacgcatggccatgtcggccgcggctgtcaacgacatcaccgcgtgggtgctgcttgccctcgccatcgcgctctcgggatccgggtcgccgctcgtgtccatctacgtcctgctctgcggcgtcgcgttcgtcggcttcgccacggtcgccgtgcggcccgtgctcgtcttcatggcacggcggtcgccggagggcgagccggtgaaagaatcgttcgtctgcgccattctagtcatcgttctcgccgccggcttcgccacggacgccatcggcatccacgcgctgttcggcgcgttcgtcatcggcgtgctcgtccccaaggaaggcgcctgcgccggcgcgctgacggagaaggtcgaggacctggtgtcgtcgctgttccttcccctctacttcgtgtcgagcggtctgaagacggacgtcaccaccatctccggcgccaagtcgtgggggctcctcgtgctcgtcatgacgacggcctgcgccggcaagatcggcggcacggtggcggcgtcgctgctgatgcgtgtgccgctgcgtgaggcgctcgcgctggggatgctgatgaacaccaaggggctcgtggagctcatcgtgctcaacatcggacgcgaccggaaggtgctcaacgaggaggccttcgccatcctcgtgctcatggcgctcgtcaccaccttcatgaccacgccggccgtcaccgccgtgtacaagccggcgcggcggcaggcgtcgtacaagcaccgcacggtggagcgcgccgacgccgacagcgagctgcgcgtgctcgcgtgcttccacgccagccgcggcatcccgacgctgatcaacctcgtggaggcgtcgcgcggcacgaggaggagcaagctcaccatgtacgccatgcacctcgtcgagctgtcggagcgctcgtcggccatctccatggtgcagcgcgcgcgccgcaacgggctcccgttcgcgagccggcgcggccacgaaggcggcggcggcggcggggaggtggtggtggcgttcgaggcgttccagcggctcaccgccgtgacggtgaagccgatgacggccatctccgacctcgacaccatccacgacgacatcgtcgcgtcggcgctggacaagcgatccgccatcatcctgctcccgttccacaagatgctctgccatgacggcacgctcgagcccgtggaccgggcgttccaccaggtgaacgtccgggtgctccgcgacgcgccatgctccgtcgccgtcctcgtcgaccgcgcgctcggtggcgcggcgcaggtctcggcgccggacgtctcctactcggtcctcctcctcttcttcggcggcgccgacgaccgcgaggcgctcgcgtacgcctcacgcatgggcgagcaccctggcatcgcgctcaccgtggcccgtttcacggccgccgccgacgacgccgccgaagacgacgacgccatacaaaagcacatctccaacgtgcgcaaggccggaaacgacggagcgttcaagtacgacgaggtgtcggcccatggccggcaagaagtggcgttcgccatcaagacactgggtagaggcaagaacctggtggtggccgggcggtcggcggcggtggcgacgccgctggtggacaagacggactgcccggagctcggccacgtcgggagctacctggcgacgccggagttctcgacgacgtcctccgtgctcgtggtgcagaagtacgactcgagaggtgacactggcacatcgtcgtcgagccaagccggaggagaggcgaccgtggaggaatccggcgtgccaatccgccggccatag

SEQ ID NO: 6283 - protein, 780 aa, Oryza sativa
MKATSEGAWQGDNPLRFSLPLLIVQICLVVVFTRGLAYALRPLRQPRVIAEIIGGILLGPSALGRNKRFLDNVFPKDSLTVLDTLANVGLLFFLFLVGLELDPASLRRTGRTALAVAAAGISLPFALGVGASLVLRAAIAPDAPRGPLIVFMGVALSITAFPVLARILAELKLLTTDIGRMAMSAAAVNDITAWVLLALAIALSGSGSPLVSIYVLLCGVAFVGFATVAVRPVLVFMARRSPEGEPVKESFVCAILVIVLAAGFATDAIGIHALFGAFVIGVLVPKEGACAGALTEKVEDLVSSLFLPLYFVSSGLKTDVTTISGAKSWGLLVLVMTTACAGKIGGTVAASLLMRVPLREALALGMLMNTKGLVELIVLNIGRDRKVLNEEAFAILVLMALVTTFMTTPAVTAVYKPARRQASYKHRTVERADADSELRVLACFHASRGIPTLINLVEASRGTRRSKLTMYAMHLVELSERSSAISMVQRARRNGLPFASRRGHEGGGGGGEVVVAFEAFQRLTAVTVKPMTAISDLDTIHDDIVASALDKRSAIILLPFHKMLCHDGTLEPVDRAFHQVNVRVLRDAPCSVAVLVDRALGGAAQVSAPDVSYSVLLLFFGGADDREALAYASRMGEHPGIALTVARFTAAADDAAEDDDAIQKHISNVRKAGNDGAFKYDEVSAHGRQEVAFAIKTLGRGKNLVVAGRSAAVATPLVDKTDCPELGHVGSYLATPEFSTTSSVLVVQKYDSRGDTGTSSSSQAGGEATVEESGVPIRRP

SEQ ID NO: 6284 - DNA, 2607 bp, Arabidopsis thaliana
  CDS (1)..(2607)
atgggtactttggtcaacggtactattccggcgatgaagtgtcccaagaatgtggcgatgatgaagacaacgtctaacggagtgttcgatggagagagtccattagatttcgcttttcctcttgtcattcttcagatttgccttgtcgtcgccgtcactcgctctttggccttccttctccgtcccatgagacaaccacgtgttgtcgccgagatcattgtaagtcctccatcaaccggtttaggtcagtcttatagtttccggtttaataaatatcctaccagactgaaatatgagttataccgggattccgttcagcttattactgtatgtggtttcttggttagaaaaaataataactacaaacctaattcctctttagtcacacatggcgggattcttcttggcccgtcggctctcggtagaatcacgtcgtacaagaattcaattttcccggcgagaagtctaacggtgctcgacactctagcaaacctcggcctccttctcttccttttcctcgtcggactcgagatcgatctgacatctctccgacgtaccggcaaaaaagcgatttccatcgccgccgccggaatgcttctccccttcggtatgggcattgtcacctccttcgctttccctgaagcttcttcttctggcgacaatagcaaagtacttccgttcatcattttcatgggagtcgcgctctcgatcactgctttcggagttttggcgagaatactcgctgaattaaagctactcacaaccgatctcggccggatttcaatgaacgccgccgcaattaacgacgtcgcggcttgggttctcctagctctcgctgtatctctctccggcgataggaattctccgcttgttcctctctgggttctgttaagtggaatcgcgtttgtgatcgcgtgttttttaatcgtaccgcgaattttcaaattcatctctcggcgttgcccagaaggcgaacccataggcgaaatgtacgtttgcgtcgccctttgcgcggttctactcgcgggtttcgcgacagacgccattgggattcacgcgattttcggtgcgtttgtgatgggcgttttgtttcccaaaggacatttctcagacgcgattgtggagaagattgaagatcttgtaatgggtcttcttctaccactgtacttcgttatgagcggtttgaaaacggatataactacgattcaaggtgtgaaatcgtggggacgactcgcgttggtgattgttacggcttgttttggcaaaatcgttgggactgtgagtgttgccttgttatgcaaggtaaggctccgtgaatcggttgttcttggggttttaatgaacacaaagggtttagtggagctaattgttctcaacattggcaaagacagaaaggttttgagcgatcagacttttgcaattatggttctcatggcgatattcacaacattcatcacaacgccaatagtcttggcgttatacaaaccaagcgagacaacacaaacacatagtagcgtcagctacaagaaccgcaaacatagacgcaagattgagaatgatgaagaaggcgagaagatgcagcagcttaaggttttggtatgtcttcaaagcagtaaagatattgatcccatgatgaaaataatggaagctactcgtggaagcaacgaaaccaaagaaagattttgcgtttacgttatgcatttaactcaactctccgagagaccttcttctattcgaatggttcaaaaggtgagaagcaacggtttgcccttttggaacaagaaaagagagaattctagtgccgttacggtcgcgttcgaggcgtctagtaagctaagtagcgtttcggtgcgttctgtgaccgcgatttcaccgttgtcaacaattcatgaggatatatgtagctctgctgatagtaaatgcacagcgtttgtgattttgccgttccataagcaatggagatctctggagaaagaatttgaaacggtgagatcggagtatcaggggattaacaaaagagttcttgagaattcaccgtgttctgttggaattttggttgatcgtggtctcggcgacaacaattctccggtagcttcgagcaacttttcactttccgtcaatgttctgttctttggcggttgcgatgatcgtgaagctttggtttacgggttacgaatggctgaacatccgggcgttaacttgaccgttgtggttatctctggtccggagagcgcaaggtttgataggcttgaagcgcaagaaacatcactatgttccttagacgagcaattccttgcagcaatcaagaaaagggccaatgcagctagatttgaagagaggacggtgaattcaacggaggaagtggttgagattatccgccaattttacgagtgcgatattttattggtgggaaaatcttccaaaggacctatggtttcaagattaccggttatgaagatagagtgtccagaactgggaccggtcggaaacttgatcgtgtcaaatgagatttctacttcagtgtctgttttggtggttcaacaatacaccgggaaaggtccttctgtggtgggttccgtctctgtcccggtggtggagacgccatga

SEQ ID NO: 6285 - protein, 868 aa, Arabidopsis thaliana
MGTLVNGTIPAMKCPKNVAMMKTTSNGVFDGESPLDFAFPLVILQICLVVAVTRSLAFLLRPMRQPRVVAEIIVSPPSTGLGQSYSFRFNKYPTRLKYELYRDSVQLITVCGFLVRKNNNYKPNSSLVTHGGILLGPSALGRITSYKNSIFPARSLTVLDTLANLGLLLFLFLVGLEIDLTSLRRTGKKAISIAAAGMLLPFGMGIVTSFAFPEASSSGDNSKVLPFIIFMGVALSITAFGVLARILAELKLLTTDLGRISMNAAAINDVAAWVLLALAVSLSGDRNSPLVPLWVLLSGIAFVIACFLIVPRIFKFISRRCPEGEPIGEMYVCVALCAVLLAGFATDAIGIHAIFGAFVMGVLFPKGHFSDAIVEKIEDLVMGLLLPLYFVMSGLKTDITTIQGVKSWGRLALVIVTACFGKIVGTVSVALLCKVRLRESVVLGVLMNTKGLVELIVLNIGKDRKVLSDQTFAIMVLMAIFTTFITTPIVLALYKPSETTQTHSSVSYKNRKHRRKIENDEEGEKMQQLKVLVCLQSSKDIDPMMKIMEATRGSNETKERFCVYVMHLTQLSERPSSIRMVQKVRSNGLPFWNKKRENSSAVTVAFEASSKLSSVSVRSVTAISPLSTIHEDICSSADSKCTAFVILPFHKQWRSLEKEFETVRSEYQGINKRVLENSPCSVGILVDRGLGDNNSPVASSNFSLSVNVLFFGGCDDREALVYGLRMAEHPGVNLTVVVISGPESARFDRLEAQETSLCSLDEQFLAAIKKRANAARFEERTVNSTEEVVEIIRQFYECDILLVGKSSKGPMVSRLPVMKIECPELGPVGNLIVSNEISTSVSVLVVQQYTGKGPSVVGSVSVPVVETP

SEQ ID NO: 6286 - DNA, 24 bp, Artificial sequence
  primer
atggcaaacactgtaggaggaatt

SEQ ID NO: 6287 - DNA, 25 bp, Artificial sequence
  primer
ttattcagacgaaaaatggtgcaca

SEQ ID NO: 6288 - protein, 789 aa, Artificial sequence
  consensus sequence
  Variant (2)..(4): Xaa in position 2 to 4 is any amino acid
  Variant (6)..(7): Xaa in position 6 to 7 is any amino acid
  Variant (9)..(14): Xaa in position 9 to 14 is any amino acid
  Variant (15)..(18): Xaa in position 15 to 18 is any or no amino acid
  Variant (20)..(22): Xaa in position 20 to 22 is any amino acid
  Variant (24)..(42): Xaa in position 24 to 42 is any amino acid
  Variant (45)..(45): Xaa in position 45 is any amino acid
  Variant (48)..(48): Xaa in position 48 is any amino acid
  Variant (50)..(52): Xaa in position 50 to 52 is any amino acid
  Variant (53)..(109): Xaa in position 53 to 109 is any or no amino acid
  Variant (112)..(112): Xaa in position 112 is any amino acid
  Variant (116)..(118): Xaa in position 116 to 118 is any amino acid
  Variant (120)..(128): Xaa in position 120 to 128 is any amino acid
  Variant (131)..(132): Xaa in position 131 to 132 is any amino acid
  Variant (134)..(136): Xaa in position 134 to 136 is any amino acid
  Variant (138)..(140): Xaa in position 138 to 140 is any amino acid
  Variant (142)..(143): Xaa in position 142 to 143 is any amino acid
  Variant (145)..(147): Xaa in position 145 to 147 is any amino acid
  Variant (151)..(152): Xaa in position 151 to 152 is any amino acid
  Variant (156)..(156): Xaa in position 156 is any amino acid
  Variant (158)..(167): Xaa in position 158 to 167 is any amino acid
  Variant (169)..(178): Xaa in position 169 to 178 is any amino acid
  Variant (181)..(182): Xaa in position 181 to 182 is any amino acid
  Variant (184)..(204): Xaa in position 184 to 204 is any amino acid
  Variant (205)..(211): Xaa in position 205 to 211 is any or no amino acid
  Variant (213)..(214): Xaa in position 213 to 214 is any amino acid
  Variant (217)..(218): Xaa in position 217 to 218 is any amino acid
  Variant (226)..(226): Xaa in position 226 is any amino acid
  Variant (230)..(230): Xaa in position 230 is any amino acid
  Variant (233)..(233): Xaa in position 233 is any amino acid
  Variant (235)..(239): Xaa in position 235 to 239 is any amino acid
  Variant (241)..(245): Xaa in position 241 to 245 is any amino acid
  Variant (247)..(249): Xaa in position 247 to 249 is any amino acid
  Variant (252)..(254): Xaa in position 252 to 254 is any amino acid
  Variant (256)..(256): Xaa in position 256 is any amino acid
  Variant (261)..(263): Xaa in position 261 to 263 is any amino acid
  Variant (265)..(277): Xaa in position 265 to 277 is any amino acid
  Variant (278)..(285): Xaa in position 278 to 285 is any or no amino acid
  Variant (287)..(308): Xaa in position 287 to 308 is any amino acid
  Variant (310)..(324): Xaa in position 310 to 324 is any amino acid
  Variant (325)..(327): Xaa in position 325 to 327 is any or no amino acid
  Variant (329)..(330): Xaa in position 329 to 330 is any amino acid
  Variant (332)..(337): Xaa in position 332 to 337 is any amino acid
  Variant (340)..(340): Xaa in position 340 is any amino acid
  Variant (343)..(343): Xaa in position 343 is any amino acid
  Variant (345)..(346): Xaa in position 345 to 346 is any amino acid
  Variant (351)..(352): Xaa in position 351 to 352 is any amino acid
  Variant (354)..(356): Xaa in position 354 to 356 is any amino acid
  Variant (358)..(366): Xaa in position 358 to 366 is any amino acid
  Variant (367)..(367): Xaa in position 367 is any or no amino acid
  Variant (369)..(370): Xaa in position 369 to 370 is any amino acid
  Variant (373)..(379): Xaa in position 373 to 379 is any amino acid
  Variant (381)..(381): Xaa in position 381 is any amino acid
  Variant (384)..(386): Xaa in position 384 to 386 is any amino acid
  Variant (389)..(400): Xaa in position 389 to 400 is any amino acid
  Variant (403)..(410): Xaa in position 403 to 410 is any amino acid
  Variant (412)..(414): Xaa in position 412 to 414 is any amino acid
  Variant (416)..(430): Xaa in position 416 to 430 is any amino acid
  Variant (433)..(436): Xaa in position 433 to 436 is any amino acid
  Variant (438)..(438): Xaa in position 438 is any amino acid
  Variant (441)..(442): Xaa in position 441 to 442 is any amino acid
  Variant (445)..(445): Xaa in position 445 is any amino acid
  Variant (448)..(449): Xaa in position 448 to 449 is any amino acid
  Variant (452)..(453): Xaa in position 452 to 453 is any amino acid
  Variant (455)..(464): Xaa in position 455 to 464 is any amino acid
  Variant (466)..(468): Xaa in position 466 to 468 is any amino acid
  Variant (470)..(470): Xaa in position 470 is any amino acid
  Variant (473)..(475): Xaa in position 473 to 475 is any amino acid
  Variant (478)..(478): Xaa in position 478 is any amino acid
  Variant (482)..(486): Xaa in position 482 to 486 is any amino acid
  Variant (488)..(677): Xaa in position 488 to 677 is any amino acid
  Variant (678)..(788): Xaa in position 678 to 788 is any or no amino acid
GXXXGXXPXXXXXXXXXXLXXXQXXXXXXXXXXXXXXXXXXXQPXVIXEXXXXXXXXXXXXXXXXXXXXXXXXXXXXXXXXXXXXXXXXXXXXXXXXXXXXXXXXXXXXGIXLGPXXXGXXXXXXXXXFPXXSXXXLXXXAXXGXXXFLFXXGLEXDXXXXXXXXXXAXXXXXXXXXXPFXXGXXXXXXXXXXXXXXXXXXXXXXXXXXXXFXXVAXXITAFPVLXRILXELXLXXXXXGXXXXXAXXXNDXXXWXLLALXXXLXXXXXXXXXXXXXXXXXXXXXLXXXXXXXXXXXXXXXXXXXXXXRXXXXXXXXXXXXXXXXXXLXXVXXXXXXTDXIGXHXXFGAFXXGXXXPXXXXXXXXXXEXXEDXXXXXXXPXYFXXXGLXXXXXXXXXXXXWGXXXXXXXXAXXXKXXXXXXXXXXXXXXXREXXXXGXLMXXKGXVEXXVLXXGXXXXXXXXXXFXXXVXMAXXXTFXTTPXXXXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXR

SEQ ID NO: 6289 - protein, 51 aa, Artificial sequence
  protein pattern
  Variant (2)..(3): Xaa in position 2 to 3 is any amino acid
  Variant (5)..(5): Xaa in position 5 is Asn or Ser
  Variant (6)..(6): Xaa in position 6 is Cys or Thr
  Variant (9)..(9): Xaa in position 9 is Ile or Leu
  Variant (12)..(12): Xaa in position 12 is Ile or Leu
  Variant (13)..(13): Xaa in position 13 is Ile or Val
  Variant (16)..(16): Xaa in position 16 is Asn or Thr
  Variant (17)..(17): Xaa in position 17 is Ile or Val
  Variant (19)..(19): Xaa in position 19 is any amino acid
  Variant (20)..(20): Xaa in position 20 is Asp, Glu, Asn, Gln or Ser
  Variant (21)..(22): Xaa in position 21 to 22 is any amino acid
  Variant (23)..(23): Xaa in position 23 is Ile or Val
  Variant (24)..(24): Xaa in position 24 is Ile or Leu
  Variant (25)..(25): Xaa in position 25 is Asp, Asn or Ser
  Variant (26)..(28): Xaa in position 26 to 28 is any amino acid
  Variant (30)..(30): Xaa in position 30 is Ala, Gly, Ser or Thr
  Variant (31)..(31): Xaa in position 31 is Ile or Met
  Variant (32)..(32): Xaa in position 32 is Phe, Leu or Met
  Variant (33)..(33): Xaa in position 33 is Ile or Val
  Variant (34)..(34): Xaa in position 34 is Leu or Val
  Variant (35)..(35): Xaa in position 35 is any amino acid
  Variant (37)..(37): Xaa in position 37 is Ile, Leu or Val
  Variant (38)..(38): Xaa in position 38 is Phe, Ile or Val
  Variant (39)..(39): Xaa in position 39 is any amino acid
  Variant (41)..(41): Xaa in position 41 is Phe or Val
  Variant (42)..(42): Xaa in position 42 is any amino acid
  Variant (44)..(44): Xaa in position 44 is Ser or Thr
  Variant (46)..(46): Xaa in position 46 is any amino acid
  Variant (47)..(47): Xaa in position 47 is Thr or Val
  Variant (48)..(49): Xaa in position 48 to 49 is any amino acid
  Variant (50)..(50): Xaa in position 50 is Ile, Leu or Val
GXXMXXKGXVEXXVLXXGXXXXXXXXXXFXXXXXXAXXXTXXTXPXXXXXY

SEQ ID NO: 6290 - protein, 59 aa, Artificial sequence
  protein pattern
  Variant (2)..(3): Xaa in position 2 to 3 is any amino acid
  Variant (4)..(6): Xaa in position 4 to 6 is any or no amino acid
  Variant (8)..(8): Xaa in position 8 is Ala or Ser
  Variant (9)..(9): Xaa in position 9 is Ile, Leu or Met
  Variant (10)..(10): Xaa in position 10 is Ala, Cys or Ser
  Variant (11)..(11): Xaa in position 11 is Ile or Val
  Variant (15)..(15): Xaa in position 15 is Gly or Pro
  Variant (18)..(18): Xaa in position 18 is Ala, Cys or Ser
  Variant (22)..(22): Xaa in position 22 is Ala, Asn or Thr
  Variant (24)..(24): Xaa in position 24 is Ile or Leu
  Variant (25)..(25): Xaa in position 25 is any amino acid
  Variant (27)..(27): Xaa in position 27 is Ile, Leu or Val
  Variant (28)..(28): Xaa in position 28 is any amino acid
  Variant (29)..(29): Xaa in position 29 is Asp, Glu or Thr
  Variant (30)..(30): Xaa in position 30 is Asp, Glu, Gln or Arg
  Variant (31)..(31): Xaa in position 31 is Ala, Ile, Leu, Pro or Val
  Variant (33)..(34): Xaa in position 33 to 34 is any amino acid
  Variant (35)..(35): Xaa in position 35 is Ala, Ser or Val
  Variant (36)..(36): Xaa in position 36 is Leu or Met
  Variant (37)..(37): Xaa in position 37 is Ala, Gly, Asn, Ser or Thr
  Variant (38)..(38): Xaa in position 38 is Ala or Ser
  Variant (39)..(39): Xaa in position 39 is Ala or Gly
  Variant (40)..(41): Xaa in position 40 to 41 is any amino acid
  Variant (44)..(44): Xaa in position 44 is Ile, Leu, Met or Val
  Variant (45)..(45): Xaa in position 45 is any amino acid
  Variant (46)..(46): Xaa in position 46 is Ala or Gly
  Variant (48)..(48): Xaa in position 48 is Ile or Val
  Variant (53)..(53): Xaa in position 53 is Ala, Cys, Ser or Val
  Variant (54)..(54): Xaa in position 54 is Ile or Val
  Variant (55)..(55): Xaa in position 55 is any amino acid
  Variant (57)..(57): Xaa in position 57 is Ala or Ser
  Variant (58)..(58): Xaa in position 58 is Glu, Gly, Asn or Ser
  Variant (59)..(59): Xaa in position 59 is Ala, Asp, Glu, Asn or Ser
FXXXXXVXXXXTAFXVLXRILXEXXLXXXXXGXXXXXXXXXNDXXXWXLLALXXXLXXX

SEQ ID NO: 6291 - protein, 50 aa, Artificial sequence
  protein pattern
  Variant (2)..(2): Xaa in position 2 is any or no amino acid
  Variant (4)..(4): Xaa in position 4 is any or no amino acid
  Variant (6)..(6): Xaa in position 6 is any or no amino acid
  Variant (9)..(9): Xaa in position 9 is Ser or Thr
  Variant (10)..(10): Xaa in position 10 is Ala, Ile, Leu or Val
  Variant (11)..(11): Xaa in position 11 is Phe, Ile, Leu or Met
  Variant (13)..(16): Xaa in position 13 to 16 is any amino acid
  Variant (17)..(17): Xaa in position 17 is Phe or Tyr
  Variant (18)..(21): Xaa in position 18 to 21 is any amino acid
  Variant (24)..(25): Xaa in position 24 to 25 is any amino acid
  Variant (27)..(27): Xaa in position 27 is Ile, Leu, Met or Val
  Variant (28)..(29): Xaa in position 28 to 29 is any amino acid
  Variant (31)..(31): Xaa in position 31 is Asp, Glu, Asn or Thr
  Variant (32)..(33): Xaa in position 32 to 33 is any amino acid
  Variant (35)..(35): Xaa in position 35 is Asn or Ser
  Variant (36)..(36): Xaa in position 36 is Ile, Leu or Val
  Variant (38)..(39): Xaa in position 38 to 39 is Ile or Leu
  Variant (40)..(40): Xaa in position 40 is any amino acid
  Variant (42)..(42): Xaa in position 42 is Leu or Met
  Variant (44)..(44): Xaa in position 44 is Phe, Ile or Leu
  Variant (45)..(45): Xaa in position 45 is Ala, Ile, Leu or Val
  Variant (47)..(47): Xaa in position 47 is Leu, Met or Val
  Variant (49)..(49): Xaa in position 49 is Ile, Leu, Met or Val
GXIXLXGPXXXGXXXXXXXXXFPXXSXXXLXXXAXXGXXXFXFXXGXEXD

SEQ ID NO: 6292 - protein, 37 aa, Artificial sequence
  protein pattern
  Variant (2)..(5): Xaa in position 2 to 5 is any or no amino acid
  Variant (8)..(8): Xaa in position 8 is Phe, Ile or Leu
  Variant (9)..(9): Xaa in position 9 is Ile, Pro or Val
  Variant (10)..(11): Xaa in position 10 to 11 is any amino acid
  Variant (12)..(12): Xaa in position 12 is Ile, Leu or Val
  Variant (13)..(13): Xaa in position 13 is Phe, Leu or Met
  Variant (14)..(14): Xaa in position 14 is Ile or Leu
  Variant (16)..(16): Xaa in position 16 is Ile or Leu
  Variant (17)..(17): Xaa in position 17 is Phe or Tyr
  Variant (19)..(19): Xaa in position 19 is Ala, Thr or Val
  Variant (20)..(20): Xaa in position 20 is any amino acid
  Variant (21)..(21): Xaa in position 21 is Ala or Ser
  Variant (24)..(24): Xaa in position 24 is any amino acid
  Variant (25)..(25): Xaa in position 25 is Thr or Val
  Variant (26)..(26): Xaa in position 26 is Asp or Asn
  Variant (27)..(27): Xaa in position 27 is Ile, Leu or Val
  Variant (28)..(29): Xaa in position 28 to 29 is any amino acid
  Variant (30)..(30): Xaa in position 30 is Ile or Leu
  Variant (31)..(32): Xaa in position 31 to 32 is any amino acid
  Variant (33)..(33): Xaa in position 33 is Ala, Gly or Pro
  Variant (34)..(34): Xaa in position 34 is any amino acid
  Variant (35)..(35): Xaa in position 35 is Ala, Asp, Ser, Thr or Val
  Variant (37)..(37): Xaa in position 37 is Ala, Gly or Leu
LXXXXEDXXXXXXXPXXFXXXGLXXXXXXXXXXXXWX

SEQ ID NO: 6293 - protein, 27 aa, Artificial sequence
  protein pattern
  Variant (2)..(5): Xaa in position 2 to 5 is any or no amino acid
  Variant (7)..(7): Xaa in position 7 is Ala, Asp or Gln
  Variant (8)..(8): Xaa in position 8 is any amino acid
  Variant (11)..(11): Xaa in position 11 is Ile or Val
  Variant (13)..(13): Xaa in position 13 is Ala, Pro or Ser
  Variant (14)..(14): Xaa in position 14 is Ile or Leu
  Variant (17)..(17): Xaa in position 17 is Ala or Gly
  Variant (19)..(19): Xaa in position 19 is Ile, Leu, Met or Val
  Variant (20)..(20): Xaa in position 20 is any amino acid
  Variant (22)..(22): Xaa in position 22 is Ile, Leu or Val
  Variant (23)..(24): Xaa in position 23 to 24 is any amino acid
  Variant (26)..(26): Xaa in position 26 is His, Lys or Arg
  Variant (27)..(27): Xaa in position 27 is Asp, Glu, Gly or Thr
AXXXXTXXIGXHXXFGXFXXGXXXPXX

SEQ ID NO: 6294 - protein, 29 aa, Artificial sequence
  protein pattern
  Variant (2)..(3): Xaa in position 2 to 3 is any amino acid
  Variant (4)..(4): Xaa in position 4 is Ile or Leu
  Variant (5)..(5): Xaa in position 5 is Ile or Val
  Variant (6)..(6): Xaa in position 6 is Ile, Leu or Val
  Variant (7)..(7): Xaa in position 7 is Ala, Leu or Val
  Variant (8)..(8): Xaa in position 8 is Phe, Leu or Val
  Variant (9)..(9): Xaa in position 9 is Cys, Ser or Thr
  Variant (10)..(10): Xaa in position 10 is Asn, Gln or Arg
  Variant (11)..(11): Xaa in position 11 is any amino acid
  Variant (12)..(12): Xaa in position 12 is Phe, Ile or Leu
  Variant (13)..(15): Xaa in position 13 to 15 is any amino acid
  Variant (16)..(16): Xaa in position 16 is Phe, Ile or Leu
  Variant (17)..(18): Xaa in position 17 to 18 is any amino acid
  Variant (19)..(19): Xaa in position 19 is Phe, Ile, Leu or Met
  Variant (20)..(20): Xaa in position 20 is Lys or Arg
  Variant (23)..(23): Xaa in position 23 is Lys or Arg
  Variant (25)..(25): Xaa in position 25 is Ile or Val
  Variant (26)..(26): Xaa in position 26 is Ala or Ser
  Variant (28)..(28): Xaa in position 28 is any or no amino acid
QXXXXXXXXXXXXXXXXXXXQPXVXXEXI

SEQ ID NO: 6295 - protein, 14 aa, Artificial sequence
  protein pattern
  Variant (2)..(3): Xaa in position 2 to 3 is any amino acid
  Variant (5)..(5): Xaa in position 5 is Ser or Thr
  Variant (6)..(6): Xaa in position 6 is Asp, Glu or Gly
  Variant (8)..(8): Xaa in position 8 is Ala, Pro, Ser or Thr
  Variant (9)..(9): Xaa in position 9 is any amino acid
  Variant (10)..(10): Xaa in position 10 is Ala, Asp or Ser
  Variant (11)..(11): Xaa in position 11 is Ile, Leu, Met or Val
  Variant (12)..(13): Xaa in position 12 to 13 is any amino acid
  Variant (14)..(14): Xaa in position 14 is Ala, Ser or Val
LXXLXXRXXXXXXX

SEQ ID NO: 6296 - protein, 20 aa, Artificial sequence
  protein pattern
  Variant (2)..(2): Xaa in position 2 is Phe, Ile, Leu or Val
  Variant (3)..(3): Xaa in position 3 is Ala, Gly, Ser, Thr or Val
  Variant (4)..(4): Xaa in position 4 is Ile or Val
  Variant (5)..(5): Xaa in position 5 is Ala or Gly
  Variant (6)..(7): Xaa in position 6 to 7 is any amino acid
  Variant (8)..(8): Xaa in position 8 is Gly, Asn, Ser or Thr
  Variant (9)..(9): Xaa in position 9 is Ile, Leu or Met
  Variant (10)..(10): Xaa in position 10 is any amino acid
  Variant (11)..(11): Xaa in position 11 is Ala, Ile, Leu or Val
  Variant (14)..(14): Xaa in position 14 is Ala, Gly, Ile, Leu or Val
  Variant (15)..(15): Xaa in position 15 is any amino acid
  Variant (17)..(17): Xaa in position 17 is any amino acid
  Variant (18)..(18): Xaa in position 18 is Ala, Gly, Leu or Val
  Variant (19)..(19): Xaa in position 19 is any amino acid
  Variant (20)..(20): Xaa in position 20 is Ala or Ser
AXXXXXXXXXXPFXXGXXXX

SEQ ID NO: 6297 - DNA, 1191 bp, Saccharomyces cerevisiae
  CDS (1)..(1191)
atgttacagagtatagtcctttccgtgtgcatgtttatgttgcacacagtcgctgccagtggacctcagtcgtaccaaaagttggatttcactaatgttggttttacaggctcctacgtagatgtgaataagtttaaagatatcaccaacaatgaatcgtgtacttgcgaagtgggtgacagagtatggtttagtggtaagaacgctccactagcagactatttatccgttcatttccgtggaccattgaagttgaaacaatttgctttttacacatcccctggatttaccgtcaacaacagcagaagttcttctgattggaaccgtcttgcctactatgagtccagttccaaaaccgctgataacgttacctttctaaatcatggaggtgaagcttccccttgtttaggaaatgctttgtcctacgctagttctaacggtactggcagcgccagtgaagctaccgttttggcagatggcactttgatttcttcagatcaagaatacataatctattcgaatgtctcatgtccaaaatcaggttatgataagggttgtggggtttaccgtagtggcattccagcttactatgggtacggaggtacaacaaagatgtttttgtttgaattcgaaatgcctactgaaactgagaaaaatagcagctctattgggtactatgacttgcctgctatttggttgctaaacgatcacattgcaaggacttctcaatatccaaccaatgccaactgttcatgttgggctagtggatgtggggaatacgatatttttgaagctatgaatggtacggagaaaaaccatctctattctactttccacactttccaaggtatcgaggatttgggtactggtatccaatcttacggatacataacaagaaatactactggaacgatgaaaggtggtgttgttttcgattctagtggaaatgtcgtttctttcatatctgatgccactccattcaatggaactgtttctgctgatactgttaacgatttattggctgcaattccagaaaacgaaacctattcttctcaattgatgagcatttctgctactgcgccttcgaccacctcgttgtcgaatggtgttcgtttaacgaacatgcaaaacggtgtatggtattatattttggccatattcactgcctttacgcaagtggttttgatttga

SEQ ID NO: 6298 - protein, 396 aa, Saccharomyces cerevisiae
MLQSIVLSVCMFMLHTVAASGPQSYQKLDFTNVGFTGSYVDVNKFKDITNNESCTCEVGDRVWFSGKNAPLADYLSVHFRGPLKLKQFAFYTSPGFTVNNSRSSSDWNRLAYYESSSKTADNVTFLNHGGEASPCLGNALSYASSNGTGSASEATVLADGTLISSDQEYIIYSNVSCPKSGYDKGCGVYRSGIPAYYGYGGTTKMFLFEFEMPTETEKNSSSIGYYDLPAIWLLNDHIARTSQYPTNANCSCWASGCGEYDIFEAMNGTEKNHLYSTFHTFQGIEDLGTGIQSYGYITRNTTGTMKGGVVFDSSGNVVSFISDATPFNGTVSADTVNDLLAAIPENETYSSQLMSISATAPSTTSLSNGVRLTNMQNGVWYYILAIFTAFTQVVLI

SEQ ID NO: 6299 - DNA, 1341 bp, Candida glabrata CBS 138
  CDS (1)..(1341)
atgtttcagttgttgacgttgttactaccgttggtcagcaaagttagtgctgactgccagatgattgctggtaattactactgttccaagacagatgctgccatttactcgaatgtcggtttctctggttcttaccaggatgtgacgtcgatggatgaacagagctgtgtttgttcacagcaacctttctcctttggtggtgctttggctccattcgatgaagagctctctgttcatttcagaggtcctctaaaactatcacaattcgcagtgtactaccctgcttcttctaactcaaagagagctgtcgcagaagaggactgtgactccgtggtcgctaaacctgtccacaaacacaagcgtgacgtcgcagttgaagtcatcgaagtcaccgaaacagtattcatcgatgaaaacggtaacactgtcaccgcttccggaacttccacttccatgtctactccaactccatctaacccttcccaagtacaatcttcccaagctccttcccaagctcctgtttcttcctccaacaaaggtactacaactctatcctccacttcaaagaacactccttcctcttcctcctcctttcaagccgcttcttcttccgctgctcctatccaagacggtggtgactggagccgtgtcgcttacttctccccaggtactgcctctggctgtactttcatgaaccaccaaggtggtactgcaggctctggtgtctggtcctcttgtttcggtaactccatctctttcgccaactctgacggtgtcactggtgcaggctccccacaacctctaggtgacgttaccatcaagtccggccaagagtacatgatcttctcctctacccaatgttccgcaaacaacgccgagtgtggttactacagagaaggtatcccagcttacaagggtttcggtggcaacagaaagattttctacttcgaattctccatgccaagtgacactaacggcaacggttacaaccaagacatgccagctatttggttactaaacgccaagattccaagaactttgcaatatggtctatcaacctgttcctgttgggctaccggctgtggtgaattggatctattcgaagtgctaagcccaggttcagacaagatgatcactcacatccacgacggccaaggtggtggtacccaagatttcttccaaagaccaactgatggtatcttcagagctgttgttatcttcaacgcttctgacaagaccatccacttggttcaagtcgacagcgccccagctggtggtctatccaacgaccaagtccaacaatggttgaacaaggccggctccgctgctgctttgccatag

SEQ ID NO: 6300 - protein, 446 aa, Candida glabrata CBS 138
MFQLLTLLLPLVSKVSADCQMIAGNYYCSKTDAAIYSNVGFSGSYQDVTSMDEQSCVCSQQPFSFGGALAPFDEELSVHFRGPLKLSQFAVYYPASSNSKRAVAEEDCDSVVAKPVHKHKRDVAVEVIEVTETVFIDENGNTVTASGTSTSMSTPTPSNPSQVQSSQAPSQAPVSSSNKGTTTLSSTSKNTPSSSSSFQAASSSAAPIQDGGDWSRVAYFSPGTASGCTFMNHQGGTAGSGVWSSCFGNSISFANSDGVTGAGSPQPLGDVTIKSGQEYMIFSSTQCSANNAECGYYREGIPAYKGFGGNRKIFYFEFSMPSDTNGNGYNQDMPAIWLLNAKIPRTLQYGLSTCSCWATGCGELDLFEVLSPGSDKMITHIHDGQGGGTQDFFQRPTDGIFRAVVIFNASDKTIHLVQVDSAPAGGLSNDQVQQWLNKAGSAAALP

SEQ ID NO: 6301 - DNA, 1203 bp, Candida glabrata CBS 138
  CDS (1)..(1203)
atggctatgattaaaaatgtgatagctgctactgcagctgcattgatgtgtggatctcttgtggaggctgaagttagaggctatgacatgattgagttcagcaatgttggtttcactgggtcttatacccctgtgaagaagatgtctaacttagacaacaacagtacttgtaagtgtgaagttggtgacaggacttggttccaaggtgataatgcaccattgaatgaacacttgtctgtgcatttccgtggtccattgtccctagaaaagtttgcattctatacttctcctaactttgtcatcaatgacaacagttctaattctcaaagttggaaccgttctgccttctatgatgcttctgctcaaacagcagataatgttactttcatgaataaccaaggtgctgattctccttgtgtcggtaaggctctttcttacgcaagcgacaatggtacctcttctgctagctctccaaatgttttgaaggccgacaactatgtcagctctgaccaagaatattctattttctccactgtcaagtgtccaaagtccggcgtcaagaacggctgtggttactacagagatggtattccagctttctacggttttggtggtgagactaagatgtttttgttcgaattcaagatgccaactgaaacccaatctaacagcagttcttttgaattttatgacatgccagccatctggttgctaaacgataaaatcccaagaacttctcaatacccaatcaacgctaactgttcctgttggtcaagtggttgtggtgagttcgatatttttgaagtcatgaacggcactgaaagaaaccacttatactcaactttccacacttaccaaggtattgaagatctgggtaccggtattcaaagttatggttacattccaagagatactaagggtactatgatgggtggtgttatctttgattctaatggtaacactgtcagtttcatctccaactcaacttccttcgaccaaactttatctccttctgcagtcaactctttattaagagcaattccaagcaatgaaacttacagcaccaagttgatgagtatatccggtgttgcaccatcttcctcaaagtctaagtctagcggtgctgcattgtctgttgatcaaggtatctggtactatgttttcactgccttcactgctgttgcacactttttgttgatttaa

SEQ ID NO: 6302 - protein, 400 aa, Candida glabrata CBS 138
MAMIKNVIAATAAALMCGSLVEAEVRGYDMIEFSNVGFTGSYTPVKKMSNLDNNSTCKCEVGDRTWFQGDNAPLNEHLSVHFRGPLSLEKFAFYTSPNFVINDNSSNSQSWNRSAFYDASAQTADNVTFMNNQGADSPCVGKALSYASDNGTSSASSPNVLKADNYVSSDQEYSIFSTVKCPKSGVKNGCGYYRDGIPAFYGFGGETKMFLFEFKMPTETQSNSSSFEFYDMPAIWLLNDKIPRTSQYPINANCSCWSSGCGEFDIFEVMNGTERNHLYSTFHTYQGIEDLGTGIQSYGYIPRDTKGTMMGGVIFDSNGNTVSFISNSTSFDQTLSPSAVNSLLRAIPSNETYSTKLMSISGVAPSSSKSKSSGAALSVDQGIWYYVFTAFTAVAHFLLI

SEQ ID NO: 6303 - DNA, 1200 bp, Kluyveromyces lactis NRRL Y-1140
  CDS (1)..(1200)
atggtacaggcactggatatattagcttcattatttgcagtggcaactgtagctgctcaaagttcaaatcaggtacaatcgtataaccttatcgaattcggtaacgtagggttcaccggttcatatactaacgtaaagaagatttcggatgcagaagaggatagttgttcctgtactgtaggagatcgagtctggtttagtggcgacaacgctccattgaatgaagcactgtctgtccacttgagaggtccgctatctctgtcgaaatttgcgttttatacgtcgccatcatttgatatcaatgattcgagttctacctcgtggtccagagaagcatactatgattcaacaagccagacagccgaaaatgtgacgtttttaaccggtgctggtgattcttcgccatgtctaggtaaagctttgacttttgcaagtgagaacggtaccggtaaggctgatgactccaccatcttggaatccaacaacttgttagcatctgatgaagaagtcattattttctcgaacgtttcgtgtcctaaatctgggtatgataagggctgtggtgtgtacagatctgggattccagcatattatggtttcgaaggtgataccaagatgttcttgttcgaattcaccatgcctacagctacagaaaagaacagttcttctattgactactacgacatgccagctatctggcttttgaacgatcacatccctagaaccgcacagtacccatcatcatcaagcagtaattgttcatgctgggctagtggatgtggtgaattcgatatcttcgaggtcatgaacggtaccgagaaaaaccatctatattccactttccatactttccaaggtatcgaagacttgggaactggtattcaagcaggtggttatatcgcaagagacacatctgctacaatgaaaggtggtgtgctatttgattccagcggtaataccgttgtgttcatgtccaatgataccgtattcgatagctccatcgactacgacacaattaataccttgatctctaatatcgacgacgatgaaacgtacagtactgaattggctacaatctctgctactgcaccaacatcaacctcaaagtcaggggctgccattatgataaaaccttcggcaggaacaatccgttatcttctactatcggcactaatgtccgttttcaatctaatggtataa

SEQ ID NO: 6304 - protein, 399 aa, Kluyveromyces lactis NRRL Y-1140
MVQALDILASLFAVATVAAQSSNQVQSYNLIEFGNVGFTGSYTNVKKISDAEEDSCSCTVGDRVWFSGDNAPLNEALSVHLRGPLSLSKFAFYTSPSFDINDSSSTSWSREAYYDSTSQTAENVTFLTGAGDSSPCLGKALTFASENGTGKADDSTILESNNLLASDEEVIIFSNVSCPKSGYDKGCGVYRSGIPAYYGFEGDTKMFLFEFTMPTATEKNSSSIDYYDMPAIWLLNDHIPRTAQYPSSSSSNCSCWASGCGEFDIFEVMNGTEKNHLYSTFHTFQGIEDLGTGIQAGGYIARDTSATMKGGVLFDSSGNTVVFMSNDTVFDSSIDYDTINTLISNIDDDETYSTELATISATAPTSTSKSGAAIMIKPSAGTIRYLLLSALMSVFNLMV

SEQ ID NO: 6305 - DNA, 1155 bp, Candida albicans SC5314
  CDS (1)..(1155): transl_table=12
atgttattttcatcattgttagtatctacattagtttcagtggctactgctgccaaccaagaagttgaagctatccagtttagtaatcttgggttttctggtacttataaccaagttgaaaagttgagtaatatctataaagattcgtgttcatgtgaagttaacaaaacgccagtatcgttttctgggacgaacgcaccattgaacgaagaagtttctgtgcatttccgtggtccacttgtattgaacaaatttgcgtcctacgtttcagatgggttcaagtatggtgatgatagttctggcgactggaagagattgagttactacgaagggtcgagtggaaccagtgagaatgtcacgtttttgacgagtgccggtaagaactcttcgtgtttgggtattgggttgacatatgctggtaccgatggtatttccaaagccgactcgtcgactgttttggccaaaaatacgttgatcaactcgaacgacgagtttgtgattttctccaacattagctgtggcaagtccgggtacaacaacgattgtggtgtctacagaagcgacattcctgcctaccatgggttttacggtaccacgaaaatgtttttgtttgaattccaaatgccaaatgagacacatacgtcaactgatatttccaactacaacatgccggccatttggcttttgaatgcgcatattccaagaaccgcacagtactcaatgaatgttaattgttcgtgctggagatctgggtgtggtgagtttgacatttttgaagtgatgaactcgactgagtaccttcacatgtacagcaccattcacgattaccaagggtctgatgatattcaaactggtatggctgcacccgcctatattgagcgtgatttgactggcactatgagtggtggtgttgcctttgacctgagtggcaatgctgttgtttgggtgtctaactctacatcgtttgattctactattcaagcttctagtgtcaactcgtgggttaagcaagctggtgctgatgttgccactacattggctaccgttactggccaatctgccactactacaagtaagaagagcggtggtgttagttaccaaccatcgtttatcactaacttgcttatgacggtgcttacactttgggttatttag

SEQ ID NO: 6306 - protein, 384 aa, Candida albicans SC5314
MLFSSLLVSTLVSVATAANQEVEAIQFSNLGFSGTYNQVEKLSNIYKDSCSCEVNKTPVSFSGTNAPLNEEVSVHFRGPLVLNKFASYVSDGFKYGDDSSGDWKRLSYYEGSSGTSENVTFLTSAGKNSSCLGIGLTYAGTDGISKADSSTVLAKNTLINSNDEFVIFSNISCGKSGYNNDCGVYRSDIPAYHGFYGTTKMFLFEFQMPNETHTSTDISNYNMPAIWLLNAHIPRTAQYSMNVNCSCWRSGCGEFDIFEVMNSTEYLHMYSTIHDYQGSDDIQTGMAAPAYIERDLTGTMSGGVAFDSSGNAVVWVSNSTSFDSTIQASSVNSWVKQAGADVATTLATVTGQSATTTSKKSGGVSYQPSFITNLLMTVLTLWVI

SEQ ID NO: 6307 - DNA, 1155 bp, Candida albicans SC5314
  CDS (1)..(1155): transl_table=12
atgttattttcatcattgttagtatctacattagtttcggtggctactgctgccaaccaagaagttgaagctatccagtttagtaatcttgggttttctggcacttataaccaagttgaaaagttaagtaatatctataaagattcgtgttcatgtgaagttaacaaaacgctagtatcgttttctgggacgaacgcaccattgaacgaagaagtttctgtgcatttctgtggtccacttgtattgaacaaatttgcgtcctacgtttcagatgggttcaagtatggtgatgatagttctggcgactggaagagattgagttactacgaagggtcgagtggaaccagtgagaatgtcacgtttttgacgagtgccggtaagaactcttcgtgtttgggtattgggttgacatatgctggtaccgatggtatttccaaagccgactcgtcgactgttttggccaaaaatacgttgatcaactcgaacgacgagtttgtgattttctccaacattagctgtggcaagtccgggtacaacaacgattgtggtgtctacagaagcgacattcctgcctaccatgggttttacggtaccacgaaaatgtttttgtttgaattccaaatgccaaatgagacacatacgtcaactgatatttccaactacaacatgccggccatttggcttttgaatgcgcatattccaagaaccgcacagtactcaatgaatgttaattgttcgtgctggagatctgggtgtggtgagtttgacatttttgaagtgatgaactcgaccgagtaccttcacatgtacagcaccattcacgattaccaagggtccgatgatattcaaactggtatggctgcacctgcctatattgagcgtgacttgactggcactatgagtggtggtgttgcctttgacctgagtggcaatgctgttgtttgggtgtctaactctacatcgtttgattctaccattcaagcttccagtgtcaactcgtgggttaagcaagctggtgctgatgttgccactacattggctaccgttactggccaatctgccactactacaagtaagaagagcggtggtgttagttaccaaccatcgtttatcactaacttgcttatgacggtgcttacactttgggttatttag

SEQ ID NO: 6308 - protein, 384 aa, Candida albicans SC5314
MLFSSLLVSTLVSVATAANQEVEAIQFSNLGFSGTYNQVEKLSNIYKDSCSCEVNKTLVSFSGTNAPLNEEVSVHFCGPLVLNKFASYVSDGFKYGDDSSGDWKRLSYYEGSSGTSENVTFLTSAGKNSSCLGIGLTYAGTDGISKADSSTVLAKNTLINSNDEFVIFSNISCGKSGYNNDCGVYRSDIPAYHGFYGTTKMFLFEFQMPNETHTSTDISNYNMPAIWLLNAHIPRTAQYSMNVNCSCWRSGCGEFDIFEVMNSTEYLHMYSTIHDYQGSDDIQTGMAAPAYIERDLTGTMSGGVAFDSSGNAVVWVSNSTSFDSTIQASSVNSWVKQAGADVATTLATVTGQSATTTSKKSGGVSYQPSFITNLLMTVLTLWVI

SEQ ID NO: 6309 - DNA, 1407 bp, Candida albicans SC5314
  CDS (1)..(1407): transl_table=12
atgaaatttagttctactacattattggctgtgttatcatcacttactgccactgtcagtgccggatgttcattcgaaggcggaaactactactgttctgaaaccaaaaaagttatctacaaaggtatcgggttttctggtagttatatggacgttaccaatatggatgaaaacactggtaaatgtactcaacaattatattccttcagtggtaacttgtctccattagacgaagaattatcagttcatttcagaggacctttgacattgttacaatttggtgtttactacccaagcagtagtggtaattcaaagagacagattgacgaccaagactgtaatgtcaaacatgttcaccataaacacaagagagctactgaagttgttcaagtcacacaaacagttttcgttgatggaaatggtaacactgttacttcccaagctctccaaacttctactgtcgaatccagtcctgctgtttcatctgctgctgctgccaacgataatgccaactctggctctggctctggctctagcgctggctctggttccggttatggatcagtatctgcccttgatggtgaaggtaaagcttacagatccgatatctcaactaaatctgctccaaccagtacttctgctcaaccatcttcatcagaaaccgcctctgtcgatggtgcttggaccagagacagttattatactccaggatccaccgataactgtgtgttcttaaactatcatggtggttctggttctggtgtttggtccgctaaattcggtaactctttatcttatgccaatgctgataactctggtggttcttcgacccctgttcccttggaagaaaccactatcaaatctggtgaagaatacattatcttctctggttctaaatgtggtagtagttccgattgtggttactatagaaaaggtactgttgcttatcacggtttcaaaggagctagcaagatttttgtttttgaatttgaaatgccaagtgatactaatggtaatggttataaccaagacatgccagccgtttggttattgaatgctaagattccaagaactttacaatatggtgaagccacctgttcttgttggaagactggttgtggtgaacttgatttgtttgaagtcttgagcagtggttcaaataaaatgatttcccacttgcacgatggtcaaggttcttctcaaaacagtaacaatggtggtggtggttctcaagattatttcgaaagaccaacttcaggtacattcaagggtgttgttattttctatggtgatgaaatccatattcttcaagttgatgatgaaactgaattcggttcatcattagatgaagaaactgttaacgcttggttgaatgaagctggttctgttgccactattggttactag

SEQ ID NO: 6310 - protein, 468 aa, Candida albicans SC5314
MKFSSTTLLAVLSSLTATVSAGCSFEGGNYYCSETKKVIYKGIGFSGSYMDVTNMDENTGKCTQQLYSFSGNLSPLDEELSVHFRGPLTLLQFGVYYPSSSGNSKRQIDDQDCNVKHVHHKHKRATEVVQVTQTVFVDGNGNTVTSQALQTSTVESSPAVSSAAAANDNANSGSGSGSSAGSGSGYGSVSALDGEGKAYRSDISTKSAPTSTSAQPSSSETASVDGAWTRDSYYTPGSTDNCVFLNYHGGSGSGVWSAKFGNSLSYANADNSGGSSTPVPLEETTIKSGEEYIIFSGSKCGSSSDCGYYRKGTVAYHGFKGASKIFVFEFEMPSDTNGNGYNQDMPAVWLLNAKIPRTLQYGEATCSCWKTGCGELDLFEVLSSGSNKMISHLHDGQGSSQNSNNGGGGSQDYFERPTSGTFKGVVIFYGDEIHILQVDDETEFGSSLDEETVNAWLNEAGSVATIGY

SEQ ID NO: 6311 - DNA, 1407 bp, Candida albicans SC5314
  CDS (1)..(1407): transl_table=12
atgaaatttagttctactacattattggctgtgttatcatcacttactgccactgtcagtgccggatgttcattcgaaggcggaaactactactgttctgaaaccaaaaaagttatctacaaaggtatcgggttttctggtagttatatggacgttaccaatatggatgaaaacactggtaaatgtactcaacaattatattccttcagtggtaacttgtctccattagacgaagaattatcagttcatttcagaggacctttgacattgttacaatttggtgtttactacccaagcagtagtggtaattcaaagagacagattgacgaccaagactgtaatgtcaaacatgttcaccataaacacaagagagctactgaagttgttcaagtcacacaaacagttttcgttgatggaaatggtaacactgttacttcccaagctctccaaacttctactgtcgaatccagtcctgctgtttcatctgctgctgctgccaacgataatgccaactctggctctggctctggctctagcgctggctctggttccggttatggatcagtatctgcccttgatggtgaaggtaaagcttacagatccgatatctcaactaaatctgctccaaccagtacttctgctcaaccatcttcatcagaaaccgcctctgtcgatggtgcttggaccagagacagttattatactccaggatccaccgataactgtgtgttcttaaactatcatggtggttctggttctggtgtttggtccgctaaattcggtaactctttatcttatgccaatgctgataactctggtggttcttcgacccctgttcccttggaagaaaccactatcaaatctggtgaagaatacattatcttctctggttctaaatgtggtagtagttccgattgtggttactatagaaaaggtactgttgcttatcacggtttcaaaggagctagcaagatttttgtttttgaatttgaaatgccaagtgatactaatggtaatggttataaccaagacatgccagccgtttggttattgaatgctaagattccaagaactttacaatatggtgaagccacctgttcttgttggaagactggttgtggtgaacttgatttgtttgaagtcttgagcagtggttcaaataaaatgatctcccacttgcacgatggtcaaggttcttctcaaaacagtaacaatggtggtggtggttctcaagattatttcgaaagaccaacttctggtacattcaagggtgttgttattttcgaaggtgatgaaatccatattcttcaagttgatgatgaaactgaattcggttcatcattagatgaagaaactgttaacgcttggttgaaagaagctggttctgttgccactattggttactag

SEQ ID NO: 6312 - protein, 468 aa, Candida albicans SC5314
MKFSSTTLLAVLSSLTATVSAGCSFEGGNYYCSETKKVIYKGIGFSGSYMDVTNMDENTGKCTQQLYSFSGNLSPLDEELSVHFRGPLTLLQFGVYYPSSSGNSKRQIDDQDCNVKHVHHKHKRATEVVQVTQTVFVDGNGNTVTSQALQTSTVESSPAVSSAAAANDNANSGSGSGSSAGSGSGYGSVSALDGEGKAYRSDISTKSAPTSTSAQPSSSETASVDGAWTRDSYYTPGSTDNCVFLNYHGGSGSGVWSAKFGNSLSYANADNSGGSSTPVPLEETTIKSGEEYIIFSGSKCGSSSDCGYYRKGTVAYHGFKGASKIFVFEFEMPSDTNGNGYNQDMPAVWLLNAKIPRTLQYGEATCSCWKTGCGELDLFEVLSSGSNKMISHLHDGQGSSQNSNNGGGGSQDYFERPTSGTFKGVVIFEGDEIHILQVDDETEFGSSLDEETVNAWLKEAGSVATIGY

SEQ ID NO: 6313 - DNA, 1368 bp, Saccharomyces cerevisiae
  CDS (1)..(1368)
atgttacaaaagctttccatgaccgcattagtcggtttgttttcttcagttgtgtcactcgtgaacgctgattgtacttactctggcggtaattactattgtgctcaaaccgatgccatcatttactctaacgtcggtttatctgctacctaccaagatgtcaccaatatggatgaatcttcttgtgcttgtacccaagctgatttcactgcttctggtagcttggctcccttcaacgaggaactatctgttcatttcaggggtccgatcgagttactacaatttggtgtttactacccaaatggtgaatctaatgctttgaagaaaagatcagagaaacaatcaatcgagtcctgtaaggaaggtgaagctgttgtctccagacataagcatcagcacaagagggatgttgctgttgaatatgttcaagttacttccactgtttacgtcgacagtaatggtcaaacagtcacagccgattccaccaataccgttgtcggtcctgctgttccttcttcttacactaaagactctactgttttgtccagcagtgctcaagcagttgaaacgagtgaaagccagtcttccatctcttcctctaaaaccacctcttctgctgctgctgcttcatcatcttcgtcatcatcttctaacactaacggtgactggtccagaggttcctactttgtcccaggctctactagcaactgtacattcatgaacaaccaaggggggactgccggttctggtgtctggtcgagttgtttcggtaactccatctcttttgctgcttcagatggtgtttctggtgctgcctccgctcaagctcttggtgatgtcaccattaaatctggtaatgaattcatgattttctccggtgaagaatgttccggtaataacggcgattgtggttattacagagaaggcattcctgcttatcatgggtttggtggggctgataaaattttcgtcttcgaattttctatgccaagtgacaccagcggttctgcctacaatcaagatatgccagctatttggttattaaatgcaaaaatcccaagaaccttgcaatatggtgatgcatcttgttcttgttggaaaactggctgtggtgaaatggatttgttcgaaattttgaccgctggttctgataaattaatctcacacatccatgacggccaagatggtggtactcaagattacttcgagagaccaactgatggtactttaaaggctgccgtaatctttaattcaagtgataaaactattcacattatcgaagtcgacgaaagctttgatgctactttaagcgatgatgtcgttgaccaatggttgagcaagtccggttcttctgcggccttgccatag

SEQ ID NO: 6314 - protein, 455 aa, Saccharomyces cerevisiae
MLQKLSMTALVGLFSSVVSLVNADCTYSGGNYYCAQTDAIIYSNVGLSATYQDVTNMDESSCACTQADFTASGSLAPFNEELSVHFRGPIELLQFGVYYPNGESNALKKRSEKQSIESCKEGEAVVSRHKHQHKRDVAVEYVQVTSTVYVDSNGQTVTADSTNTVVGPAVPSSYTKDSTVLSSSAQAVETSESQSSISSSKTTSSAAAASSSSSSSSNTNGDWSRGSYFVPGSTSNCTFMNNQGGTAGSGVWSSCFGNSISFAASDGVSGAASAQALGDVTIKSGNEFMIFSGEECSGNNGDCGYYREGIPAYHGFGGADKIFVFEFSMPSDTSGSAYNQDMPAIWLLNAKIPRTLQYGDASCSCWKTGCGEMDLFEILTAGSDKLISHIHDGQDGGTQDYFERPTDGTLKAAVIFNSSDKTIHIIEVDESFDATLSDDVVDQWLSKSGSSAALP

SEQ ID NO: 6315 - DNA, 1524 bp, Schizosaccharomyces pombe
  CDS (1)..(1524)
atgattgccaagtcgtttattgcttcttttctcttcctttgtttcgcgttttctggcgttaaagccgatggatgctctgaggaaaatggttactactactgtaaccaggcctccgaagtagaattcaccaatgttggctattcttctacttataacgaaatcaccaacatggatacctcttcatgctcttgtagcagtactcccaagtcttatggcggcaatttggctccctttgacgaagagttctccttccacttccgtggccctattgagctcaagcgttttgcagtctattatcccgacacttctaacgcattatcttctcttcgtaagcgtagcaacaaccaacacatgaagagacatcctcatcataagcgtgacgatgtcatcgacagtactcttaccgtgtacgaaacggtcatgtatactacagctgtttatggtgattcagccaccacaccagctgcttctgaagctcaagctagcagtgacattttgtcaagccttgccagcctttcctctgcttctaccgacaatctcgctgccagcgttactcctactactgtcgctgcttctgttgcatcttctgtcgataccgattccgcttccgccactatttcctcagtcgtcgacagcgctacttcttccgttagtaccgtgattccatcttccattatttccgctgcccctcctgattccgcctctgagtccactcctgcctctacttcctacgcatcctctaccacatctgccacttccacatcaactacctctggatcatctggctcctccgactggggtcgttcctctttctatgaggccgattcgggcacctcggacaatatcgtctttttgaacaacatgggtggtagtgctggtagtggtgtttggtcttcttgttttggtaactctctttcatttgctgcttccaatggtgttgatggtgcctcatcttctcaagtccttgaaaatatcttagtggcttctgacaaagagttttccatttggactgctaccgaatgcaacaatgactgtggttactacttaccaggtattcctgcttaccacggtttctctggagccaagcttgtgttaatggagtttatcatgccccatgatagctcttcttcttataaccaagacatgcctgccatttggtctttgaatgctcagattcctcgtacccttcagtatggaaatgccgattgctcgtgctggaccactggatgtggtgaatttgacatcttcgaagtcttgagcactggtaacgagaagatgattcctacccttcacggttcacaaggaagcagcaatggtaacggtggtggtgctggttccagcgattactttgctcgtcccactagctccagcatgatcggtgctgttatttatgacacttcttcttctggtatctacatcattgatgttaccgaccaaaacgttagctttgactcaacttactctgcttctgatgtcgatgcttggttgcaatctggtgcaaccattgttcaattatcaagttaa

SEQ ID NO: 6316 - protein, 507 aa, Schizosaccharomyces pombe
MIAKSFIASFLFLCFAFSGVKADGCSEENGYYYCNQASEVEFTNVGYSSTYNEITNMDTSSCSCSSTPKSYGGNLAPFDEEFSFHFRGPIELKRFAVYYPDTSNALSSLRKRSNNQHMKRHPHHKRDDVIDSTLTVYETVMYTTAVYGDSATTPAASEAQASSDILSSLASLSSASTDNLAASVTPTTVAASVASSVDTDSASATISSVVDSATSSVSTVIPSSIISAAPPDSASESTPASTSYASSTTSATSTSTTSGSSGSSDWGRSSFYEADSGTSDNIVFLNNMGGSAGSGVWSSCFGNSLSFAASNGVDGASSSQVLENILVASDKEFSIWTATECNNDCGYYLPGIPAYHGFSGAKLVLMEFIMPHDSSSSYNQDMPAIWSLNAQIPRTLQYGNADCSCWTTGCGEFDIFEVLSTGNEKMIPTLHGSQGSSNGNGGGAGSSDYFARPTSSSMIGAVIYDTSSSGIYIIDVTDQNVSFDSTYSASDVDAWLQSGATIVQLSS

SEQ ID NO: 6317 - DNA, 25 bp, Artificial sequence
  primer
atgttacagagtatagtcctttccg

SEQ ID NO: 6318 - DNA, 25 bp, Artificial sequence
  primer
tcaaatcaaaaccacttgcgtaaag

SEQ ID NO: 6319 - protein, 471 aa, Artificial sequence
  consensus sequence
  Variant (2)..(2): Xaa in position 2 is any amino acid
  Variant (5)..(5): Xaa in position 5 is any amino acid
  Variant (7)..(7): Xaa in position 7 is any amino acid
  Variant (9)..(10): Xaa in position 9 to 10 is any amino acid
  Variant (12)..(18): Xaa in position 12 to 18 is any amino acid
  Variant (19)..(24): Xaa in position 19 to 24 is any or no amino acid
  Variant (26)..(32): Xaa in position 26 to 32 is any amino acid
  Variant (33)..(33): Xaa in position 33 is any or no amino acid
  Variant (35)..(35): Xaa in position 35 is any amino acid
  Variant (37)..(38): Xaa in position 37 to 38 is any amino acid
  Variant (41)..(42): Xaa in position 41 to 42 is any amino acid
  Variant (44)..(45): Xaa in position 44 to 45 is any amino acid
  Variant (54)..(54): Xaa in position 54 is any amino acid
  Variant (56)..(57): Xaa in position 56 to 57 is any amino acid
  Variant (59)..(60): Xaa in position 59 to 60 is any amino acid
  Variant (62)..(75): Xaa in position 62 to 75 is any amino acid
  Variant (76)..(228): Xaa in position 76 to 228 is any or no amino acid
  Variant (230)..(230): Xaa in position 230 is any amino acid
  Variant (232)..(233): Xaa in position 232 to 233 is any amino acid
  Variant (236)..(241): Xaa in position 236 to 241 is any amino acid
  Variant (242)..(243): Xaa in position 242 to 243 is any or no amino acid
  Variant (245)..(246): Xaa in position 245 to 246 is any amino acid
  Variant (248)..(251): Xaa in position 248 to 251 is any amino acid
  Variant (252)..(257): Xaa in position 252 to 257 is any or no amino acid
  Variant (259)..(260): Xaa in position 259 to 260 is any amino acid
  Variant (262)..(262): Xaa in position 262 is any amino acid
  Variant (264)..(264): Xaa in position 264 is any amino acid
  Variant (266)..(267): Xaa in position 266 to 267 is any amino acid
  Variant (269)..(270): Xaa in position 269 to 270 is any amino acid
  Variant (272)..(274): Xaa in position 272 to 274 is any amino acid
  Variant (276)..(278): Xaa in position 276 to 278 is any amino acid
  Variant (280)..(284): Xaa in position 280 to 284 is any amino acid
  Variant (286)..(291): Xaa in position 286 to 291 is any amino acid
  Variant (292)..(292): Xaa in position 292 is any or no amino acid
  Variant (294)..(295): Xaa in position 294 to 295 is any amino acid
  Variant (297)..(298): Xaa in position 297 to 298 is any amino acid
  Variant (302)..(304): Xaa in position 302 to 304 is any amino acid
  Variant (306)..(308): Xaa in position 306 to 308 is any amino acid
  Variant (309)..(313): Xaa in position 309 to 313 is any or no amino acid
  Variant (316)..(316): Xaa in position 316 is any amino acid
  Variant (319)..(319): Xaa in position 319 is any amino acid
  Variant (325)..(325): Xaa in position 325 is any amino acid
  Variant (328)..(328): Xaa in position 328 is any amino acid
  Variant (330)..(330): Xaa in position 330 is any amino acid
  Variant (331)..(331): Xaa in position 331 is any or no amino acid
  Variant (333)..(333): Xaa in position 333 is any amino acid
  Variant (335)..(335): Xaa in position 335 is any amino acid
  Variant (339)..(339): Xaa in position 339 is any amino acid
  Variant (342)..(343): Xaa in position 342 to 343 is any amino acid
  Variant (345)..(350): Xaa in position 345 to 350 is any amino acid
  Variant (351)..(354): Xaa in position 351 to 354 is any or no amino acid
  Variant (364)..(365): Xaa in position 364 to 365 is any amino acid
  Variant (370)..(370): Xaa in position 370 is any amino acid
  Variant (373)..(376): Xaa in position 373 to 376 is any amino acid
  Variant (377)..(379): Xaa in position 377 to 379 is any or no amino acid
  Variant (384)..(385): Xaa in position 384 to 385 is any amino acid
  Variant (390)..(390): Xaa in position 390 is any amino acid
  Variant (392)..(392): Xaa in position 392 is any amino acid
  Variant (396)..(404): Xaa in position 396 to 404 is any amino acid
  Variant (405)..(405): Xaa in position 405 is any or no amino acid
  Variant (407)..(408): Xaa in position 407 to 408 is any amino acid
  Variant (410)..(411): Xaa in position 410 to 411 is any amino acid
  Variant (414)..(419): Xaa in position 414 to 419 is any amino acid
  Variant (420)..(421): Xaa in position 420 to 421 is any or no amino acid
  Variant (423)..(427): Xaa in position 423 to 427 is any amino acid
  Variant (429)..(430): Xaa in position 429 to 430 is any amino acid
  Variant (432)..(432): Xaa in position 432 is any amino acid
  Variant (434)..(434): Xaa in position 434 is any amino acid
  Variant (437)..(438): Xaa in position 437 to 438 is any amino acid
  Variant (440)..(440): Xaa in position 440 is any amino acid
  Variant (442)..(442): Xaa in position 442 is any amino acid
  Variant (444)..(458): Xaa in position 444 to 458 is any amino acid
  Variant (459)..(461): Xaa in position 459 to 461 is any or no amino acid
  Variant (463)..(470): Xaa in position 463 to 470 is any amino acid
NXGFXGXYXXVXXXXXXXXXXXXXCXXXXXXXXFXGXXAPXXEXXSVHFRGPLXLXXFXXYXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXWXRXXYYXXXXXXXXNXXFXXXXXXXXXXGXXSXCXGXXLXXAXXXGXXXAXXXXXLXXXXXXXSXXEXXIFSXXXCXXXXXXXXCGXYRXGIPAYXGFXGXXKXFXFEFXMPXXTXXXXXXXXXXDMPAIWLLNXXIPRTXQYXXXXXXXCSCWXXGCGEXDXFEVXXXXXXXXXXSXXHXXQGXXXXXXXXGXXXXXYXXRXTXGTXXGXVXFXXXXXXXXXXXXXXXXXXFXXXXXXXXV

SEQ ID NO: 6320 - protein, 20 aa, Artificial sequence
  protein pattern
  Variant (3)..(3): Xaa in position 3 is Phe or Leu
  Variant (4)..(4): Xaa in position 4 is Ala, Asp or Asn
  Variant (5)..(5): Xaa in position 5 is Asp or Glu
  Variant (6)..(6): Xaa in position 6 is any amino acid
  Variant (7)..(7): Xaa in position 7 is Phe, Leu or Val
  Variant (9)..(9): Xaa in position 9 is Phe or Val
  Variant (11)..(11): Xaa in position 11 is Phe or Leu
  Variant (12)..(12): Xaa in position 12 is any amino acid
  Variant (15)..(15): Xaa in position 15 is Ile or Leu
  Variant (16)..(16): Xaa in position 16 is any amino acid
  Variant (18)..(19): Xaa in position 18 to 19 is any amino acid
APXXXXXSXHXXGPXXLXXF

SEQ ID NO: 6321 - protein, 20 aa, Artificial sequence
  protein pattern
  Variant (2)..(2): Xaa in position 2 is any amino acid
  Variant (5)..(5): Xaa in position 5 is any amino acid
  Variant (6)..(6): Xaa in position 6 is Asp or Gly
  Variant (7)..(7): Xaa in position 7 is any amino acid
  Variant (8)..(8): Xaa in position 8 is Pro or Val
  Variant (11)..(11): Xaa in position 11 is any amino acid
  Variant (13)..(13): Xaa in position 13 is Phe or Tyr
  Variant (14)..(14): Xaa in position 14 is any amino acid
  Variant (16)..(16): Xaa in position 16 is Ala, Asp, Asn or Thr
  Variant (17)..(17): Xaa in position 17 is any amino acid
  Variant (19)..(19): Xaa in position 19 is Ile or Met
GXYRXXXXAYXGXXGXXKXF

SEQ ID NO: 6322 - protein, 31 aa, Artificial sequence
  protein pattern
  Variant (2)..(2): Xaa in position 2 is Gly or Asn
  Variant (3)..(3): Xaa in position 3 is any amino acid
  Variant (4)..(4): Xaa in position 4 is Asp, Glu, Asn or Ser
  Variant (5)..(5): Xaa in position 5 is Asp or Asn
  Variant (6)..(6): Xaa in position 6 is Gly, Ile or Leu
  Variant (7)..(7): Xaa in position 7 is Gly, Asn or Gln
  Variant (8)..(8): Xaa in position 8 is Gly or Thr
  Variant (10)..(12): Xaa in position 10 to 12 is any amino acid
  Variant (13)..(15): Xaa in position 13 to 15 is any or no amino acid
  Variant (17)..(17): Xaa in position 17 is Phe or Ile
  Variant (18)..(18): Xaa in position 18 is any amino acid
  Variant (20)..(20): Xaa in position 20 is any amino acid
  Variant (21)..(21): Xaa in position 21 is any or no amino acid
  Variant (23)..(23): Xaa in position 23 is any amino acid
  Variant (24)..(24): Xaa in position 24 is Ala, Gly, Ser or Thr
  Variant (25)..(27): Xaa in position 25 to 27 is any amino acid
  Variant (29)..(29): Xaa in position 29 is Ala, Gly or Val
  Variant (30)..(30): Xaa in position 30 is Ala or Val
  Variant (31)..(31): Xaa in position 31 is Phe, Ile or Leu
QXXXXXXXGXXXXXXYXXRXXTXXXXXGXXX

SEQ ID NO: 6323 - protein, 26 aa, Artificial sequence
  protein pattern
  Variant (2)..(2): Xaa in position 2 is any amino acid
  Variant (3)..(3): Xaa in position 3 is any or no amino acid
  Variant (5)..(5): Xaa in position 5 is Phe, Leu or Val
  Variant (7)..(7): Xaa in position 7 is any amino acid
  Variant (8)..(8): Xaa in position 8 is Ala, Gly or Ser
  Variant (9)..(9): Xaa in position 9 is Ile or Leu
  Variant (10)..(10): Xaa in position 10 is Ser or Thr
  Variant (11)..(11): Xaa in position 11 is Phe or Tyr
  Variant (13)..(13): Xaa in position 13 is Ala, Gly, Asn or Ser
  Variant (14)..(14): Xaa in position 14 is Asp, Glu, Ser or Thr
  Variant (15)..(15): Xaa in position 15 is Asp or Asn
  Variant (17)..(17): Xaa in position 17 is any amino acid
  Variant (18)..(18): Xaa in position 18 is Asp, Gly, Ser or Thr
  Variant (19)..(19): Xaa in position 19 is any amino acid
  Variant (21)..(21): Xaa in position 21 is Ala, Asp, Gly or Ser
  Variant (22)..(22): Xaa in position 22 is Asp, Glu or Ser
  Variant (23)..(23): Xaa in position 23 is Ala, Pro or Ser
  Variant (24)..(24): Xaa in position 24 is Asn, Gln or Thr
  Variant (25)..(25): Xaa in position 25 is Ala, Ile, Pro or Val
SXXCXGXXXXXAXXXGXXXAXXXXXL

SEQ ID NO: 6324 - protein, 9 aa, Artificial sequence
  protein pattern
  Variant (4)..(4): Xaa in position 4 is Glu, Gln, Ser or Thr
  Variant (7)..(7): Xaa in position 7 is Asn, Ser or Thr
  Variant (8)..(8): Xaa in position 8 is Ala, Asp or Glu
FEFXMPXXT

SEQ ID NO: 6325 - protein, 20 aa, Artificial sequence
  protein pattern
  Variant (2)..(2): Xaa in position 2 is any amino acid
  Variant (3)..(6): Xaa in position 3 to 6 is any or no amino acid
  Variant (8)..(8): Xaa in position 8 is Asp, Gly or Asn
  Variant (9)..(9): Xaa in position 9 is Gly, Gln or Ser
  Variant (10)..(10): Xaa in position 10 is Ser or Thr
  Variant (11)..(11): Xaa in position 11 is any amino acid
  Variant (12)..(12): Xaa in position 12 is Asp, Gln or Ser
  Variant (13)..(13): Xaa in position 13 is any amino acid
  Variant (14)..(14): Xaa in position 14 is Asp, Glu or Ser
  Variant (15)..(15): Xaa in position 15 is Ala, Asp, Ser or Thr
  Variant (16)..(16): Xaa in position 16 is Ile or Val
  Variant (17)..(17): Xaa in position 17 is Asp or Asn
  Variant (18)..(18): Xaa in position 18 is Ala, Asp, Ser or Thr
  Variant (19)..(19): Xaa in position 19 is any amino acid
  Variant (20)..(20): Xaa in position 20 is Ile, Leu or Val
TXXXXXFXXXXXXXXXXXXX

SEQ ID NO: 6326 - DNA, 996 bp, Saccharomyces cerevisiae
  CDS (1)..(996)
atgctgatgccaaagtcagttgcattactcagaataagatacactttggaagccgctctggcaagaggtttcacaacagtgagagactgtgggggtgcagaaggctttctgaaagcagagattcgtcagggatccttgaatggtcccagattaattacgtgtggacatgccatttcccaaactggtggtcatggcgatctgagatctggtgccctacctgctagtgcctttgacagctgttcatgccactttggtcaagttggtgttgtagcagatggtgttcccgaatgctacaaagcggccagagaagagtttagaagaggtgcagactttattaagattatgggtggtggaggtgtggcctctccaactgacaaaatatcaaacaaacaattttgcgacgacgaaataaaagcacttgtagatgtcgcaaatagttaccacacatacgtaacagcacacgcctacactgcggaagcgatacaaaattgtatcaagttaggtgttaagggtatcgaacacggaaacttattagatgaacgtaccgcagagcttatggcagaattgggttgctacttgactccaacactagttacctacaaagtgatgggttctgatcaatttagtgcattcttgggacctgaaaatagtagaaaaaatacagaggtgctttacaaaggaattgatgcaatgaaaattgcccagaaaaaaaaagttaaaatttgttttggttcagatttattgggtcctctatatggttatcaaacgcaagagtttcgtattagagggaaagttcaaacgacacaagagattttgctctcagcaactgttactcctgccgaaatgaacggattaggcgataaattgggacagattaagccagggttcattgctgacctactgatgatgaaatcaaatccgttggacgatataacgattttggatgaacccgagagcaacatactatttgtcatgaaagagggaaggatatattga

SEQ ID NO: 6327 - protein, 331 aa, Saccharomyces cerevisiae
MLMPKSVALLRIRYTLEAALARGFTTVRDCGGAEGFLKAEIRQGSLNGPRLITCGHAISQTGGHGDLRSGALPASAFDSCSCHFGQVGVVADGVPECYKAAREEFRRGADFIKIMGGGGVASPTDKISNKQFCDDEIKALVDVANSYHTYVTAHAYTAEAIQNCIKLGVKGIEHGNLLDERTAELMAELGCYLTPTLVTYKVMGSDQFSAFLGPENSRKNTEVLYKGIDAMKIAQKKKVKICFGSDLLGPLYGYQTQEFRIRGKVQTTQEILLSATVTPAEMNGLGDKLGQIKPGFIADLLMMKSNPLDDITILDEPESNILFVMKEGRIY

SEQ ID NO: 6328 - DNA, 1248 bp, Bradyrhizobium sp. ORS278
  CDS (1)..(1248): transl_table=11
atgcccacgatcctgttccagaacgccgccctgcttgatccgctgcagcccgagctgcgcgagggctcgcatgtgctggtcgaggacgggctgatcaaggaggtgtcggacaagccgctgcagaccgcggtggggcagaccatcgacctcaggggcaagacgctgatgcccggactgatcgacctgcatgtgcatgcgatcgctgtcgagctcaacctggcccagcaggtgcagatgccgaacgtgctggtgaccctgcgctcggcactgatcctgcgcggcatgctgcggcggggcttcacgacggtgcgcgacgccggcggcgccggctatccgctgaagcaggcggtcgacaccggcctcaccgaaggcccgcggctgttcgtctccggccgcgcgctgagccagaccggcggccatggcgacatgcgcgcgcgcaccgattttctctccgacaatgcgccatgcccgtgctgcgtccgggtcggcgcgctggcgcgcgtggccgacggtgtcgacggcgtgcgcaaggcggtgcgcgaggagctgcagatgggcgccgaccagatcaagatcatggcctcgggcggcgtcgcgtcgccgaccgatccggtcggcgcgttcggctattccgaggacgagatccgcgccatcgtcgccgaggcgagggggcgggggacctacgtgctggcgcatgcctacaccgcggaggcgatcgcgcgggcggtgcgctgcggcgtgcgcaccatcgagcacggcaacctcgtcgacctgccgaccgcgcggctgatggccgagcacggcgtctatgtgatcccgacgctcgttacctatgaggcgctcgcgaacgagggcgcgcaatacggcctgccgccggagagcgtcgccaagatcgccgacgtgcgcgacgccggccttcgctcgctgtcgatctatcgcgaagccggcgtcaaaatgggctatggcagcgaccttctcggcccgtcgcagcggctgcaaagcgacgagttccgcatccgcgccgagattgtcggcaaccgcgaggcgatcgccagcgccaccatgatcggcgccgaggtgctggggatggacggcaagctcggccgcatccagcccggcgcgatcgccgatctcctcgtcgtcgatggcaatccgctgcgcgacatctcctgtctgctcgggcagggcgatcacatcccgctggtggtgaaggccggccagatccacatcgacaggctgaacgcctga

SEQ ID NO: 6329 - protein, 415 aa, Bradyrhizobium sp. ORS278
MPTILFQNAALLDPLQPELREGSHVLVEDGLIKEVSDKPLQTAVGQTIDLRGKTLMPGLIDLHVHAIAVELNLAQQVQMPNVLVTLRSALILRGMLRRGFTTVRDAGGAGYPLKQAVDTGLTEGPRLFVSGRALSQTGGHGDMRARTDFLSDNAPCPCCVRVGALARVADGVDGVRKAVREELQMGADQIKIMASGGVASPTDPVGAFGYSEDEIRAIVAEARGRGTYVLAHAYTAEAIARAVRCGVRTIEHGNLVDLPTARLMAEHGVYVIPTLVTYEALANEGAQYGLPPESVAKIADVRDAGLRSLSIYREAGVKMGYGSDLLGPSQRLQSDEFRIRAEIVGNREAIASATMIGAEVLGMDGKLGRIQPGAIADLLVVDGNPLRDISCLLGQGDHIPLVVKAGQIHIDRLNA

SEQ ID NO: 6330 - DNA, 1185 bp, Bacillus halodurans C-125
  CDS (1)..(1185): transl_table=11
atgaaatattgtattcacaatacaagacttatcataggtatagctgatcgcgtaatcgaaaatggctccattttatttgatcaagataaaatccttaaagtgtcggcccattctattacagacgctgatgtgttcattgatgggacaactttttctgttctaccaggtttaattgacgttcacgtccatttaggaatggattgctcagtagatccatttgatacgatggaaaacacagaagatgcattcacttctttcattgcctataaacaagggctacaatttcttagagcaggtataaccaccgtaagaaatttaggtactaaaaacaacgtagatatcatttacaaaaaggctgttgaaagcggacttgtcattggaccaagggtgtacgcagctggtcaacctttaattatgacaggtggccatggacaacctatgggtacagaagtggacggaaaggatgaagtcattaaggccactcgccaacgaataaaagaaggagctgaccttattaaaataatggctactgggggcgtattaactaaaggaaatcatccaggagctgttcactttaatgtcgatgaacttaaatgcatctgtcaagaagcggcaaaagcttctttaaccacggccgcgcacgccataggcttaaatggggttaaaaacgcaatcaaagctggagtcaatacaatcgaacatggatattacttagataaggaaacggttgatacgatgagagatttagggatctatctcacacccactctcttggctccgacattacttcaaaaaaacagtgaacacattccacaacatatgatagataaaatagaagagattgaaaaggaacatagaaaaagtttccgactagctttagaaagaggcgttaaaatcatcgcgggtacagacgctgggaccccttttaataatcccggtcaacttgtagaagaattaaaaattatgttagaagaaggtatgacaactgctcaggccattgaatcggctacctatttaggcgctaagtgtcttaaagtcgattccttaataggatctcttgaggaacaaaaattggccgacctaattgtcgttaaaggaaatcctttagaagatataagcaacctcaagaatattcaacacgtgtttaaaggaggggttcgtctttacccggatcaaatccattga

SEQ ID NO: 6331 - protein, 394 aa, Bacillus halodurans C-125
MKYCIHNTRLIIGIADRVIENGSILFDQDKILKVSAHSITDADVFIDGTTFSVLPGLIDVHVHLGMDCSVDPFDTMENTEDAFTSFIAYKQGLQFLRAGITTVRNLGTKNNVDIIYKKAVESGLVIGPRVYAAGQPLIMTGGHGQPMGTEVDGKDEVIKATRQRIKEGADLIKIMATGGVLTKGNHPGAVHFNVDELKCICQEAAKASLTTAAHAIGLNGVKNAIKAGVNTIEHGYYLDKETVDTMRDLGIYLTPTLLAPTLLQKNSEHIPQHMIDKIEEIEKEHRKSFRLALERGVKIIAGTDAGTPFNNPGQLVEELKIMLEEGMTTAQAIESATYLGAKCLKVDSLIGSLEEQKLADLIVVKGNPLEDISNLKNIQHVFKGGVRLYPDQIH

SEQ ID NO: 6332 - DNA, 1275 bp, Methanothermobacter thermautotrophicus str. Delta H
  CDS (1)..(1275): transl_table=11
ttgtatatatattttccttacagaattgaaggtgaccataagggtattttcaggggtttttacatgagatttgcagtgaagggtgaatttctggacatctattcaggggagcatgaaaggaggtacgtgcttgttgataaggggaggataaccgccattgagagtagtgtcacaggtgttgaggttattgatgcctctgataagttcattctaccaggcttcattgacctgcacacccatctaatggaggatgggttcaggacagagagcaaacttgaggatccactctcactctacttctacggggcccttgacaatatgagggcaaccctccaggcaggtgttacaacggtaagggatgcgggtcttgcagacctcggtgttaagatggcctccgaccggcacatcatccaggcgccccggatgcagataagcgtcacgcccctatcaatcacgggggggcacttcgactttcacacaagatcaggactcaacattgaaaggagatacagggggctaccctccggtatctgtgatgggatcccatctgtgaggaagaggacgagggaggtcctgagggctggggcggatgttgttaaggtaatggcgactggtggagtcatgagcagcacggacagaccatcggacacccagttcacaccgtcagaacttgcagccatagttgaggaggcatcattcaggggtaaaaatgttatggtccatgcccatggtctccaggggataaagaattccataaaggcgggtgttcattcagttgaacatggaacatacctggataaaaggaccgccaggttgatggctgaaaggggcgtctacctggtaccaacattcctggtaacccgcctcaacaatgataaggccctgaggggagaactggcggaatacagccgcagggacgccattgaggtggcagaagtccaccgggagaacatggagatggcctacaatgagggtgtgcggatggttatgggcacagattcaggtgttgttgagcatggaatgaacctgcttgaactatcctaccttacagagaccggcatggagccactggaagccataagggctggaaccatacatgcagccgaatgcatggggtgggaggaccggataggttcaatagaaaagggtaaaattgcagatattgttgtaactgaggtgaatccggtggaggagatagacgaactttccaggcccgggaacgtgctcctggttgtgagggatggcataatctacagggatgagctggtctattga

SEQ ID NO: 6333 - protein, 424 aa, Methanothermobacter thermautotrophicus str. Delta H
MYIYFPYRIEGDHKGIFRGFYMRFAVKGEFLDIYSGEHERRYVLVDKGRITAIESSVTGVEVIDASDKFILPGFIDLHTHLMEDGFRTESKLEDPLSLYFYGALDNMRATLQAGVTTVRDAGLADLGVKMASDRHIIQAPRMQISVTPLSITGGHFDFHTRSGLNIERRYRGLPSGICDGIPSVRKRTREVLRAGADVVKVMATGGVMSSTDRPSDTQFTPSELAAIVEEASFRGKNVMVHAHGLQGIKNSIKAGVHSVEHGTYLDKRTARLMAERGVYLVPTFLVTRLNNDKALRGELAEYSRRDAIEVAEVHRENMEMAYNEGVRMVMGTDSGVVEHGMNLLELSYLTETGMEPLEAIRAGTIHAAECMGWEDRIGSIEKGKIADIVVTEVNPVEEIDELSRPGNVLLVVRDGIIYRDELVY

SEQ ID NO: 6334 - DNA, 1191 bp, Sulfolobus solfataricus P2
  CDS (1)..(1191): transl_table=11
atgataactctcgtagggaaaatattcgacggagaaaaaattattgaacaaggtactgtagttatagagaatgataaaatcgaaagagttagtgaaggaattgatatcccgcaaggaagtgaagtaattcaagctaatttcataatgcctggtttagttgatgcccatttgcatttcttcggagttgaagaggataacgtcctttcctggaatatagtaaacgaaattgatgtagcaataaggagtactagagacatggagagactgctacgttccgggttcactctagttagggatttaggaagtaaggttgctgtaaggctagattaccttcagagaaggggagagatattgggaccgaccgtcattgcctctggatactctttagcaatcactggcggtaatgatgatccaaaggatttgccaatagatattgcgcagaggctctcatattcattttactgtgattctccttatgagtgtagaaaagctgtgagaatggcaattagacaaggggctagggtaataaaagtttacgcgtctggagccttttcccaaggtggaaaaattctgcctggatttgcattggatgagctcaaggctatagttgacgaatctcacagatttggtttaaaagtcgcatctcatgcctatggaaaagaggcaattatgaactccattctagctggtgtggatacaatagaacacggtttagggttagacgatgagactgcaagtatgattaaagagaggggaatttgctatattccaacattagctacttatgaagtaccatttgaggtaagggatcctgaggttaggatttacagagaagagcttgtcaagagacattttagtgaggacattaggattgctgtttcccacggggtgaaaatagctaccggtacggattatgtgggatctaagaaaagacctcatggacagaattatagagagtccgttctcctatctagatatatgagtaatttagaagtactaagagcatcaacatcaatagcttcagaatgtcttggtgtcaaggtgggttacataagggaaggatataaggctgacttaatagtattaaaggatgaccccactagagatattgagaacttgaaacctaataatgtctcatatgtcattaaagatggtaagttgtatactggttatggattataccaagaataa

SEQ ID NO: 6335 - protein, 396 aa, Sulfolobus solfataricus P2
MITLVGKIFDGEKIIEQGTVVIENDKIERVSEGIDIPQGSEVIQANFIMPGLVDAHLHFFGVEEDNVLSWNIVNEIDVAIRSTRDMERLLRSGFTLVRDLGSKVAVRLDYLQRRGEILGPTVIASGYSLAITGGNDDPKDLPIDIAQRLSYSFYCDSPYECRKAVRMAIRQGARVIKVYASGAFSQGGKILPGFALDELKAIVDESHRFGLKVASHAYGKEAIMNSILAGVDTIEHGLGLDDETASMIKERGICYIPTLATYEVPFEVRDPEVRIYREELVKRHFSEDIRIAVSHGVKIATGTDYVGSKKRPHGQNYRESVLLSRYMSNLEVLRASTSIASECLGVKVGYIREGYKADLIVLKDDPTRDIENLKPNNVSYVIKDGKLYTGYGLYQE

SEQ ID NO: 6336 - DNA, 1227 bp, Sulfolobus solfataricus P2
  CDS (1)..(1227): transl_table=11
atggagctagccataagaaacgggatcgtttttaacggaaaagaaataataggaaaaactaacatctatgtgagagaaggaaaaattgtagaagtctctagagaagatcacagtgcgaaaatggaaattgatgccaaagacatgtttgtaatgcccggattaattgacgctcatattcatctttctggaatcaaaggtggtagtctattaaagataatgtttgagaaaccagaatatagggtacttcgcgctgctaaatggctagaaaagctactgttagctggatttacaactgtcagggactgtggagaaacagtgtctttagccttaaagagggctttaaatgacggaattataggtgggcctaaggtaattgctgccggcaaacctattacacagacttttggacatggggaattaagtcatgatgtaccgttagagttctcaaaaaccatgagcttttctgaattttgtgacggaatggaatcatgtattcacgctgccaggaaagttctaagggatggcgctgatttcatcaaaatattcgcaactggcggagtgctatcacagagggatagaccagaacatccccagctaagttacgaggagattagggcaatagttaacgaagctgaaaaagtcaatacttacgtagcagctcatgctcatggagatagaggagcaaggattgcaatagaggctggagtaaaaacgttagaacacggtaccttacttaaggatgagacgctaaagttaatgaaggagaaaaacgtaacgttaactccaacattgacgattcaagagttaatattcaaatatggtaaacagattggagtcgatgagtggggactccaaaagatcacttccgtaagggagaatattgcaaatgttgttagaaaagctaaggagtatggagttacgataataagtggtactgatttgggttttgaaacgggattagaggagattgatatgggaaagaattggatggagactgttttacttgttgaaagaggagggctgtctccaatagaggctttaagagcctcaacttataatgctgcgatggctattggaattaacgctggtgtaatagagattggaaaagatgctgatatcataatcattaatggtgatcctacgctaaatgtgagggaaatatctaagattacacatgtagtcaagaatggaaaattaacggtggagaataagtcaattaagggttag

SEQ ID NO: 6337 - protein, 408 aa, Sulfolobus solfataricus P2
MELAIRNGIVFNGKEIIGKTNIYVREGKIVEVSREDHSAKMEIDAKDMFVMPGLIDAHIHLSGIKGGSLLKIMFEKPEYRVLRAAKWLEKLLLAGFTTVRDCGETVSLALKRALNDGIIGGPKVIAAGKPITQTFGHGELSHDVPLEFSKTMSFSEFCDGMESCIHAARKVLRDGADFIKIFATGGVLSQRDRPEHPQLSYEEIRAIVNEAEKVNTYVAAHAHGDRGARIAIEAGVKTLEHGTLLKDETLKLMKEKNVTLTPTLTIQELIFKYGKQIGVDEWGLQKITSVRENIANVVRKAKEYGVTIISGTDLGFETGLEEIDMGKNWMETVLLVERGGLSPIEALRASTYNAAMAIGINAGVIEIGKDADIIIINGDPTLNVREISKITHVVKNGKLTVENKSIKG

SEQ ID NO: 6338 - DNA, 1224 bp, Sulfolobus solfataricus P2
  CDS (1)..(1224): transl_table=11
ttggatttaggaataaagaatggtaacgtatttaatggtaaaggagttgtgggaaaggttaatatttacgtaaaggatggtaaaattgtagagatatctaaagagaataagcaagctaaaattgagatcgatgccaaagatatgtttgtaatgcccgggctaatagatgcgcatattcaccttactggtattaaaggagggagtttgttaaaaacaatgtttgagaaaccagagtatagagtgttaagggcttctaagtggctagagaaattgctgttagctgggttcactactgttagagattgtggcgaaacaatatcattagctctaaagagaggcgtgagtgaagggataataaatggacccagaattattgcagcgggaaagcctataagtcaaactttcggacatggcgaactaagtcatgatgttcccttagagttttcgatggcattaagtttttcagaattttgtgacggagtagaatcatgtattcgcgcatcaaggaaagttttaagagatggagctgactttattaaaatatttgctactggaggagtattatcacaaagagataggccggaacacccacagctgagctacgaggagattagtgcaatagttaatgaagctgaaaaaataaatacttatgttgctgctcacgctcatggggataaaggagccagaatcgctgttgaggctgggataaagacattagagcatggaactctacttagggacgagacattaaagcttatgagagagagaaatgtaaccttaacacccacgcttacaatccaagaattaatatataaatatggtaagcaaataggagttgatgagtgggggctacaaaagatcaacgaagtaagagagagcgttgtaaatgtagttaaaaaggcagaggagtatggagtcatgataataactggaacggatttgggttttgaaactggattagaggaaatagatataggtaaaaattggatggaaagtgtgctcttggtagaaagaggaggtttatctacaattagttcattaagagcctcaacctataattcggcgtttgccattggaattaacgctggagccatagaagtggggaaggatgccgatatcatagtaatagatggagatccaactgaaaacataagggatctatctaaagttagaagagtagttaaaaacggtaagttaactgtagaagatggtaagttcttgtaa

SEQ ID NO: 6339 - protein, 407 aa, Sulfolobus solfataricus P2
MDLGIKNGNVFNGKGVVGKVNIYVKDGKIVEISKENKQAKIEIDAKDMFVMPGLIDAHIHLTGIKGGSLLKTMFEKPEYRVLRASKWLEKLLLAGFTTVRDCGETISLALKRGVSEGIINGPRIIAAGKPISQTFGHGELSHDVPLEFSMALSFSEFCDGVESCIRASRKVLRDGADFIKIFATGGVLSQRDRPEHPQLSYEEISAIVNEAEKINTYVAAHAHGDKGARIAVEAGIKTLEHGTLLRDETLKLMRERNVTLTPTLTIQELIYKYGKQIGVDEWGLQKINEVRESVVNVVKKAEEYGVMIITGTDLGFETGLEEIDIGKNWMESVLLVERGGLSTISSLRASTYNSAFAIGINAGAIEVGKDADIIVIDGDPTENIRDLSKVRRVVKNGKLTVEDGKFL

SEQ ID NO: 6340 - DNA, 1185 bp, Sulfolobus tokodaii str. 7
  CDS (1)..(1185): transl_table=11
atgataagtttaattggaaagatttttgatggagagaaaataattgaaaagggaactgttgttatagatggagataaaatagtcaaaatagtagaagaagagagtaaagaaggagaagttatatacggaaatttcataatgcctggtttaattgatacccatatacatttcttcggtgtagatgaggataatcttctgtcatggaatctcgttaacgaaattgacgtcgctataagaagtacgagagatatggaaaggattttaagatcggggtttacaaccgttagggatttagggagtaaagtagcggttaatttagccagattacaaagaaaaggtgagatcataggacctactgtcattgcttctggatactcgttatcaataactggaggtaatgatgaccccaaatcattacctattgacatagctcaaaggctttcatattccttctattgtgattccccatatgagtgcagaaaggccgtaagaatggcgataaggcagggtgcaacagtaataaaagtttatgcttctggtgcattttctcaaggaggaaaaataatgccgggattttcactagatgagttaaaagcaattgttgaagaggctcatagaaatggacttaaagttgcgtctcatgcctatgggaaggaagctattatgaactcagtcctagctggagttgatacgatagaacatggtttaggcttagatgaggaatctgccactttaattaaagaaaaaggagtatgttatatacctacattagcgacttacgaaataccatttgaagtagatccaatagttagaccatttagagaagaactagttaaaaggcacttcactgaagatatgagaattgcaatatctaaaggtttgaaaattgcattgggaactgattatgtaggatctaaacaaagacctcacggaaaaaattatagagaagctgtactactttcaagatatatgccaaatgtagaagtattaaaatctgcaacttctatagctagtgaatgcctaggattacacaatgttggcagaataagagaaggttataacgctgatgtaatcgtattaaacgctgatcccttaaatgacatagaaaacttatcaccacaacatataatgtatgtgataaaagaagggcaaaagtataaaggttatgctctttttaatgattaa

SEQ ID NO: 6341 - protein, 394 aa, Sulfolobus tokodaii str. 7
MISLIGKIFDGEKIIEKGTVVIDGDKIVKIVEEESKEGEVIYGNFIMPGLIDTHIHFFGVDEDNLLSWNLVNEIDVAIRSTRDMERILRSGFTTVRDLGSKVAVNLARLQRKGEIIGPTVIASGYSLSITGGNDDPKSLPIDIAQRLSYSFYCDSPYECRKAVRMAIRQGATVIKVYASGAFSQGGKIMPGFSLDELKAIVEEAHRNGLKVASHAYGKEAIMNSVLAGVDTIEHGLGLDEESATLIKEKGVCYIPTLATYEIPFEVDPIVRPFREELVKRHFTEDMRIAISKGLKIALGTDYVGSKQRPHGKNYREAVLLSRYMPNVEVLKSATSIASECLGLHNVGRIREGYNADVIVLNADPLNDIENLSPQHIMYVIKEGQKYKGYALFND

SEQ ID NO: 6342 - DNA, 1287 bp, Caulobacter crescentus CB15
  CDS (1)..(1287): transl_table=11
atgcgtaaattgatggcgggcgcctgcgccctggttgtgacgagcgcgctggccggcgcggccaacgctcaggcgacgttcgtccaggcgggacgcctgctcgctgaccccgcgacgggcaaggtcgagatcgccaagaccctggtcctcgaaaacggcaaggtgacgcgcatcctcgacggttatgtcgccgagcccggcggcaaggtcgtcgatctgaaggacagcttcgtcctgccgggcctgatcgacagccacgtccacctgaccggccagcagaacccgaacggacgcctgcaggccgtgacgcagtcgccgtccgacagcgccatggtcggggccggcttcgcccgcaagacattgatggccggcttcacgaccgtggccaatctgggcgctaacagccaggcgatcttcgctctgcgggaaggcgtcaagcgcggcgacgtggccgggccccgcatcctggcgtcgggctcgtcgatctcggtccatggcggccatggcgacatcaacggctatagcgaggacgtcatgcacgccttgcggccggaatcggtctgctcgggcgcggacgactgccgacgcgcggtgcgggagcagatctggctgggcgccgacctcatcaagatcacggcgacgggcggcgtgctgtccaacaccgccgcgggcctcgccaagcagttctccgacgccgagctggccgcgatcgtcgagtccgcccacagcatgggccgtaaggtgaccgcccacgcccatggcggcgacggcatcaacgccttcctcaaggcgggtggcgactcgatcgagcacggcacctatctcgacaacgagggcatcgccctgatgaagaagtccggggcctatctggtgcccaccctgatggccggcgacttcgtctatcggatcgcttcgggtccgaacaactacttcacccccgcccaaacggccaaggcgctcgaggccggccccaagatgctcgacatggttcgccgcgcgcacgccgacggcgtcaaggtcgccttcggcaccgacagcggcgtctcggcccacggcgacaacgccggggagttcgccctgctggtcaaggcgggcatgaccccgctggaggccatccagaccgccacggtcaacgccgccgaccacttctcgctcagcaacgagatcggcagcctcacgcccggcaaggcggcggacctgatcgcggtgaagggcgatcctctgaaggatgtcaccgaactccagcgcgtgacctcggtcatcaagggcggcgtcgtctacaagtaa

SEQ ID NO: 6343 - protein, 428 aa, Caulobacter crescentus CB15
MRKLMAGACALVVTSALAGAANAQATFVQAGRLLADPATGKVEIAKTLVLENGKVTRILDGYVAEPGGKVVDLKDSFVLPGLIDSHVHLTGQQNPNGRLQAVTQSPSDSAMVGAGFARKTLMAGFTTVANLGANSQAIFALREGVKRGDVAGPRILASGSSISVHGGHGDINGYSEDVMHALRPESVCSGADDCRRAVREQIWLGADLIKITATGGVLSNTAAGLAKQFSDAELAAIVESAHSMGRKVTAHAHGGDGINAFLKAGGDSIEHGTYLDNEGIALMKKSGAYLVPTLMAGDFVYRIASGPNNYFTPAQTAKALEAGPKMLDMVRRAHADGVKVAFGTDSGVSAHGDNAGEFALLVKAGMTPLEAIQTATVNAADHFSLSNEIGSLTPGKAADLIAVKGDPLKDVTELQRVTSVIKGGVVYK

SEQ ID NO: 6344 - DNA, 1290 bp, Caulobacter crescentus CB15
  CDS (1)..(1290): transl_table=11
atgcgtatggggatgaagatcgcgacgctgatggcgggcgcggcggtgggtctgaccttgggcggcgcggccagcgcggccgagatcaaggccgtcagcgctgcacgcctgctggacgtggcgagcggcaagtatgtcgacaaccccctggtcatcgtcaccgacggccgcatcaccagcatcggcaagaagggcgacgcggttccggccggcgccacggccgtcgacctgcccggcgtgaccctgctgccgggtctgatcgacatgcacgtgcacctcgacagcctggccgaggtgggcggctataacagcctcgaatacagcgaccgcttctggagcgtggtgcagaccgccaacgccaagaagacgctggaggccggcttcaccacagtgcgcaatgtcggcgcggccgactatgacgatgtgggcctgcgcgaggccatcgatgccggctatgtgcccggtccccggatcgtcaccgccgccatctcgttcggcgccaccggcggtcactgcgactcgaccttcttcccgccgtcgatggaccagaagaaccccttcaacagcgacagcccggacgaggcgcgcaaggccgtgcggacgctgaagaagtacggcgcccaggtgatcaagatctgcgccacgggcggggtcttctcgcgcggcaacgagccgggccagcagcagctgacctatgaggagatgaaggccgtcgtcgacgaggcgcacatggcgggcatcaaggtcgccgcccacgcccacggcgcctcgggcatccgcgaggcggtgcgggccggggtcgacaccatcgagcacgccagcctggtcgacgacgagggcatcaagctggccgtccagaagggcgcctacttttcgatggacatctacaacaccgactacacccaggccgagggcaagaagaacggcgtcctggaagacaatctgcgcaaggaccgcgacatcggcgagctccagcgcgagaacttccgcaaggcgctgaaggccggggtgaagatggtctacggcactgacgccggtatctatccgcacggcgacaacgccaagcagttcgcggtgatggtccgctatggcgccacgccgctgcaggcgatccagtcggcgaccctgaccgccgccgaggcgcttggccgcagcaaggacgtcggccaggtggcggtgggccgctatggcgacatgatcgcggtggccggcgatccgctggccgacgtcaccacgctggaaaagccggtcttcgtgatgaagggcggcgcggtggtgaaggccccgtag

SEQ ID NO: 6345 - protein, 429 aa, Caulobacter crescentus CB15
MRMGMKIATLMAGAAVGLTLGGAASAAEIKAVSAARLLDVASGKYVDNPLVIVTDGRITSIGKKGDAVPAGATAVDLPGVTLLPGLIDMHVHLDSLAEVGGYNSLEYSDRFWSVVQTANAKKTLEAGFTTVRNVGAADYDDVGLREAIDAGYVPGPRIVTAAISFGATGGHCDSTFFPPSMDQKNPFNSDSPDEARKAVRTLKKYGAQVIKICATGGVFSRGNEPGQQQLTYEEMKAVVDEAHMAGIKVAAHAHGASGIREAVRAGVDTIEHASLVDDEGIKLAVQKGAYFSMDIYNTDYTQAEGKKNGVLEDNLRKDRDIGELQRENFRKALKAGVKMVYGTDAGIYPHGDNAKQFAVMVRYGATPLQAIQSATLTAAEALGRSKDVGQVAVGRYGDMIAVAGDPLADVTTLEKPVFVMKGGAVVKAP

SEQ ID NO: 6346 - DNA, 1296 bp, Caulobacter crescentus CB15
  CDS (1)..(1296): transl_table=11
atgaaactgcacgtgttttgcgtcgccgccctcgcaacgctgcttccggctgtcgccgcagcgcaggtctcgtatgtccgcgccggcaagctggtcgatccccaggccggcaaggtgctgaccgaccagatcctccgcatcgagggcgagcgcatcgtttcggtggggccctggaagggcgcgcccaaggacggccccaaggacgccaaggtcaccgactggtcgggtctgaccgtgctgcccggcctgatcgacatgcacacccacctcgtcgacgacgagcagagcgagaacatcgccctgccgctgctgcgctcggccgcccagcaggcctatatcggcgcgggccatgcgcgcacgaccctgatggccggcttcaccagcgtgcgcgatgtcgggacctggcgggcgctcggcgacgcggccctgcgcgacgccatcaccgaggggctcgtgcccggaccgcgcatgtcggtggccggcgcctatgtcaccgcgccgggcgggggcggggagatcaccggcgtcgcgccggatgtgacgatcccggccgacatgcggcgcggcgtggtcgaggacgccgccgacgtccacagaaaagtccgcgccctgctggtcggcggcgccgacttcatcaagctgatcgccacgggcgccgtcctgactgagggcaccgagcctggccagcttgagctgtcggaagaggaaatccgcgccgccgtcgaggaggccgccaagcgcgggacctatgtcaccgcccacgcccacggcgccgaggggatcaagatcgccgtccgcgccggggtgcggtcgatcgagcatggctcgctgatcgacgacgaggggatcgccctgatgaaggccaagggcgcgttcctggtggccgacatctacaatggcgacttcatcgacacctatggccgcgagcacggttggccggcgggcatgatccgcaagaaccgcgagaccaccgacgcccagcgcgagggcttccgcaaggcggtcaaggccggggtcaagatcgcctacggcaccgacgccggcgtctatccgcacggctggaacgcccggcagatgccctacatggtcaggtacggcatgacgccgatgcaggcgatccagtcagcgaccaccgtggcggccgagctgatgggcaagaccggccaggtcggctgccatgcgcccggctgctacgccgacctgatcgccgtggcgggtgatccgctggcggatgtttcggtgctgaccaaggtcgcgaaggtcatgaagggcgggaccgtggtcaaggacgactag

SEQ ID NO: 6347 - protein, 431 aa, Caulobacter crescentus CB15
MKLHVFCVAALATLLPAVAAAQVSYVRAGKLVDPQAGKVLTDQILRIEGERIVSVGPWKGAPKDGPKDAKVTDWSGLTVLPGLIDMHTHLVDDEQSENIALPLLRSAAQQAYIGAGHARTTLMAGFTSVRDVGTWRALGDAALRDAITEGLVPGPRMSVAGAYVTAPGGGGEITGVAPDVTIPADMRRGVVEDAADVHRKVRALLVGGADFIKLIATGAVLTEGTEPGQLELSEEEIRAAVEEAAKRGTYVTAHAHGAEGIKIAVRAGVRSIEHGSLIDDEGIALMKAKGAFLVADIYNGDFIDTYGREHGWPAGMIRKNRETTDAQREGFRKAVKAGVKIAYGTDAGVYPHGWNARQMPYMVRYGMTPMQAIQSATTVAAELMGKTGQVGCHAPGCYADLIAVAGDPLADVSVLTKVAKVMKGGTVVKDD

SEQ ID NO: 6348 - DNA, 1443 bp, Sinorhizobium meliloti 1021
  CDS (1)..(1443): transl_table=11
atgatcgtcatgtgtcaaaaaacccctggatcgcggcagttggcgcgttgcaatgctgtagtgcatgcggtcactcgcgccgaagcgttgttccttcttgcgcgccccgttttcactttgcttcgctcaggcagagaaatgcttgcggcggctctcgttctcggactttgcgccacggccagcgccgacgacgtgcttttcgagaacgtccgcatctttgacggaaaaggtgcggttctttcggcgccgtcgaatgttctggtcaagggcaatgtaattgcggcgatttcgacaagcccaatcgagggggaaggcgctgagcgaattgccggcgacgggcgaaccctgatgccgggcctgatcgatgcgcactggcatgccatgttggccgcgtccagcccggcggaagcaatgggcgacgtcagcttcgcaagcatcctggccggcgaggaggcgacggataccctgatgcgcgggttcactactgtccgcgacttggggggaccggcgttcggcctcaagcgagcgatcgaccaaggcatcatccctggaccgcgcatctatgcatccggtgccatgatcacagtcaccagcgggcatggcgatttccgccagctcaccgacttgccgcggagaaccggcggtctgctcacccccatggagacggtcgggggtgcgatggtcgtcgacagcccggacgaggtgcggttgcgcgtccgcgaacagttcatgcagggagccgttctgatcaagctaacggcgggcggcggggtgtcctcacccttcagcccgctcgatgtcaccaccttcaccgagcccgaactgcgggccgccgttgaaattgccgagaattggggcacctacgttgccgcgcatgccttcacctctgatgcgatacggaaagccatcgcggctggtgtgaagtgcatcgaacacggcttcctcatggatgaggccaccgccaggctgatcgctgaaaatgacatttggctgagcttgcagccgcttcccgaattgatgaggacaggcctccgggacggttcggtcgagcgcgccaaggcagatgaggtatggccgggcatcggcagaacatacgaactagcaaagaggtacaagatcaagaccgcgtggggcacggacgtcctgttctcccgcgcgctggcgaagcagcagggagcaatactggcttcgctcgtgcgttggtacacgcctgccgaagcgctcgtcatggcgacagcgaccaatgccgaactgctggcgctttcgggccaacgcaacccctatccgggaaagctgggcgtcatcgaagaagacgctctcgcggacctcctcctcgtcgaaggcaatccgctggagaatatcgacctggtggccgatcctgccaacagcttcaaaatcatcatgaaggacggcgtgatctacaaaaacacactcaccccgtga

SEQ ID NO: 6349 - protein, 480 aa, Sinorhizobium meliloti 1021
MIVMCQKTPGSRQLARCNAVVHAVTRAEALFLLARPVFTLLRSGREMLAAALVLGLCATASADDVLFENVRIFDGKGAVLSAPSNVLVKGNVIAAISTSPIEGEGAERIAGDGRTLMPGLIDAHWHAMLAASSPAEAMGDVSFASILAGEEATDTLMRGFTTVRDLGGPAFGLKRAIDQGIIPGPRIYASGAMITVTSGHGDFRQLTDLPRRTGGLLTPMETVGGAMVVDSPDEVRLRVREQFMQGAVLIKLTAGGGVSSPFSPLDVTTFTEPELRAAVEIAENWGTYVAAHAFTSDAIRKAIAAGVKCIEHGFLMDEATARLIAENDIWLSLQPLPELMRTGLRDGSVERAKADEVWPGIGRTYELAKRYKIKTAWGTDVLFSRALAKQQGAILASLVRWYTPAEALVMATATNAELLALSGQRNPYPGKLGVIEEDALADLLLVEGNPLENIDLVADPANSFKIIMKDGVIYKNTLTP

SEQ ID NO: 6350 - DNA, 1263 bp, Xanthomonas campestris pv. campestris str. ATCC 33913
  CDS (1)..(1263): transl_table=11
atgtcggcgttgctggtcgccgcagggtgcgcgtgcacatcgctgagcgcgcacgcccagaccaccgtcatcaccgccgcccgcctgctggatgtgcaggcaggacgctatgtggagcgcccgcagatcgacgtcgtcgccggccgtatcacgcgtgtcggtcgccagggcgacccgctgccaccacaggcgcagcgcatcgacctgggcgagcgcacgctgttgcccgggctgatcgacatgcatgtgcatctcaccgtggatcccacattgggcggctacaagggcctggaatacaccgacaatttctggaccgtggtgggcgtggccaatgccgccaagacgctccgcgcagggttcaccacggtgcgtaatgttggttcgctcaactacgacgatgtcgcgctcaagcaggcgatcgagcgcggcaccgtgccggggccgcgtatcgtgccggcgacctacggcatcggcgcgaccggagggcactgcgatgccaccgagttcccgccatcggtgcgcgtcaccggccccggtgtggccgatggcccggatgcgatccgcgcggcggtacgcacgctgcgcaaatacggcgccgaagtgatcaagttctgcggcaccggcggcgtgctgtccaagaccgacagcgttggcgggcagcaatacagcctggaggaaatgcgcgcgctggtggacgaggcgcatcgcctgggcttgaaggtcgccgtgcatgcgcacggcaccgccggcatcaacgatgcgatccgtgccggcgccgacaccatcgagcacgccagcctggccgatgccgaatccttcaagctggccaaggcgcacggcacctggttttcgatggacatctacaacgacgactacatcctggccgagggcgaaaagaacggtttgtttgccgagtcgctggagaaggagcgccagatcgggcgcaagcaacgcgagacctttcgcgccgcacatgtggcgggcgtgcggctggtgttcggtagcgatgccggcgtgtatcccaacggcgacaacgcgcgccagttcgccaagatggtggagtggggcatgaccccgctggaggcgattcgcgccgccaccgtagacgccgccgatgcattggggcgcagtgccgacgtcggcgccatcgcgccggggcgctatgccgatctgatcgcggtgagcggcgatccgctgcaggacgtgagcgtgctgatgcaggtggagagcgtgatcaagggcggcgaacgcgtcgccgattga

SEQ ID NO: 6351 - protein, 420 aa, Xanthomonas campestris pv. campestris str. ATCC 33913
MSALLVAAGCACTSLSAHAQTTVITAARLLDVQAGRYVERPQIDVVAGRITRVGRQGDPLPPQAQRIDLGERTLLPGLIDMHVHLTVDPTLGGYKGLEYTDNFWTVVGVANAAKTLRAGFTTVRNVGSLNYDDVALKQAIERGTVPGPRIVPATYGIGATGGHCDATEFPPSVRVTGPGVADGPDAIRAAVRTLRKYGAEVIKFCGTGGVLSKTDSVGGQQYSLEEMRALVDEAHRLGLKVAVHAHGTAGINDAIRAGADTIEHASLADAESFKLAKAHGTWFSMDIYNDDYILAEGEKNGLFAESLEKERQIGRKQRETFRAAHVAGVRLVFGSDAGVYPNGDNARQFAKMVEWGMTPLEAIRAATVDAADALGRSADVGAIAPGRYADLIAVSGDPLQDVSVLMQVESVIKGGERVAD

SEQ ID NO: 6352 - DNA, 1233 bp, Oceanobacillus iheyensis HTE831
  CDS (1)..(1233): transl_table=11
atgacaactttactgataaaaaacggattatttatagatggaaatggtggtgaaccacaaaaggatgcagttattgtagtaaaagataatcaaattgcttacgtaggaccagaaacagcttattcaagtagtggcgaggagcaagttgtagatgccgagggcggaacaatacttcctggaatgattgatacacatgtgcatatgatgatggaattttctccagttgcagaaagattggagacacctttttcttttatgtattatcaagcagcgaaatatttagaaaccacattaaaagcaggaatcacctctgtaagagacgcacttggtactgatcttggtgtgaagaaagcggtagaagaaggtttgatttcaggaccacgcttacaattaagtatcaatgcgcttacgattaccggtggacatggagatggttatactgtttctggacgtgaagttgacttactgccttcggattatccaggcatgccaagtgggaaatgtgatggtgtagaagaagtgcgtaagaagacacgtgagatgttacgtgccggagcagaaattattaaggtacatgctactggtggtgttctaagtgctacggatcatccagagtttactcaattttcgcaagaggaactagagacgattgtagaagaagggcgcttccgaaaaggagtcaaagtaatggcgcatgctcaaggtgctgaaggaattaaaaacgcagtaagagcaggggtacattcgatagaacatggaatatttcttgatgatgaggcaattgatttgatgatagaaaaaggcacgttccttgttcctacattacttgcaccagttgctgtactagaaacagctaaagagacgggtatgcctgatacggcagtacaaaaatcaaaagaagttattgaaattcataaagctagtattgctaaagcccataaagccggtgttaaaattgcaatgggaactgatgctggtgtgatgaagcatggaacaaatttacgtgagctaggtttgatgacagaagcagggatgacagcgatggaggcgattgttgcttcaacaaaaacagccgccgaatgtttgggatggcaagacagagttggtaccattgaagaaggaaagttagcagatataattattgttaatggcaatccattagacgatattaacctgctagcgaataatgaaaatataacaaccgtcattaaagacgggaaaatagaaaaatag

SEQ ID NO: 6353 - protein, 410 aa, Oceanobacillus iheyensis HTE831
MTTLLIKNGLFIDGNGGEPQKDAVIVVKDNQIAYVGPETAYSSSGEEQVVDAEGGTILPGMIDTHVHMMMEFSPVAERLETPFSFMYYQAAKYLETTLKAGITSVRDALGTDLGVKKAVEEGLISGPRLQLSINALTITGGHGDGYTVSGREVDLLPSDYPGMPSGKCDGVEEVRKKTREMLRAGAEIIKVHATGGVLSATDHPEFTQFSQEELETIVEEGRFRKGVKVMAHAQGAEGIKNAVRAGVHSIEHGIFLDDEAIDLMIEKGTFLVPTLLAPVAVLETAKETGMPDTAVQKSKEVIEIHKASIAKAHKAGVKIAMGTDAGVMKHGTNLRELGLMTEAGMTAMEAIVASTKTAAECLGWQDRVGTIEEGKLADIIIVNGNPLDDINLLANNENITTVIKDGKIEK

SEQ ID NO: 6354 - DNA, 1344 bp, Pseudomonas putida KT2440
  CDS (1)..(1344): transl_table=11
atgagtgccctgcacctgcactgctccaccctgttcgacggcactggcctgcacacccgccaacgacagacattgatcatcgaagacggcgtgatccgccatgtcgggccaaccgccgaggcaccccgtccacaacccggcgaccgtgaagcccacggccagttcgtcatgcccgggctggtggacgtgcacacccacctggcgtttggcaatgcccagagcgaggaagacatcgacatctggaccagcgacgagtttcgcgccctgcgggggctgttcttcgctcagcacgttctggctgccggcgtgacgtccatggtctgccccggcgacagtggccaactcagcattgccgtgcgcaatacggtcaacgccggactgttcgaaggcccccgtatcgctgcaagcagccgagtcatcaccaatcgacagagcctgaacgactggttccccacccgcgtcggcgcccctgagtacttcaccgccgcgctggtcaccagccgtgacgatgccattgcccagatccgcaagcaggccaaggacggcgtggacctgatcaagatcgccatggacggcacccaccgtcgccccaacggtgaaatcatcgccgctttcaccgccgacgagacccgtgagatggtctacgaagctcatcgcctcggctgccgggtggctacccacgcctatggccgggaagcggtgatgtgcgcggccaaggctggcgtcgacctggtgttccacgccttctacatggatgacgcctgcatcgaagcgctgcttgaggctggcagcgtgctcgctccgaccatgaccttcccgcagaacaccgtcgacttctgccagccccatgaccccgctatcagcaccggctacgccgcctactgcgcccggaccctcgagctcggcgcgccggtactcaagcgtgccaaggccgccggcgtacccttcgcctgcggcagcgacagcggctttgctgtcacaccctatggcgaatggcacgctcgcgaactggagctgctggtacggcatctggacttcaccccggccgaagcgttattcgccgcaacccatgtcggcgcacgcttgatgccgcgcggcgagacgctcggcaccctggaaccgggcaaacaggccgacctgctggtgctcgacggttcgcccctggacgacatccgcatccttcaagaccgcgctcggctgcaggcggtgtacaaggccggcgagccggtacggctgcaacgcaccgcctacaaccccaagcaggtgtcggacttcaattcgctgaaatggaccgacctctacacccgcgaccgcgtgtccgaactcggcaaatggaggctgtga

SEQ ID NO: 6355 - protein, 447 aa, Pseudomonas putida KT2440
MSALHLHCSTLFDGTGLHTRQRQTLIIEDGVIRHVGPTAEAPRPQPGDREAHGQFVMPGLVDVHTHLAFGNAQSEEDIDIWTSDEFRALRGLFFAQHVLAAGVTSMVCPGDSGQLSIAVRNTVNAGLFEGPRIAASSRVITNRQSLNDWFPTRVGAPEYFTAALVTSRDDAIAQIRKQAKDGVDLIKIAMDGTHRRPNGEIIAAFTADETREMVYEAHRLGCRVATHAYGREAVMCAAKAGVDLVFHAFYMDDACIEALLEAGSVLAPTMTFPQNTVDFCQPHDPAISTGYAAYCARTLELGAPVLKRAKAAGVPFACGSDSGFAVTPYGEWHARELELLVRHLDFTPAEALFAATHVGARLMPRGETLGTLEPGKQADLLVLDGSPLDDIRILQDRARLQAVYKAGEPVRLQRTAYNPKQVSDFNSLKWTDLYTRDRVSELGKWRL

SEQ ID NO: 6356 - DNA, 1248 bp, Bradyrhizobium japonicum USDA 110
  CDS (1)..(1248): transl_table=11
atgcccagcatcctcttcaagaacgccgctctgctcgatccgctccaggcggacctgatggacgcacatcacgtgctggtcgaagacaatttgatcaaggaggtctcggaccggccgctccaggtcaccgccgaccgaaccatcgatctgaggggcaagacgctgatgcccggtctgatcgacctgcatgtgcatgcggtggcggtcgagctcaatctggcgcagcaggtgcacatgcccaacgtgctggtgacgctgcgctcgaccctgctgctgcgcggcatgctgcggcgtggcttcaccaccgtccgcgatgccggcggcgccggccatgcgctgaagcaggcgatcgagaccggcctcactgacggcccgcggctgttcgtctccggccgcgcgctcagccagaccggcggccacggcgacatgcgggcgcgctcggattatctggcgagtgacgcaccatgtccgtgctgcgtgcgggtcggcgcactggcacgcgtcgccgacggcgtcgacggcgtgcgcagggccgcgcgcgaggagctccagatgggcgccgaccagattaagatcatggcctccggcggcgtggcctcgccgaccgatccggtcggcgccttcggctactccgaggacgagatccgcgccatcgtcgaggaagcgcgcgggcgccagacttatgtgctcgcccatgcctacaccgccgccgccatcgcgcgcgcggttcgctgcggcgtgcgcaccatcgagcacggcaatctcgtggatgagccgaccgcgcgcctgatggccgagaagggggcctatgtggttccgacgctcgtcacctatgaggcgctggccaacgagggcgcgcagtatggcctgccgccggagagcgtcgccaagatcgccgatgtccgcgacgccggcctgcgttcgctcgcgatctatcgcgatgccggcgtgaagatggggttcggcagcgatttgctcgggccgtcccagcgcctccagagcgatgaattccgcatccgcgccgagattctcggcccgcgcgccgtcatcgccagcgccacggtgattggtgccgaggtgctcggcatggagggcaagctcggccggatcgcacccgaggctctcgcagacctgctggtggtcgacggcaatccgctgcgcgatgtcgcctgcctgctcggccagggtgagcacattccgctggtgctgaaggccggcaaggtccagttcgacaggctgaacgcgtag

SEQ ID NO: 6357 - protein, 415 aa, Bradyrhizobium japonicum USDA 110
MPSILFKNAALLDPLQADLMDAHHVLVEDNLIKEVSDRPLQVTADRTIDLRGKTLMPGLIDLHVHAVAVELNLAQQVHMPNVLVTLRSTLLLRGMLRRGFTTVRDAGGAGHALKQAIETGLTDGPRLFVSGRALSQTGGHGDMRARSDYLASDAPCPCCVRVGALARVADGVDGVRRAAREELQMGADQIKIMASGGVASPTDPVGAFGYSEDEIRAIVEEARGRQTYVLAHAYTAAAIARAVRCGVRTIEHGNLVDEPTARLMAEKGAYVVPTLVTYEALANEGAQYGLPPESVAKIADVRDAGLRSLAIYRDAGVKMGFGSDLLGPSQRLQSDEFRIRAEILGPRAVIASATVIGAEVLGMEGKLGRIAPEALADLLVVDGNPLRDVACLLGQGEHIPLVLKAGKVQFDRLNA

SEQ ID NO: 6358 - DNA, 1515 bp, Bradyrhizobium japonicum USDA 110
  CDS (1)..(1515): transl_table=11
atggctgatttgcataatctcctgtggttgcaaattgactcgatgcggtttgcgggcatcaatccgcagataacatcgcacaccgcgcggctggctgattttcgctccggcaacttgcggccagaactgcgcagcggcgtatctgcgtggagattggatatgcgggatttgaccacgccggccggactcttcagagtcgccgcactgctcatgtcggttggaacgagcctctgtctctcgtcgcaaacgcgggcccaacaggactccgccgttctgttccgcaacgtccggatattcgacggaaagagcggtgcgctctccgccgcgtccaatgttctcgtcaggaacacgaagatcgagaagatatcgaccgcgaacatcacggctgacgcccaggcaatcgacggcggcggccgggtgctgatgccggggctgatcgacgcgcattggcacgcgatgctggtccgtccgacgccggccgcggccctcggcgacgtcggctacaacaatctgctcgccgcgagcgaggcgaccgcgacgctgatgcgcggcttcaccacggtgcgcgacatgggcgggcccagtttcggcctcaagcgggcgatcgacgaggacctcgtcgccggtccgcgcatctatccctccggtgccatcatcaccatcaccagcggccatggcgacttccggcagctctccgatctgccgcgaaccatcggcggcatgctcagccgcatggagcaggtcggcggcagcatggtcgccgacagtcccgacgaggtgcgtgttcgcgcgcgcgagcagctcatgcagggcgcctcgcaggtcaagctcacggcgggcggcggcgtcgcgtcgcccttcagtccgctcgacgtctccaccttcaccgagcccgagctgcgggcggcggtcgaggccgccgacaattggggcacctatgtcgccacgcacgcctatacgccggtcgcgatccagcgctcgatcgcagccggcgtgagatgcatcgagcatggtcacctcatggacgaggcgagtgccaagctgatagcggagaaggggatctggctcagcacccagccgttcctggatatgtccatggctgccgcgctcggacctgcggagcaggacaagatgcggcaggtggtcaccggcaccgaccgcgtctatgcgctggcgaaaaagtacggcatcaagaccgcgttcggcaccgacgtcctgttctcgaaggcattggcggacagacagggctcaatgctggccgcgctcacgcgctggtacacgccggccgaagcgctggccatggcgacgtcggccaatgccgaattgctgggcctgtcgggtccgcgaaatccctatcccggcaagctcggcgtggtcgaggagggcgcgctcgccgatctcctgctggtcgacggcaatccgctcgacaacatcaccctcgttgaagatcccgcgaagaatttcgtcgtgatcatgaagggcggcaaggtctacaagaatatcgttccgcgctga

SEQ ID NO: 6359 - protein, 504 aa, Bradyrhizobium japonicum USDA 110
MADLHNLLWLQIDSMRFAGINPQITSHTARLADFRSGNLRPELRSGVSAWRLDMRDLTTPAGLFRVAALLMSVGTSLCLSSQTRAQQDSAVLFRNVRIFDGKSGALSAASNVLVRNTKIEKISTANITADAQAIDGGGRVLMPGLIDAHWHAMLVRPTPAAALGDVGYNNLLAASEATATLMRGFTTVRDMGGPSFGLKRAIDEDLVAGPRIYPSGAIITITSGHGDFRQLSDLPRTIGGMLSRMEQVGGSMVADSPDEVRVRAREQLMQGASQVKLTAGGGVASPFSPLDVSTFTEPELRAAVEAADNWGTYVATHAYTPVAIQRSIAAGVRCIEHGHLMDEASAKLIAEKGIWLSTQPFLDMSMAAALGPAEQDKMRQVVTGTDRVYALAKKYGIKTAFGTDVLFSKALADRQGSMLAALTRWYTPAEALAMATSANAELLGLSGPRNPYPGKLGVVEEGALADLLLVDGNPLDNITLVEDPAKNFVVIMKGGKVYKNIVPR

SEQ ID NO: 6360 - DNA, 1248 bp, Clostridium tetani E88
  CDS (1)..(1248): transl_table=11
atgagtaaaattgcatttataggtggtttattaatagatggtacaggaaaggaacctataaaaaattccttattacttgttgataataaaaaaattaaatatgctggaccaatgatggatgttaatgaagaatatgaaaaaatagatattacaggaaaaataattatgcctggattaattgacactcatcttcattttagtggaaatagaactgataatgacactgaatgggtgctagatcctgttatacaaaaaacaattgtagctgttgctcaggctcgtgaagctcttgaacatggattaacatctgtaggcgaaatttctcgttcaggtatatatatacgtaatatgattgaagaaggagtaattcctggaccacgtgtagttacaacaggacttggtttctgtaggacagcaggacatggtgattcacataaattaccgttagattataataatgactctcatccttgggctgagagagtagatggaccttgggatcttagaaaagcaataagaaggagaattcgtgaaaatccagatgctattaaaatttggtctacaggtggaggcatatggagacttgatgcaaaggctgatttacattattgtatggaagaaatacaagctgttgtggatgagtgcaacatggttggacttcctgtatggtcacatgcagaaggctatgaaggagcactaaattcatgtaaagctggagtatctgcaattattcatggacaagaactaaatgaagaatgtcttgaaataatgaaagaaaaggatattacattctgtccaactttacagttcttctatgaatggtttactgtatatgaaccaccatatagagctattcatgataagtatccaggtaagaatactgctgaaaaagagcttaatcgtataattgataatttgcaaaacgcaaataaaaaaggcattagaataactgttggttctgattcattttgtagtagtttaactccatatggtgaatatgctattacagaaatgtatacacttaataaagctggattaacaaaaatggaaacaattttggctgctactaaaaatggagcagaaatgcttagaatagatgatatcacaggaactcttgaagagggaaaatttgctgaccttcttgttttatccaaaaatccattagaagatattcacaatgtaaatactgataatatggaaattattatgaaagaaggggcatttattaaaaaagtaaatgataaataa

SEQ ID NO: 6361 - protein, 415 aa, Clostridium tetani E88
MSKIAFIGGLLIDGTGKEPIKNSLLLVDNKKIKYAGPMMDVNEEYEKIDITGKIIMPGLIDTHLHFSGNRTDNDTEWVLDPVIQKTIVAVAQAREALEHGLTSVGEISRSGIYIRNMIEEGVIPGPRVVTTGLGFCRTAGHGDSHKLPLDYNNDSHPWAERVDGPWDLRKAIRRRIRENPDAIKIWSTGGGIWRLDAKADLHYCMEEIQAVVDECNMVGLPVWSHAEGYEGALNSCKAGVSAIIHGQELNEECLEIMKEKDITFCPTLQFFYEWFTVYEPPYRAIHDKYPGKNTAEKELNRIIDNLQNANKKGIRITVGSDSFCSSLTPYGEYAITEMYTLNKAGLTKMETILAATKNGAEMLRIDDITGTLEEGKFADLLVLSKNPLEDIHNVNTDNMEIIMKEGAFIKKVNDK

SEQ ID NO: 6362 - DNA, 1260 bp, Pseudomonas syringae pv. tomato str. DC3000
  CDS (1)..(1260): transl_table=11
atgagtaccgctgataccacccgcctgattttgcgcaacggccgtctgctggacctgcagcaggggcgattgatcccggggcaggaagtcgtgatcgagggcgaacggatcgtagcagtgcgtgccgagggtgaagctgccccggcagatgcgcaggttatcgatctgggcggcagaaccctgatgcccggcctgatcgactgccatgtgcatgtgctggcgtccaacgccaacctgggcatgaacgcgttgcaacccaacgcgatcatcatgtaccgcgccttgccgattctggccgcaatgctcaatcgtggtttcaccactgtgcgcgacgccggaggagccgactgggcgctggcacgttcgatccagatgggcctgattcccggaccaagaatatttgcctccggcaaggcactgtcgcagaccggcgggcatggcgacatgcgcgcacgcggcgaactgttgctcaacgaaccgtgctcgtgctgcttccgcgccggagccatcgcccgcgtggtggacggcgtcgataatgtgcgcctggcggtgcgcgaagagctgcaacagggtgccaaccagatcaagatcatggcctcgggcggcgtttcttcaccgaccgatccgattgccaatacccagtacagcgaggccgaaatccgcgcaatcgtcgatgaagcggccgcagccaacacctacgtcatggcccatgcctacactgcccgagccattagacgcgccatcgagtgcggcgtacggaccatcgagcacggcaatctggtggacgccgacacggctcggctgatggccgaaaaaggcgcgtttgcggtgccgactcaggtgacctacgaaatgctcgcagaatacggcgaacgctttggcctgcctgccgactccgtggccaagatcgaggacgtgcgtcaggccgggcgcaacgcgctgttactgttcgccgaagcgggcgtgccgatgggctatggctctgatcttttgggcgaaatgcacgaataccagacccatgaactgaagattcgtgcggagttgctgggtaacctggcggcgctgcgcagtgcaaccagtgttgccgcgcagatacttcaacgcgaaggtgaattggggtgcatcgcggccggtgcaattgccgacctgctggtggtggacggcgacccgctgagcgatatcagctgcctggtgggccagggcgagcagttggcgatgattgttcagggtggtcatgtgcacaagaacaccctggcctga

SEQ ID NO: 6363 - protein, 419 aa, Pseudomonas syringae pv. tomato str. DC3000
MSTADTTRLILRNGRLLDLQQGRLIPGQEVVIEGERIVAVRAEGEAAPADAQVIDLGGRTLMPGLIDCHVHVLASNANLGMNALQPNAIIMYRALPILAAMLNRGFTTVRDAGGADWALARSIQMGLIPGPRIFASGKALSQTGGHGDMRARGELLLNEPCSCCFRAGAIARVVDGVDNVRLAVREELQQGANQIKIMASGGVSSPTDPIANTQYSEAEIRAIVDEAAAANTYVMAHAYTARAIRRAIECGVRTIEHGNLVDADTARLMAEKGAFAVPTQVTYEMLAEYGERFGLPADSVAKIEDVRQAGRNALLLFAEAGVPMGYGSDLLGEMHEYQTHELKIRAELLGNLAALRSATSVAAQILQREGELGCIAAGAIADLLVVDGDPLSDISCLVGQGEQLAMIVQGGHVHKNTLA

SEQ ID NO: 6364 - DNA, 1326 bp, Gloeobacter violaceus PCC 7421
  CDS (1)..(1326): transl_table=11
gtgcacagatggcgatggctggggggtctggcggcggggatgggccttgctgtggcggtcggggcggcggagcctgcggccgaagcagtggtcgcggtgcgggccggtgcgctggtggatacggtggcaggccgggtgctgagcgatcagatcatcctcatcgagggcgagcgcgtgcgggcggtggggccgagcgggacggtgagtatcccggctggagcccagaggattgacctcggccgcgccacggtgctgccggggctaatcgaagcgcacgcgcatctgacgagcgacccgtttcgggccggctaccaggggcttggggtctcggcgattcgcgaggcgctctacggggcgaaggcggcgcgcgacacgctggaggcgggtttcaccactgtgcgcaacgtcggtgcgggggcttacggcgatgtcgccctgcgcgacgccatcaacgacggggacattccggggccgcgcctgctggtttcaggtccggccttgggcatcaaaggcggccactgcgacaacaatttgctcgcccccgatttcaactacaccgccgagggggtggccgacggcccctgggcggcccgcgccaaagtgcgcgaggtggtcaagtacggggcggatgtgatcaagctctgcgccaccggtggggtgctctccaagaacaccgacccgggcgtgcagcagtacaccttcgaggagatgcaggccatcgtcgaagaagcccacaaattgggccgcaaagtcgccgcccacgcccacggcgccgagggtatcaagcaggctatccgggcaggcgtcgattcgatcgagcacgcgagcctgatcgatgcggagggcatgcgcctggcccgccaaaaaggcaccgccctggtcatggatatttatgtcgacgaatttattcttgccgaaggcgagcgggcgggcatcctgcccgagtcgctcgaaaaggagcgcaaagtcggtcaactgcagcgcgacaacttccggcgcgccctcgccgcgggcgaccgcatcgtctttggcaccgacgccggggtctatccccacggcaccaacgccaaacagttcgcctacatggtccagtacggcatgacgccgatgcaggcgatccaggcggccacggtgaacgccgccgagttgttgggctggcaggacaaagtcggctcgctcaccccgggcaagtacgccgatctgatcgccgtggaggccgatccgctcaaggacgtgagcgccctcacccgggtcagttttgtaatgaagggcggccgggtcgtcaaatccgccgcgccgtccgcgacggtcgggcaggcgcgctga

SEQ ID NO: 6365 - protein, 441 aa, Gloeobacter violaceus PCC 7421
MHRWRWLGGLAAGMGLAVAVGAAEPAAEAVVAVRAGALVDTVAGRVLSDQIILIEGERVRAVGPSGTVSIPAGAQRIDLGRATVLPGLIEAHAHLTSDPFRAGYQGLGVSAIREALYGAKAARDTLEAGFTTVRNVGAGAYGDVALRDAINDGDIPGPRLLVSGPALGIKGGHCDNNLLAPDFNYTAEGVADGPWAARAKVREVVKYGADVIKLCATGGVLSKNTDPGVQQYTFEEMQAIVEEAHKLGRKVAAHAHGAEGIKQAIRAGVDSIEHASLIDAEGMRLARQKGTALVMDIYVDEFILAEGERAGILPESLEKERKVGQLQRDNFRRALAAGDRIVFGTDAGVYPHGTNAKQFAYMVQYGMTPMQAIQAATVNAAELLGWQDKVGSLTPGKYADLIAVEADPLKDVSALTRVSFVMKGGRVVKSAAPSATVGQAR

SEQ ID NO: 6366 - DNA, 1230 bp, Mycobacterium avium subsp. paratuberculosis K-10
  CDS (1)..(1230): transl_table=11
ttgcagacgatcaaggccgccgggctgttcgacgtcgacgccggcgagatcgttcggcccgggattctgcgggtcgacggggaccggatcgtcggagtcggggactcgggcccgacgggcgcggacgacaacgtgatcgacctgggcgaggcgatcctgttgcccgggttgatggacatggaggtcaacctgctgatgggcgggcgcggggagaaacccggtctgtctcaggtgcaggacgacccgccgacccgggtgctgcgcgcggtcggcaatgcccggcgcacgctgcgcgccgggttcaccacggtgcgcaacctgggcctgttcgtcaagaccggcggatatctactggacgtggcgctggccaaggccatcgacgcgggctggatcgacgggccccgggtggtgccggccgggcacgccatcaccccgacgggcggccacctggacccgacgatgttcgccgcgttcgcgccgcacgccctggaactcaccgtcgaggaaggcatcgccaacggcatcgacgagatccgcaaggcggtgcgctaccagatcaagcacggcgccgaactgatcaaggtgtgccactcgggtggcgtcatgtcattgacgggaccacctggcgcacagcactattcggacgaggagctgcgcgcgatcgtcgatgaggcgcatcggcgcgggatgcgcgtcgccgcccacacccacggcgccgacgcggtcaagcacgcggtcgccgccggcatcgactgcatcgagcacggttttctgatcgacgacgaggcgatcgccagcatggtcgagcacggcaccttcctggtgagcacccgtcgcctggccgaggggatggacgtctcgcacgccccgcccgagctgcaggccaaggccgcccagatgttcccgaagtcgcgcacctcgatcctggccgcgcaccgggccggggtgaagatcgccgtcggcaccgacgcgcccgcaatcccgcacggccgcaacgccgatgaactcgtcacgctcgtcgagtgggggctgccgccggtggcggtgctgcgggccgccaccgtcaccgcggccgagttgatcaactccagcgaccgcggccggctggccgagggctacctcgccgacgtcatcgccgttccgggaaatccgttggaggacatcacggtaacccagcacgtcagcttcgtcatgaaaggcggcaaggtctatgtccacaaccagaactga

SEQ ID NO: 6367 - protein, 409 aa, Mycobacterium avium subsp. paratuberculosis K-10
MQTIKAAGLFDVDAGEIVRPGILRVDGDRIVGVGDSGPTGADDNVIDLGEAILLPGLMDMEVNLLMGGRGEKPGLSQVQDDPPTRVLRAVGNARRTLRAGFTTVRNLGLFVKTGGYLLDVALAKAIDAGWIDGPRVVPAGHAITPTGGHLDPTMFAAFAPHALELTVEEGIANGIDEIRKAVRYQIKHGAELIKVCHSGGVMSLTGPPGAQHYSDEELRAIVDEAHRRGMRVAAHTHGADAVKHAVAAGIDCIEHGFLIDDEAIASMVEHGTFLVSTRRLAEGMDVSHAPPELQAKAAQMFPKSRTSILAAHRAGVKIAVGTDAPAIPHGRNADELVTLVEWGLPPVAVLRAATVTAAELINSSDRGRLAEGYLADVIAVPGNPLEDITVTQHVSFVMKGGKVYVHNQN

SEQ ID NO: 6368 - DNA, 1248 bp, Mycobacterium avium subsp. paratuberculosis K-10
  CDS (1)..(1248): transl_table=11
atgaccaccgtgctgcgggcggcccgatgggcggacgtggtgaccggaaagatccacgcaccggcggtgatcgtggtcgacgacgaacgcatctcggcgatgaatcccgaagggccgctgccggattcggcgaccaccgtcgacctcggggacaccacgctgctgcccggcctgatggacatggaactcaacctgctcatcggcgggccgggtgggccggagggtctgccgtcgccgatgcacggcgtgcaggacgaccccgcctaccgcaccctgcgcggggcggtcaacgcgcgcaccaccttggaggccgggttcaccaccgtgcgcaacctcgggctgatggtcaagaccgggggatatctgctcgacgtcgcgctgcaacgcgccgtcgacgcgggctggcacgccgggccccggatctatccggccggccatgccgtcaccccgtacggcgggcatctggacccgacggtgtttcagcggctggcccccgggatcatgccgctgtcggtggccgagggcatcgccaacggggtgcccgacgtgatcgcctgcgtgcggtaccagatccggcacggcgccaagctgatcaaggtgtccgcctccggcggggtgatgtcgcacagcaccgcgcccggggcgcagcagtactccgacgccgaattcgccgcgatcgccgacgaggcccaccgggccggtgtccgggtggccgcacatgcggtgggggacagcgcaatccaggcctgcatccgcgcgggcatcgactgcatcgaacacggctttttggccagcgacgagaccatccagatgatggtcgatcacggcacgttcctggtgtcgaccacctacctgaccgaggccatggccatcgaccgcatcgcgccggaactgcgcaagaaggcgctcgaggtgttcccgcgggcaaaggccatgctgcccaaggcgatcgaggccggcgtccggatcgcctgcggcaccgatgcgccggccatcccgcacggccagaacgccaaggaactgggcgcgctggtgcagcggggcatgacccccgcccaggcgatccgggcggcgaccgtggtggccgccgagctgatcgaggccgacgacgagctgggcaggctggcgcccggctacctcgccgacatcatcgcggtgcccggcaacccgttcgacgacatcgccgccacccttgacgtccgcttcgtcatgaagaatggacagatctacaaaacccctgcggcctag

SEQ ID NO: 6369 - protein, 415 aa, Mycobacterium avium subsp. paratuberculosis K-10
MTTVLRAARWADVVTGKIHAPAVIVVDDERISAMNPEGPLPDSATTVDLGDTTLLPGLMDMELNLLIGGPGGPEGLPSPMHGVQDDPAYRTLRGAVNARTTLEAGFTTVRNLGLMVKTGGYLLDVALQRAVDAGWHAGPRIYPAGHAVTPYGGHLDPTVFQRLAPGIMPLSVAEGIANGVPDVIACVRYQIRHGAKLIKVSASGGVMSHSTAPGAQQYSDAEFAAIADEAHRAGVRVAAHAVGDSAIQACIRAGIDCIEHGFLASDETIQMMVDHGTFLVSTTYLTEAMAIDRIAPELRKKALEVFPRAKAMLPKAIEAGVRIACGTDAPAIPHGQNAKELGALVQRGMTPAQAIRAATVVAAELIEADDELGRLAPGYLADIIAVPGNPFDDIAATLDVRFVMKNGQIYKTPAA

SEQ ID NO: 6370 - DNA, 1332 bp, Aspergillus nidulans FGSC A4
  CDS (1)..(1332)
atgcgctccattcccgcgaaaccctggattccgcgcgaaccaggccctgacatcgcctttatcaatgctaatgttgtcgacgtcgaaaccggcaagattatcccgaattcctctgtccggatcgcggacggttgtattgtagatgtcgctactggcaaatacactcccccttccagctcgaccgtcatagacgcagaggaccactacatctgccctggccttatagactgccacgtgcatcttactgcaacgcccggcaaccctgctctcagagacatgttttctgccagcccaaccagcctcgcccatcgcgccgcatacgtcgcgcgagagatgctcctccgcggattcacgacggcgcgcgacacgggaggtgccgacgccgcgctgcgcgacgctattgctgaaggccttgtgcctggcccgcgcctcttcatcgcaggaaaggcactctcgcagacgggcggacatggcgactcccgcgccgctttccaaggcgaggaagagaaatgctgcggtgggcactcgccgtctctagcacgggtgtgtgatggcgtacccgcctgcctgagcgccgtccgcgacgagctgcgccggggcgcagatttcatcaagatcatgtgtggtggcggcgtagcgtccccctctgatgcgttggatatgcttcagttcacggcagaagagattcaggcgatcacgagaactgctgcgcactcgggcaagtacgtgactgcgcactgctatactgtggatgcgatccgccatgcagtcgataatggggtccgcgggatcgagcacggaaatttcatcgaccgcgagacggcagagtactgcagggacatgggggtcacattcaccccgacgctcgtgacatactacggcatggtgcagccagcattctcgcacttcctagacgatgccagccagaggaagaaccaggaggtcctccgaggcggcctggatgctctggcggtcctccgtgacgccggcgtggcaatgtgctacggatccgatctcctggcaggcttgcatcccctgcagaaccaggagttccggatcagggctggtgtgttgactgcccgtgagattctacaatctgccaccgtggacgcggccaggtatctggggatggaggggaagctgggcagtatcaggagcgggggtattgcggacctgcttgtcctcaaggcaaatcctctggaggatatcacagtcctggatcgcattggagagaatttggtcggtctcttgaaagacgggcgggtggtcacccacaagctcgatgggctgtctgtcgacccgctgtatgatccattccgggtccgtcagtag

SEQ ID NO: 6371 - protein, 443 aa, Aspergillus nidulans FGSC A4
MRSIPAKPWIPREPGPDIAFINANVVDVETGKIIPNSSVRIADGCIVDVATGKYTPPSSSTVIDAEDHYICPGLIDCHVHLTATPGNPALRDMFSASPTSLAHRAAYVAREMLLRGFTTARDTGGADAALRDAIAEGLVPGPRLFIAGKALSQTGGHGDSRAAFQGEEEKCCGGHSPSLARVCDGVPACLSAVRDELRRGADFIKIMCGGGVASPSDALDMLQFTAEEIQAITRTAAHSGKYVTAHCYTVDAIRHAVDNGVRGIEHGNFIDRETAEYCRDMGVTFTPTLVTYYGMVQPAFSHFLDDASQRKNQEVLRGGLDALAVLRDAGVAMCYGSDLLAGLHPLQNQEFRIRAGVLTAREILQSATVDAARYLGMEGKLGSIRSGGIADLLVLKANPLEDITVLDRIGENLVGLLKDGRVVTHKLDGLSVDPLYDPFRVRQ

SEQ ID NO: 6372 - DNA, 1338 bp, Aspergillus nidulans FGSC A4
  CDS (1)..(1338)
atggcctcggtaacagacgcagatatcaagccctggctccggcccccgcctcagtcgtacctcctcagcgcagcaaacatcgtcgatgtcgcagctggtgttataaaagagaatcattatgtgatgataaaaaatggcagaataacctctgtttcgtccagccgtcctctcgacgccgaattaccagagtcttacatcaccgtcgactgcgcaggcctctacatcagcccgggcctcttcgatgcgcacgtccacttcgtggcagtcccaggcttccccagcctctccactgcatttggcaacttcaacgacgtatcgcttctacgtcagccatatgtcgcagcgcagatgctgcatcgcgggttcacatccgtccgcgattgcggcggcgcccagctcgctttcaaacaagcaatcgaggagggtgtctttcctggcccgagactcttcattgccggacacgcactgtcgcaatcaggcgggcacggggatatccgctcggcgcatgaccatgttcagtgctgcgcggggcacacgaacggactcggccggatctgcgacggggtgcctgcttgtatgacggccgtgcgggaggagatccggtctggcgcggatttcattaagatcatgggcagtggcggggtgtcaacgccgacggatcgattggagcagctacagttcacgaggcaggagatccaggccatcgtggagtgtgcagagaacgcggggacgtatgtcacggcccacgcctatacgcctaaagccatgctgcatgcaatcgagaatggggtgaagggtattgagcatggaaatttcgtgactgaggaggtggccaggatcatggttgaaaagggtatctaccttacgcctactctgatctcgtacgcggagatggactctgaaaaatggaggggctatcttcctgccgatggacaggcgaagaacacggaggtgctgagcgcagggctgaagagtctaaagatcgcggccgatgcgggtgtcacgatatgctacggcagcgatctcctcgggccgctgggtttggcgcagacgggcgagttcaggctcagagcgcaggcgttgagtccgttgacggtgttgcaaagtgcaaccatcaacccggcaaggatgatgggacagtccgagtcaatcggccagatcaaggagggattctttgcggatgtgctgttccttagcaggaatccgctggaggacgtgaccatctttgatcgaccagaggagtgcgtcctgggtgtgatgaaggagggaagagtgtataagagtcgatgggatggcctaaaagaggatgctgacattccggtacggatcaggaattag

SEQ ID NO: 6373 - protein, 445 aa, Aspergillus nidulans FGSC A4
MASVTDADIKPWLRPPPQSYLLSAANIVDVAAGVIKENHYVMIKNGRITSVSSSRPLDAELPESYITVDCAGLYISPGLFDAHVHFVAVPGFPSLSTAFGNFNDVSLLRQPYVAAQMLHRGFTSVRDCGGAQLAFKQAIEEGVFPGPRLFIAGHALSQSGGHGDIRSAHDHVQCCAGHTNGLGRICDGVPACMTAVREEIRSGADFIKIMGSGGVSTPTDRLEQLQFTRQEIQAIVECAENAGTYVTAHAYTPKAMLHAIENGVKGIEHGNFVTEEVARIMVEKGIYLTPTLISYAEMDSEKWRGYLPADGQAKNTEVLSAGLKSLKIAADAGVTICYGSDLLGPLGLAQTGEFRLRAQALSPLTVLQSATINPARMMGQSESIGQIKEGFFADVLFLSRNPLEDVTIFDRPEECVLGVMKEGRVYKSRWDGLKEDADIPVRIRN

SEQ ID NO: 6374 - DNA, 1230 bp, Mycobacterium sp. JLS
  CDS (1)..(1230): transl_table=11
gtgaaaccgctgctgctccaccacgccacgctcatcgacgggacgggcgccgcaccgctgccggatgcggcggtcctggtcgagaacgaccggatccgttgggccggagcggcttccgacgcccccaccgatgacgccacccgggtcgatctcggcggcaacaccatctgcccgggattcttcgactgccacgtccacttcagcctgcccggcgccggcgccacgcccatcgaccgggcgctgaatccgccctcgtaccactatttccagttgatcgaccggctgcgcgtcacactgcacaacggtgtcaccaccgcccgcgacctgatgggcatcgatgccggagtccgtgatgcggtggcacacggtctggtcgacgggccccggttgctcgtggcgatcaacatgatgagccagacctgcggccacgccgactttcatctgccgtccgggatcgacctgacgccgatggtcggcggctcgctggtcgacaccgtcgacgaggcgcggcggcgcacccgtgagctcatcgccgcgggggccgacgtcatcaaggtggcgtccagcggcggggtgtcctcccccagcgaccaacccgaatggctgggcatgcgccgcgaactcatcgcggctgtggtggaggaggccgcggcctacggccacaagcgggtggccgcccacgcgatcggccgcgccggcatcgaagcggccgtcgaggccggtgtctccagcgtcgaacacggctatcaactcgacgaggggctgcggcacaagatggtcgaggcgggcatcttcctggtgccgaccctgctggagacgatggccgacgtcacctcctcaccggccggccaggccaagagcgcccactggcacgccgtggcacaggagtcgatcggcgcgtcggctgcggccggggtgaagatcgccgtcggcaccgacgcggggctcagcccggcgcacgggacgaacctcaaggagctcgggctgctggtgcgcttcggcggcctcaccccgatgcaggcgatcgtcgccgccacctccacctctgccgaattgtgcggtctggctgagcaattgggcaccgtcgaggcaggcaagctggccgacctggtgatcgtgcggggcgacccgctggccgacatcgactccgtgggtgagcccgacaacatcctgctggtgctcaaagagggccgcgcggcgatcgaccgcgcgggttttctgaccgcttag

SEQ ID NO: 6375 - protein, 409 aa, Mycobacterium sp. JLS
MKPLLLHHATLIDGTGAAPLPDAAVLVENDRIRWAGAASDAPTDDATRVDLGGNTICPGFFDCHVHFSLPGAGATPIDRALNPPSYHYFQLIDRLRVTLHNGVTTARDLMGIDAGVRDAVAHGLVDGPRLLVAINMMSQTCGHADFHLPSGIDLTPMVGGSLVDTVDEARRRTRELIAAGADVIKVASSGGVSSPSDQPEWLGMRRELIAAVVEEAAAYGHKRVAAHAIGRAGIEAAVEAGVSSVEHGYQLDEGLRHKMVEAGIFLVPTLLETMADVTSSPAGQAKSAHWHAVAQESIGASAAAGVKIAVGTDAGLSPAHGTNLKELGLLVRFGGLTPMQAIVAATSTSAELCGLAEQLGTVEAGKLADLVIVRGDPLADIDSVGEPDNILLVLKEGRAAIDRAGFLTA

SEQ ID NO: 6376 - DNA, 1182 bp, Clostridium difficile 630
  CDS (1)..(1182): transl_table=11
atgaacaaaaaatatattaaagcagggaatttaattgatggaaccggaaatagtattatgcaaaataagggtataattattgatggagatactatagttgaaattgaagatataagagatgatttaaatggatatgatgtgtacgattacttagataaaactgttatgccaggcattatgaattgtcatgttcacttgacaatggagccagttggaaatccaaagatatattatgataatgtatcagatgtagagcttgtagtaaatacgataaaacaacttgatgcttatttggattcaggagtaacatatattagaagcttaggttgtcccaaatatgtggatgtacaacttaaaaatcttatagacaaagggtctatagatggtcctggtatagttacttcaggtccagttatatgtatgacaggagggcatggatattattttggtattgaaagtgatggagtggatgaatgtagaaaatcagccagaacagttttaaaaaatggagtagattgtgtaaagataatggcaactggaggtgtaacaactgatggagttgagccagggtcaccacaattaactttggaggaaatgaaggctgctgtagatgaagctataaaagcaggtaaaataactgccacacatgcacaaggaagaactggtataaaaaatgcagtgcttgcaggaattacttctatagaacatggtgtttatttagatgatgaaataattgatttgatgcttgaaagaggaacttacttagttccaactgtggctgcaccatattttattctaaatgcaggaaaagaaagtggaataactgaagctactcttagaaagtgtgagattgttgccattccacacaaagagtcattcctaaaagcatataaaaaaggaattaaaattgcagttggttctgatgcaggaacttcttataatgaacatggaaaaacatattatgaaatgaaactaatgtcagattatggtatggataatatggatataatagttgctgctacaaaaacagcatctgaacttttaagaattgataaaaattatggaactctagaaaaaggaaagaaagcagatgttatagttgtaaatggaaatccagtagagaatatagacgtacttgcagatgtgttagcagtatttaaacttggtaaaaaagttagataa

SEQ ID NO: 6377 - protein, 393 aa, Clostridium difficile 630
MNKKYIKAGNLIDGTGNSIMQNKGIIIDGDTIVEIEDIRDDLNGYDVYDYLDKTVMPGIMNCHVHLTMEPVGNPKIYYDNVSDVELVVNTIKQLDAYLDSGVTYIRSLGCPKYVDVQLKNLIDKGSIDGPGIVTSGPVICMTGGHGYYFGIESDGVDECRKSARTVLKNGVDCVKIMATGGVTTDGVEPGSPQLTLEEMKAAVDEAIKAGKITATHAQGRTGIKNAVLAGITSIEHGVYLDDEIIDLMLERGTYLVPTVAAPYFILNAGKESGITEATLRKCEIVAIPHKESFLKAYKKGIKIAVGSDAGTSYNEHGKTYYEMKLMSDYGMDNMDIIVAATKTASELLRIDKNYGTLEKGKKADVIVVNGNPVENIDVLADVLAVFKLGKKVR

SEQ ID NO: 6378 - DNA, 1239 bp, Legionella pneumophila subsp. pneumophila str. Philadelphia 1
  CDS (1)..(1239): transl_table=11
atgaactcaattctttttaaaaatgccaacgttattttgggagagtctacagagcttaaaaaaaaatttgatgttctggtgcaaaataatttgatctcccaggtgtcgcaaacaccgcttcaacctttcgaaggaatgcgcattatcgatgtcaaagggaaaacattaatgcctggtttaatcgatgcccatgctcatattaccggattgaccctaagcccaaaaaatatcttctactctgaagcagagatatttttggctgctgctacttatcttaaaaacagcttgttttatggttttacgactttacgagaagctggaggcgctgattttagaatagcacaattactagataataagagtattccagggcctcgattattttattctgggagggcattaactcaaacgggtggaggagctgactttagaaaaccgaatgaacagattgatccttgtgggcatgttggctctttctcgacgatgtcggttattgcagatgggattgatgaagtgagaaaggctgctcgagaagagttaaggaaaggagcaacacaattaaaagtatttgcttcaggcggggttgttttcccttcccttagcaatccaacactgtatgaatattccgaggaggagttatcgactattgttgaagaggcacgagcaagaaatacttatgttatggcccatgcttatagcgatgaatcagtaagaaagtgcattaaatcgggtgtgcgttccattgaacacgctaattttgtaagcgaaccaactgtagaattaatgtcggaaagtggtgtgttttacgatccgacatttatttcattggtgcaaagaattgaaagtgctgaacaaaaccggttgtctgaagctattgtagccaatttgaaaaatactattgaaaaaggcaaaaaggtttatgaatatgctttaaaatataagattcctattgcttttggtacagatttgtggggtcctgaggcacagagagatcagttaagagaatttgaaatgctcaaggagcttgattcagcagccaatattattcgttcagctaccgtagtcaatgcggaattattaatgcaaaagggaaaacttggcgtcataagcgaaggagcttatgctgatctgttagtagtagatggtaatcctttagtcaatttaaatgttctgctccgcccggatgaaaaccttaaattgattatgaaagatggggtcatttataagaatgaattataa

SEQ ID NO: 6379 - protein, 412 aa, Legionella pneumophila subsp. pneumophila str. Philadelphia 1
MNSILFKNANVILGESTELKKKFDVLVQNNLISQVSQTPLQPFEGMRIIDVKGKTLMPGLIDAHAHITGLTLSPKNIFYSEAEIFLAAATYLKNSLFYGFTTLREAGGADFRIAQLLDNKSIPGPRLFYSGRALTQTGGGADFRKPNEQIDPCGHVGSFSTMSVIADGIDEVRKAAREELRKGATQLKVFASGGVVFPSLSNPTLYEYSEEELSTIVEEARARNTYVMAHAYSDESVRKCIKSGVRSIEHANFVSEPTVELMSESGVFYDPTFISLVQRIESAEQNRLSEAIVANLKNTIEKGKKVYEYALKYKIPIAFGTDLWGPEAQRDQLREFEMLKELDSAANIIRSATVVNAELLMQKGKLGVISEGAYADLLVVDGNPLVNLNVLLRPDENLKLIMKDGVIYKNEL

SEQ ID NO: 6380 - DNA, 1263 bp, Bacteroides fragilis NCTC 9343
  CDS (1)..(1263): transl_table=11
atggacaatagtattttaatcaataacgttcaaattttcgatggaagcagcgaacagaccggccggggaaatgtgctggtggtaaacagccggattaaaaccgtttcagaaagtccgatccctacggacggaattcccaatgttaccattcttgacggaaagggaaaattcctgatacccggactaatcgacgcacactggcatgcttatatgtcatgcaatacgatgatggatctgcttactgcagacaccgcttatacgcagttcaaagccggacaagaagctcgagctaccctactccgcggcttcacaaccatccgggatgcaggtggtccggtcttcgggcttaaacgggccatcgacgaaggaatcctttccggaccacgcatttatcccagtggctctcttatctcccagacaggagggcatggagatttccgggcggtatatgacgaaccccgtccctttgactgttgcggactgacgcataccgaaaagatgggagctgccattatcgccgacggaatagacgccgtgaccgtcgccgcacgcaataatctccgcctgggagccagccagattaaattgatgacaggcggcggggtagcttccttgtatgatcggttggaagatacacagttcttcgaggaagagattcatgctgccgttaaagcggcggaagatgcaggaacatacgtaatggtgcatgtctatgtgcccagagctattcaacgagctatccatgcaggtgtaaaaagcattgagcacggccatctgattgacgaacccaccatgcagctgatcgcagagaaagagatatggctcagtatgcaacccttcactttaggagataatcaattcccgacaaaagaacaacaggagaagcatgccttggtagttcaaggtacggaccaaacctatcaactggcaaagaaatacaacgtcaagctggcatggggaacagatttactgttcaatcctgccaacacgaagaatcagaatcagggaatccttaaattaagacaatggttcagtaactttgaaattctcaagatggtaacacatgataatgcggaattgctggctctgtccggtgcacgaaatccctatcccgggaaattgggtgttatagaagaagatgcctgggcagacttaattctggtagatggagacgtactgaaagacattaccctattgggagatccggaaaagaatttcataatgatcatgaaaggaggagaaatatacaagaatagagtctga

SEQ ID NO: 6381 - protein, 420 aa, Bacteroides fragilis NCTC 9343
MDNSILINNVQIFDGSSEQTGRGNVLVVNSRIKTVSESPIPTDGIPNVTILDGKGKFLIPGLIDAHWHAYMSCNTMMDLLTADTAYTQFKAGQEARATLLRGFTTIRDAGGPVFGLKRAIDEGILSGPRIYPSGSLISQTGGHGDFRAVYDEPRPFDCCGLTHTEKMGAAIIADGIDAVTVAARNNLRLGASQIKLMTGGGVASLYDRLEDTQFFEEEIHAAVKAAEDAGTYVMVHVYVPRAIQRAIHAGVKSIEHGHLIDEPTMQLIAEKEIWLSMQPFTLGDNQFPTKEQQEKHALVVQGTDQTYQLAKKYNVKLAWGTDLLFNPANTKNQNQGILKLRQWFSNFEILKMVTHDNAELLALSGARNPYPGKLGVIEEDAWADLILVDGDVLKDITLLGDPEKNFIMIMKGGEIYKNRV

SEQ ID NO: 6382 - DNA, 1260 bp, Pseudomonas syringae pv. syringae B728a
  CDS (1)..(1260): transl_table=11
atgagtaacactgaacccacacgcctgatcctgcgcaacggccgcctgctggacgtgcaacaagggcaattgatttcgggccaggaggtcgtgatcgagggtgagcgcattgtcgaagtacgtgccgagggtcagccggccccggcaggcgctcaggtcatcgatctgggtggcagaacactgatgcccggcctgatcgactgccatgtgcatgtgctggcttccaacgccaacctgggcatgaacgccctgcaacccaacgcaatcatcatgtaccgcgccttgccgattctggcggcgatgctcgaccgcggttttaccaccgtgcgcgatgccgggggggctgactgggcactggcccgttcgattcaaatggggctgattcccggcccgcgcatcttcgcatcgggcaaggcactgtcgcagaccggcgggcatggcgacatgcgcgcacgcggcgaactgctgctcaacgagccctgctcctgctgcttccgcgccggggccatcgcccgcgtggtggatggtgtcgacaacgtgcgcctggcggtgcgcgaagagctgcagcaaggcgccaaccagatcaagatcatggcctcgggcggtgtttcttcgccgaccgacccgattgccaacacccaatacagcgaagctgaaatccgcgccatcgtcgacgaggccgccgccgcgaacacctacgtcatggcgcatgcctacaccgctcgggcgattcgccgcgccatcgaatgcggtgtcagaaccatcgaacatggcaatctggtcgatgccgacaccgcgcggctcatggctgaaaaaggcgcatttgcggtgccgactcaagtcacttacgaaatgctcgccgaatatggcgaacgcttcgggctgccggcagactcggtcgccaagatcgaggatgtgcgtcaggccgggcgcaatgccctgctgctgttcgccgaagcgggcgtaccgatgggctatggctcggatttgctgggcgaaatgcacgagtaccagactcatgaattgaagattcgcgcagaactgctgggtaatctggcagcgctgcgcagtgccacaagtgtcgcggcgcagatccttcagcgcgaaggcgaactgggctgcatcgccgccggtgcgatcgctgatctgctggtggtggatggcgacccgctgagcgatatcagttgcctggtcggtcagggcgagcacctggcgatgattgttcagggcggtcatgtgcgcaagaacaccctggtctga

SEQ ID NO: 6383 - protein, 419 aa, Pseudomonas syringae pv. syringae B728a
MSNTEPTRLILRNGRLLDVQQGQLISGQEVVIEGERIVEVRAEGQPAPAGAQVIDLGGRTLMPGLIDCHVHVLASNANLGMNALQPNAIIMYRALPILAAMLDRGFTTVRDAGGADWALARSIQMGLIPGPRIFASGKALSQTGGHGDMRARGELLLNEPCSCCFRAGAIARVVDGVDNVRLAVREELQQGANQIKIMASGGVSSPTDPIANTQYSEAEIRAIVDEAAAANTYVMAHAYTARAIRRAIECGVRTIEHGNLVDADTARLMAEKGAFAVPTQVTYEMLAEYGERFGLPADSVAKIEDVRQAGRNALLLFAEAGVPMGYGSDLLGEMHEYQTHELKIRAELLGNLAALRSATSVAAQILQREGELGCIAAGAIADLLVVDGDPLSDISCLVGQGEHLAMIVQGGHVRKNTLV

SEQ ID NO: 6384 - DNA, 1356 bp, Colwellia psychrerythraea 34H
  CDS (1)..(1356): transl_table=11
atgaaattgaaaaatacattgataagtaaagccactagtaagttggtaattagcgctgttgcagcgttctcactaacttcagcagcctttgctgctgatcaaacattgattaaaaacgttaaaatttgggacggtacatcctcggggttaagtaaacaacaagacgtattaattgaaggtgaattaattaaatcgataggtagcggcctaaaagtcgcagctgacgttgaagtcattgatggacaaggtaaaaccatgataccaggtcttatcgatatgcattcacacctatgtttacaagaaggtatgttagtgggtcgtgataactatgatcaaatggcaatgggtgctcgaacagctcattctttaactcaataccttgaccaaggttttactactgcacgtgatgttggctgtaacgtattaggtgtagcaaaagcaattaacaatggcctattacctgggcctcgtattttccctgctggtggctttttaagtcaaaccggaggccatgctgatacgggcagatttaatgaccaacctggtgctattgatgatttagagcgtcatggttttggttatattgttgatggtaaaacagaagtacgacgtgcagctcgtcaaaatctacgtgctggtgcaacgcatttaaaattaatggctggtggcggtgttgccagtgaatttgatccacttcacagcacacaattttctgttgaagaatttgaagccgctgtagaagttgccaaagattacggcacatatgtaacagtacatgcataccacgatcgcagtgtaaaccgtgccattgatgccggtgttcgagttattgaacataactttttagtatcagaaaaaaccattaaacgtatgaaaaaagaaggtattgccctttctgctcagtcggtaatgtcattacaagcatttggcgatccagactcaattaccttctttagcgctgatcaaaaaatgaaagctaaaaaagtaaactctggtgctacacaaatgtttaaatgggctttaaaacataacttattaattgttaccggtggagatatgtttggccctgcttacaatactaagcaagctgaaaatatgacttggatgggtaaagttggcgctaaaccactacaaatcatgaagatgggtacatctaatgctgctgaagttttaacttggtctggtggtatgaatccatataaatatggtgctttaggtgttatcaaaaaaggtgcttatgcagatttaattttaatcgacggtaacccacttaaaaacattgaagtattgaacgagtacaaaactaagttcaaattaatcatgaaaaatggtcaagtgcataaaaacacgctttaa

SEQ ID NO: 6385 - protein, 451 aa, Colwellia psychrerythraea 34H
MKLKNTLISKATSKLVISAVAAFSLTSAAFAADQTLIKNVKIWDGTSSGLSKQQDVLIEGELIKSIGSGLKVAADVEVIDGQGKTMIPGLIDMHSHLCLQEGMLVGRDNYDQMAMGARTAHSLTQYLDQGFTTARDVGCNVLGVAKAINNGLLPGPRIFPAGGFLSQTGGHADTGRFNDQPGAIDDLERHGFGYIVDGKTEVRRAARQNLRAGATHLKLMAGGGVASEFDPLHSTQFSVEEFEAAVEVAKDYGTYVTVHAYHDRSVNRAIDAGVRVIEHNFLVSEKTIKRMKKEGIALSAQSVMSLQAFGDPDSITFFSADQKMKAKKVNSGATQMFKWALKHNLLIVTGGDMFGPAYNTKQAENMTWMGKVGAKPLQIMKMGTSNAAEVLTWSGGMNPYKYGALGVIKKGAYADLILIDGNPLKNIEVLNEYKTKFKLIMKNGQVHKNTL

SEQ ID NO: 6386 - DNA, 1305 bp, Colwellia psychrerythraea 34H
  CDS (1)..(1305): transl_table=11
atgaaatctttaatgaaagtaactacgcttattggacttaccctctccactttagtatcaactcaactatcagcaaaaacccaagtaattcatgcgggtgaagtgttaacagtgcctggaaaagcgccattaactaaacaaaccattgtcattaaagatggcgttatcacctcactgaaatcaggctttgttccagtcaataaaatagataaacaagcacagttaattgatttaactaagagctttgttatgcccggccttatggatatgcatgtgcatttacaaggtgaattaggtcctaaaaatgacagtgaaaaactcaggatgtcagattctgacaagttagtgaaaagtgcctactttgctaataaaaccctactggctggctttactaccgttagagatttaggtggcagcccagagcaaagctatgcgttacgcgatggtattgctaaaggttacttacaaggcccaagaataatagccgcagggagtaatgttgccgtaacaggcggtcatggtgatgttgatggcatgaaccctgcgttgttagaaatgcatacggctaaaactgtctgtgatggtccttacgattgtcgccgcgctacccgccgtgcgataaaatttggtgcagatgttattaaaataacctctacaggcggtgtcttatcagacactgatactggtacaggtcagcaaatggcggatgatgaactaagagaagtcattgattctgcccatgcattaggtagaaaagtagccagtcatgcccatgctgcagcaggcataaacgcagcattaagagccggtgttgatagcattgaacatggcagttacgccaatgaagaaagcattaaactgttcaagaaaacaggtgcttacttagtacctaccttgatggctggcgatactgtggtagccttagctaaaaatactaactttatgtcgccagcgatcagcgccaaggccattcgcgtaggtggcgatatgatcgaaaactttaaacgttcatacaagtcaggtgtaaaaattgcctatggcactgacagtggtgtatctaaacatggtgataatggtaaagaagcagtactcatgtttaacgccggtatgaccgctcaagatattttaaagtcagctaccgttaatgctgctgacttaattggtaaatctgagtcgttaggcaccatagaagcaggtaaaatcgccgatattattgccatggataacagtccattaaaagatatgaaagaattgcttgatgttgattttgttatgaaatctggtgttatcgttaaacagcaataa

SEQ ID NO: 6387 - protein, 434 aa, Colwellia psychrerythraea 34H
MKSLMKVTTLIGLTLSTLVSTQLSAKTQVIHAGEVLTVPGKAPLTKQTIVIKDGVITSLKSGFVPVNKIDKQAQLIDLTKSFVMPGLMDMHVHLQGELGPKNDSEKLRMSDSDKLVKSAYFANKTLLAGFTTVRDLGGSPEQSYALRDGIAKGYLQGPRIIAAGSNVAVTGGHGDVDGMNPALLEMHTAKTVCDGPYDCRRATRRAIKFGADVIKITSTGGVLSDTDTGTGQQMADDELREVIDSAHALGRKVASHAHAAAGINAALRAGVDSIEHGSYANEESIKLFKKTGAYLVPTLMAGDTVVALAKNTNFMSPAISAKAIRVGGDMIENFKRSYKSGVKIAYGTDSGVSKHGDNGKEAVLMFNAGMTAQDILKSATVNAADLIGKSESLGTIEAGKIADIIAMDNSPLKDMKELLDVDFVMKSGVIVKQQ

SEQ ID NO: 6388 - DNA, 1302 bp, Colwellia psychrerythraea 34H
  CDS (1)..(1302): transl_table=11
atgggagtgataacgcccatttctgcaagtgaaaagcaatctactatattactcaaaaacgttcatgtctttgatggtatgaatgaaaagcgcatgatgaatgccaatgtactaatcgaaaataatattatcaaggaaatcacccagaaaaatattaatgctcccgaggcaactcaaattgatggtaaaggccgaacgttaatacctggattgattgatatgcattggcattccgcctactccagtattcctatgcaaaaaggccttacccttgaccacgcatatcatttgctgattggtgcaaaagcaaatgaaaaagcacttttacgtggctttactacggtgagagatgttggcggtaatgttttttctttagctaaactgactgatgaaggggtctataacggccctcgtatctttccgtctgggccggcaataagtcaaacttctgggcatacagactttagaccaggtacggcagtacctgctgaaactaatgccccgctggtgtatatggagtcaatcggccatgtaatggtggcagatggcgttcctgaagtattaaaacgtactcgagaggcacttcgaatgggtgcgacacaaatcaaaattaattcaggtggtggagtctcatcttcgttcgatccccttgatgttactcaatttacgttagaggagactaaagccgcagtagctgccgcttctgattggaatacgtatgtggccacacacacatttaccgatgctgctactcaacgagctttagaggctggtgtaataagtatagagcacggtcacttattgagtgaaaaaacgctacgtttgatgaagaaaaaaggggcttaccttagcattcaacctatattggatgacgaagatgccatcgcatttccagaaggatcatttagtcgtcagaaatatgtcgaagtcactaaaggtactgatcgtgtttatcgtttggctaagaaagtgggcgttaaaacagtgttcggcacagatacactatttgaccctttacttgcagagaagcaaggaaaacagttagccaaattatcaaaatggcattcacctgttgaagcattacgtcaggctacgtcaacggctggggaattattagctttatcaggccaacgcagcccttatcctcaaggtgcattgggagtcattaaagtaggtgcttatgcagacttaattttagttgatggtaatccgttgaaaaaccttaatttagtttcgaatccaaaggataattttgatttaattatgaaagatggaaaaatatataagaatactcttaattga

SEQ ID NO: 6389 - protein, 433 aa, Colwellia psychrerythraea 34H
MGVITPISASEKQSTILLKNVHVFDGMNEKRMMNANVLIENNIIKEITQKNINAPEATQIDGKGRTLIPGLIDMHWHSAYSSIPMQKGLTLDHAYHLLIGAKANEKALLRGFTTVRDVGGNVFSLAKLTDEGVYNGPRIFPSGPAISQTSGHTDFRPGTAVPAETNAPLVYMESIGHVMVADGVPEVLKRTREALRMGATQIKINSGGGVSSSFDPLDVTQFTLEETKAAVAAASDWNTYVATHTFTDAATQRALEAGVISIEHGHLLSEKTLRLMKKKGAYLSIQPILDDEDAIAFPEGSFSRQKYVEVTKGTDRVYRLAKKVGVKTVFGTDTLFDPLLAEKQGKQLAKLSKWHSPVEALRQATSTAGELLALSGQRSPYPQGALGVIKVGAYADLILVDGNPLKNLNLVSNPKDNFDLIMKDGKIYKNTLN

SEQ ID NO: 6390 - DNA, 1260 bp, Pseudomonas syringae pv. phaseolicola 1448A
  CDS (1)..(1260): transl_table=11
atgagtattgctgatcctacacgcctgatcctgcgcaacggccgcctgctggacctgcaaaaagggcaattgatttccggccaggaagtcgtgatcgagggtgagcgcattatcgacgtgcgtgccgaaggcgagcctggcccggttggcgcgcggattatcgatctgggcggcagaaccctgatgcccggcctgatcgactgccatgtgcatgtgctggcttccaacgccaacctgggcatgaatgccctgcaacccaacgcaatcatcatgtaccgcgcattaccgattctggctgcgatgctcaaccgcggttttaccactgttcgtgatgctgggggcgccgactgggcgctggcgcgttcgatccagatggggctgattcccgggccaaggatcttcgcttcgggcaaagcgctgtcgcagaccggcggccatggcgacatgcgcgcacgcggcgaattgctgctcaacgagccctgctcctgttgcttccgcgccggggccatcgcccgcgtggtggatggcgtcgacaatgtgcgcctggccgtgcgcgaagagctgcaacaaggcgccaaccagatcaagatcatggcttcgggcggcgtctcgtcaccaaccgatccgattgccaacacccaatacagcgaagctgaaatccgcgccatcgttgacgaagccgccgctgcgaacacctacgtgatggcccatgcctataccgcacgagcgattcggcgcgccatagaatgcggcgtaagaaccatcgagcacggcaacctggtggatgccgacaccgcccgactgatggccgaaaaaggcgcatttgcggtgccgactcaggtcacctatgaaatgcttgccgagtacggcgagcgcctcggcctgccagcggactcggtggccaaaatcgaggatgtgcgccaggccggccgcaacgccctgctgctgttcgccgaagcgggcgtaccgatgggctatggctcggatttactgggggaaatgcacgagtaccagacccacgaactgaagattcgcgccgaactgctcggtaatctggcggcgttacgcagtgcaacaagtgttgcggcgcagatactccagcgcgagggtgaactgggttgcatcagcgccggtgcgatagccgatctgctggtggtggatggcgacccgctgagcgatatcggttgcctggtcggtcagggcgagcatctggcgatgattgttcagggcggtcacgtgcgtaagaacaccctggtctga

SEQ ID NO: 6391 - protein, 419 aa, Pseudomonas syringae pv. phaseolicola 1448A
MSIADPTRLILRNGRLLDLQKGQLISGQEVVIEGERIIDVRAEGEPGPVGARIIDLGGRTLMPGLIDCHVHVLASNANLGMNALQPNAIIMYRALPILAAMLNRGFTTVRDAGGADWALARSIQMGLIPGPRIFASGKALSQTGGHGDMRARGELLLNEPCSCCFRAGAIARVVDGVDNVRLAVREELQQGANQIKIMASGGVSSPTDPIANTQYSEAEIRAIVDEAAAANTYVMAHAYTARAIRRAIECGVRTIEHGNLVDADTARLMAEKGAFAVPTQVTYEMLAEYGERLGLPADSVAKIEDVRQAGRNALLLFAEAGVPMGYGSDLLGEMHEYQTHELKIRAELLGNLAALRSATSVAAQILQREGELGCISAGAIADLLVVDGDPLSDIGCLVGQGEHLAMIVQGGHVRKNTLV

SEQ ID NO: 6392 - DNA, 1239 bp, Ralstonia eutropha JMP134
  CDS (1)..(1239): transl_table=11
atgacccagattccacagatcctctttcacggcggcgacgtgctcgaccccggcatgggcgagttgctgcgcggccatgatgtcctcgtcgagggcgagcgtattgtcgcggtcggcccggccatcgatgcgcccaacgcacagcgcatcgatgcgcgtggcaagaccgtgatgccgggcctgatcgactgccatgtgcacgtgctcgcgtcgctggcaaacctgggcctgaacgcggtgcagcccaacgtactggtcgccatccgcgccttgccgatcatgaagggcatgctcgaccgtggcttcaccacggtgcgtgatgccgggggcgccgactggggcctgtcgcaggcggtggccactggcctggtgcccggaccgcggatctttccgtccggcaaggcgctgtcgcagaccggcggccatggcgacttccgcccgcgttctgacgtgctggagccttgctcgtgcgcattccgcgccggggccatcgcgcgggttgcggatggtgtcgacgcggtgcgcctggcggtgcgcgaagagatccagaagggtgccacccagatcaagatcatggcttcgggcggcgtggcgtctccgaccgatccgatcggcaatacccagtacagcgaggacgagatccgggccatcgtggccgaagcggaggccgcgcagacttatgtgatggcccacgcctacaccggccgtgccatcacgcgtgccgtgcgctgcggcgtgcgtaccatcgaacacggcaatctggtcgacccagccgccgcgaaggaaatgcgcaggcatggcgccttcgtcgttccgacgctggtcacctatgatgcgctcgcacgcgatggcgcgcgcctgggcctgcctgccgattccgttgccaagatcgagaccgtgcgccaggcggggcgcgagtcgctgcgcatctatgccgacgccggcgtgccgatgggctacggttcggacctgctcggcgagatgcacgaccaccaggccgaagagttccgcattcgtgccgaactgctcggcaacctcgaggcgatccgttcggcgacctcgatcgccgcggccatcctgcagcgcgacggcgaactcggtgccgtgcgggccggggcgacggccgacctgctgctcgtggatggcaatccgttacacgatatcggcctgatcgccggacagggggaacacctcagcgtcgtgatgcaagccggccgtattcaccgtcgcgcgaactga

SEQ ID NO: 6393 - protein, 412 aa, Ralstonia eutropha JMP134
MTQIPQILFHGGDVLDPGMGELLRGHDVLVEGERIVAVGPAIDAPNAQRIDARGKTVMPGLIDCHVHVLASLANLGLNAVQPNVLVAIRALPIMKGMLDRGFTTVRDAGGADWGLSQAVATGLVPGPRIFPSGKALSQTGGHGDFRPRSDVLEPCSCAFRAGAIARVADGVDAVRLAVREEIQKGATQIKIMASGGVASPTDPIGNTQYSEDEIRAIVAEAEAAQTYVMAHAYTGRAITRAVRCGVRTIEHGNLVDPAAAKEMRRHGAFVVPTLVTYDALARDGARLGLPADSVAKIETVRQAGRESLRIYADAGVPMGYGSDLLGEMHDHQAEEFRIRAELLGNLEAIRSATSIAAAILQRDGELGAVRAGATADLLLVDGNPLHDIGLIAGQGEHLSVVMQAGRIHRRAN

SEQ ID NO: 6394 - DNA, 1311 bp, Methanosarcina barkeri str. Fusaro
  CDS (1)..(1311): transl_table=11
atgggagcaacaacgccggctgatcaggcagccaaatcaaagactctttttaccaatgttcacgtcttcgacggcgtgcacaagaagcgcatcgagaatgcctacgtgctggttgaaggtaatctaatcaagcagatctcggcccagaagatcaccgctgacggcgcgatggtgatcgacggcggcggccgtacgatgacacccggctttattgccgcgcatgaacatctgatcgggcaaatgccgttcggagatatcttcacccaagataccagatactatgcatatgtagccacccagacagtgaatacctaccttatgaaaggttatacgacggtccgggacgtcgccggaaatacatactcactgaagaaggccatcgaccggggttatgtcgtgggaccccgcatctatccttccggacccatgatctcccagacagcagggcatgcagaccatcggcatgattccgaagagtcccagctcatcgacggaccctgggatccgatggtgcgttatggcgacatggcgatcgtggacggggtgccggagatgttgaaggccgtcagggaaaacctgcggcggggtgcatcgcagatcaagattgctgtgggagggggcaccggctcttacgccgatcctctcgaagtggtggagttcacgccggaagagatccgggccgccgtccaggccaccgcggactttggcacttacgtcttggcccatgtttacaacaacgatggaattcggcgggcgatcgacaacggcgtgaaaagtatcgagcatgccaacctagttgacgaggagacgctccgctgtatgaaagagaagaatgtctggctctccccgcagatcattgtcttcacctttattccccacggatacacagaggaccaggccaacaagcatcgtcaggcctatgccggcatcgacaatatgttcaaaatatgcaagaagatcggctttaccaagatcgtctttggctcggacatcatcaccgaccccgaaaccttggaacacatcaacgatgaattcaagcatcgcgccaagtggttcacaccggcggagatccttcgccaagcgaccgcgaatggtgcagagctgctcgccatgtcgggtcccaagaacccctaccctggcaaactcggtgtgatcgaggagggagcctatgcagatttattgctcattaacggcaacccactcgaggatatttcggtcctgacaaaaccggaagagaacctcgtgctgatcatgaaggacggcaagatctacaagaacacgctctatgaaagaactcagaacaataaatga

SEQ ID NO: 6395 - protein, 436 aa, Methanosarcina barkeri str. Fusaro
MGATTPADQAAKSKTLFTNVHVFDGVHKKRIENAYVLVEGNLIKQISAQKITADGAMVIDGGGRTMTPGFIAAHEHLIGQMPFGDIFTQDTRYYAYVATQTVNTYLMKGYTTVRDVAGNTYSLKKAIDRGYVVGPRIYPSGPMISQTAGHADHRHDSEESQLIDGPWDPMVRYGDMAIVDGVPEMLKAVRENLRRGASQIKIAVGGGTGSYADPLEVVEFTPEEIRAAVQATADFGTYVLAHVYNNDGIRRAIDNGVKSIEHANLVDEETLRCMKEKNVWLSPQIIVFTFIPHGYTEDQANKHRQAYAGIDNMFKICKKIGFTKIVFGSDIITDPETLEHINDEFKHRAKWFTPAEILRQATANGAELLAMSGPKNPYPGKLGVIEEGAYADLLLINGNPLEDISVLTKPEENLVLIMKDGKIYKNTLYERTQNNK

SEQ ID NO: 6396 - DNA, 1290 bp, Methanosarcina barkeri str. Fusaro
  CDS (1)..(1290): transl_table=11
atgggagcaacaacaccggctgatcaggcagccaaaccaaagactctttttaccaatgttcacgtcttcgacggcgtgcacgagaagcgcatcgagaatgcctacgtgctggttgaaggtaatctaatcaagcagatctcggcccagaagatcaccgctgacggcgcgatggtgatcgacggcggggggcgcacgctgatgcccgggctcatcgatgcccactggcataccatgttctgtttttggcctatcagcaaaatacttagttccgatttcggccttctcagcatagcggccgccaaatcggctggagaaacccttctgcgcggcttcacaacggtgagggatgccggtgccaatgttttctcaataaagaaggccactgatgagggtttgatcgacggccctcgagtttatcctgccggcgcatatatcagccagacctccggtcacggcgatttccgtggccctaatgacgtgcctgagaatccaggcactccgctcgactacatgcagcgagtcgggaacgtgttgatcgcagatggggtgccagaggtgattaagcgcacccgggaggtgcttcgcatgggtgccagccagatcaaggccatggcaggcggcggtgtgacttcactttatgatccactcgatgtcacagaatacacattcgaggagatgaaggcgatctgcaatgttaccaggacctggaacacctatgtcatgatccacgccaataccgacgcggccatccggcagtggattgaagccggtgctctgtccgtcgagcacggtttcttcattgaggaggaaacagcgaaactaatggcagaaaagtgcgtgtggtggagtatgcagccgatgtctgttggtgacgaagacgcttttaaattcgagaatcctattagcacggccaagtatgcgcagtgtgttgccggcctggagaaagtcatcgcgctcaccaaaaagtaccaggttaaaaccgccttcggaaccgacatgcttttcgatcctgagctcgccgcaaaacagggcaaattcctggctaagatgaagaagtggtacacaccctatgaagctctgaaaatggccacccacgataatgcccagctgctcaaactttgcggtccgcgcgacccctaccccgccgagcttggagtggtgaagggaggcgcttatgctgacctgctgctggttgatggaaatccgctggaaagtctcgacctagtggccgatcagaacaacttcaagatcatcatgaaggacgggaagatctacaaaaacacgctctga

SEQ ID NO: 6397 - protein, 429 aa, Methanosarcina barkeri str. Fusaro
MGATTPADQAAKPKTLFTNVHVFDGVHEKRIENAYVLVEGNLIKQISAQKITADGAMVIDGGGRTLMPGLIDAHWHTMFCFWPISKILSSDFGLLSIAAAKSAGETLLRGFTTVRDAGANVFSIKKATDEGLIDGPRVYPAGAYISQTSGHGDFRGPNDVPENPGTPLDYMQRVGNVLIADGVPEVIKRTREVLRMGASQIKAMAGGGVTSLYDPLDVTEYTFEEMKAICNVTRTWNTYVMIHANTDAAIRQWIEAGALSVEHGFFIEEETAKLMAEKCVWWSMQPMSVGDEDAFKFENPISTAKYAQCVAGLEKVIALTKKYQVKTAFGTDMLFDPELAAKQGKFLAKMKKWYTPYEALKMATHDNAQLLKLCGPRDPYPAELGVVKGGAYADLLLVDGNPLESLDLVADQNNFKIIMKDGKIYKNTL

SEQ ID NO: 6398 - DNA, 1263 bp, Burkholderia sp. 383
  CDS (1)..(1263): transl_table=11
atgaccattaccgtgcttcaaggcggcaacgtactcgatctcgaacggggcgtgctgctcgaccatcatcatgttgtgatcgacggcgaccggatcgtcgaagtcaccgatcggccggtggattttccgaatgcgcaggtgatcgacgtgcgcggcaagaccgtgatgccggggttcatcgattgccatgtgcatgtgctggcgtcgaatgcgaatctcggcgcgaatgcgacgcagccgaatattcttgccgcgattcggtcgttgccgattcttgatgcgatgctgtcgcgcgggttcaccagcgtgcgtgatgctgggggcgcggactggagtttgatgcaggcggtcgaaaccgggctggtgtcggggccgcggatttttccgtcaggaaaggcgttgtcgcagaccggcgggcatggggactttcggcctcgtggggatttgctggagccttgttcttgctgtttcaggacgggggcgattgctcgggtggtggacggggtcgaaggtgtgcggctcgcggttcgtgaagaaattcagaaaggcgcgacgcagatcaagatcatggcgtcagggggcgtggcttcgccgactgatccgattgcgaacacgcagtactccgaggatgagattcgggccatcgtggatgaagccgaggccgcgaatacttatgtgatggcgcacgcgtatacggggcgggcgattgcgcgggcggtgcggtgtggggtcaggacgatcgagcacgggaatcttgtggatgaggctgcggcgaagttgatgcatgagcatggggcgtttgtggtgcctacgcttgtcacttatgacgcgcttgccaaacacggcgcggagttcgggatgccgccggaatcggtggcgaaggtggcttccgttcagcagaaaggacgcgaatcgctggaaatctatgcgaacgccggcgtgaagatggggttcgggtcggatctgctcggggaaatgcacgaatttcaaagcggagagttccggatccgggccgaggtgctggggaatctggaagcgctcaggtcggcaacgaccgtggcagcggagatcgtcaacatgcaggggcagctcggggtcgtggcggcgggagcgatcgcggatctggtcgtgcttgatgggaatccgcttgaggatattggggtggtggccggtcagggtgagcgagttgaatatgtattgcagcgagggaggatcgtgaaggcacgtgagttccggcgaaccatggctcgggagagaatctga

SEQ ID NO: 6399 - protein, 420 aa, Burkholderia sp. 383
MTITVLQGGNVLDLERGVLLDHHHVVIDGDRIVEVTDRPVDFPNAQVIDVRGKTVMPGFIDCHVHVLASNANLGANATQPNILAAIRSLPILDAMLSRGFTSVRDAGGADWSLMQAVETGLVSGPRIFPSGKALSQTGGHGDFRPRGDLLEPCSCCFRTGAIARVVDGVEGVRLAVREEIQKGATQIKIMASGGVASPTDPIANTQYSEDEIRAIVDEAEAANTYVMAHAYTGRAIARAVRCGVRTIEHGNLVDEAAAKLMHEHGAFVVPTLVTYDALAKHGAEFGMPPESVAKVASVQQKGRESLEIYANAGVKMGFGSDLLGEMHEFQSGEFRIRAEVLGNLEALRSATTVAAEIVNMQGQLGVVAAGAIADLVVLDGNPLEDIGVVAGQGERVEYVLQRGRIVKAREFRRTMARERI

SEQ ID NO: 6400 - DNA, 1230 bp, Rhodospirillum rubrum ATCC 11170
  CDS (1)..(1230): transl_table=11
atgcgtgagaccgttttccgcaatgcccgtgttcttgacgtcgcccgtggagcctatgacgacggccaatccgtggtggtgcgcgatggcgtgatcgtcgccgtggcgacggatgcccaccggctggccggggccgatgcccgcgagatcgacgtggccggtcgggtgctgatgcccgggctgtgcgatgcccatgtccatgtcaccgcctttacccccgatttcgccctgcttggccgcaccgcgccaagctatgtcaccgtgcgggcccaggacattctgcagggcatgatcgggcggggcttcaccaccgtgcgcgatgccggcggcgccgattggggcttggccaaggccctggccgaaggggcgatcgtcggcccgcgcctgctttattgcggacacgcgctgtcgcaaaccggcggtcacgccgatatgcgcggccccggccagcataatcttgaccaatgcctgtgctgcgccggcctgggtcaagtctgcgacggcgtgcccgaaatgcgccgggcctgccgcgaggagatccgcaagggcgccacccatctcaagctgatggtctcggggggcgtcgcctcgcccaccgaccgcatcgattccacccaattcgccctggacgaactgcgcgccgcctgcgaagaggccgaggccgccaatattccggtgatggcccacgcctataccggccgcgccgccgtgcgggcccttgaagccggcgtcagttccatcgagcacggcaatctgatcgatcaggcggcgatcgataccttgctgcgccttgaccgctggctggtgccgaccctggccacctatcacgccctggccgccgaaggggtcgaggcggggatgccggccgagcttaacaaaaaggtctataccgtgctcgaggctggcaccgaggccctgcgcatggccgccaaagccggggtcaagctggtctatggctcggatctgctgggcaccatgcagcgccaccagctgacggaattcgccatccgcgccgtcgttcaggaccccatcgacatcctgcgcgccgccaccacgcaagccgccgccctgttccgcatggaggatcgcatcggcgccgtgcgcgcgggctatctggccgatctgttgatcgtcgacggcgacgttctccacagcgtcgccccgtggtcggcccccgaagagacgatcaagatggtgatgaaggacggcgagatcctggtctcgcgctag

SEQ ID NO: 6401 - protein, 409 aa, Rhodospirillum rubrum ATCC 11170
MRETVFRNARVLDVARGAYDDGQSVVVRDGVIVAVATDAHRLAGADAREIDVAGRVLMPGLCDAHVHVTAFTPDFALLGRTAPSYVTVRAQDILQGMIGRGFTTVRDAGGADWGLAKALAEGAIVGPRLLYCGHALSQTGGHADMRGPGQHNLDQCLCCAGLGQVCDGVPEMRRACREEIRKGATHLKLMVSGGVASPTDRIDSTQFALDELRAACEEAEAANIPVMAHAYTGRAAVRALEAGVSSIEHGNLIDQAAIDTLLRLDRWLVPTLATYHALAAEGVEAGMPAELNKKVYTVLEAGTEALRMAAKAGVKLVYGSDLLGTMQRHQLTEFAIRAVVQDPIDILRAATTQAAALFRMEDRIGAVRAGYLADLLIVDGDVLHSVAPWSAPEETIKMVMKDGEILVSR

SEQ ID NO: 6402 - DNA, 1470 bp, Frankia sp. CcI3
  CDS (1)..(1470): transl_table=11
atgaccgatcccccggcatcatcggaacaatccctgactccggagcagcctccggcgcacgggcgatccaccgcgacggaacagtccgagtccgggcgtcccgagtccgggcggtcgacggtgcccggacgatcagaggcggccgaggccttcgtcctgcggggggtgcacgtcctcgacaggaccgggcgcttcggtgagccgaccgacgtcgccgtcggcggcgggatcatccatgcggtcggcacgcgactcggtcttgaccgggacgccgtcgacgttgacgcccacgacctgtggctgatgccaggggtcgtcgactgccacgcccacgtcacgcagtccacctatgatccgttcgagctggcgacggcgtcgctgtccacccgggtcctgcagaccgccgccgcgttgcgggcgtcgttggcggccggtgtcacacacctgcgggacgccggcggcgccgacgccggcatccgggacgcggtcagcgcgggcaccgtgcccggacctcggcttgccgtgtccgtcgtcgggctgagccggtccgggcggcacggtgacggggcgatcatcggtcccgggctggagtcggccgaagatcttctcatgccggactatcccggccggcccccgcataccgttaccgaggcgggcagcctgccggcctcggtgcggggcattctgcgggcgggtgcggactggatcatgatctacgcgagcggcggggtgatgtccgcccggccggggcagcccgagccgcagttcagcccggtggagcttgcggccgccgtcgcggaggcccggcggtacggacgtccggtgatgatgcacgccttgggcgagcggtcgatcgaggccgcggtcgcagccggagcgcgttccatcgaacacggcatcgggctcaccgagcccgtggcggccgccatggcggccgccggggtgacgctcgtccccaccctgtcgccctaccaggacctggcggcgctggcggccaccggagtgctgccgggctgggcggcggaccgagccgaggccaccgaggccgcgctggccggcacgatcgcggtcgcccgtgcggcgggggtgccgatcgcgctcggcagcgacgcccggcaccgcacccggcacggcgcgaacctggccgagatcagccggctgcgccatgccgggctcaccccacccgaggcgctgctcgccgcgaccgcgaccggagcccggctcttcggactgggtgagggagccggccgcatcgccgtcggctccgccttcgacgcgatcctgctcgacgcggaccccggggacctgtcgatcttcgagcggccgggcgctgtgagcggagtgttccttggcggtcgcgcggtgctgccccacccgcggctgcccgggaagctggtccgccccaccatggtgatggaagaggtgccgagaatcgttcccgagcggcccgcggtgtcgccgcccggctga

SEQ ID NO: 6403 - protein, 489 aa, Frankia sp. CcI3
MTDPPASSEQSLTPEQPPAHGRSTATEQSESGRPESGRSTVPGRSEAAEAFVLRGVHVLDRTGRFGEPTDVAVGGGIIHAVGTRLGLDRDAVDVDAHDLWLMPGVVDCHAHVTQSTYDPFELATASLSTRVLQTAAALRASLAAGVTHLRDAGGADAGIRDAVSAGTVPGPRLAVSVVGLSRSGRHGDGAIIGPGLESAEDLLMPDYPGRPPHTVTEAGSLPASVRGILRAGADWIMIYASGGVMSARPGQPEPQFSPVELAAAVAEARRYGRPVMMHALGERSIEAAVAAGARSIEHGIGLTEPVAAAMAAAGVTLVPTLSPYQDLAALAATGVLPGWAADRAEATEAALAGTIAVARAAGVPIALGSDARHRTRHGANLAEISRLRHAGLTPPEALLAATATGARLFGLGEGAGRIAVGSAFDAILLDADPGDLSIFERPGAVSGVFLGGRAVLPHPRLPGKLVRPTMVMEEVPRIVPERPAVSPPG

SEQ ID NO: 6404 - DNA, 1281 bp, Novosphingobium aromaticivorans DSM 12444
  CDS (1)..(1281): transl_table=11
atgcgcttgttcgcccgtgttctcttgattgcctcgagcctttgcgccgcgccgctggccgcgcagaagcaggaggcgctgacgctcctgcgacccgacgcggtattcgacggcgagaccgccgtcctgcgcaagggttgggccgtgctggtgcggggcaaccggatcgaggcggtgggaccggatgtcggcgcacctgccgaggcctcggtgctggaactgccgggaacgaccctgatgcccggcatgatcgaggggcattcgcacctctttctccacccctacaacgagacgccgtgggacgaccaggtcctgcacgaaccgctcgcgttgaggactgcgcgggcgacggttcatgcgcgcgcgacgctgatggcaggctttaccaccgtgcgtgatgtcggcaccgagggcgccggctatgccgacgtggggctgaagcaggccatcgagcaagggatcgtgccggggccgcgcatgctggtggcgacgcgggccatcgtggcgcccggcgcctacgggccgcgcgggttcgagccgggcgtggcagtaccgctgggggccgaggaagccggcgggccggaccttgtcgacgcggtgcgtcggcagatcggggcgggtgcggatctggtgaaggtctatgccgactaccgctggggaccgggcgagccgagccgcccgacctttaccgaaggcgagctgaaagcggcggtagaggctgcgcacagcgccgggcggcaggtcgtcgcccatgccagcacggcggaaggaatgcgccgtgccgtggcagcgggcgtcgacaccatcgagcatggggacgaaggtacgccggaggtcttcgccgcgatgaaggccaggggcgtgggcttctgcccgacgctggcggccggggatgcggtggcgcgctatcgcgggtggaacggtacagcgcccatgccgaagagcgtgcaggaagggttcgatgcacttgcaaaggcgcggaaggccggggtggcgatttgcatgggcggcgatgttggcgtctatgcgcacggcgacaatgcgcgcgaagcggaaatgatggtcaagggcggaatgacgcctggcgaagtggccatcgccgcaacatcgggcaatgcgcgcatgttcggcatcggcggccgtctgggcgcggtcaggacgggtatgctggctgacctcgtggcggtcgaaggcaatccgctcgccgatatttcagcgatccggaaggtggcgctggtgatgaaggacggcgtgctgtggaaagggcctgtggggcgctag

SEQ ID NO: 6405 - protein, 426 aa, Novosphingobium aromaticivorans DSM 12444
MRLFARVLLIASSLCAAPLAAQKQEALTLLRPDAVFDGETAVLRKGWAVLVRGNRIEAVGPDVGAPAEASVLELPGTTLMPGMIEGHSHLFLHPYNETPWDDQVLHEPLALRTARATVHARATLMAGFTTVRDVGTEGAGYADVGLKQAIEQGIVPGPRMLVATRAIVAPGAYGPRGFEPGVAVPLGAEEAGGPDLVDAVRRQIGAGADLVKVYADYRWGPGEPSRPTFTEGELKAAVEAAHSAGRQVVAHASTAEGMRRAVAAGVDTIEHGDEGTPEVFAAMKARGVGFCPTLAAGDAVARYRGWNGTAPMPKSVQEGFDALAKARKAGVAICMGGDVGVYAHGDNAREAEMMVKGGMTPGEVAIAATSGNARMFGIGGRLGAVRTGMLADLVAVEGNPLADISAIRKVALVMKDGVLWKGPVGR

SEQ ID NO: 6406 - DNA, 1269 bp, Novosphingobium aromaticivorans DSM 12444
  CDS (1)..(1269): transl_table=11
atgctgcgctatctgcttccgcttgtcgccctgatccctgcaaccgccagtgccgagacgctttacgtgcgtgccgggcggctggtcgaccccgaggcgggcaaggtgctgacgggccaggtgctcacggtcgaggacgggcgggttgtttcggtgcagggggacgggccgttgccgcaaggggcgaaggtggtggactggtcggggtttacggtcctgccggggctgatcgattgccatgtgcatctggccgacgtggagcaatcgaacaacgtggccgagccgctgctccattcggcgatggagatcgggttcatcggtgcgaggaatgcgaagaaaacgctgctggccggtttcaccacggtccacgatgtcgggagtttccgcgcctatgccgacgtcgaactgcgcaatgcgatcaaccggggagatgtgccgggcccgcgggtgagcgcggtgggggcctatgttacgatccccggcggcgggggcgaggtgaccgggttcgcgcccgacgtgacggtgccggccgacatgcgcgcgggcgtcgtgaacgatgcggccgacgtgacccgcaaggtcaatgcgctgttccagaacggcgcggattcgatcaagttgatcgcgacgggcgcggtgctggcgcaggggaccgagccggggcagatcgagctttcgggcgagatgatgaaggcggcggtggacgttgcccgccagcgcggatcatgggtgaccgcccatgcccatggtgcggcggggatcaagcttgccatccagtccggcgtcaaggcgatcgagcatgcgagcctgatcgacgacgaagggatcgcgctggccagggcgcggggcgtgtggctcgacatggatatctacaacggcgacttcattgccgaggtgggcaagcgcgatggctggcccgccgacatgctgcgcaagaacgacgagacgaccgaagcgcagcgggagggctttcgcaaggcggtgaaggcgggcgtcaggttgagctacggcacggatgcgggggtctttccgcacgggctgaacgcgcgacagttcaggtacatggtgcgatacgggatgacgccgatgcaggcgatccagtctgcgacgaccgtggcggccgatctgctggggtggagccgcgacgtgggcgcgctgtcgcccggccactatgccgacatgatcgcggtggcgggcgatccgctggccgacgtgagcgtgctggagaacgtcgcgcacgtgatgaagggcggcgaggtggtgcgctaa

SEQ ID NO: 6407 - protein, 422 aa, Novosphingobium aromaticivorans DSM 12444
MLRYLLPLVALIPATASAETLYVRAGRLVDPEAGKVLTGQVLTVEDGRVVSVQGDGPLPQGAKVVDWSGFTVLPGLIDCHVHLADVEQSNNVAEPLLHSAMEIGFIGARNAKKTLLAGFTTVHDVGSFRAYADVELRNAINRGDVPGPRVSAVGAYVTIPGGGGEVTGFAPDVTVPADMRAGVVNDAADVTRKVNALFQNGADSIKLIATGAVLAQGTEPGQIELSGEMMKAAVDVARQRGSWVTAHAHGAAGIKLAIQSGVKAIEHASLIDDEGIALARARGVWLDMDIYNGDFIAEVGKRDGWPADMLRKNDETTEAQREGFRKAVKAGVRLSYGTDAGVFPHGLNARQFRYMVRYGMTPMQAIQSATTVAADLLGWSRDVGALSPGHYADMIAVAGDPLADVSVLENVAHVMKGGEVVR

SEQ ID NO: 6408 - DNA, 1236 bp, Burkholderia xenovorans LB400
  CDS (1)..(1236): transl_table=11
atgcttattctgaagaacgcccgtgttctggatgtcaatcatgagcacgacgacgcacgctattcgatcgtgatcgagaacgacacgatccgcgaggtgtcgcgcgaacccgtctcgatcaacggtgccgacgtgatcgatgtcgacggtaaaacggtgatgcccggtatggtcgactgccacgcgcatgtgatcgcgtcggttgcgcatctgggtaacaacgggcgcttgcccaacactttcgcggtgctgcgcgccgtaccgattctcgccggcatgctgcatcgcggcttcacgaccgtgcgcgatgcaggcggcgccgactatgcgttgtcgcgagctatcgaagaaggcgtgattgcgggcccgcgcctcttcgttgccggcaaggcgctgtcgcaaaccggcggtcatggcgattttcgcgagcgcttcgacaactcggatcctgatccgtgcggctgtcaccggaacctcggtgcaatcggccgcattgtcgacggcgtggacgagatccgcaaggcagtccgcgaagagatgcgttccggcgcgcaccacatcaagatcatggcgtcgggcggcgttgcatcgccgaccgatccgatcggcaatctgcagttttcagtcgacgagattaaagccgtcgtggaagaagccgcgtcgcatcaaacctatgtgatggcccacgcctataccggcaaggcgatcgcccgagtggtcgaactcggcgtgcgcacgatcgagcacggcaacctgatcgacgatgaagccgccgccgtcatggcaaaacacggcgcgtttgccgtgcctacgctggtgacctacgacgcgatgagcaaggtgggcaccaggtccggggtcggagagagcgcgctcgccaagaacgaatcggtccgtattcaggggctgaaggcactggaaatcctgaagcgtcacggcgtgaagatgggtttgggaaccgatctgctcggcgacatgcatcagtatcaaagcgatgaactgtcgattcgtgcggacattctgggcgcattcgagacgatctgtcaggccactgcgatcggtgctgaaatcgtcggcatgcaggggcgcctcggggtgattgcggcagacgctttcgcggatcttctcgtggtcgacggcgatccttcgagagacatccgcctgctgggcggccagggcgagcggatttccgcggtcatgaaaaatggcgcctgggttcgtcaagccctgtcgtag

SEQ ID NO: 6409 - protein, 411 aa, Burkholderia xenovorans LB400
MLILKNARVLDVNHEHDDARYSIVIENDTIREVSREPVSINGADVIDVDGKTVMPGMVDCHAHVIASVAHLGNNGRLPNTFAVLRAVPILAGMLHRGFTTVRDAGGADYALSRAIEEGVIAGPRLFVAGKALSQTGGHGDFRERFDNSDPDPCGCHRNLGAIGRIVDGVDEIRKAVREEMRSGAHHIKIMASGGVASPTDPIGNLQFSVDEIKAVVEEAASHQTYVMAHAYTGKAIARVVELGVRTIEHGNLIDDEAAAVMAKHGAFAVPTLVTYDAMSKVGTRSGVGESALAKNESVRIQGLKALEILKRHGVKMGLGTDLLGDMHQYQSDELSIRADILGAFETICQATAIGAEIVGMQGRLGVIAADAFADLLVVDGDPSRDIRLLGGQGERISAVMKNGAWVRQALS

SEQ ID NO: 6410 - DNA, 1311 bp, Burkholderia xenovorans LB400
  CDS (1)..(1311): transl_table=11
atgaagcggcgtgtccggcggtattggccggaagcatttcctcatcaagtcaggaacatatcaatgagcattacggtaatcagcggcggcaacgtactcgatctggcccagggcgtgttgctcgagcatcagtacgtcgtgatcgaaaacggccatatcgtcgaagtcaccgatcgtcccgtcgatctgcccaacgcgcgcgtaatcgatgctcgcggcaaaacggtgatgcccgggctgatcgattgtcatgtgcacgtgctggcttcgcgcgcgaacctcggtacgaacgcgacgcagccgaacattctcaccgcgattcgcgcgctgccgattctcaaggccatgctcggccgcggctttacgagtgtgcgcgatgcgggcggcgcggattgggctttgactcaggcgctggagagcggtctgattccgggcccgcgtattttcccgtcgggcaaggcgctctcgcaaacgggcggccacggcgatttccgtccgcgtggcgatatgctcgaaccgtgctcgtgctgctttcgggccggcgcgattgcgcgcgtggtcgacggcgtggatgccgtgcggctcgccgtgcgcgaagagattcagaaaggcgccacgcagatcaagatcatggcctcgggcggtgttgcctcgccgaccgatccgatcggcaacacgcagtattccgaggacgaaatccgcgcgatcgtcgccgaagccgaggcggccaatacctacgtgatggcgcacgcgtacacgggccgcgccatctcgcgggcgattcgctgcggcgtgcgcaccatcgagcacggcaacctggtcgacgaagccgccgcgaagctgatgcgcgaacatggcgcgttcgtggtaccgacgctggtcacgtacgacgcattggccaaacacggcgccgactatggtttgccggccgactcgatcgccaaggtcgaaaccgtgcggcaagcggggcgcgactcgctacagatctatgcgaatgccggtgtgccgatgggtttcggttccgacctgctcggcgaaatgcacacgttccagagcgacgaattgcgtattcgcgccgacgtgctcggcaatctggaagccttgcgttcagccacgacgatcgccgcggatatcgtcgatctgagcggcaagctgggcgtcatcaaggccggcgcgattgccgacattctcgtggtggacggcgatccgctcacggacatcggcgtgctgaccgggcagggcgagcgcatcgagtacgtatttcagcgaggcgaagtggtgagcgagcgaggcagcgtcgcgtcgcgctga

SEQ ID NO: 6411 - protein, 436 aa, Burkholderia xenovorans LB400
MKRRVRRYWPEAFPHQVRNISMSITVISGGNVLDLAQGVLLEHQYVVIENGHIVEVTDRPVDLPNARVIDARGKTVMPGLIDCHVHVLASRANLGTNATQPNILTAIRALPILKAMLGRGFTSVRDAGGADWALTQALESGLIPGPRIFPSGKALSQTGGHGDFRPRGDMLEPCSCCFRAGAIARVVDGVDAVRLAVREEIQKGATQIKIMASGGVASPTDPIGNTQYSEDEIRAIVAEAEAANTYVMAHAYTGRAISRAIRCGVRTIEHGNLVDEAAAKLMREHGAFVVPTLVTYDALAKHGADYGLPADSIAKVETVRQAGRDSLQIYANAGVPMGFGSDLLGEMHTFQSDELRIRADVLGNLEALRSATTIAADIVDLSGKLGVIKAGAIADILVVDGDPLTDIGVLTGQGERIEYVFQRGEVVSERGSVASR

SEQ ID NO: 6412 - DNA, 1281 bp, Acidobacteria bacterium Ellin345
  CDS (1)..(1281): transl_table=11
atgaaaaggctgattgcggttctcttgttcctctgtacgcttgccttcgcgcaatccactcccaacaacgtggtcgtcgtgaaagccggccatctgctcgacgtcaaaactggtcagtaccagaacaacgtcaacatcgtcatcgagagcggcgtaatcaagagcgtcggctcaggcgctcctccggcaggcgcgaaggtcatcgatctctccaacgcgacggtgctgcccggactcacagacgcgcacacgcacctcacctatgacgccggcgatgtcggcctgaagggcctgacgatctcgccggaaaaagaagctttgaatggcgcaggaaatgcacgcatcacgctcctagccggattcacgaccgtccgcaatgttggagcgcgtgcttttgccgatgttgctctccgtgatgccatcaacgatggccacgtccctggcccgcgcatgctcgtcagcggtccggcattgagcatctcgggcggccacggcgataacaatctccaaccctgggaagaccactcctacggcgacggggttgccgacggcgttgacgccgtgcagcacaaggtccgcgacaacatcaagtacggcgccgacgtcatcaagttcatggccaccggtggcgttatgtcgaagggcgataaccccgagcactcgcagtacacgctcgaggaaatgaaaatgatcgtcagcgaggcgcaccgcttcggccgcaaggtcgccgcgcacgcacacggcgtgcagggcattatgtgggcgactgaggccggagtggattctatcgagcacggcacctatatcaacgatgaagccatcgcgctcatgaagcagcacggcacctaccttgtccccacgctctatctcaccgagtggctgcccgagaacgccgacaagatcggcattccgccatacgtgaaagccaaaatgaatgtcgtgctacccctgctccgcaagaacatttcgcacgcgttcgccagcggcgtgaaggtcgcttttggcaccgacgccgccgtttatccgcacggcctcaacggtcatgaattcaagacctacgtcgatcttggcatgacgccactccaggccattcaaagctcgaccatcggcgcgcccgacctgctcggcatgaccgacaagatcggtaccgtcgaagccggcaagttcggtgacctgatcgccgtcaccggcgacccgttgaaggacatcacagaactgcagagagtgaagttcgtgatgaagggcggcgaggtgtacaaagacgaaatccacgcccactaa

SEQ ID NO: 6413 - protein, 426 aa, Acidobacteria bacterium Ellin345
MKRLIAVLLFLCTLAFAQSTPNNVVVVKAGHLLDVKTGQYQNNVNIVIESGVIKSVGSGAPPAGAKVIDLSNATVLPGLTDAHTHLTYDAGDVGLKGLTISPEKEALNGAGNARITLLAGFTTVRNVGARAFADVALRDAINDGHVPGPRMLVSGPALSISGGHGDNNLQPWEDHSYGDGVADGVDAVQHKVRDNIKYGADVIKFMATGGVMSKGDNPEHSQYTLEEMKMIVSEAHRFGRKVAAHAHGVQGIMWATEAGVDSIEHGTYINDEAIALMKQHGTYLVPTLYLTEWLPENADKIGIPPYVKAKMNVVLPLLRKNISHAFASGVKVAFGTDAAVYPHGLNGHEFKTYVDLGMTPLQAIQSSTIGAPDLLGMTDKIGTVEAGKFGDLIAVTGDPLKDITELQRVKFVMKGGEVYKDEIHAH

SEQ ID NO: 6414 - DNA, 1338 bp, Acidobacteria bacterium Ellin345
  CDS (1)..(1338): transl_table=11
atgaaaaccaagttcgtgctcgcgctcttactcaccacgcttgctttcgcgcaacaacccaagccgaagcccgtgcccaaggtcacctacatccgcgccggccacctcttcgacgccacctccgacaatcgtcgcgacaatgtggtcatcgtcgtggaaggcgaccgtattaaatccgtggaagccgggagcttcgcgatcccgaacggatcgacagttatcgatctccgcaacgctacagtgctgcccggcctgattgattgccacacccacctgaccgcgcgcgccgaccgctacgatcccatcaattacttcaagggaacgccgttcaccgaggggtttgccgcggtgcgtaacgcacattccacgctgctcgcgggattcaccacggtgcgcgatgtcggatcgccgccgtttgccgccgtggacctgcgcaatgccatcaatgatggctttatctccggcccgcgcgtggttgccagcggcccaccactctccatcaccggcggacacggcgacgtgaacggattttcgcccgaaacccgcgtcaccctgttccccgaccagcgcgacttccgcattgctgacggtgtggaccaggtccgccagacggtgcgcgcgcaggtgaaatacggcgttgacgtaattaaagtcctcgctaccggcggcgtcctttcgcaaggcgatagccccggcgcgccgcaattcacctttgaagaacttaaaactgccgccgacgaagcccacgctgcgggccgcaaggttgccgcgcacgcccacggcgccgaaggcatcaagcgcgccatactcgcgggcattgattccatcgagcacgcctcgctcgccaacgacgaagacatcgcgcttgccaaggagcacggcacgtatttcgtcatggacatctacaacgacgactacattctcggcaaagccgttgaattcggcctgcccgcggcgaacgtcgagaaagaaaagatggtcggccgcacccagcgcgagaactttgagaaggcgttcaaagcgggcgtgaagatggcgttcggcaccgacgccggcgtctacccgcacggcgacaacgcgaagcagtttaaatacatggtgcaattcggcatgacccctgcgcaggcgatccgcgccgccacgttcaatgccgccgacctcatcggccgcagtaaagacgtcggcaccgtcgaagccgggaaattcgccgacatcatcgccgtcagcgacgatccgctcgcgaacgtgcaggcgctggagaacgtgcagttcgtgatgaagggcggggtggtttacaaggacaagatcgcgaatacggcggtcgctgcaatcgaataa

SEQ ID NO: 6415 - protein, 445 aa, Acidobacteria bacterium Ellin345
MKTKFVLALLLTTLAFAQQPKPKPVPKVTYIRAGHLFDATSDNRRDNVVIVVEGDRIKSVEAGSFAIPNGSTVIDLRNATVLPGLIDCHTHLTARADRYDPINYFKGTPFTEGFAAVRNAHSTLLAGFTTVRDVGSPPFAAVDLRNAINDGFISGPRVVASGPPLSITGGHGDVNGFSPETRVTLFPDQRDFRIADGVDQVRQTVRAQVKYGVDVIKVLATGGVLSQGDSPGAPQFTFEELKTAADEAHAAGRKVAAHAHGAEGIKRAILAGIDSIEHASLANDEDIALAKEHGTYFVMDIYNDDYILGKAVEFGLPAANVEKEKMVGRTQRENFEKAFKAGVKMAFGTDAGVYPHGDNAKQFKYMVQFGMTPAQAIRAATFNAADLIGRSKDVGTVEAGKFADIIAVSDDPLANVQALENVQFVMKGGVVYKDKIANTAVAAIE

SEQ ID NO: 6416 - DNA, 1290 bp, Myxococcus xanthus DK 1622
  CDS (1)..(1290): transl_table=11
atgcgcgccttcctcttcgtctcgctgttcgccaccaccgtggcgaccgctgccgaaccgacgcacaccgccccaccagcgtcctatctgttgcgtcccgaccgcgtcttcgaaggtgtcacctccaagccgcacacgggctgggtcgtcctggtgacgggcgaccgcatcgccgccgcggggccggaagccaaggtgaaggtcccccagggcaccacgtccgttgacttgagcggcaccacgctgctgcccggcctcatcgagggccactcccacctgctcctccatccgtacaacgaggcctcctggaacgaccaggtgctgaaggagtcgctggcgcttcgggtggcccgcgccaccaaccacgcccgcgccacgctggcggcgggcttcaccaccgccagggacctgggcaccgagggcgcggccgacgcggacgtcggcctcaagcaggccatccaccagggcatcatccccggcccgcgcctactggtggccacgcgcgccatcgtcgccaccggcagctatggccccaagggcttcgcctcggagtggcacgtcccccagggagcggaagaggcggacggcgtggagaccctcacccgggtggtgcgcgcgcaaatcggccagggcgcggactgggtgaaggtgtacggcgactaccgctggggccccaaccacgaagcccgccccaccttctccctggaggagctgaagcgcatcgtcgacaccgcccgaagcagtggccgcccggtgtccgtccatgcgaccacaccggagggcatccgccgcgcggtgctggcgggcgcggagagcatcgagcacggggacgaaggcaccgccgaggtgttccgcctcatggcccagcggggcgtctacctctgccccaccctggccgccagcgaagcgatgttcgaacaccgcggctacaagcgcggcgtggacccggagcccacccacctccaacagaagcgcgccaccttccgcgcggccctcagcgccggcgtccccatgtgcgcggggggagactccggcgtcttcccccacggagagaacgcgcgcgaactcgagctgatggtggcctacggcatgacgcccgcgcaggcgctccaggccgccacctccaacaacgcggcgatgctccaccgcgaggaccagttgggccaggtgaaggcggggctgctcgcggacttggtggcggtggagggagatccaacgaaggacatcaccaccctgcgcaaggtgcgctgggtgatgaagggcggcacggtcgccgtggagcgtcgctga

SEQ ID NO: 6417 - protein, 429 aa, Myxococcus xanthus DK 1622
MRAFLFVSLFATTVATAAEPTHTAPPASYLLRPDRVFEGVTSKPHTGWVVLVTGDRIAAAGPEAKVKVPQGTTSVDLSGTTLLPGLIEGHSHLLLHPYNEASWNDQVLKESLALRVARATNHARATLAAGFTTARDLGTEGAADADVGLKQAIHQGIIPGPRLLVATRAIVATGSYGPKGFASEWHVPQGAEEADGVETLTRVVRAQIGQGADWVKVYGDYRWGPNHEARPTFSLEELKRIVDTARSSGRPVSVHATTPEGIRRAVLAGAESIEHGDEGTAEVFRLMAQRGVYLCPTLAASEAMFEHRGYKRGVDPEPTHLQQKRATFRAALSAGVPMCAGGDSGVFPHGENARELELMVAYGMTPAQALQAATSNNAAMLHREDQLGQVKAGLLADLVAVEGDPTKDITTLRKVRWVMKGGTVAVERR

SEQ ID NO: 6418 - DNA, 1227 bp, Mesorhizobium sp. BNC1
  CDS (1)..(1227): transl_table=11
atgaccaaactgctgctgaaaaacgccaacattctcgacgttgtggccggtcgcctcatcggcgagcatgacgtgctaatcgccgatgggcggattcgcgaaatagaccatggcctcagccataattcggcccgccagatcgaccttgctggccgaacgctcatgcccggcctctgcgatgcgcatgtgcatgcggctgcgccgatgaattcgtttgccgagctcgaatgcctgtctccatcctacgtcgcgatccgaagcgccaaggtcctggagggcatgctactacgcggttttacgactgtccgggacggcggcggcgcagatttcggccttgcacgagcggtcgacgagggattcgtgacgggaccaaggcttctctactgcggcaaagcgctttcgcaaaccggaggccatggagacatgcgccagcccggccagctggcgcgagacgcgcatccatacgtccctggcctaggacagatctgcgacggcgttgatgccgtcaggcgcgcagtgcgggaagagatccgccgaggcgcccaccacatcaagctcatggttggcggcggcattgcctccccgtccgatcccatcgatcaggatcagttttccaaggaggagattttggcggctgtcgaggaagccgaatgcgcgaacagatatgtcatggtacattcctatgcaaacaggtctgtcgcgcgggcagtacaatgcggagcgcgctcaattgaacatgccaactttctggacgacaagaccgcgcagatcattcgggaacatcaggcgcatgtagttccaacgctggctatcttccatgtcatggtgaaggaggggctggagatcggcatctcaccgcgagtgcacgccattaacaagcacgtgctggagcacgggatgcgcgccctcgaagtcgcccgacgcaaccaggtctcgcttgcttacggcactgatctcagcgggcaattgcatatccatcaatcggtcgaattctcactgcgggcggaggttttctcgccggccgatctgctgcgccaggcaactgtcaacgcagccgagttgtttcgcatggccgatcgaatcggcaaggttgcggtcggattcgaagccgacctcattggcatcgacggcgatccgctggagcgcatcggggtgctccaggagcagggtcgccatatcgatctcatcataaagggcggctcggtcatcaaggcccagctcaactaa

SEQ ID NO: 6419 - protein, 408 aa, Mesorhizobium sp. BNC1
MTKLLLKNANILDVVAGRLIGEHDVLIADGRIREIDHGLSHNSARQIDLAGRTLMPGLCDAHVHAAAPMNSFAELECLSPSYVAIRSAKVLEGMLLRGFTTVRDGGGADFGLARAVDEGFVTGPRLLYCGKALSQTGGHGDMRQPGQLARDAHPYVPGLGQICDGVDAVRRAVREEIRRGAHHIKLMVGGGIASPSDPIDQDQFSKEEILAAVEEAECANRYVMVHSYANRSVARAVQCGARSIEHANFLDDKTAQIIREHQAHVVPTLAIFHVMVKEGLEIGISPRVHAINKHVLEHGMRALEVARRNQVSLAYGTDLSGQLHIHQSVEFSLRAEVFSPADLLRQATVNAAELFRMADRIGKVAVGFEADLIGIDGDPLERIGVLQEQGRHIDLIIKGGSVIKAQLN

SEQ ID NO: 6420 - DNA, 1236 bp, Mesorhizobium sp. BNC1
  CDS (1)..(1236): transl_table=11
atgaccagctttcttttcaccaatggcagggtgcttgaccccgaggctggtgtgacgaggggcggccttgatgtgctcgtggaagaaggccgcatcagaaatgtgggcgagcgcctcgatgcgccctcgggcgcgcggcgcatcgaccttgccggccgcacgctcatgccgggcctgatcgactgccatgtgcacgtggtggcggaaacgctggacctttgggccaacataatcgcgcccacctcactctctgccttgcgctcggcgcgcgtcatggaagaggcgctgcagcgaggtttcaccaccctgcgggatctcggcggggcggatatcgggttggtgcgcggcgtggaggaaggtctgataaagggtccgcgcctcattatctgcgggaaagggctcaccacgacgggcgggcatgcggacctcaggcagcgaacggacaaccggccgggcatgatgtcggaccgtctgggctccatgggctatgtggtggacggcgtcgacgcctgccggctggccgcgcgggagatgatcaagggcggggcgcgcttcatcaagatcatggctaatggcggcgtctcttctcccaacgaccccatcgaatccatccagttctcgcgcgaggagattgccgccatcgtggaggaggccgagaacgcgaacatctatgtctcggcccatctttatacagatcgcgcaatccgccgcgccgtggagctcggcgttcactcgctggagcactgcaacctgatcgaaccggaaaccgcccgaatggcggccgaaaagggctgcatcgccgtgccgacgctggtggcttacgaggcgctgcatctggaaggcaagcgcttcggcttcggcgagacggagttctccaagatcgacgtggtgcgcaacgggggcctgaagtcgcttaagatcatgcgagacgccggcctcaaaatggccttcggctccgacctgctcggcgaattgcggaaatatcactgcatggaattcgagcttctggcgaaggtgctcacacccgtggagatcatccgctcggccaccgtgatcggcgcggagctttgcggttatgccggcagcctcggcgtgatcgcgccggatgcactggccgacctgatcgtggtcgacggtgatccgctggaggacatcgcccttctgcaggacgatggcgcgcatatcccgctggtcatgcgcgacggcgtcgtcctgaaggaccggctcgaaagctga

SEQ ID NO: 6421 - protein, 411 aa, Mesorhizobium sp. BNC1
MTSFLFTNGRVLDPEAGVTRGGLDVLVEEGRIRNVGERLDAPSGARRIDLAGRTLMPGLIDCHVHVVAETLDLWANIIAPTSLSALRSARVMEEALQRGFTTLRDLGGADIGLVRGVEEGLIKGPRLIICGKGLTTTGGHADLRQRTDNRPGMMSDRLGSMGYVVDGVDACRLAAREMIKGGARFIKIMANGGVSSPNDPIESIQFSREEIAAIVEEAENANIYVSAHLYTDRAIRRAVELGVHSLEHCNLIEPETARMAAEKGCIAVPTLVAYEALHLEGKRFGFGETEFSKIDVVRNGGLKSLKIMRDAGLKMAFGSDLLGELRKYHCMEFELLAKVLTPVEIIRSATVIGAELCGYAGSLGVIAPDALADLIVVDGDPLEDIALLQDDGAHIPLVMRDGVVLKDRLES

SEQ ID NO: 6422 - DNA, 1239 bp, Rhodococcus sp. RHA1
  CDS (1)..(1239): transl_table=11
atgactaccaccacggacaccaaccgcacctggctgttcaccaacgcgtccgtgctcgacccggacgtgggaaccctccacccggaccgccgggtcctcgtcaccgacggtgtcatcaccgaggtcggcggtagcgaggtcagctaccgcggggccgagacgatcgacctgcacggccgcaccctcatgcccggcctgatcgatgcgcatgtgcacgtcaccgcggccaccgcggacctgtccgccctcccccggatggcgccctcgtacaccaccctgcacgccgccgccgagctgaaccggatgctgcgccgcggattcacctccgtccgcgactgcggcggcgccgaccacggtctcgccgccgggatccgggccgggctgatccaagggccgcggctgcactacgccggcaaggcgctctcgcagaccggcggtcacggcgatgtccgccacccgggcgacgacaccccgggcagccattactgctgccccgatttcgggcgggtctgcgacgggatctccgaatgccgccgcgccgcccgcgacgagctgcgcaagggcgccacccacctgaagatcatgctcagcggcggtgcgacgtcaccgaccgaccggatcgacagcacccagttctcggtcgaggagatccgtgcgatcgtcgaggaggcgcgggcggcgaaccggtacgccgccggtcatgcgtacaccccggaggctattgcccgcggtgtcaccaacggcgttcgctcgatcgagcacggcaacttcatcgacgacgcgaccgctgccctgttccgtgagcacgacgcgttcatcgttccgacgttggtcacctatcacgccctgtcgaaggagggcgcggctgccgggctgtcggatgcactgcaggcgaaggtgtccgaggtactggaggcgagcttccgaggccttgagaccgctcaccgcaacggcatcaacatcgccttcggctccgatctactcggctccctgcaggatcgccaactcgacgaattcaccctccgcactcaggtgcaggaaccggtggacgtgatccgctctgccacggtggtgggcgcgcgtctgctccaggcggacgggcggctgggcatcgtggcaccgggcgcccatgccgatctcctggtagtcgacggaaatcccttggaggacatcaccgctctcaccgactccgttcacatggtgatggccggcgggtcgatgatcctgcgttccctctga

SEQ ID NO: 6423 - protein, 412 aa, Rhodococcus sp. RHA1
MTTTTDTNRTWLFTNASVLDPDVGTLHPDRRVLVTDGVITEVGGSEVSYRGAETIDLHGRTLMPGLIDAHVHVTAATADLSALPRMAPSYTTLHAAAELNRMLRRGFTSVRDCGGADHGLAAGIRAGLIQGPRLHYAGKALSQTGGHGDVRHPGDDTPGSHYCCPDFGRVCDGISECRRAARDELRKGATHLKIMLSGGATSPTDRIDSTQFSVEEIRAIVEEARAANRYAAGHAYTPEAIARGVTNGVRSIEHGNFIDDATAALFREHDAFIVPTLVTYHALSKEGAAAGLSDALQAKVSEVLEASFRGLETAHRNGINIAFGSDLLGSLQDRQLDEFTLRTQVQEPVDVIRSATVVGARLLQADGRLGIVAPGAHADLLVVDGNPLEDITALTDSVHMVMAGGSMILRSL

SEQ ID NO: 6424 - DNA, 1278 bp, Hyphomonas neptunium ATCC 15444
  CDS (1)..(1278): transl_table=11
atgaaaaaactcactgccgctgccatttgcgcgatgctgctttccgcgcccgccatggctgaagatgcaatcatccatgctggctatgttctggccaagccgggcgaaggctatctcacccgtcagacaatcctcgtggaggatggccgggttgtttcagtcacgtctggctactcaacgccgaaagactatgcggtgatcaatctgcgtgacgcatatgttctgcccggcctgatcgacagccatgtgcacattaccggcgagaatggcccggaaggccgtatcaaggaatttgagaactcggatgtcgatacagcgtttgatggcgctgcgtttgcgttgaccacgctggaggcaggcttcacgaccgttcaggatgtcggggcgcccaatgattccatcttcgggctgcgggatgccatcgcgcggggggctgtgccgggcccgcgtctgcgcgcatcgggcggtagtgtggccgttacgggcgggcatggtgatataaacggctattcggcccgcgtgatggcagaattcacgggcgccaatatctgcaacggggcggacgattgccgccgggctgtgcgtcaacagatcaaggaaggcgccgatctgatcaagatcacggcaacaggcggcgtactttccaatacgtccgcgggcctggaacaacagttcacggaagaagaactcgaagctatcgtagatgccgcgcactcgatgggcaggaaggttactgcccacgcgcatggcaagagcggtgtggacgccgcccttcgcgccggtatcgactcgatcgagcacggcacctatctcgacggggagtcgattgccctgttcaaggaaaatggtgcaacgctggtgccgacggttctcgccggcgcgactgtaaccggatggaccaatgaaccctggctgccggctgcctcgcgagcgaaggctgcgcaggttggcccgctgatgcttgaaatgcttcgccgggcgcatgagggcggggtcactgtagcgttcgggaccgacaccggcgtctcccgccatggtgacaatgccaaggaatttgccttgatggtcgaggccggattcacgccggaagaagcaatccgttcggccacggtggtggcgtcagaacatctggaaatgtcgcaggatataggcactctggaggctggcaaatatgccgaccttatcgcggtgacggccgatcctctcaaggacatccgggcgcttgaggcagtcagctttgtcatgaagggcggagaggtctacaagtccggcaagtaa

SEQ ID NO: 6425 - protein, 425 aa, Hyphomonas neptunium ATCC 15444
MKKLTAAAICAMLLSAPAMAEDAIIHAGYVLAKPGEGYLTRQTILVEDGRVVSVTSGYSTPKDYAVINLRDAYVLPGLIDSHVHITGENGPEGRIKEFENSDVDTAFDGAAFALTTLEAGFTTVQDVGAPNDSIFGLRDAIARGAVPGPRLRASGGSVAVTGGHGDINGYSARVMAEFTGANICNGADDCRRAVRQQIKEGADLIKITATGGVLSNTSAGLEQQFTEEELEAIVDAAHSMGRKVTAHAHGKSGVDAALRAGIDSIEHGTYLDGESIALFKENGATLVPTVLAGATVTGWTNEPWLPAASRAKAAQVGPLMLEMLRRAHEGGVTVAFGTDTGVSRHGDNAKEFALMVEAGFTPEEAIRSATVVASEHLEMSQDIGTLEAGKYADLIAVTADPLKDIRALEAVSFVMKGGEVYKSGK

SEQ ID NO: 6426 - DNA, 1311 bp, Hyphomonas neptunium ATCC 15444
  CDS (1)..(1311): transl_table=11
atgtctatttccaggcgcgttctgcgcaccgctgcgatggcggcgattctgatggctggcgcgttgccggcggtttccgaaaccgttctgatccatgcgggtaaagtgctcgatgtgccgggcaatgcgccgcgtggggccaccacgattacggtgaccgatggcaagatcgtatcgcttgagaacgggcacaagagggcaagcggcagtgacgtgcgggtgatcgacctgaaggacagctttgtgctgccgggcctgatcgacagccatgtgcacctgacctcggattccggcgggatcgtctggcagctggaagagatcaccctgtcgccggcggcgcaggcgtttgatgcctgggacaatggcatgaagaccctgcgcgcgggctttaccaccgtccgcaatctgggcgatggcgacggcgcggtgctggcgctgcgcgacgcggtcaatgacgggcaggtgcaggggccgcggattctggacgcggcaaactccatctctgtttcctccggccatatggacagctcgctgggataccgcgatgagctgcggccctatttcaaggcggcgggcaatacatgtgacggcgccgaagactgccgccgggccgtgcgcctgcaagtctcgcgcggggctgacctgatcaagctggcgaccacgggcggcgtcaacagccggatcggcgcgggcctgggcaagcagatgttcgaggatgaagcggttgccattgtcgaaacggcaaagctgttcggcaaaaaggtggccgcccatgcccatggcggcgacggtatccggctggcgctggaggcgggcgttgattccatcgagcatggcacgatcctcgacccggaaaccatcgaggcgtttgtggcttcgggcgcctattacgtgccgacgctttcgaccgtgaacggatatatcgagcggatggaagccaatcccgatgcctatgagccggatgtgcgcgccaagatcgagtggcgcatcggcatcacgggcaagagccttgagattctctatcccaaaggcgttccgattgcctttggcaccgatgcgggcgtttccaaacatggccgcaatgccgatgagttcgagctgatggtgcgctttggcatgtcgccgatggaggccatcaaggcggcgacggtgaatgcggcagacctgctcggcatcaccgatgtggccggcacgctggagccgggcaagagcgccgacatcatcgccgtgaagggcgacccgattgccgatgtgaagctgctgaagtcggtgagcttcgtgatggcgcgcggtgaggtggtgaaggagtag

SEQ ID NO: 6427 - protein, 436 aa, Hyphomonas neptunium ATCC 15444
MSISRRVLRTAAMAAILMAGALPAVSETVLIHAGKVLDVPGNAPRGATTITVTDGKIVSLENGHKRASGSDVRVIDLKDSFVLPGLIDSHVHLTSDSGGIVWQLEEITLSPAAQAFDAWDNGMKTLRAGFTTVRNLGDGDGAVLALRDAVNDGQVQGPRILDAANSISVSSGHMDSSLGYRDELRPYFKAAGNTCDGAEDCRRAVRLQVSRGADLIKLATTGGVNSRIGAGLGKQMFEDEAVAIVETAKLFGKKVAAHAHGGDGIRLALEAGVDSIEHGTILDPETIEAFVASGAYYVPTLSTVNGYIERMEANPDAYEPDVRAKIEWRIGITGKSLEILYPKGVPIAFGTDAGVSKHGRNADEFELMVRFGMSPMEAIKAATVNAADLLGITDVAGTLEPGKSADIIAVKGDPIADVKLLKSVSFVMARGEVVKE

SEQ ID NO: 6428 - DNA, 1305 bp, Hyphomonas neptunium ATCC 15444
  CDS (1)..(1305): transl_table=11
atgttcacacgcgccctcgccacagttgcaacggccttcatgatcgccggcggcgctgcgtcagctgaaacggtttacctcacggctgggcattttgttgaccccgtttccggcgaaaccgtgcgggacgccgctttcgtgatcgaagacggggcggtgacagggcgcggaacgaagtccagcctcaaggcaccgcgcggggcaaaaacggtggatctgggcgcggcgtatctgatgccgggcttcatcgacatgcacgtccacctgaccagcgacgcggaagacgggccctattattccctcagcctctcggatgagcgcatggccatcaagggtgtgaagaacgctcgtaagacgctgctggcgggcttcacaaccgttcgtaatctgggcgccgaaagctatggggatgtggccctgcgcgaggcgattgatgcgggtgaagtgcctgggccacgtttgctcgtctctggcccgccggttgggatttcgggagggcactgctcggatacgaaccttctgccttccgagtatcgcctgaagggtgaaggcgttgccaacggcccctgggaaatgcgcgccaaggttcgcgagaacatcaaatatggcgttgatctcatcaagacgtgctcaacgggcggcgtcctctccaaaggcacggccctgggcgcggcccaaggcacgatcgaggaaatcgaggctatcgtggaagaagcacatgcccgcggattgaaagtggccagccatgcccacggcaccgtgggcatccgcaatgcaattatcgcgggcgttgatacggtcgagcatggctcgatcatggacgaggcaacgatccagctggctgtggaacacggcacttacctgtcgatggacatctacaataccgaatacatcctctctgaaggcgctaagaacgggctgctggaagagtcgctcgccaaggagcgctcaatctcggcgcgccagcgggcgagctttaccgccgctgttgaggcgggcgcgaaggtcgtgttcgggtcagacgcaggcgtctatccccatggcctcaatggcaaccagttctcgcgcatggtgacgttcggcatgacgccgatgcaggcgttgcgggcgggtacgtcctttgcggcagaagcgcttggcaagactggcgaagtcggctgcggtgatgtgggctgcaaggcagacttcgtggccgtcagcgccgatccgctggccgacatgcaacgccttgccgatgtggagttcgtgatgaagggcggggtcgtctacaagcaggacggcgcgccgcaggccccgtcattctag

SEQ ID NO: 6429 - protein, 434 aa, Hyphomonas neptunium ATCC 15444
MFTRALATVATAFMIAGGAASAETVYLTAGHFVDPVSGETVRDAAFVIEDGAVTGRGTKSSLKAPRGAKTVDLGAAYLMPGFIDMHVHLTSDAEDGPYYSLSLSDERMAIKGVKNARKTLLAGFTTVRNLGAESYGDVALREAIDAGEVPGPRLLVSGPPVGISGGHCSDTNLLPSEYRLKGEGVANGPWEMRAKVRENIKYGVDLIKTCSTGGVLSKGTALGAAQGTIEEIEAIVEEAHARGLKVASHAHGTVGIRNAIIAGVDTVEHGSIMDEATIQLAVEHGTYLSMDIYNTEYILSEGAKNGLLEESLAKERSISARQRASFTAAVEAGAKVVFGSDAGVYPHGLNGNQFSRMVTFGMTPMQALRAGTSFAAEALGKTGEVGCGDVGCKADFVAVSADPLADMQRLADVEFVMKGGVVYKQDGAPQAPSF

SEQ ID NO: 6430 - DNA, 1233 bp, Leuconostoc mesenteroides subsp. mesenteroides ATCC 8293
  CDS (1)..(1233): transl_table=11
atgacagaaactaaatattataattttaatggttttaattcaaaaacaggtaattttgatccacaatgttatgccattgtggatgatgaaacaggacgatatactgaagtcgggcatggtgaaggtcctaaattgggacagagcgttgatgtgggtgaaaaatatatgatgcctggtataattaatacgcacattcatgttgactctgatgtgaattatgaatttggaaaaactaaatttggtgtggataatgaaaacgaacatgttcgtgcagtgattgtggcaacccacaatatgaaaacgatgttacgtcatggtgtaacagttgtacgaaatgttggaacagcacgcatgacagatattgaaattgcacgcatgcagcgtgaaggcagtgtagaaggaccaatgatgattgctagtggggcagctttttccatgactggtgggcacggtagtggtggaggaggcattgaggtagatggtgttgatgaagtgcgcaaggcagtacggcaagctatgaaagaaggcgctcaaatcattaagtttatggtgactggcggggtgagcgctggagattttgaaaatcccaatcaagttcaattaaatgaagacgaggtacgagcaggtgttattgaagcacataaaaaaggtatcaaagttgcggcacatgctcaaggggctgagggaattaagattgcaattcgtgctggtgttgattccgttgaacacgcatttcacattgatgatgaagcaattgatatgatgaaagtaaatgggacctttgtagttccaacaatgattgcgatgaagcgtattattgatcggcctgaggaagttccggcatggatgattgaacgtgcgacaacgcattggcaagcacatcagaagagcgttgcacgagctgccatggcaggagttaacattgccatgggaacagatgctggtacacccttcaatggttttgcaaatgagagcgctgtggaaatggatatgatggttgaatttggtcatatgacaccacaacaagttttacaatcagctacgattaatgcagctaaattgatgggaattagtgataattatgggatgatagcagttgggcaatatgctgacttcatcgtaattcaagagaacccaaatgataatataaaagctattcaggaaaaagataagtgggtatttcaacatgggcaacccgtggtatttcatcaagaagagaacatcatttcatag

SEQ ID NO: 6431 - protein, 410 aa, Leuconostoc mesenteroides subsp. mesenteroides ATCC 8293
MTETKYYNFNGFNSKTGNFDPQCYAIVDDETGRYTEVGHGEGPKLGQSVDVGEKYMMPGIINTHIHVDSDVNYEFGKTKFGVDNENEHVRAVIVATHNMKTMLRHGVTVVRNVGTARMTDIEIARMQREGSVEGPMMIASGAAFSMTGGHGSGGGGIEVDGVDEVRKAVRQAMKEGAQIIKFMVTGGVSAGDFENPNQVQLNEDEVRAGVIEAHKKGIKVAAHAQGAEGIKIAIRAGVDSVEHAFHIDDEAIDMMKVNGTFVVPTMIAMKRIIDRPEEVPAWMIERATTHWQAHQKSVARAAMAGVNIAMGTDAGTPFNGFANESAVEMDMMVEFGHMTPQQVLQSATINAAKLMGISDNYGMIAVGQYADFIVIQENPNDNIKAIQEKDKWVFQHGQPVVFHQEENIIS

SEQ ID NO: 6432 - DNA, 2193 bp, Solibacter usitatus Ellin6076
  CDS (1)..(2193): transl_table=11
atgaaagcctacatcgcgctgttcaagaacaatatgcggctcaccttgcgcgatcgcggcgtgctgttcttcaactacctgttcccgttgattttcttcttcgcttttgcggagctgtttcacgccggagtgggcggcggcatcgcctatttcgtgagcaccgtcctggtcatgggcattctcggcaacggactgtggggcgcgggcatgcgcagcgtgcaggagcgcgaggccaacatcctgcggcgcttcaaggtcacgcccatctcgcccctgccgatcctggtggccgcaatggtcagcggttggctcctcttcgtgcccgtgctctttctgctggtgggcctggcgcatttcctctacgccatgccgcttccgcagaactggttttcgctgtttctgatggcgtccctgggtgtctgttcgctacgcgccatcggcctgatcctggccgccgtcaccaacaccatgcaggaagccaccatcgccattcagattctttacatgccgatgctgtttctgagcggcgccacgtttcccgccgcgatgctgcccaaatgggcgcagaccctggcgcagttcatgccggcatcttacctggtgacgggcttccagggtattttcttccagaatcagaacctgctcgataacaaggccgcggtcggcgcgctgctggccaccatcctgctcggaacctttctcgcgatgcagctcttccgctgggagaaggaagaaagaattcaaccgcgcaaaaagctttgggtgattgcggtgttggcgcccttcgcggtattgggcacctggcagatgttcagtaaggagcatctcggcgaaaatcaggccctctttcgccagctgcagcgctcggaccgcttcctgatccgcaacacgcggatcttcaccggggatggcgccgtgatcgaaaatggttccgtcttcgtccacgatggcaagatcgccgaggtctaccagggcacggcgccggatcccgagcagatcaaagccgaagtcatcgagggcgcgggcaagactttgctgcccggcctgatcgacgtgcacgttcatcttgcggcctcgggcggcctcgggggcagcgacagcgagtttcagctcgcgatgcagcactccgccgccgccctcctctatagcggtgtcaccgccgcgcgcagcgtgggagacggcctcgatgcttcactcaagcttcgcaagtccctcgattccggtgccagactcggcgccaacctcttcatctgcggaccgatgttcactgccgaaggcggccacggcaccgaattcgtcgaacatctgccgcctgccatcaagaacagcgtcagagcccaactgattcgcactccgaagacgccggaggaggctcgcaaacaagtgcgcgacctgaaggccgcccaagtggacggaatcaaggcgatcctcgaggccggctggggagacggcatgctcttcgaccgcctggacctcctgatcgtgcgcgccgtcgccgaagaagcccacgcccagcgccttcctctggccatccacaccggcgacgcgcgcgatgtcgccgacgcgatcgaaatcggcactaccagcgtggagcacggttcctggcgcgatgaaattcccgaccgtctgctggagcgcatggcgcacggcggcatctatctggatcccacgctcggcgtcatcgaggcctatgcgaactacttcgccggcaagtccgatgcgctcggcaactccctcgttcagcaggtggtctccggacagctgctcaagaacacccgcgaatttctggcttccggcaaggccgtaaacccggaccgcgccgagcaatttcagcacgctctggatcaggcgcgcgccaatctgctgcacgcctggaaggccggtgtgcccctggcgatgggcaccgattcgggcaaccccatggtctttcacggcccctccctgcaccacgaaatccagctctgggtgcaggcgggcatcccaatcccggtggccctgcaagcagccacggtcaacgccgcgaagctcctcggcgctggtcagcggatcggcgcaattcgcaagggcatggacgcggacctattgatggtggacggcaacccgctgcaggagatcggcgccaccgagcgtatttccctcgtggtgttgaagggcgagcggattcggcgtgccgctcttttcgatcagaagtga

SEQ ID NO: 6433 - protein, 730 aa, Solibacter usitatus Ellin6076
MKAYIALFKNNMRLTLRDRGVLFFNYLFPLIFFFAFAELFHAGVGGGIAYFVSTVLVMGILGNGLWGAGMRSVQEREANILRRFKVTPISPLPILVAAMVSGWLLFVPVLFLLVGLAHFLYAMPLPQNWFSLFLMASLGVCSLRAIGLILAAVTNTMQEATIAIQILYMPMLFLSGATFPAAMLPKWAQTLAQFMPASYLVTGFQGIFFQNQNLLDNKAAVGALLATILLGTFLAMQLFRWEKEERIQPRKKLWVIAVLAPFAVLGTWQMFSKEHLGENQALFRQLQRSDRFLIRNTRIFTGDGAVIENGSVFVHDGKIAEVYQGTAPDPEQIKAEVIEGAGKTLLPGLIDVHVHLAASGGLGGSDSEFQLAMQHSAAALLYSGVTAARSVGDGLDASLKLRKSLDSGARLGANLFICGPMFTAEGGHGTEFVEHLPPAIKNSVRAQLIRTPKTPEEARKQVRDLKAAQVDGIKAILEAGWGDGMLFDRLDLLIVRAVAEEAHAQRLPLAIHTGDARDVADAIEIGTTSVEHGSWRDEIPDRLLERMAHGGIYLDPTLGVIEAYANYFAGKSDALGNSLVQQVVSGQLLKNTREFLASGKAVNPDRAEQFQHALDQARANLLHAWKAGVPLAMGTDSGNPMVFHGPSLHHEIQLWVQAGIPIPVALQAATVNAAKLLGAGQRIGAIRKGMDADLLMVDGNPLQEIGATERISLVVLKGERIRRAALFDQK

SEQ ID NO: 6434 - DNA, 1284 bp, Solibacter usitatus Ellin6076
  CDS (1)..(1284): transl_table=11
atgagattcccgcggcggatgcgcgcggcgatcacgctggtcagttctccgaggccgtcttctttagagcggtgcggtaagcttacctctatgtttcgtgcatttgttcttctatgcgcagcggcgaacggtttcgcgcagccggtggtgattcgcacctcgaccctgatcgatgggaaggggcacgttctcaagaacaaagaactggtgatcgagggcggcaagatcacgcggattgcggatgccaggcagaagccgacgatcgatttgaccggcatgacggtgatgccggggtggatcgacactcacgttcacgtcacctggtacttcaataaagacggccgctacgaggctggcgggcgaggttcgaaatcgacgccgcagcaggcggcgctgtacgcggccgccaatctctacgccacgctcatgggcggctttacgacagtgcagagcgtgggggcggaactggatggcgacctgcgcgaccggatcgcggcgggaacacttgcggggccgcggctgttgacctcactgcgggcggtgaatgagaacacgggagacacggcggcgatccgaacgtacgtacagaagatgaagtccgatggcgcggacctggtgaagctcttcgcgacggccagcatccgcgacggcggcaagatgacgatgacgccggaacagatcgcggcggcatgcggcgaggccaaacaacagggactgcgcgccgtggtgcacgcccactcgtccgacggggcgcgcgccagcgtaatggcggggtgcacgtcgatcgaacacgggacgttcctggacgacgccacgctggagctgatggcgcagcgcggcgtgtacttcgacccgaatttcctggtgctgcacaattacctggacaacaagccgaaattcctggggatcggcaactacaccgaagaaggcttcgcggcgatggagaaggggctgccgctggtggcggaagtgttgaagcgcgcgcgcacccatcacgtgaagatcgtgctcggaacggatggcgtagcgggcgcgcacgggcgcaatgccgaggagttcatttaccgcgtcaaggatggaggcgaccggccgatggacgcgctgacgagcggcacgtcggtggcggcggaatcgctggggatggcggaccggatcgggtcgatcgcggagggaatgcaggccgacctggtgggcgtcacgggcgatccgctgaatgacatcacggcagtacggaacgtggcgttcgtgatgaagggcggcaaggtctaccggtacgggaagtga

SEQ ID NO: 6435 - protein, 427 aa, Solibacter usitatus Ellin6076
MRFPRRMRAAITLVSSPRPSSLERCGKLTSMFRAFVLLCAAANGFAQPVVIRTSTLIDGKGHVLKNKELVIEGGKITRIADARQKPTIDLTGMTVMPGWIDTHVHVTWYFNKDGRYEAGGRGSKSTPQQAALYAAANLYATLMGGFTTVQSVGAELDGDLRDRIAAGTLAGPRLLTSLRAVNENTGDTAAIRTYVQKMKSDGADLVKLFATASIRDGGKMTMTPEQIAAACGEAKQQGLRAVVHAHSSDGARASVMAGCTSIEHGTFLDDATLELMAQRGVYFDPNFLVLHNYLDNKPKFLGIGNYTEEGFAAMEKGLPLVAEVLKRARTHHVKIVLGTDGVAGAHGRNAEEFIYRVKDGGDRPMDALTSGTSVAAESLGMADRIGSIAEGMQADLVGVTGDPLNDITAVRNVAFVMKGGKVYRYGK

SEQ ID NO: 6436 - DNA, 1242 bp, Solibacter usitatus Ellin6076
  CDS (1)..(1242): transl_table=11
atgcgtcctttgtacgttttcttcctggttgcgctcaccgcgttcgcgcaggactccacagttctcaagcccgctcatgtcttcgatggcgagaccagccacgaaggctgggccgtccgcgtgcgcggcagccggatcgaggccgctgggcccgccgccactattgacaccgccaatgccaaagtgatcgacctgcccggcgccactctactgcccggactcgtggaaggccactcccacattcttctccacccctacaacgagactccgtggaacgaccaggtaatgcacgaaggcctcgcgctgcgcgccgctcgcgccgtgaatcacctgcgcgccacgctgatggcgggcttcaccacggtccgtgacctgggcaccgagggcgcgggatacgccgacgtcgaactcaagcaggccgtgaaccagggaatcgtcccgggaccccgcgtattgactgcgactcgcgcaatcgttgccaccggtagctacgcgcccaaaggcttcgcgctcgaattccgcgtgccccagggcgccgaagaggccgatggaatcgacagcctgacccgcgtggtccgcgaccagatcggccatggcgccgattggatcaagctctacggcgattaccgctggggcgccggccccggcgcgcgccccacattctcgctggaggaaatgaagcttgccgtggagactgcgaagagcgccggcgttcccgtggccgtccatagcagcacgcccgaaggcatgcgccgcgcgacactcgccggcgccgagaccatcgagcacggcgatgaaggcacacccgagatctttaagctgatggtggatcacaatgtcgcgctctgccccactctcgcggccggcgacgccacctcgcaatacgccggatggaaaaaggggcagggacccgaaccgcgcggcattcagcgcaagaaggcgagcttcaaagcggcgctggaatccggcgtcaccatcctttccggcagcgacgtcggcgtctttgcccacggcgaaaacgggcgcgaaatcgaaatgatggtggagtacggcatgacgccggtcaacgccctgaaggccgcgacctcaaccgccggccgtgtccttcacctggatatcggcaccgtaaagccgggcatgttcgccgacctgatcgccgtggatggcgacccgaccaaagaaatcgccgccatccgccgcgtcaagttcgtcatgaaaaacggcacggtgtacaagcaataa

SEQ ID NO: 6437 - protein, 413 aa, Solibacter usitatus Ellin6076
MRPLYVFFLVALTAFAQDSTVLKPAHVFDGETSHEGWAVRVRGSRIEAAGPAATIDTANAKVIDLPGATLLPGLVEGHSHILLHPYNETPWNDQVMHEGLALRAARAVNHLRATLMAGFTTVRDLGTEGAGYADVELKQAVNQGIVPGPRVLTATRAIVATGSYAPKGFALEFRVPQGAEEADGIDSLTRVVRDQIGHGADWIKLYGDYRWGAGPGARPTFSLEEMKLAVETAKSAGVPVAVHSSTPEGMRRATLAGAETIEHGDEGTPEIFKLMVDHNVALCPTLAAGDATSQYAGWKKGQGPEPRGIQRKKASFKAALESGVTILSGSDVGVFAHGENGREIEMMVEYGMTPVNALKAATSTAGRVLHLDIGTVKPGMFADLIAVDGDPTKEIAAIRRVKFVMKNGTVYKQ

SEQ ID NO: 6438 - DNA, 1371 bp, Solibacter usitatus Ellin6076
  CDS (1)..(1371): transl_table=11
gtgaagaccgccgcgcttgtaactacgatcttgggtatttgcatactgggtggtatttgcatactgggccaaacgcagcaaccccaggcggccgaaaacgccaccctctttctcaacgttcgcgttttcgatggcaagggcagcgcgctctcgccttcttccagcgtactggtcaaaggcaactcgatcgagcgcgtatccaccacccccattgataccggcacgggccgaactgtcacggtggtcgatggcggcggccgtgtgttgatgcccggcctgattgacgcgcattggcatgccttcatggcgtcagtgccgcagatgcttctcatgaccgccgacccttcctatcttcaactcctggctgcccgacaggccgaggcgacgttgatgaggggcttcaccaccgtgagaaaccttggcggtccggtattcggactcaagcgcgcgatcgacgaaggcgccatggttggtccgcgcatctacccttcgggagccttcatctcgcaaacctcgggacacggggattttcgcttcggcttcgagcttccgcgaatgcccggcggtcctttgagtcattccgagatcgagggcgtcgcagccatcgccgacagcccggacgaggtccgtctgcgggcgagagagcaactcagacagggtgcgagccagatcaagctgatggccggcggcggggtggcgtccccgtacaacccgttggaatcggtccagtatacggagccggagattcgcgcggcagttgaagcggccgacaattggggcacctatgtgacggtacacgcgtatactccgctggccatccgtcaggcggttgccgcgggcgtcaaatgcatcgagcacggccacctgatcgacgaaccgactgccaggttgctggcggaaaaaggcatctggtggagcttgcagccgtttctggacgacgaagatgcgtctcccctggtgaacccgttctctcaggcaaagaaattgaaagtgttcgccggcacagagaacgcgtacaggctatccaggaagtacaaggtcaaaaccgctttcggcacggacatcctgttcgatgccagggtcgcggggcggcagggggcgcagctcgccaagctggtccgctggtacacgccggccgaaacgctgagcatggccaccgcggcaaatggcgagctgatggcgctctccggcttgatcaacccgtatcccggcaaactgggcgtgatcgaagacggcgccctggcggacctgatcctggtcgatggcaatccgctggaaaatatcaggctcatcgaggatccgggcaagaacttcgtcgtcatcatgaaggacggcaagatctacaagaacaccctgccgaagaagcactaa

SEQ ID NO: 6439 - protein, 456 aa, Solibacter usitatus Ellin6076
MKTAALVTTILGICILGGICILGQTQQPQAAENATLFLNVRVFDGKGSALSPSSSVLVKGNSIERVSTTPIDTGTGRTVTVVDGGGRVLMPGLIDAHWHAFMASVPQMLLMTADPSYLQLLAARQAEATLMRGFTTVRNLGGPVFGLKRAIDEGAMVGPRIYPSGAFISQTSGHGDFRFGFELPRMPGGPLSHSEIEGVAAIADSPDEVRLRAREQLRQGASQIKLMAGGGVASPYNPLESVQYTEPEIRAAVEAADNWGTYVTVHAYTPLAIRQAVAAGVKCIEHGHLIDEPTARLLAEKGIWWSLQPFLDDEDASPLVNPFSQAKKLKVFAGTENAYRLSRKYKVKTAFGTDILFDARVAGRQGAQLAKLVRWYTPAETLSMATAANGELMALSGLINPYPGKLGVIEDGALADLILVDGNPLENIRLIEDPGKNFVVIMKDGKIYKNTLPKKH

SEQ ID NO: 6440 - DNA, 1302 bp, Solibacter usitatus Ellin6076
  CDS (1)..(1302): transl_table=11
atggctcctatgcatcgcaccctcgccgcccttttcctgttcgcgctcgccgcctccgcggcagacaaatcgtacgtgctcaaagcggcacgaatgttcgacggtaagagcgaccacgtcaccactccaggcctgatcgtggtggtcaacagcaagatcgccgcagtcggtccgaaggccgccatcccctctggcgccgaaacgatcgatctcggcgacgccaccctcctccctggctttatcgacgcccacacccacctcacctaccccttcgaacgcgactacagcaagcaggaactcgacggcctcaagaagaccatcccggagcggaccctcgacgccgtcgccatcgtgcgcactacactaatggccggcttcaccactgtccgcgatgtcggcgccggagattacatcgacgtcggcgtgcgcaacgccatcaacaatggcaagatccccggaccccgcatgctggttgccgtcaacgcactcggcgccaccggcggccattgcgactactccgccggcttcgctcctatgatcttcggccgcgagagcggcatcaccgacggcgtcattaacagtcccgaccaagcccgccaagccgtccgctacaacatcaaacacggcgccgacgtcatcaagacctgcgccaccggcggcgtgctctccctcacggacgacgtcgataccccgcaacttacccaggccgaactcgacgccctggtggacgaagcacacgccctgcgccgtaaaaccgccgcccacgcgcacggcgccaccggagccaagcgcgccatccgcgccggtatcgattccatcgagcatggcagcttcctggacgacgaagcgctcgacatgatgaaggcgcgcggtactttctacattcccaccctgatggccgccgaaggcctgaaggagcggctcaccgacggttacctgccgcccgtggtcgccggcaaagcgcgccaggcgatggcggcactcaatgccaccgtgcgcaacgccatcgcccgcggtgtgaaaatcggcgtcggcaccgacgccaccgtgtatcctcacggacgcaatgccgaggaattccacctgctcgtcgatctcggcatgacgccgatcaacgccctcaaagccggtagttcgctggacgccgaactgctcggcgtgtcggaccgcaccggttcgttggaagccggcaaatttgccgatatcgtcgcctgccgcggcaatcccgagaccgacatccgccaggtggagaagattcgctttgtgatgaaagatggaacggtttaccgtaacggtcagtag

SEQ ID NO: 6441 - protein, 433 aa, Solibacter usitatus Ellin6076
MAPMHRTLAALFLFALAASAADKSYVLKAARMFDGKSDHVTTPGLIVVVNSKIAAVGPKAAIPSGAETIDLGDATLLPGFIDAHTHLTYPFERDYSKQELDGLKKTIPERTLDAVAIVRTTLMAGFTTVRDVGAGDYIDVGVRNAINNGKIPGPRMLVAVNALGATGGHCDYSAGFAPMIFGRESGITDGVINSPDQARQAVRYNIKHGADVIKTCATGGVLSLTDDVDTPQLTQAELDALVDEAHALRRKTAAHAHGATGAKRAIRAGIDSIEHGSFLDDEALDMMKARGTFYIPTLMAAEGLKERLTDGYLPPVVAGKARQAMAALNATVRNAIARGVKIGVGTDATVYPHGRNAEEFHLLVDLGMTPINALKAGSSLDAELLGVSDRTGSLEAGKFADIVACRGNPETDIRQVEKIRFVMKDGTVYRNGQ

SEQ ID NO: 6442 - DNA, 1230 bp, Mycobacterium avium 104
  CDS (1)..(1230): transl_table=11
ttgcagacgatcaaggccgccgggctgttcgacgtcgacgccggcgagatcgttcggcccggcctgctgcgggtcgacggggaccggatcgtcggagtcggggactcgggcccgacgggcgcggacgacaacgtgatcgacctgggcgaggcgatcctgttgcccgggttgatggacatggaggtcaacctgctgatgggtgggcgcggggagaaacccggtctgtctcaggtgcaggacgacccgccgacccgggtgctgcgcgcggtcggcaatgcccggcgcacgctgcgcgccgggttcaccacggtgcgcaacctgggcctgttcgtcaagaccggcggatacctgctggacgtggcgctggccaaggccatcgacgcgggctggatcgacgggccgcgggtggtgccggccgggcacgccatcaccccgacgggcggccacctggacccgacgatgttcgccgcgttcgcgccgcacgccctggaactgaccgtcgaggaaggcatcgccaacggcatcgacgagatccgcaaggcggtgcgctaccagatcaagcacggcgccgagctgatcaaggtttgctgctcgggtggcatcatgtcattgacgggaccgcctggcgcacagcactattcggacgaggagctgcgcgcgatcgtcgatgaggcgcatcggcgcgggatgcgcgtcgccgcccacacccacggcgccgacgcggtcaagcacgccgtcgccgccggcatcgactgcatcgagcacggttttctgatcgacgacgaggcgatcgccagcatggtcgagcacggcaccttcctggtgagcacccgtcgtctggccgaggggatggacgtctcgcacgccccgcccgagctgcaggccaaggccgcccagatgttcccgaagtcgcgcacctcgatcctggccgcgcaccgggccggggtgaagatcgccgtcggcaccgacgcgcccgcaatcccgcacggccgcaacgccgatgaactcgtcacgctcgtcgagtgggggctgccgccggtggcggtgctgcgggccgccaccgtcaccgcggccgagttgatcaactccagcgaccgcggccggctggccgagggctacctcgccgacgtcatcgccgttccgggaaatccgttggaggacatcacggtaacccagcacgtcagcttcgtcatgaaaggcggcaaggtctatgtccacaaccagaactga

SEQ ID NO: 6443 - protein, 409 aa, Mycobacterium avium 104
MQTIKAAGLFDVDAGEIVRPGLLRVDGDRIVGVGDSGPTGADDNVIDLGEAILLPGLMDMEVNLLMGGRGEKPGLSQVQDDPPTRVLRAVGNARRTLRAGFTTVRNLGLFVKTGGYLLDVALAKAIDAGWIDGPRVVPAGHAITPTGGHLDPTMFAAFAPHALELTVEEGIANGIDEIRKAVRYQIKHGAELIKVCCSGGIMSLTGPPGAQHYSDEELRAIVDEAHRRGMRVAAHTHGADAVKHAVAAGIDCIEHGFLIDDEAIASMVEHGTFLVSTRRLAEGMDVSHAPPELQAKAAQMFPKSRTSILAAHRAGVKIAVGTDAPAIPHGRNADELVTLVEWGLPPVAVLRAATVTAAELINSSDRGRLAEGYLADVIAVPGNPLEDITVTQHVSFVMKGGKVYVHNQN

SEQ ID NO: 6444 - DNA, 1260 bp, Mycobacterium smegmatis str. MC2 155
  CDS (1)..(1260): transl_table=11
gtgacgcagaccgtactgcgcgcggcgcgctgggtcgacgtcgccgcaggcgtggtccgcgcaccggccgtcgtggtcatcgagggcaaccggatcaccgaggtgaatcccgctgcgccgctgccggataccgcggccgtcatcgatctcggcgacgtcaccctgctgccgggcctgatggacatggaactgaacctgctcatcggcggcccggaagggctgccgtcgccgatgcacggtgtgcaggacgatccggcgtaccggacgctgcggggcgcggtcaacgcgcgcaccacggtgcaggccggtttcaccacggtccgcaacctgggtctgatggtcaagaccggcggctatctgctcgacgtggcgttgcagcgcgcaatagatcagggctggcatcaggggccacgcatccaccccgccgggcatgccgtcacgccgtacggcggtcacctcgatcccacggtgttccagcgactggcgccgggcatcatgccgctgtcggtggccgaaggcatcgccaacggagttccggatgtcatcgcgtgtgtgcgctaccagatccgccacggcgccaggctgatcaaggtgtcggcctcgggtggcgtgatgtcacacagcacggctcccggcgcccagcagtacggcgacgccgaactcgccgcgatcgccgacgaggcgcaccgcgccggggtcaaggtcgccgcgcacgcggtcggtgacaccgcgatccaggcctgtatccgcgcgggtatcgactgcatcgagcacgggttcctcgctaccgacgagaccatccagatgatggtcgaccacggcacgttcctggtgtcgacgacgtatttgaccgatgccatggcgatcgaccgcatcgcccccgaactgcgcaagaaggcactcgatgtcttcccacgtgcaaaagccatgctgcccaaggcgattgcggccggtgtccggatcgcgtgcggcaccgacgcaccggccataccgcacgggcagaacgccaaggaactgtgcgcgctggtcgaacgcggcatgaccccgatgcaggcgctgcaggccgcgaccgtggtcgccgcggagttggtggatgcctccgacgagctgggccggctggcacccggatacctcgccgacgtcgtcgccgtgcccggcgacccgagcaccgacatctccgcgatactcgacgtctcgttcgtgatgaaggacggcgcggttgtcaaacaccgcgagccgtcggacgccgcggtgcgctag

SEQ ID NO: 6445 - protein, 419 aa, Mycobacterium smegmatis str. MC2 155
MTQTVLRAARWVDVAAGVVRAPAVVVIEGNRITEVNPAAPLPDTAAVIDLGDVTLLPGLMDMELNLLIGGPEGLPSPMHGVQDDPAYRTLRGAVNARTTVQAGFTTVRNLGLMVKTGGYLLDVALQRAIDQGWHQGPRIHPAGHAVTPYGGHLDPTVFQRLAPGIMPLSVAEGIANGVPDVIACVRYQIRHGARLIKVSASGGVMSHSTAPGAQQYGDAELAAIADEAHRAGVKVAAHAVGDTAIQACIRAGIDCIEHGFLATDETIQMMVDHGTFLVSTTYLTDAMAIDRIAPELRKKALDVFPRAKAMLPKAIAAGVRIACGTDAPAIPHGQNAKELCALVERGMTPMQALQAATVVAAELVDASDELGRLAPGYLADVVAVPGDPSTDISAILDVSFVMKDGAVVKHREPSDAAVR

SEQ ID NO: 6446 - DNA, 1221 bp, Mycobacterium smegmatis str. MC2 155
  CDS (1)..(1221): transl_table=11
gtgctgaccctcaaagctgcgggtctcgtcgacgtcgacaccggggaactcatccgccccggtgtcgtgcgcgtcgagggcgaccgcatagtcggcatcggcggcccggccgaaggcgaggtcatcgacctcggggatgccatcctgctgcccggcctgatggacatggaggtcaacctcctcatgggcgggcgcggtgagaatcccgggctgtcgcaggtacaggacgatccccccacccgtgtgctgcgcgccgtgggcaacgcgcgccgcacgctgcgggccggtttcaccaccgtgcgcaacctcggcctgttcgtcaagaccggcggttacctgctggatgtcgcgctgggcaaggcgatcgacgcggggtggatcgacggaccgcgcgtgatccccgcaggccacgcgatcaccccgaccggtgggcacctggatcccacgatgttcgccgcgttcatgcccggcgtgctggaactgaccgtcgaggagggcatcgccaacggcgtcgacgagatccgcaaggccgtgcgctaccagatcaagcacggcgcacagctgatcaaggtgtgctgttcgggcggtgtgatgtcactgaccggagaggccggggcacaacactattcggacgaagagctgcgtgtcatcgtcgacgaggcacaccggcgcgggttgcgggtcgccgcacacacgcacggcgccgaggccgtcaaacacgcgatcgactgcggcatcgactgcatcgaacacggcttcctcatggacgacgaggccatcgagatgatggtggcgcacgaccggttcctggtgtcgacgcgtcggctcgccgagtacatggacgtctccaaggcgccaccggagcttcaggccaaggccgccgagatgttccccaaggcgcgcacgtcgatcaaggccgcgtacgaggccggcgtcaagatcgctatcggcaccgacgccccggccatcccccacggccgcaacgccgacgaactggtcacgctggtgcagtggggcctgccgcctgcggccgtgctgaaagcggccaccgtgaccgcggccgagttgatcaacgtgaccgaccgcggccgcctcgccgaaggcctgctggccgacatcatcgcggtgccgggcaacccgctggaagacatcagcgttacacaaaacgtagactttgtaatgaaaggcggtaaggtcttccgcaatgacaaagccaactga

SEQ ID NO: 6447 - protein, 406 aa, Mycobacterium smegmatis str. MC2 155
MLTLKAAGLVDVDTGELIRPGVVRVEGDRIVGIGGPAEGEVIDLGDAILLPGLMDMEVNLLMGGRGENPGLSQVQDDPPTRVLRAVGNARRTLRAGFTTVRNLGLFVKTGGYLLDVALGKAIDAGWIDGPRVIPAGHAITPTGGHLDPTMFAAFMPGVLELTVEEGIANGVDEIRKAVRYQIKHGAQLIKVCCSGGVMSLTGEAGAQHYSDEELRVIVDEAHRRGLRVAAHTHGAEAVKHAIDCGIDCIEHGFLMDDEAIEMMVAHDRFLVSTRRLAEYMDVSKAPPELQAKAAEMFPKARTSIKAAYEAGVKIAIGTDAPAIPHGRNADELVTLVQWGLPPAAVLKAATVTAAELINVTDRGRLAEGLLADIIAVPGNPLEDISVTQNVDFVMKGGKVFRNDKAN

SEQ ID NO: 6448 - DNA, 1230 bp, Mycobacterium sp. KMS
  CDS (1)..(1230): transl_table=11
gtgaaaccgctgctgctccaccacgccacgctcatcgacgggacgggcgccgcaccgctgccggatgcggcggtcctggtcgagaacgaccggatccgttgggccggagcggcttccgacgcccccacggatgacgccaccccggtcgatctcggcggcaacaccatctgcccgggattcttcgactgccacgtccacttcagcctgcccggcgccggcgccacgcccatcgaccgggcgctgaatccgccgtcgtaccactatttccagttgatcgaccggctgcgcgtcacactgcacaacggtgtcaccaccgcacgcgacctgatgggtatcgacgccggagtccgtgatgcggtggcacacggtctggtcgacgggccccggttgctcgtggcgatcaacatgatgagccagacctgcggccacgccgacttccatctgccgtccgggatcgacctgacgccgatggtcggcggctcgctggtcgacaccgtcgacgaggcgcggcggcgcacccgtgagctcatcgccgcgggggccgacgtcatcaaggtggcgtccagtggcggggtgtcctcccccagcgaccaacccgaatggctgggcatgcgccgcgaactcatcgcggctgtggtggaggaggccgcggcctacggccacaagcgggtggccgcccacgcgatcggccgcgccggcatcgaagcggccgtcgaggccggtgtctcaagcgtcgaacacggctatcaactcgacgaggggctacggcacaagatggtcgaggcgggcatcttcctggtgccgaccctgctggagacgatggccgacgtcacctcctcaccggccggccaggccaagagcgcccactggcacgccgtggcacaggagtcgatcggcgcgtcggccgcggccggggtgaagatcgccgtcggcaccgacgcggggctcagtccggcgcacgggacgaacctcaaggagctcgggctgctggtgcgcttcggcggcctcaccccgatgcaggcgatcgtcgccgccacctccacttcggccgaattgtgcggtctggctgagcaattgggcaccgtcgaggcaggcaagctggccgacctggtgatcgtgcggggcgacccgctggccgacatcgactccgtgggtgagcccgacaacatcctgctggtgctcaaagagggccgcgcggcgatcgaccgcgcgggttttctgaccgcttag

SEQ ID NO: 6449 - protein, 409 aa, Mycobacterium sp. KMS
MKPLLLHHATLIDGTGAAPLPDAAVLVENDRIRWAGAASDAPTDDATPVDLGGNTICPGFFDCHVHFSLPGAGATPIDRALNPPSYHYFQLIDRLRVTLHNGVTTARDLMGIDAGVRDAVAHGLVDGPRLLVAINMMSQTCGHADFHLPSGIDLTPMVGGSLVDTVDEARRRTRELIAAGADVIKVASSGGVSSPSDQPEWLGMRRELIAAVVEEAAAYGHKRVAAHAIGRAGIEAAVEAGVSSVEHGYQLDEGLRHKMVEAGIFLVPTLLETMADVTSSPAGQAKSAHWHAVAQESIGASAAAGVKIAVGTDAGLSPAHGTNLKELGLLVRFGGLTPMQAIVAATSTSAELCGLAEQLGTVEAGKLADLVIVRGDPLADIDSVGEPDNILLVLKEGRAAIDRAGFLTA

SEQ ID NO: 6450 - DNA, 1254 bp, Mycobacterium sp. KMS
  CDS (1)..(1254): transl_table=11
gtgaccggtccgaccgttctcaaagcggcccgctgggccgacgtcgaggccggcgtcgtccgcgcaccggccgtcgtggtgatcgagggtaaccgcatccagtccgtgaatcccgctgagccgccgcagaatccggctcaggagatcgacctcggcgacgtcaccctgctgcccggcctgatggacatggagctgaacctgctcatcggcggacccggggggccggagggtctgcccagtccgatgcacggggtgcaggacgacccggtgtaccgcacgttgcgggcggcggtgaacgcccgcaccacactcgacgccggattcaccaccgtgcgcaatctggggctgatggtcaagaccggcggctacctgctcgatgtggcgctccaacgcgccgtcgaccagggctggcacgccggcccgcggatctacccggccggccacgccgtcaccccgtacggcggccacctggatccgacggtcttccagcgcctggcaccggggatcatgccgctgtcggtggccgaggggatcgccaacggcgtcgacgacgtgcggacctgcgtgcgttaccagatccgccacggcgccaagttgatcaaggtctcggcctccggtggggtgatgtcgcacagcaccgcccccggcgcgcagcagtactccgacgacgagttcgccgcgatcgccgacgaggcccaccgcgccggggtacgggtcgccgcacatgcggtgggggacagcgcgatccgcgcctgtatccgcgccgggatcgactgcatcgaacacggcttccttgccacggacgagacgatccagatgatggtcgatcacggcacgttcctcgtctcgaccacctatctcaccgaggcgatggcggtcgaccgcatcgcacccgagctgcgccgcaaggccgaggaggtgtttccccgggctcaggcgatgctgccgaaggcgatcgccgccggtgtgcgcatcgcgtgcggcaccgacgccccggcggtgccgcacggacagaacgccaaagagctgtgtgcgctcgtgtcccggggcatgacgcccatgcaggcgctgcgcgcggcgaccatcacgtccgcagagctcatcgaggccgacggcgaactcggccggctcgcccccggctatctcgccgacatcatcgcggtgcccggcgatccgtcgagcgacatcgcgaccacgctcgacgtgcggttcgtgatgaaggacggtgtcgtccacaagcgcggcaccgtctga

SEQ ID NO: 6451 - protein, 417 aa, Mycobacterium sp. KMS
MTGPTVLKAARWADVEAGVVRAPAVVVIEGNRIQSVNPAEPPQNPAQEIDLGDVTLLPGLMDMELNLLIGGPGGPEGLPSPMHGVQDDPVYRTLRAAVNARTTLDAGFTTVRNLGLMVKTGGYLLDVALQRAVDQGWHAGPRIYPAGHAVTPYGGHLDPTVFQRLAPGIMPLSVAEGIANGVDDVRTCVRYQIRHGAKLIKVSASGGVMSHSTAPGAQQYSDDEFAAIADEAHRAGVRVAAHAVGDSAIRACIRAGIDCIEHGFLATDETIQMMVDHGTFLVSTTYLTEAMAVDRIAPELRRKAEEVFPRAQAMLPKAIAAGVRIACGTDAPAVPHGQNAKELCALVSRGMTPMQALRAATITSAELIEADGELGRLAPGYLADIIAVPGDPSSDIATTLDVRFVMKDGVVHKRGTV

SEQ ID NO: 6452 - DNA, 1227 bp, Mycobacterium sp. KMS
  CDS (1)..(1227): transl_table=11
atgctgacactgaaggcggccgggtacgtcgacgtcgatgccggggagatcatccgccccggcatcgtccgtgtcgacggtgaccggatcgtctccgtcggcggatcgccggtcgacggtgacgaggtgatcgatctcggcgactcgatcctgttgcccggcctgatggacatggaggtcaacctcctgatgggcggccggggcgagaaccccggcctgtcccaggtgcaggacgaccccccgacccgggtgttgcgcgcggtgggcaacgccaggcgcaccctgcgcgccgggttcaccacagtgcgcaacctcggtctgttcgtcaagaccggcggatacctgctcgacgtcgcgctcggtaaggcgatcgacgccggctggatcgacgggccgcgtgtcatcccggcgggacacgcgatcacgccgaccggcggccatctcgaccccacgatgttcgcggcgttcatgccgggcgcactggagttgacggtcgaggagggcatcgccaacggcatcgacgagatccgcaaggccgtgcgctaccagatcaaacacggcgcccagctgatcaaggtgtgcgtatccggcggcgtcatgtcgttgacgggtgaggctggcgcacaacactattcggacgaggaactgcgcgccatcgtcgacgaggcgcaccggcgcgggctgcgggtggctgcccacacccacggcgccgaggcggtcaaacacgcagtggcctgcggtatcgactgcatcgagcacggattcctgatggacgacgaggccatccagatgctggtcgacaacgaccgattcctggtgacgacgcggcggctggcggagtacatggacgtgtccaaggcgccgccggagttgcaggccaaggccgctgagatgttccccaaggcgcgcacgtcgatcaaggccgcctacgaggcgggcgtgaagatcgccgtcggcaccgacgccccggcgatcccgcacggccgcaacgccgacgaactcgtcaccctcgtcgaatggggtatgccgccggccgcggtgctgcgggccgcgaccgtcgtggccgccgatctgatcaacgtcagcgaccgcggccgcctggccgagggactgctcgccgacatcatcgccgtaccgggagatccgttgtccgacatcaccgtcacccggcacgtgaacttcgtcatgaaaggcggaaaggtcttcaagaatgacagcgccaattag

SEQ ID NO: 6453 - protein, 408 aa, Mycobacterium sp. KMS
MLTLKAAGYVDVDAGEIIRPGIVRVDGDRIVSVGGSPVDGDEVIDLGDSILLPGLMDMEVNLLMGGRGENPGLSQVQDDPPTRVLRAVGNARRTLRAGFTTVRNLGLFVKTGGYLLDVALGKAIDAGWIDGPRVIPAGHAITPTGGHLDPTMFAAFMPGALELTVEEGIANGIDEIRKAVRYQIKHGAQLIKVCVSGGVMSLTGEAGAQHYSDEELRAIVDEAHRRGLRVAAHTHGAEAVKHAVACGIDCIEHGFLMDDEAIQMLVDNDRFLVTTRRLAEYMDVSKAPPELQAKAAEMFPKARTSIKAAYEAGVKIAVGTDAPAIPHGRNADELVTLVEWGMPPAAVLRAATVVAADLINVSDRGRLAEGLLADIIAVPGDPLSDITVTRHVNFVMKGGKVFKNDSAN

SEQ ID NO: 6454 - DNA, 1281 bp, Croceibacter atlanticus HTCC2559
  CDS (1)..(1281): transl_table=11
atgaaacgtctcatattactactattaatttttagttgtgcatcaatctttgcgcaagatacttacattcattgtggtaagttatttaattctgaaactgctaaaattgaaactgaaaaaacgatagttgtaaaaggcgataaaatagatgcagttttacaaggttatgcacaaccaaaaaatgcagacgcaatcataattaacttaaaagataaaacagtgttgcctggtttaatagatatgcacgtgcatattgaaagtgaaactggtgccaataaatatttagagccatttgtattaaatgaagcagatgtagcttacaatgcgcaagaaattgcacaaagaacgctaatggctggttttacaactgtaagagatttaggtggcacaggcgtaaatgtgtctttaagaaatgcaattaatcaaggaaaggtacaaggcccaagaattttaactgcagaaaaagctttaggaacaactggcggtcacgcagatcctacaaatggcaggaacaaagaacttattggagatccaggtcctaaagaaggagttgtaaatggtgtgagagatgctcgtaaagcagttagacaacgttataaaaacggagcagattggataaaaataactgcaactggtggtgttttaagtgtagccaagagtagtaaaaaccctcagtttacagatgaagaaattgctgaaatctgtaatactgctgcagattacggtatgaaagtggctgctcatgcacacggtgataaaggtatgcaacgtgctataaataatggcgtaaaaactattgaacacggcacattaatgagtgatgaaactatggatattatgaaagaaaaaaaatcttttttagtgcctacaatctctgcagggaaatatgtttcagaaaaggcaaaaattaaagactattatccagctattatagtcccaaaagctttagaaatagggccaaaaattcaagatatgtttggtcgtgcttataaaagaggtgtgcccatagcctttggtacagatgcaggcgtatttcctcatggtgaaaatgctaaagagtttatgtacatggttgaagctggtatgcccgaacacattgcgttacagacggcaacattcataaatgcagaagtattagaaatgccatttcaaatagggcaattaaaaaaaggcgcttttgcagatatcattgctgtaaacgaagatcctactaaaacaattaccgctatgcaaaatgttagttttgttatgaaaggtggcactgtttataagaaggaataa

SEQ ID NO: 6455 - protein, 426 aa, Croceibacter atlanticus HTCC2559
MKRLILLLLIFSCASIFAQDTYIHCGKLFNSETAKIETEKTIVVKGDKIDAVLQGYAQPKNADAIIINLKDKTVLPGLIDMHVHIESETGANKYLEPFVLNEADVAYNAQEIAQRTLMAGFTTVRDLGGTGVNVSLRNAINQGKVQGPRILTAEKALGTTGGHADPTNGRNKELIGDPGPKEGVVNGVRDARKAVRQRYKNGADWIKITATGGVLSVAKSSKNPQFTDEEIAEICNTAADYGMKVAAHAHGDKGMQRAINNGVKTIEHGTLMSDETMDIMKEKKSFLVPTISAGKYVSEKAKIKDYYPAIIVPKALEIGPKIQDMFGRAYKRGVPIAFGTDAGVFPHGENAKEFMYMVEAGMPEHIALQTATFINAEVLEMPFQIGQLKKGAFADIIAVNEDPTKTITAMQNVSFVMKGGTVYKKE

SEQ ID NO: 6456 - DNA, 1254 bp, Oceanicola batsensis HTCC2597
  CDS (1)..(1254): transl_table=11
atgagtacttcccatgtgatcaagggcgccacgctgatcgacggtaccggagcggatccggtccggaatgcgacggtcgtggtgcaggacgggctcgtcacctatgccggccccgccgatcaggccgaagagccggaaaacgcgagaattgtcgaagccgacggcgcgaccgtcatgccgggcctgatggatgtccatgtgcatatctcgctcagcgcgcccgcgcacctcgtgcaggaagtcacggcaaggtcgttcggagaggcggccttcgaggtttccgccaatctcgcggacactgtggccggtggcgtgaccacgatccggacggtgagcgacctcggtcatctcgacattgcggcgcgggacgccatcgtgaagggcaagctcaacggtccgcgggtccatccctgcggtcacggtctgaccacaacagggggacatggcgacatcatgccgtgctggctgagccagtcccatggagacatcgccgagatcgtcgacggcccggacgagatccgtaagggtatccgcaagcaagccaaggccggcgcgacctggatcaagctcttccagaccgggggggtggtggatccgcacggccggctcgacgccgaggagttcctcccctgcgaattcgaggcggcgttggaggcggcgaaccttctgggtatgccggtctgtgtccatgcgcacaacaagcccgcgatcatccggtcgatccggaacggctgccgctcgatcgagcacggcatgcacttcgacgaggaatgcgcggaactggcaaaggagcacggcacctggctggtcccgacactgacggtcatggaccgcatcattcaggacggcaagcaagcgggcgttcccgactacatcatcgagaacgtgatcgagcggaccgacaagcaccgcgaatacgtcaagtatgcctatgacatcggggtcaacatcgccgccgggaccgatgccggttcgcttctgaccccgcacggctcgggcgggcaggaagtgatccagttcgtcaagtgcggcatgaccgtcgtgcaggcgatcgaggtcgccacgcgcaacactgccaagctgcttcaggacgatacgatcggcacgctggaacccggcaagcaggcggacctgatcgtggtcgatggcgacgtggccggcgaccccgacctgctcgctgaccgaaccagaatgcgggaggtcctcgtcgccgggcgtcgcgtcgcctccggaggtcggcaggtaacctgctga

SEQ ID NO: 6457 - protein, 417 aa, Oceanicola batsensis HTCC2597
MSTSHVIKGATLIDGTGADPVRNATVVVQDGLVTYAGPADQAEEPENARIVEADGATVMPGLMDVHVHISLSAPAHLVQEVTARSFGEAAFEVSANLADTVAGGVTTIRTVSDLGHLDIAARDAIVKGKLNGPRVHPCGHGLTTTGGHGDIMPCWLSQSHGDIAEIVDGPDEIRKGIRKQAKAGATWIKLFQTGGVVDPHGRLDAEEFLPCEFEAALEAANLLGMPVCVHAHNKPAIIRSIRNGCRSIEHGMHFDEECAELAKEHGTWLVPTLTVMDRIIQDGKQAGVPDYIIENVIERTDKHREYVKYAYDIGVNIAAGTDAGSLLTPHGSGGQEVIQFVKCGMTVVQAIEVATRNTAKLLQDDTIGTLEPGKQADLIVVDGDVAGDPDLLADRTRMREVLVAGRRVASGGRQVTC

SEQ ID NO: 6458 - DNA, 1332 bp, Erythrobacter sp. NAP1
  CDS (1)..(1332): transl_table=11
atgggactgctcaagaccattcggagcgcgcttgtaggaaccgccgtgggcctcgcgacgatggccgcgtcgccggcctttgccgaaacgctgatcgatgctggcagcgtcatcaccgatgcggcgagcgagccgtcagggcccagctatattatcgtgaaggacggtcgcatccacgacatcgttgcttcggacagcgatcaggcgcgcggctacgaagcagcagccacgaatgaggcgggcgaatgggtgtgggactatgtcgatctgtccgacaagaccgtgttgcccggcctgatcgacctgcacactcacctttctggcgatccgtcgggtgaattctggcgggcagcgacgaccccgcctgaatacttcacactgatcgctgccaagaatgcgcgcatcaccgcgctcgcgggctttaccaccgtgcgcgatctcggttcgcgcaccgatcaagtgacacagatgcttcgccgtgcaaccgcagaggggcttgcgcccggaccgcgcgtcgtcaccagcgctcgcaccatctcgatcatcggcgggcatggcgacaccaatggctttgtcgagcatgtgaatgatgtgctcgattcaggctttacctgcaccggtccggtcgagtgcgcatcaaaggtccggctcgcctcgcagtacggtgccgatctcatcaagatcaccgcgaccggcggcgtcctctcgcaacaggggcgcgggctcgaagcgcatttctcggacgaggagatgaaggcgatcgtcgatacggcagagagcctcggcctgaaagtcgcggcgcacgcacacggcgctcgcgggattgaggctgcagcccgcgccggtgttcatacgatcgagcacggaacctatatcgacgatgccgccgctcaggcgatgaatgagagcggcaccacgctcgtgccgaccctgatggcctttgacggcatccgccagaaccttggcaagggcttctacactccggtggtcgaagccaagatccgcgaggtcgccaaggtcgccgacactatcatcgagcgcgcccgtgcaaacggcgtgaggatcgcattcgggaccgatgcgggcgttttcccgcacggtctcaacgctggcgagttcggcctcatgatgcgcggcggaatgtcgagccgcgaagctcttgccagcgccaccaccgtcgctgccgacattctcgggatgagcgaccagatcggtcagctgacaccaggctattcagccgacatcatcgcggtcgatggcaatccgattgccgatgcaacggtgcttgaaaatgtcgactgggtgatggtgcgcggtcgcgtgatcgaatga

SEQ ID NO: 6459 - protein, 443 aa, Erythrobacter sp. NAP1
MGLLKTIRSALVGTAVGLATMAASPAFAETLIDAGSVITDAASEPSGPSYIIVKDGRIHDIVASDSDQARGYEAAATNEAGEWVWDYVDLSDKTVLPGLIDLHTHLSGDPSGEFWRAATTPPEYFTLIAAKNARITALAGFTTVRDLGSRTDQVTQMLRRATAEGLAPGPRVVTSARTISIIGGHGDTNGFVEHVNDVLDSGFTCTGPVECASKVRLASQYGADLIKITATGGVLSQQGRGLEAHFSDEEMKAIVDTAESLGLKVAAHAHGARGIEAAARAGVHTIEHGTYIDDAAAQAMNESGTTLVPTLMAFDGIRQNLGKGFYTPVVEAKIREVAKVADTIIERARANGVRIAFGTDAGVFPHGLNAGEFGLMMRGGMSSREALASATTVAADILGMSDQIGQLTPGYSADIIAVDGNPIADATVLENVDWVMVRGRVIE

SEQ ID NO: 6460 - DNA, 1317 bp, Pseudoalteromonas tunicata D2
  CDS (1)..(1317): transl_table=11
atgaccatgtcaaaattctccttaggcgtattaagtactgtgatgctcgcgattagcccagccctttttgcacaagtagatgctgtaatttatggtggtactgtgctaaccgttcccgggaaatcacctctcaaagagcaaaccttaattttggaagacggaaaaattagtgcgatacacaatggttatcgcactttagcacagctgaaattaaccgatgtacctgtgattgacctaaaagatagttatgtcatgccagggctgatagatatgcatgtccatttgacgtttgagcgcgacccgacagcgaatcctcatgtgtggttaacacaatatgatgcagattttgctttggcgtcagttccttatcttgaaaaaacgctcaatgctggcttcactaccgtgcgtgatttaggcggttcttataaagttatttttcccttaaaacgagctgttaataaccaaacaattgttgggccgcgcatttttgcagctggcgattttatttctgcaactggaggccatggcgatttacatggttatcgtcatgatgttacagagcttgttactggtggtctgggcatttgtgatggtgctgacgattgccgaagagcggtgcgagaagtgattaaaagtggcgccgatgtcattaaaattactgcaactggcggcgtgttaagtaatactgcggctggagtaaaacaacaatttaccgaccaagagctcgaagctattgttagcactgcgcataatttaggacgtaaagtgacggctcatgcccatggcaccgatggcattaatgcagcaatccgcgctggagttgattcaattgagcatggctcttatcttgataaagaatccattcgtttgtttaataagcatcaaacctatttagtgccaacattattagcaggcgcaacggtatcagaagaagccctaacgaatccaaatatgcccgctgcgattgtcgctaaagtaaaacaagttgcgccagtgatggagcaagcgtttcgcactgcattaaaaaataacgttaatattgcttttggcacggattctggggtgtcacagcatggccaaaatgccaaagaatttgctttaatggttaaatatggcatgtcacccaaagatgcgattgtcagtgctacactcagtgctgcaaccttgcttggcatgcaacagcagcttggcagtttagaagtaggtaaatttgccgatattattgctcttaaaggtgatccagaacaagatatcagcgagttatctcgagtatcatttgtgatgaaaaatgcggtgatttataaaaatgaaaagtaa

SEQ ID NO: 6461 - protein, 438 aa, Pseudoalteromonas tunicata D2
MTMSKFSLGVLSTVMLAISPALFAQVDAVIYGGTVLTVPGKSPLKEQTLILEDGKISAIHNGYRTLAQLKLTDVPVIDLKDSYVMPGLIDMHVHLTFERDPTANPHVWLTQYDADFALASVPYLEKTLNAGFTTVRDLGGSYKVIFPLKRAVNNQTIVGPRIFAAGDFISATGGHGDLHGYRHDVTELVTGGLGICDGADDCRRAVREVIKSGADVIKITATGGVLSNTAAGVKQQFTDQELEAIVSTAHNLGRKVTAHAHGTDGINAAIRAGVDSIEHGSYLDKESIRLFNKHQTYLVPTLLAGATVSEEALTNPNMPAAIVAKVKQVAPVMEQAFRTALKNNVNIAFGTDSGVSQHGQNAKEFALMVKYGMSPKDAIVSATLSAATLLGMQQQLGSLEVGKFADIIALKGDPEQDISELSRVSFVMKNAVIYKNEK

SEQ ID NO: 6462 - DNA, 1281 bp, Flavobacteria bacterium BBFL7
  CDS (1)..(1281): transl_table=11
atgaaatttaaatttacgttctttttattactaacggtttttataactgttgctcaagatagcatgacctacattcatgctggtcacttgctggatactaaaaatggtaaatggcaggatcaaatgaccattacggttaagaatgatcgtgtctcaaaagttgaaaaaggatataaagaagtcccagaagatgggacttatataaacctgaaagataaatgggtcatgcctggttttacagacatgcacgtacatatggagacagaatataatcctcatgcttacgtttcaaaatatgtggatgacccagcagatgttgcctatagctctgtccaatatgcagaaattacattactatctggatttacaactgtgagagatttaggcggtagcggtatcaatatatctttaagagatgctattaattctggtaaggttccaggacctagaatatttactgcgggaaaatctattgccacaactggtggacacgcagatcctacaaatggaagtagtcaagaattaatgggtgatccaggaccacgtgaaggtgtggcaaactcacctgccgaaggtcgtgaagcggttagacatcgttataaaaatggcgccgactgtattaaaatcacagcaactggtggcgtattgagtgttgcaaaaaacggcagtaatccacaatttacagttgaagaaattaaggccatcacagaaaccgcagcagattatggatttcatgtagcggcacatgcccatggcgatgaaggaatgcgtcgcgctgttttaggtggtgttaaaactattgagcatgggacgtatatgagtgaggaaacgatggacttaatgaagaaaatggattgttatcttgtacctactattaccgcaggaaaagaagtagctgagaaagccgaagtagaaggtttttatccagctatagtagttcctaaagcaagaacggtaggaccacagattcaaggcacttttgctagagcttataaacgtggagttcctattgtttttgggacagatgctggtgtttttgcgcacggtaaaaacgcaaaggaatttggttatatgcacgaggccggaatgcctattatggaaaccattcagagtgctaccatcacacctgctattattttaaatgaagaaaacaatataggtcaagtccaacaaggtttctatgcagacatcattgcagtctcagaaaacccagaagataatgtagcaactctagaaacggttgaatttgtgatgaaggaaggagtggtttataaaaggtaa

SEQ ID NO: 6463 - protein, 426 aa, Flavobacteria bacterium BBFL7
MKFKFTFFLLLTVFITVAQDSMTYIHAGHLLDTKNGKWQDQMTITVKNDRVSKVEKGYKEVPEDGTYINLKDKWVMPGFTDMHVHMETEYNPHAYVSKYVDDPADVAYSSVQYAEITLLSGFTTVRDLGGSGINISLRDAINSGKVPGPRIFTAGKSIATTGGHADPTNGSSQELMGDPGPREGVANSPAEGREAVRHRYKNGADCIKITATGGVLSVAKNGSNPQFTVEEIKAITETAADYGFHVAAHAHGDEGMRRAVLGGVKTIEHGTYMSEETMDLMKKMDCYLVPTITAGKEVAEKAEVEGFYPAIVVPKARTVGPQIQGTFARAYKRGVPIVFGTDAGVFAHGKNAKEFGYMHEAGMPIMETIQSATITPAIILNEENNIGQVQQGFYADIIAVSENPEDNVATLETVEFVMKEGVVYKR

SEQ ID NO: 6464 - DNA, 1305 bp, Alteromonadales bacterium TW-7
  CDS (1)..(1305): transl_table=11
atgaaaacagcactcacaacattatcgtcaattgtattggcaatgttcgttaataatgtaaacgcagcacaatctaaaatcatttacgcaggtagtttacttgtagcacctgagcaggcattaaaaaaagaacaaaccttagttgttaccaatgacaaaataacggctattaaagacggttatgtatcaaagtcagtacttaatttacctgatgctgaaatagttaatttaaaaaaccagtttgttatgccaggtttgattgatatgcatgtgcatgtaacttttgaacgtgacgctaaagcaaacccacaccgttgggctacagaatatgaagccgattatgcgcttcgttctattaaatatttacagcgtacgcttgatgccggctttacgtcggtgcgtgatttaggcagcgactatcaagttatttttccgttaaaacgcgcaattgaacgacaagacattgcaggacctcgtatttttgcagcgggtaatacaatatcgccaagcggcggtcatgctgatatgcatggctacagaaaagacataaccgatgtttttaaaacgacattaggcatttgtaatggcgctgacgattgccgccgtgctgtgagagaagttattaaaagtggtgctgatgtaattaaaattactgcaacgggtggtgtgttgagtaataccgcagcgggagtgaatcaacaactcactgatgatgagctggctgctattgtagatacagcgcatcatttagggcgaaaggtaacagcgcatgcccacggaacagaaggaattaaagcagcgcttagagctggggttgactcaatagagcacgggtcttatttagataaaaaaacagtcgatttattcaataaaacgcaggcctatttagttcccacactgcttgctggtgccacggtaagtgaagaggtacttactaatcctaatatgccagcggcaattgcgaataaagtgcgagaagtaacgcctaaaatgcaggcatcgtttaagttagcgctcaaaaacaaggtaaacattgcctttggtaccgactcgggtgtatcgcgtcatggtcttaatgcaaacgagtttggtttaatggttgataatggaatgagtgaggcgcatgcaataaagtcagccacagtgtatgctgctaaattgttagggcaaagccatcagttaggcgacttgagtgttggtaaacaagcagatattatcagcgtaaacggctcaccacttgaagacataaacgtacttaaaaacgtgcaatttgttatgaaagcagggcaaatttacaagcaatag

SEQ ID NO: 6465 - protein, 434 aa, Alteromonadales bacterium TW-7
MKTALTTLSSIVLAMFVNNVNAAQSKIIYAGSLLVAPEQALKKEQTLVVTNDKITAIKDGYVSKSVLNLPDAEIVNLKNQFVMPGLIDMHVHVTFERDAKANPHRWATEYEADYALRSIKYLQRTLDAGFTSVRDLGSDYQVIFPLKRAIERQDIAGPRIFAAGNTISPSGGHADMHGYRKDITDVFKTTLGICNGADDCRRAVREVIKSGADVIKITATGGVLSNTAAGVNQQLTDDELAAIVDTAHHLGRKVTAHAHGTEGIKAALRAGVDSIEHGSYLDKKTVDLFNKTQAYLVPTLLAGATVSEEVLTNPNMPAAIANKVREVTPKMQASFKLALKNKVNIAFGTDSGVSRHGLNANEFGLMVDNGMSEAHAIKSATVYAAKLLGQSHQLGDLSVGKQADIISVNGSPLEDINVLKNVQFVMKAGQIYKQ

SEQ ID NO: 6466 - DNA, 1278 bp, Alteromonadales bacterium TW-7
  CDS (1)..(1278): transl_table=11
gtgaaaaagcacctattatcagcctcaatagccatattatgtttgagcagtctacctgcccaggcagtcacctacatttctgcaaaagccatgttagatgtagagaatggcacactcattcaatcgccattaattactattgatgatggtgtgatcacctcaatagaacgtaataaaaagccgaaactaggtaaaaatgatgaacttattaacctgccacagttaacactagtccctggattgatggacatgcatgtacacttaacgagtgatcctactgtttctcgaagtgagcgcttgggtcaatcaatcccacgcatggcagttaaatcggcttattttgctaaaaagacccttgaagcaggttttactaccgtaagaaatgtgggcgcagatggttatagcgttattgcggtgcgagacggtattaatgcgggtgacattgtaggcccacgaatttgggctgcagggccttcattgggtataactggcgggcactgtgacaataaccgtttaccgcctgagctaaaatatacctcaacaggtgtagcagacgggccatgggcggttagaacaaaagtacgtgaaaatataaagtacggtgcaaacgctataaagttttgtgctacaggtggtgttttttcaaagggtaccaaagtaggtgtgcaacaatattcgcttgaagaaatgaaagccattgttgaagaagctcacatgcgcgacctaccagttgcagcgcatgcacacggcacaagcggcataaaaacagccatcattgcaggtgttgacagcgtagaacacgcaagctttttagacgatgaagccatagccctggctaaaaaacatggcacttggctttctatggatatatacaacacagaatacacattaagctttggcgaacaaaatggtgtagacgaagaaaacctaaacaaagaacgccaagtttctaaaaaacaaagagatagctttagccgagctgtgaaagctggtgtgaacatggtatttggaaccgacgctgccatctacccacatggtgataatgcaaagcaattttcacgtatggttgaatttggcatgactgaactgcaagctattcaatcagctaccattaacagcgctaaacttttaaaaatgaataataaactagggcaaataaaaacgggatatgccgccgatattattgctgttgaaggaaacccattaaaaaacatttcaacattagagcaaataccgtttgtgatgaaagcaggtattgtttataaaactgaaaaataa

SEQ ID NO: 6467 - protein, 425 aa, Alteromonadales bacterium TW-7
MKKHLLSASIAILCLSSLPAQAVTYISAKAMLDVENGTLIQSPLITIDDGVITSIERNKKPKLGKNDELINLPQLTLVPGLMDMHVHLTSDPTVSRSERLGQSIPRMAVKSAYFAKKTLEAGFTTVRNVGADGYSVIAVRDGINAGDIVGPRIWAAGPSLGITGGHCDNNRLPPELKYTSTGVADGPWAVRTKVRENIKYGANAIKFCATGGVFSKGTKVGVQQYSLEEMKAIVEEAHMRDLPVAAHAHGTSGIKTAIIAGVDSVEHASFLDDEAIALAKKHGTWLSMDIYNTEYTLSFGEQNGVDEENLNKERQVSKKQRDSFSRAVKAGVNMVFGTDAAIYPHGDNAKQFSRMVEFGMTELQAIQSATINSAKLLKMNNKLGQIKTGYAADIIAVEGNPLKNISTLEQIPFVMKAGIVYKTEK

SEQ ID NO: 6468 - DNA, 1275 bp, marine gamma proteobacterium HTCC2080
  CDS (1)..(1275): transl_table=11
atgcttctggcaccaacagtcattgcagagcgattggctctggtacctgatgctctcatcgacgggctcagtgacaagccacaaaaaaatcgggcagtcttgatcgagggagacaccatcgtcgatgtggtcaacgttgacacactgacacccgatgtccgccagataacactgccggggcaaaccttgatgccgggcttaatcaacggacacgaacatccgctgatttatggtgataattatcagaacgtccatttatcgggttcctctgcttacaaaaccctactagggctcgcggcgctgcaaggcatgctgcaacacggctggacgacggtaagagtaatgggtgacgccgacgtctatttcggtaatcaggatatcgcccgggcggtcagtgaaggcgtacaccaagcaccgcgtattaccggagctggccactatttatcgatcactgggggtggcggagatatcaactatctctctcccgaacaagccatgatcagcgacggctatattgttgatggcgccatggaagtgcgccgcgccgtgcggcgagagatcaaatttgggtctgactggatcaagattttagtcactggtgcctttcactcggtgggcgacgaccccaaaaacgttgccttcagtcccgacgaactcgctgaggcagtggcagaagctaataggcacggcgtacccgtggcggcccatgcccatgccaacgctggcatcaatcaggccattgaagccggtgtgcgctctatagagcacggcacgtatctggacgcgcattcgatagagctgatggtcgagcacggtacttttctggtgcccaccatatacgtcggtgattattacgccggtaccgataaattgctggcgcaagaaaaaaacgacgacgtttatctcaattaccgcgacgagtggctgagcttaatagggcaggcccatcgcgcgggggtcaaagtggtggtgggttctgatctcggtggctacaacattgatcccagagcctacgctcgtgagattgccgtgctaacagaagccggcctatctcctatggcggcaattaaagcagcaacctcggtcgcagcagatatgcttcagtggagcgggcaagtaggttcggtacaggccgggcgatgggcggatcttattgctgtttccggaaatcctctcactgatctgtcattacttgagaacccagcgtttgtgatgaaaggcggggaaatcgtacgctgggatgaggcaccacaacaaagtgcgtcgtacccctag

SEQ ID NO: 6469 - protein, 424 aa, marine gamma proteobacterium HTCC2080
MLLAPTVIAERLALVPDALIDGLSDKPQKNRAVLIEGDTIVDVVNVDTLTPDVRQITLPGQTLMPGLINGHEHPLIYGDNYQNVHLSGSSAYKTLLGLAALQGMLQHGWTTVRVMGDADVYFGNQDIARAVSEGVHQAPRITGAGHYLSITGGGGDINYLSPEQAMISDGYIVDGAMEVRRAVRREIKFGSDWIKILVTGAFHSVGDDPKNVAFSPDELAEAVAEANRHGVPVAAHAHANAGINQAIEAGVRSIEHGTYLDAHSIELMVEHGTFLVPTIYVGDYYAGTDKLLAQEKNDDVYLNYRDEWLSLIGQAHRAGVKVVVGSDLGGYNIDPRAYAREIAVLTEAGLSPMAAIKAATSVAADMLQWSGQVGSVQAGRWADLIAVSGNPLTDLSLLENPAFVMKGGEIVRWDEAPQQSASYP

SEQ ID NO: 6470 - DNA, 1044 bp, Aspergillus oryzae
  CDS (1)..(1044)
atgaaggatctcagcgacaacgtcagccttctacgacagccaagcgtctgtcaatcgatgttgaaccgaggattcacaactgtacgagactgtggaggggcagggctggcattaaaggaatcgatccaggaaggcgtgattcctggaccgcggttgttcattgccggacacgctctttcacaaactggtggtcatggggatcgtcgccaaccacatgatcgcaacaagtgctgtgcaggacatgtcaacggcattggacgtatagtggacggtgtggaacagtgcctgaagtatgctcgcgaggagatccgacaagggtcagactttatcaaaatcatgggaggaggcggtgtcgccagtccatcggaccagattcatcatgtccaattttccgacgaagagatcaaggccattgtcaccgtagctaacaacgcgggaacatatgtcacttctcacgtgtacaccccgcaggccatacaacaagccatcagtcagggagtgaaggcgatcgaacatggaaatctcctcgatgaagccacggcgaaactgatgaaggagaacggcgtcatccttactccgactctagtcacttacgctacaatggactcacccgagttccgctccttccttcctccggcttccgcccagaagaatcgggaagtgctgcacaaggggttacaggctctcgagcttgctagcaaagctggtgttgatatatgctttgggacagatctcctaggcccgttgcactttgcacagagtaaggaattcgccatccgtagcagtgtacagacacctttggaaattctccagagtgccactatcactcctgctcgcctgctgaagcaagacggatttctcggccaaattgtgcctgggtttgccgtcgacttggtgattctgaacgcaaatcccttggaggatataactgtgcttgataggtttaacgatcatatactagcgaccatcaaggacggacgcgtgctagcatcacggtggagtcaactagatgttgaagcaattccgctaccaaagatagaatga

SEQ ID NO: 6471 - protein, 347 aa, Aspergillus oryzae
MKDLSDNVSLLRQPSVCQSMLNRGFTTVRDCGGAGLALKESIQEGVIPGPRLFIAGHALSQTGGHGDRRQPHDRNKCCAGHVNGIGRIVDGVEQCLKYAREEIRQGSDFIKIMGGGGVASPSDQIHHVQFSDEEIKAIVTVANNAGTYVTSHVYTPQAIQQAISQGVKAIEHGNLLDEATAKLMKENGVILTPTLVTYATMDSPEFRSFLPPASAQKNREVLHKGLQALELASKAGVDICFGTDLLGPLHFAQSKEFAIRSSVQTPLEILQSATITPARLLKQDGFLGQIVPGFAVDLVILNANPLEDITVLDRFNDHILATIKDGRVLASRWSQLDVEAIPLPKIE

SEQ ID NO: 6472 - DNA, 1032 bp, Aspergillus oryzae
  CDS (1)..(1032)
atgttcgccgccagcccgaatacaattgcataccgcactacctatgtcgcccggaacatgctcctccgaggcttcaccactgcgcgtgatacaggcggcgctgatgcggcattacgcgatgctatcgcagagggactgctatctggaccgcgcctcttcatcgcgggcaaggccctctctcaaaccgggggtcatggggacttacgagccccgtatcagggtgacgagcataaatgttgtggtggacactcacccgcgctagctcggatctgtaacggcgtcccagcgtgcttagaggccgttcgagatgagctccggcaaggggcaaacttcatcaagataatgtgtggagggggagtcgcaacgcccaccgatgcgctagatatgcttcagttcacggccgaagaaatccaggccatcacaaccaccgccgcatactccaaaacttacgttaccgctcatgcctataacgcggaggcaatccgccacgcggtcgataatggagtgcgtggtattgaacatggcaatttcattgaccccgagactgccagatactgcaaagagaaaggggtggtcttcaccccgaccctgatcacctatcaaggaatgacggaacccccattcgataactttcttgacgagtttagtcaagcgaagaacctcgaggttctggccagtggccttcaggctctggaaattctacgcgatgctggcataacaatgtgctacggatctgatcttctggcaggcctccacacgttacaaaaccgtgaattcagtattcgatcagccgttctcagtccgctggagatcctccagtcggcgactatcaacgctgccacattggttggtatggagggcaaattgggctgtataaaggagggggcgattgcggatttcctgattctcaatgctaacccgctggaagacattacaattttggatcatgtagacaagtcattaatggcgattgccaaagaggggcggattgttagtagcaagatagcggatttatcagtggaccctctttag

SEQ ID NO: 6473 - protein, 343 aa, Aspergillus oryzae
MFAASPNTIAYRTTYVARNMLLRGFTTARDTGGADAALRDAIAEGLLSGPRLFIAGKALSQTGGHGDLRAPYQGDEHKCCGGHSPALARICNGVPACLEAVRDELRQGANFIKIMCGGGVATPTDALDMLQFTAEEIQAITTTAAYSKTYVTAHAYNAEAIRHAVDNGVRGIEHGNFIDPETARYCKEKGVVFTPTLITYQGMTEPPFDNFLDEFSQAKNLEVLASGLQALEILRDAGITMCYGSDLLAGLHTLQNREFSIRSAVLSPLEILQSATINAATLVGMEGKLGCIKEGAIADFLILNANPLEDITILDHVDKSLMAIAKEGRIVSSKIADLSVDPL

SEQ ID NO: 6474 - DNA, 1335 bp, Aspergillus oryzae
  CDS (1)..(1335)
atgacacagacaacccaagtcccagggactgacatcaagccctggttgcagccagcaccgcaaagctacgtctttaccaacgccaacattgtcgacgttgaagctggcacgatcttggaaaattcatcactcgtgatcagcgaaggcaagattcagtcaatctcacagggagagcatcaaccgaccgacctacatgtaatcgattgtcagggtcgctatatctgccctggattatttgatgcccatgttcacttgtgcgctgtgccagggttcaccgacctgagcaaagcttttgggaatcccaacgatgtgcacctgctgcgccagccttatacagccgctcagatgctgcaccgcggctttactagcatccgtgattgcggtggagcccaactcgccttgaaagaggccatcgaagatggagtctttccaggtcctcgcatcttcctgtccggtcatgccctgtcacaattcgggggacacggcgatttacgaaactcgcatgagcacggccaatgctgcggcggagtccacaaccaaaactcgctcgggcgcatgtgcaacggcgtgcccgagtgcatggcagctgttcgcgaagagatccggtgcggagccgatttcatcaagatcatgggctcgggcggtgttgcatctccaaccgacaagctggagcacctccaattcacggacgccgagatccaggcgatggtggagtgtgcagcgaatgcgggcacttttgtgacagctcatgcgtacacggtcaaggcgatccggcattgtattgataatggtgttcggggcatcgagcatgggaactttgtcgataaaccgactgctcagctgatggctgaaaagggcgtctacctgacccccaccctcatcacttatgctcagatggccagtgatcgttggaagggttacttgtctccggaatctcagactaaaaattcccaggtgcttgagtccggcttgggagctctcaagatcgcatcggatgcaggcgttaccatgtgttatggctcggatctcttgggcccgttgggcgctgctcaaacacaggaattccaattgcgttcgcaggtactctcgccgcttgaggtcctgcgcagtgcgactatcaacccggcgaggatgatgagctgcgatgatagtctcggtcagattaaagagggctttgaggccgatttgctggttttaagcaaaaaccctttggagaacgtaactatctttgacaagcctgacgaacatgttctagctgtcatgaaggcgggacgtgtttataagagccggtgggctgcgctccccgaggatggcgcaactccggtgaggctatga

SEQ ID NO: 6475 - protein, 444 aa, Aspergillus oryzae
MTQTTQVPGTDIKPWLQPAPQSYVFTNANIVDVEAGTILENSSLVISEGKIQSISQGEHQPTDLHVIDCQGRYICPGLFDAHVHLCAVPGFTDLSKAFGNPNDVHLLRQPYTAAQMLHRGFTSIRDCGGAQLALKEAIEDGVFPGPRIFLSGHALSQFGGHGDLRNSHEHGQCCGGVHNQNSLGRMCNGVPECMAAVREEIRCGADFIKIMGSGGVASPTDKLEHLQFTDAEIQAMVECAANAGTFVTAHAYTVKAIRHCIDNGVRGIEHGNFVDKPTAQLMAEKGVYLTPTLITYAQMASDRWKGYLSPESQTKNSQVLESGLGALKIASDAGVTMCYGSDLLGPLGAAQTQEFQLRSQVLSPLEVLRSATINPARMMSCDDSLGQIKEGFEADLLVLSKNPLENVTIFDKPDEHVLAVMKAGRVYKSRWAALPEDGATPVRL

SEQ ID NO: 6476 - DNA, 1332 bp, uncultured gamma proteobacterium
  CDS (1)..(1332): transl_table=11
  misc_feature (551)..(551): r is g or a
atgaacaagggcaaattcctgaagagtgcggcaaggatcgcgtgcgtgacactggctgtcgcagcaatatccggcactgccactgccagggatatcgtcattcatgctggccgcctgatcgacgggaccggggccgcaccgcgccagaacgtatcgatcctgatcaccgaccagcggatcaccgcggtccagcccggcttcgtcacaccgcaaggcgccgaagtggtggatctggccgacaagaccgtactccccggcctcatcgacacacacgaccatatcaccgcgggctggcacggcggtgacccgatccgcaacagcgttacacgcagcgatttcgaagatgccatcgaagccaccgtcttcacccgcaacactttgctggccggcttcacctcggtgcgcgattgcggcgcgaatacccaggtggtggttgcgctcaagaaatcgatcgagggcggcgccgtgccgggtccgcgcctgtgggtggccggcacacctctgggtccaacgggcggccacggggatgcggtcaacggactgcgggtggrattcgccgatattccgcacatcagcgacaatgtcgtggacagtcccgaagcggcgagacttgcggtacggcggctcaagcgcgaaggcgccgacctcatcaagatcatgccttccggcggggtcatgtcgatcggcgacgatccacgccatcagttgatgaccgacgacgagatcaaggccatcatcgataccgcccatgcgctcggcataaaagttgctgctcatgcccacggcaagcaagccatcgatcataccatcgaactcggcgtggattcgatcgagcacggctcttatgccgatgccgcaagctacaagcttttcaagcaatatggcacctatctggtgccgacgatgctggtgggtgagcgagtctatcagcgcgccaagcaacaccccgaagaactcaatccgtcaacggcgcaaaaggcgctcgaaatcgcgccgctgctgcgccgcaatctccatgacgcctatgccgcgggcgtgaagatcgccttcggaaccgatactttcggcctgtcgaagcatggcgagaacggacaggaattcgcattgctggtgggtgcgggcatgaccccgatggatgcgatcaaggccgcaacgggaaatgccgcggacctgctcggcagcgccgacgtgggtacgctgcaaccgggccgctatgccgatgtcattgccgtcgatggcgatcctctgtccaatatccaggttctggaaaacgtggccttcgtgatgaaaggcggcgcgatcgtcaaatcgggcggcaaggcgcagatctga

SEQ ID NO: 6477 - protein, 443 aa, uncultured gamma proteobacterium
  misc_feature (184)..(184): The Xaa at location 184 stands for Glu, or Gly.
MNKGKFLKSAARIACVTLAVAAISGTATARDIVIHAGRLIDGTGAAPRQNVSILITDQRITAVQPGFVTPQGAEVVDLADKTVLPGLIDTHDHITAGWHGGDPIRNSVTRSDFEDAIEATVFTRNTLLAGFTSVRDCGANTQVVVALKKSIEGGAVPGPRLWVAGTPLGPTGGHGDAVNGLRVXFADIPHISDNVVDSPEAARLAVRRLKREGADLIKIMPSGGVMSIGDDPRHQLMTDDEIKAIIDTAHALGIKVAAHAHGKQAIDHTIELGVDSIEHGSYADAASYKLFKQYGTYLVPTMLVGERVYQRAKQHPEELNPSTAQKALEIAPLLRRNLHDAYAAGVKIAFGTDTFGLSKHGENGQEFALLVGAGMTPMDAIKAATGNAADLLGSADVGTLQPGRYADVIAVDGDPLSNIQVLENVAFVMKGGAIVKSGGKAQI

SEQ ID NO: 6478 - DNA, 1440 bp, Neurospora crassa
  CDS (1)..(1440)
atgagtcaatctgaagcaacgtggacctcagcctttggagggatcccggaaatcgtcatcaaaccatggaaaccaccgccacgaaggacctatctctttaaaagagcgaacctcgttgataccgctcaaggaaccattatctccaacgtaaacatcaagatcgcagatggcgtgatcaagctcatcgagaaaaacgatcccagaattaccagcctcgctcatcatcaacgaggcgaagatgacttgggatcggtaatcgaagttgaccttgaaggcaaatttctgtgccctgggcttattgactgccatgtccacgtcagtgccgtaccaggggaactcagtctttcatccaccgccgctatctctgatcccgccatttcgcttcttcgtcaacccttcgtctgctcccagatgcttagcaggggatttaccaccgttcgtgacacaggcggtgccacgcttgctttgaaggaggccatcgaagagggtgtttttcccgggccacggctcttcatctgtaatcgggctctgtctcagacaggtggccatggtgacctccgcggcgcgcacgaccacaagaaccgaggaggaggaggaggaggaggaggaggaggagaaggctgctgcgggggctcagcgggtcaactggctgtggtctgtgatggagtaccggagtgcattcgtgcggcgcgagagcagttgagaacaggagcggacttcatcaagattatggtaggaggcggcgttgcctcccccacggatcggttgaccaacacgcaattcacggctgctgaggtccgggccatctgcgatgtggcagagagctatggaacctacgtgacagctcatgcgtacacgcccaaagcaattcgccatgctgttgacaatggtgtcaagggtatcgaacatggaaatcttattgacgaagcgacggcacggtacatggccgagaggggaatatggttaacaccaacgctagtgacatatgatgcgatggcatcagatgagtatgccggcttcctaccaccagagaatcagcgaaaaaacgaagaggtattgcggcaggggctgaagtcgctcacaattgcggaaaaggcaggagtcaacatgtgttatggctctgatcttttaggacctttgacgagagagcagtcaaaggagtttggcatccggtcggtcatcctaaagagcaagcaggttttgcagtcagctactgtgaatgcggcaaagatgctaggacaggagtcgtttctgggccaactcaaaccaggatatgctgccgatatgcttattctcaacgtcaacccattcaatgacgtggcgatgctggatgaaccaaagaaacacgtgttggcagtaattaaggacggacgagtatgtgtgagccgttggagaaagcttcccatggatgcaacacacggagaggagttaattgagtga

SEQ ID NO: 6479 - protein, 479 aa, Neurospora crassa
MSQSEATWTSAFGGIPEIVIKPWKPPPRRTYLFKRANLVDTAQGTIISNVNIKIADGVIKLIEKNDPRITSLAHHQRGEDDLGSVIEVDLEGKFLCPGLIDCHVHVSAVPGELSLSSTAAISDPAISLLRQPFVCSQMLSRGFTTVRDTGGATLALKEAIEEGVFPGPRLFICNRALSQTGGHGDLRGAHDHKNRGGGGGGGGGGEGCCGGSAGQLAVVCDGVPECIRAAREQLRTGADFIKIMVGGGVASPTDRLTNTQFTAAEVRAICDVAESYGTYVTAHAYTPKAIRHAVDNGVKGIEHGNLIDEATARYMAERGIWLTPTLVTYDAMASDEYAGFLPPENQRKNEEVLRQGLKSLTIAEKAGVNMCYGSDLLGPLTREQSKEFGIRSVILKSKQVLQSATVNAAKMLGQESFLGQLKPGYAADMLILNVNPFNDVAMLDEPKKHVLAVIKDGRVCVSRWRKLPMDATHGEELIE

SEQ ID NO: 6480 - DNA, 1430 bp, Microbacterium esteraromaticum
  CDS (74)..(1255): transl_table=11
  misc_feature (1288)..(1288): s is g or c
  misc_feature (1305)..(1305): b is g, c or t
  misc_feature (1306)..(1306): s is g or c
  misc_feature (1307)..(1307): s is g or c
  misc_feature (1308)..(1308): s is g or c
ttcgaactcgacgaaggcgaccccgtcgccaccggattcagcctgcgctgaccaccagcgaaacggagaccccatgcgcacagcatcgatcaccatcaccggagcacaggtgtggaacggcgacggcttcgacgcccgcgacgtgcacatcgtcgacggcagggtcgccgatgcgggcgaccctgatgcccggcggctcgacggcagcggcaggtggctcgtccccgggctgatcgacgcgcacttccacgcgtatgcgacgagcatggacggactcgagaacgaacggggcccgctcagctacgcggccatcaacggcgcgacccggctctcgaaggccctgcagcgcggcttcaccaccgtgcgcgacgtggccggcggcgacatcggcctcgcccgcgccatcgatgccgacctgttcccctccccccgctatcacttcaccggcccggcgctcagccagaccggcgggcacggcgacccgcgctcggcgcacgtcgacgtgtgcttctcgcacgggcacatgtgcgaggtcgtcgacggcgtcgacaacctgcgcctggccgtgcggaaccggctgcgcaccggtgcgcatgcgatcaaggtcatggcatccggaggcgtcttctcactcaccgatcccatccgcgtgccgcagtactcggccgacgagctgcgcgccgtggtcgatgaggccacccgtcggggcagctacgtctgcgcgcacgcctactcgtcagaggcggttcagcacgcggtgaccgcgggcgtgcgctcgatcgagcacggcaacctgatcgacgccgagaccgcgcggctgatggccgaagccggggccttcctcgtgccgaccctcgccgcgtacgacgcgatggaccgtcgcggtgcggagatcggcctcaacgagacctcgctcgcgaagaacagcgaggtgctgtcgaaaggccaggacgccgtgcgcctcgcccacgaggcaggggtgcgcgtcggcttcggcaccgacctcatgggagacctcgaagacgaccagctcgcgggcatccggctgcaggtcgaggcatcgggcgccgccgcgaccctgcggtcgatgaccgctgtgaacgccgagctcatcggcgacgagtcgctcggccacctgaacgccggcgcctacggagacgccgtgctgctggcatccgacccgctcgccgagcccgctgcactgtggcagcaagacgcccgcctcgccgtggtgcgcgccggcagcgtgatctgagtgagcgtcgtcgcccctgctcaacgtcgtcgsccctgctcagcgtcgtbsssccctgctcagtcacgtagctgagcaggggcgacgacaatgggcaggggcgaggacgcagcgcacggtgccccatcacaacccgcgtcgggcgtcagcgcaccgccgagccccagctctgcga

SEQ ID NO: 6481 - protein, 393 aa, Microbacterium esteraromaticum
MRTASITITGAQVWNGDGFDARDVHIVDGRVADAGDPDARRLDGSGRWLVPGLIDAHFHAYATSMDGLENERGPLSYAAINGATRLSKALQRGFTTVRDVAGGDIGLARAIDADLFPSPRYHFTGPALSQTGGHGDPRSAHVDVCFSHGHMCEVVDGVDNLRLAVRNRLRTGAHAIKVMASGGVFSLTDPIRVPQYSADELRAVVDEATRRGSYVCAHAYSSEAVQHAVTAGVRSIEHGNLIDAETARLMAEAGAFLVPTLAAYDAMDRRGAEIGLNETSLAKNSEVLSKGQDAVRLAHEAGVRVGFGTDLMGDLEDDQLAGIRLQVEASGAAATLRSMTAVNAELIGDESLGHLNAGAYGDAVLLASDPLAEPAALWQQDARLAVVRAGSVI

SEQ ID NO: 6482 - DNA, 24 bp, Artificial sequence
  primer
atgctgatgccaaagtcagttgca

SEQ ID NO: 6483 - DNA, 25 bp, Artificial sequence
  primer
tcaatatatccttccctctttcatg

SEQ ID NO: 6484 - protein, 424 aa, Artificial sequence
  consensus sequence
  Variant (3)..(4): Xaa in position 3 to 4 is any amino acid
  Variant (6)..(6): Xaa in position 6 is any amino acid
  Variant (8)..(8): Xaa in position 8 is any amino acid
  Variant (10)..(28): Xaa in position 10 to 28 is any amino acid
  Variant (29)..(46): Xaa in position 29 to 46 is any or no amino acid
  Variant (48)..(49): Xaa in position 48 to 49 is any amino acid
  Variant (53)..(53): Xaa in position 53 is any amino acid
  Variant (56)..(57): Xaa in position 56 to 57 is any amino acid
  Variant (59)..(70): Xaa in position 59 to 70 is any amino acid
  Variant (71)..(78): Xaa in position 71 to 78 is any or no amino acid
  Variant (80)..(82): Xaa in position 80 to 82 is any amino acid
  Variant (86)..(96): Xaa in position 86 to 96 is any amino acid
  Variant (100)..(110): Xaa in position 100 to 110 is any amino acid
  Variant (111)..(146): Xaa in position 111 to 146 is any or no amino acid
  Variant (148)..(152): Xaa in position 148 to 152 is any amino acid
  Variant (155)..(156): Xaa in position 155 to 156 is any amino acid
  Variant (159)..(162): Xaa in position 159 to 162 is any amino acid
  Variant (166)..(177): Xaa in position 166 to 177 is any amino acid
  Variant (178)..(181): Xaa in position 178 to 181 is any or no amino acid
  Variant (183)..(184): Xaa in position 183 to 184 is any amino acid
  Variant (186)..(189): Xaa in position 186 to 189 is any amino acid
  Variant (191)..(196): Xaa in position 191 to 196 is any amino acid
  Variant (197)..(197): Xaa in position 197 is any or no amino acid
  Variant (199)..(200): Xaa in position 199 to 200 is any amino acid
  Variant (203)..(214): Xaa in position 203 to 214 is any amino acid
  Variant (216)..(218): Xaa in position 216 to 218 is any amino acid
  Variant (223)..(278): Xaa in position 223 to 278 is any amino acid
  Variant (279)..(316): Xaa in position 279 to 316 is any or no amino acid
  Variant (318)..(318): Xaa in position 318 is any amino acid
  Variant (320)..(323): Xaa in position 320 to 323 is any amino acid
  Variant (325)..(325): Xaa in position 325 is any amino acid
  Variant (327)..(354): Xaa in position 327 to 354 is any amino acid
  Variant (355)..(362): Xaa in position 355 to 362 is any or no amino acid
  Variant (365)..(367): Xaa in position 365 to 367 is any amino acid
  Variant (369)..(375): Xaa in position 369 to 375 is any amino acid
  Variant (376)..(385): Xaa in position 376 to 385 is any or no amino acid
  Variant (387)..(390): Xaa in position 387 to 390 is any amino acid
  Variant (392)..(393): Xaa in position 392 to 393 is any amino acid
  Variant (396)..(402): Xaa in position 396 to 402 is any amino acid
  Variant (404)..(419): Xaa in position 404 to 419 is any amino acid
  Variant (420)..(423): Xaa in position 420 to 423 is any or no amino acid
PGXXDXHXHXXXXXXXXXXXXXXXXXXXXXXXXXXXXXXXXXXXXXLXXGFTXVRXXGXXXXXXXXXXXXXXXXXXXXGXXXGPRXXXXXXXXXXXGGHXXXXXXXXXXXXXXXXXXXXXXXXXXXXXXXXXXXXXXXXXXXXXXXRXXXXXGAXXIKXXXXGGVXXXXXXXXXXXXXXXXEXXAXXXXAXXXXXXXVXXHAXXXXXXXXXXXXGXXXIEHGXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXXGXVXXXXGXDXXXXXXXXXXXXXXXXXXXXXXXXXXXXXXXXXXXXATXXXAXXXXXXXXXXXXXXXXXGXXXXGXXADXXXXXXXPXXXXXXXXXXXXXXXXXXXXG

SEQ ID NO: 6485 - protein, 26 aa, Artificial sequence
  protein pattern
  Variant (2)..(2): Xaa in position 2 is Ala, Ser, Thr or Val
  Variant (3)..(3): Xaa in position 3 is any amino acid
  Variant (4)..(4): Xaa in position 4 is Ala, Gly, Asn, Ser, Thr or Val
  Variant (5)..(6): Xaa in position 5 to 6 is any amino acid
  Variant (7)..(7): Xaa in position 7 is Ala, Gly or Ser
  Variant (8)..(14): Xaa in position 8 to 14 is any amino acid
  Variant (16)..(17): Xaa in position 16 to 17 is any amino acid
  Variant (18)..(18): Xaa in position 18 is Ala, Cys, Gly, Ser or Thr
  Variant (22)..(22): Xaa in position 22 is Ala or Gly
  Variant (23)..(25): Xaa in position 23 to 25 is any amino acid
  Variant (26)..(26): Xaa in position 26 is Asp, Asn, Ser or Thr
HXXXXXXXXXXXXXGXXXIEHXXXXX

SEQ ID NO: 6486 - protein, 22 aa, Artificial sequence
  protein pattern
  Variant (2)..(4): Xaa in position 2 to 4 is any amino acid
  Variant (6)..(6): Xaa in position 6 is any amino acid
  Variant (7)..(10): Xaa in position 7 to 10 is any or no amino acid
  Variant (12)..(12): Xaa in position 12 is Ala or Val
  Variant (13)..(14): Xaa in position 13 to 14 is any amino acid
  Variant (15)..(15): Xaa in position 15 is Ile, Leu or Val
  Variant (17)..(19): Xaa in position 17 to 19 is any amino acid
  Variant (20)..(20): Xaa in position 20 is Gly, Asn, Ser or Thr
  Variant (22)..(22): Xaa in position 22 is Ala or Gly
RXXXRXXXXXGXXXXKXXXXGX

SEQ ID NO: 6487 - protein, 22 aa, Artificial sequence
  protein pattern
  Variant (2)..(2): Xaa in position 2 is any amino acid
  Variant (3)..(3): Xaa in position 3 is Ile, Leu or Val
  Variant (4)..(5): Xaa in position 4 to 5 is any amino acid
  Variant (7)..(7): Xaa in position 7 is any amino acid
  Variant (8)..(8): Xaa in position 8 is any or no amino acid
  Variant (10)..(10): Xaa in position 10 is any or no amino acid
  Variant (12)..(12): Xaa in position 12 is Phe, Ile, Leu, Met or Val
  Variant (13)..(13): Xaa in position 13 is Ile, Leu or Val
  Variant (14)..(17): Xaa in position 14 to 17 is any amino acid
  Variant (18)..(18): Xaa in position 18 is Asp, Asn or Ser
  Variant (20)..(21): Xaa in position 20 to 21 is any amino acid
  Variant (22)..(22): Xaa in position 22 is Asp, Glu, Asn, Ser or Thr
GXXXXGXXAXDXXXXXXXPXXX

SEQ ID NO: 6488 - DNA, 573 bp, Saccharomyces cerevisiae
  CDS (1)..(573)
atgatcattgtggtacttattcccacgcataaccgactacggcaccacaacgacgcaccaatgccatctgacgtagcatcgaggaccgggctgccaaccccgtggaccgtcaggtatagtaagtccaagaaaagagagtattttttcaatccagagacgaagcactcgcaatgggaggagcctgagggcaccaacaaggaccagctacacaagcacttaagagaccatccagtgcgtgtaagatgcctgcacattctcatcaagcacaaggattcaagaagacccgcatcgcatagatccgagaacattacgatatccaagcaagacgctacggacgaactgaaaaccttaatcacgaggttggatgacgactctaagacgaactccttcgaggccctggctaaagagagatcagattgctcttcatacaagcgaggcggcgacctcggctggttcgggagaggcgagatgcagcctagctttgaagacgctgccttccagctcaaggtcggcgaggtaagcgatatcgttgaatcaggaagcggtgttcatgtgatcaagcgggtaggttag

SEQ ID NO: 6489 - protein, 190 aa, Saccharomyces cerevisiae
MIIVVLIPTHNRLRHHNDAPMPSDVASRTGLPTPWTVRYSKSKKREYFFNPETKHSQWEEPEGTNKDQLHKHLRDHPVRVRCLHILIKHKDSRRPASHRSENITISKQDATDELKTLITRLDDDSKTNSFEALAKERSDCSSYKRGGDLGWFGRGEMQPSFEDAAFQLKVGEVSDIVESGSGVHVIKRVG

SEQ ID NO: 6490 - DNA, 372 bp, Oryza sativa (japonica cultivar-group)
  CDS (1)..(372)
atggcgtcgtcggcgacggagacggagacggtgagggcgttgcacatcctgatcaagcacgagggctcccgccgcaaggcctcctggaaggatcccgacggccgcgtcatctccgctaccacgcgcgccgacgccgccgcgcgcctcgccgacctccgcgaccagatcctctccggccgcgccaacttcgccgacctcgccgcccgccactccgactgctcctccgcgcgccgtggcggcgacctgggcacttttgggaggaggcagatgcagaaacccttcgaagatgcgacatttgctctcaaggttggtgagatgagtgacactgtggacactgacagtggtgttcacatcatcctgcgcactgcttaa

SEQ ID NO: 6491 - protein, 123 aa, Oryza sativa (japonica cultivar-group)
MASSATETETVRALHILIKHEGSRRKASWKDPDGRVISATTRADAAARLADLRDQILSGRANFADLAARHSDCSSARRGGDLGTFGRRQMQKPFEDATFALKVGEMSDTVDTDSGVHIILRTA

SEQ ID NO: 6492 - DNA, 453 bp, Encephalitozoon cuniculi GB-M1
  CDS (1)..(453)
atgcagtcagataattgtgcctgcctccaccccgagatgtggataaagctcaaggacaaggagacagggagcccatacttttacaacacggagacggccgagcgaacagaaaaaaggccaaacgaaggctttaggctgtaccacatactgataaagcatgagaagtcaagaaagcctgtggatatgagcatcgacgaggcattctccagaataaaggcaatacatgaggatttaagggcaaaggctggcgacaagaacttcagggagctcttcaaagaagctgcaattaagcattcgcaatgctcatctgcaaaaagaggtggtgacctgggatttgtgtgtggaaatgaaatgatgaaagagtttgaaaagcctgcattttcacttggaaggggggaaatgtcagggcctgtgtctacgccctcagggttccatataatttatcgaagatga

SEQ ID NO: 6493 - protein, 150 aa, Encephalitozoon cuniculi GB-M1
MQSDNCACLHPEMWIKLKDKETGSPYFYNTETAERTEKRPNEGFRLYHILIKHEKSRKPVDMSIDEAFSRIKAIHEDLRAKAGDKNFRELFKEAAIKHSQCSSAKRGGDLGFVCGNEMMKEFEKPAFSLGRGEMSGPVSTPSGFHIIYRR

SEQ ID NO: 6494 - DNA, 537 bp, Magnaporthe grisea 70-15
  CDS (1)..(537)
atggccgaccagcaccccgaaaccggcctcccgcccaactgggaggtgcggctgtccaagagcaagaacctcccctactacttcaacacctccaacaccacgtcgcggtgggagcccccgccaggcaccgacacggacaaactcaagcagtacatgggcaagtaccactcgtcggcgcttccctcggactcgccccaggccggccagatccgcgccgcgcacctgctcatcaagcaccgcgactcgcgccggccctcgagctggaaggaggaaaacattacgcgcaccaaggaggacgcccgccgcatcatcgaggcccacaaggaccgcatcgcctcgggcgaggcgtcgctggccgccctggccaccacggagagcgactgcagcagcgcccgcaagcgcggcgaccttggcttctttggccgcggcgatatgcagaaggagtttgaggaggccgcctttgccctcaagccgggcgagatcagcggcgtggtcgacacggccagcggcctgcatctgattgagaggttggcatga

SEQ ID NO: 6495 - protein, 178 aa, Magnaporthe grisea 70-15
MADQHPETGLPPNWEVRLSKSKNLPYYFNTSNTTSRWEPPPGTDTDKLKQYMGKYHSSALPSDSPQAGQIRAAHLLIKHRDSRRPSSWKEENITRTKEDARRIIEAHKDRIASGEASLAALATTESDCSSARKRGDLGFFGRGDMQKEFEEAAFALKPGEISGVVDTASGLHLIERLA

SEQ ID NO: 6496 - DNA, 534 bp, Gibberella zeae PH-1
  CDS (1)..(534)
atggctgacaccggtcttcctcctggctgggaggtccgacactccaactccaagaacctcccctactacttcaactcggccgagaagctgtcgcgatgggaacccccctccggcaccgacaccgaaaagctcaagcactacatggccaccaaccacagcgctggttcgcgtcccggtgccgttcccggtgtccccgagggcaagatccgagctgcccatcttctcgtcaagcatcgcgacagccgacgacccagcagctggagagaggcagagatcactcgcaccaaggaagaggctttcgagatcatcaaggagcacgagcaaaagatcaaatcgggaagcgtcagccttggcgagcttgctctcaccgagtccgactgctcatctgctcgcaagcgaggagatttgggatactttggcagaggtgatatgcagaaggagtttgaagatgcctcctttggtctttcgccaggccagatgagcgagattgtcgagacagccagtggtctgcacttgattgagcgtttggaataa

SEQ ID NO: 6497 - protein, 177 aa, Gibberella zeae PH-1
MADTGLPPGWEVRHSNSKNLPYYFNSAEKLSRWEPPSGTDTEKLKHYMATNHSAGSRPGAVPGVPEGKIRAAHLLVKHRDSRRPSSWREAEITRTKEEAFEIIKEHEQKIKSGSVSLGELALTESDCSSARKRGDLGYFGRGDMQKEFEDASFGLSPGQMSEIVETASGLHLIERLE

SEQ ID NO: 6498 - DNA, 522 bp, Candida glabrata CBS 138
  CDS (1)..(522)
atgtctgaaacacaagaggttagtactgggctaccagctccatggactgttagatacagtaagtctaagaaacgtgagtacttcttcgatcccgaaactaagaagtcacagtgggaagagcccgagggcactgatcatgagcaatttataagctatctgaaggatcacccattgcgtgtacgttgtctgcatatcttgatcaagcacaaggattcgaggagaccagcatcgcaccgccaagaaaagataacgattaccaaagaggaagctataaaggagttgaaagagatccaagccaggttagaggaagatcaagaacagaagaagaaacacagttttgaggcaattgccaaggagagatcagattgttcatctttcaagcgtggtggtgatctgggttacttcggcaggggtgaaatgcagcctagctttgagaaggccgcttttgcactaaagattgacgaagtaagtgatattgtggagagtgacagtggtgtccatcttatcaagcgtgttggttaa

SEQ ID NO: 6499 - protein, 173 aa, Candida glabrata CBS 138
MSETQEVSTGLPAPWTVRYSKSKKREYFFDPETKKSQWEEPEGTDHEQFISYLKDHPLRVRCLHILIKHKDSRRPASHRQEKITITKEEAIKELKEIQARLEEDQEQKKKHSFEAIAKERSDCSSFKRGGDLGYFGRGEMQPSFEKAAFALKIDEVSDIVESDSGVHLIKRVG

SEQ ID NO: 6500 - DNA, 489 bp, Kluyveromyces lactis NRRL Y-1140
  CDS (1)..(489)
atggcaggtacaggacttccagaaccctgggttatcaagtttagtagatcgaagaaacgtgaatacttcttcaacccggagactaaggaatcggtttgggaggcaccgtcaggtacagatgaggaccaatcaaagaaatacttagaggagaacccattgagggtcagagctttgcatctcttgattaagcacaaggattctagaagaccagcgtctcatagaaatgaaaatattaccattactaaggatgaggctaaagaagaattagaaacttatatcaagagattgaatggtggtgaaccattcgaatcattggctaaagagagaagtgattgttcatcagcgaaaagaggtggtgatttggggttcttcggtcatggagaaatgcaaccttctttcgagaaggctgcgtttgctttgaaaatcgatcaagtcagtgatattgtagaatctgacagtggtcttcatatcatcaaaagagttgcctga

SEQ ID NO: 6501 - protein, 162 aa, Kluyveromyces lactis NRRL Y-1140
MAGTGLPEPWVIKFSRSKKREYFFNPETKESVWEAPSGTDEDQSKKYLEENPLRVRALHLLIKHKDSRRPASHRNENITITKDEAKEELETYIKRLNGGEPFESLAKERSDCSSAKRGGDLGFFGHGEMQPSFEKAAFALKIDQVSDIVESDSGLHIIKRVA

SEQ ID NO: 6502 - DNA, 534 bp, Debaryomyces hansenii CBS767
  CDS (1)..(534)
atgtcagatactgaaactggattaccaataaactgggccattcgtgtatcccgtacgcataataaagaatattatttaaatcaagccactaaagaatcatcttgggaaccaccgtttggaaccgataatgacaagttgcagaaatacatagctaaatataaggcaaacggaaataagcctgttattcctgaagatggtaaggttcgtgcatctcatattttggttaagagtaatcaatcgagaagaccgaaatcgtggaaatatccggatggaataaccagaacaagagacgaagctattttgttgttgaagctgtatcaagacaaaatattgggtggagaaatcagtttacaagacttagcttccactgaaagtgactgctcgtctcatgctcaaggtggtgacttaggatttttcggtaagggtcaaatgcaaccttctttcgaagaagctgcgttcggattaaatgttggtgagatcagtgatatcattgaaagtgatagtggtattcacttaatacaaagaactgcttaa

SEQ ID NO: 6503 - protein, 177 aa, Debaryomyces hansenii CBS767
MSDTETGLPINWAIRVSRTHNKEYYLNQATKESSWEPPFGTDNDKLQKYIAKYKANGNKPVIPEDGKVRASHILVKSNQSRRPKSWKYPDGITRTRDEAILLLKLYQDKILGGEISLQDLASTESDCSSHAQGGDLGFFGKGQMQPSFEEAAFGLNVGEISDIIESDSGIHLIQRTA

SEQ ID NO: 6504 - DNA, 558 bp, Yarrowia lipolytica CLIB122
  CDS (1)..(558)
atgtccattgatccgtctacaggtctcgtttccggctgggaagtccgtcattcgcgaacccggaacctgccctactacttccaccccgccaccagcaactcatcgtgggagccgccggccggcaccgactcggacctgctgaagcagtacatggccaccaactactcgcaaaagaacacagctgtgcccaatactgctcctggcactggcaatggctctggccagaagatccgggtgtcgcatcttctcatcaagcaccgggattcgcgacgaccgtcgtcgtggaaggatgccaacattgagcgaaccaaggaggaggctcgtgcaattctggagggacatcaggccaagatcaaggctggtgagaccaccattggtgaccttgccgtgtcggagtccgactgctcgtctgcacgaaagcgaggcgacttgggtttcttcggcaagggcgagatgcaggccgagtttgagcaggcttcttttgctctggagaacggtcaggtcagtgacatagtcgagacagccagtggtctccatctgattgagcgtactggttag

SEQ ID NO: 6505 - protein, 185 aa, Yarrowia lipolytica CLIB122
MSIDPSTGLVSGWEVRHSRTRNLPYYFHPATSNSSWEPPAGTDSDLLKQYMATNYSQKNTAVPNTAPGTGNGSGQKIRVSHLLIKHRDSRRPSSWKDANIERTKEEARAILEGHQAKIKAGETTIGDLAVSESDCSSARKRGDLGFFGKGEMQAEFEQASFALENGQVSDIVETASGLHLIERTG

SEQ ID NO: 6506 - DNA, 633 bp, Aspergillus nidulans FGSC A4
  CDS (1)..(633)
ctgatatttcgtcaaaaggtaaacaccggtcttccagcagggtgggaagttcgccattcgaactccaaaaaccttccctactacttcaaccccgctaccagagagtcacgatgggaacctccagcggataccgatatggagactcttaagatgtacatggcaacatatcacagcggcgccgctacttaccatgaagccccgagtcaagaaggcaagatccgttgcagtcacctcctagtcaagcacagagacagcaggcgaccgagcagctggagggaggccgagattactcgaacaaaagaggaggcgcgcgagattttgcgcggtcatcaggagcgaatcatgcgaggggagatccggctcggagatcttgcgatgtccgagtcggactgcagtagtgctaggaagaagggcgatctcggcttctttggccgtggtgaaatgcagaaagagttcgaggaggcagcgttcgcattgcaaccgggtcaagtcagtgacattgtcgaatcagggtctggtcttcatctcatcgagcggtatgtgagcttcagtatgccttgggtcgcgctaatcatgttgtttttcacaggctacaatagatattgttgggcattgttattttggtatatttga

SEQ ID NO: 6507 - protein, 210 aa, Aspergillus nidulans FGSC A4
MIFRQKVNTGLPAGWEVRHSNSKNLPYYFNPATRESRWEPPADTDMETLKMYMATYHSGAATYHEAPSQEGKIRCSHLLVKHRDSRRPSSWREAEITRTKEEAREILRGHQERIMRGEIRLGDLAMSESDCSSARKKGDLGFFGRGEMQKEFEEAAFALQPGQVSDIVESGSGLHLIERYVSFSMPWVALIMLFFTGYNRYCWALLFWYI

SEQ ID NO: 6508 - DNA, 534 bp, Candida albicans SC5314
  CDS (1)..(534): transl_table=12
atggcatcgacatcaacaggcttaccacctaattggacgattagagtatccagatcccataacaaagagtatttcttaaaccaatctaccaatgagtcgtcttgggacccaccttatggcactgacaaagaagtattgaatgcatacattgcgaagtttaaaaacaatggttacaagccacttgtgaatgaggatggccaggttagagtttctcatttgttgatcaagaacaatcaatcaagaaaacccaagtcttggaagtccccagatggtataagtagaactagagacgaatctatacagatattgaagaaacatttggaaagaatattgagtggtgaggttaaactaagtgaattggcaaataccgaaagtgattgcagctcacatgacagaggtggtgatttagggttttttagcaaaggacaaatgcaaccaccattcgaagaagccgcattcaatttgcatgttggagaagtcagtaacataattgaaaccaatagtggtgtccatatcctccaaagaacaggataa

SEQ ID NO: 6509 - protein, 177 aa, Candida albicans SC5314
MASTSTGLPPNWTIRVSRSHNKEYFLNQSTNESSWDPPYGTDKEVLNAYIAKFKNNGYKPLVNEDGQVRVSHLLIKNNQSRKPKSWKSPDGISRTRDESIQILKKHLERILSGEVKLSELANTESDCSSHDRGGDLGFFSKGQMQPPFEEAAFNLHVGEVSNIIETNSGVHILQRTG

SEQ ID NO: 6510 - DNA, 525 bp, Ustilago maydis 521
  CDS (1)..(525)
atgtcgtctcagtgggagatccgtttcagcaattcgcgtcgtctgccctacttctacgaccacgtctcgcaacagtcaacatgggagatcccccaaggccacaccgaagagtccatccgctcgcttcccggtgccaagtatctcgacccggccaacgcgcccggtagtgcggctgacaagccggacaaggttcgagccagtcacctgctcatcaagcatgctggcagtcgcagacccagttcctggaaggaggccaacatcacgcgatccaaacaggatgccatcgagcagctcaaaaagttcgagcaagaactccagcaagactcgagtaaagacaaatttgcctcgctcgctagtgtccactcagactgctcttcagcaagggccggaggcgatctcggcttcttccagcgtgggcagatgcaaaagccctttgaagatgctgctttcggtctcaagccgggcgagctgagcagcatcgtcgacactgacagcggcgtgcatctcatctaccgcactgcctga

SEQ ID NO: 6511 - protein, 174 aa, Ustilago maydis 521
MSSQWEIRFSNSRRLPYFYDHVSQQSTWEIPQGHTEESIRSLPGAKYLDPANAPGSAADKPDKVRASHLLIKHAGSRRPSSWKEANITRSKQDAIEQLKKFEQELQQDSSKDKFASLASVHSDCSSARAGGDLGFFQRGQMQKPFEDAAFGLKPGELSSIVDTDSGVHLIYRTA

SEQ ID NO: 6512 - DNA, 537 bp, Cryptococcus neoformans var. neoformans B-3501A
  CDS (1)..(537)
atgtcatcaaccggttgggagattcgtttttccaattctcgtcaaatcccctacttctacaactcggaacgtagcatctccacttgggaacccccttctgaactcagcgcagagcaaattcagcaattgcctggcgcggccaagtatatgaatgtacagttggctcaacctgcaggtggcaaggaaggtcaggtgagggccagtcatatcctggcaaagcatgctggaagcaggaggcccgcttcatggagaaatgataagatcacaatcacttccgacgaggctcaagctattatcgaacagcacatcgcatatcttcaatccctccctccggctgatcttcccaaggaatttgcaaagattgcctcaacagagagcgattgttcaagcgcgaggaagggtggtgatcttggatggtttgggaggggacaaatgcaaaagccctttgaggacgcgacgtttaacactcctgtcgggcagctgagcgggattgtcaagacggactctggtatccatgtcatcctgcgtactggatag

SEQ ID NO: 6513 - protein, 178 aa, Cryptococcus neoformans var. neoformans B-3501A
MSSTGWEIRFSNSRQIPYFYNSERSISTWEPPSELSAEQIQQLPGAAKYMNVQLAQPAGGKEGQVRASHILAKHAGSRRPASWRNDKITITSDEAQAIIEQHIAYLQSLPPADLPKEFAKIASTESDCSSARKGGDLGWFGRGQMQKPFEDATFNTPVGQLSGIVKTDSGIHVILRTG

SEQ ID NO: 6514 - DNA, 1143 bp, Clostridium difficile 630
  CDS (1)..(1143): transl_table=11
atgtctgaagaaaaaaatccaaaagaaaatacattagatgaatctaaaaattcagataatgtaaattctaaaaaagatgatgtgtcagatgaaaaaaatactgataacaaagttaaaaaaagggaaataaagctaaacaacaaaacacttaaagctattgtagcaattgttgcagtaggagctatatgtttaggtggaggctatatttttggcaaagaagctggaagaaaattgcctgctacttcaaaacactataatagcagtgaggtagtagctactattggggataaaaaaataacaggtgaaatgttaagaaagagaatggagccattattttatttaaatgcaaaaactactatgactgatgacgaaatacgttcatatgaatcaaatatgattgaaactatgattacatctgatatattatcctctgaagcagcaaaagagaaaataagtataactaatgaccaactagatgctcagtataataatttaatgagtagtatagaatcagcaatgggaatgactaaagaagagtttttaaaacagtttgatttgactgaaaaatatataaaagatgatatgaaaaaagagctagtagcatcaaaatatttaaatgaaaaatcaaaagttactgataaagaagcagagaactattacaataaaaacaagagcaattatttacaagttagagcttcacatattttaataaaaactgttgatgataaaggtaagcaagttagtagtagcaaaaaagctgaacttaagaaagaagctgaagaaatacttaaaaaagcccaagctggggaagattttgctactctagctaaaaaatactctgaagatagtagtgcagaatcaggtggagatttaggtttctttggtaaaggtcagatggtggaatcttttgaaaaagcagcctttgcattgaagaagggagaggtatctaacaaacttgtagaaagtgattatggatatcatataattaagaaaactgatgaaaaatatcagccatttgaagaggtaaaatcagatttagtaagcagtttaacatcagaaaaacaaaacctacttatacaaaatctaaaagaaaaatataatgttaaaattacagataaatatcaaatgaaagctaaagaatag

SEQ ID NO: 6515 - protein, 380 aa, Clostridium difficile 630
MSEEKNPKENTLDESKNSDNVNSKKDDVSDEKNTDNKVKKREIKLNNKTLKAIVAIVAVGAICLGGGYIFGKEAGRKLPATSKHYNSSEVVATIGDKKITGEMLRKRMEPLFYLNAKTTMTDDEIRSYESNMIETMITSDILSSEAAKEKISITNDQLDAQYNNLMSSIESAMGMTKEEFLKQFDLTEKYIKDDMKKELVASKYLNEKSKVTDKEAENYYNKNKSNYLQVRASHILIKTVDDKGKQVSSSKKAELKKEAEEILKKAQAGEDFATLAKKYSEDSSAESGGDLGFFGKGQMVESFEKAAFALKKGEVSNKLVESDYGYHIIKKTDEKYQPFEEVKSDLVSSLTSEKQNLLIQNLKEKYNVKITDKYQMKAKE

SEQ ID NO: 6516 - DNA, 996 bp, Clostridium difficile 630
  CDS (1)..(996): transl_table=11
ttgaaaaaagtaataacattggtaatagctatgattttggtagtatctgtgactgcttgcagttctagtaaaggagaaactgtggcaacagttgaaggtacaaagatatcatcagatgaatttaaaaaaactatagctctttataaagattctatggaacaaacttatggaaaagatatatgggataaggaagttgaaaagggtgtaaaatacaaggacaagtttaaagatttaattcttgaccaacttataactacagaagtaatatattctcaagctaaaaaagataacttacttcctaaaaaagaggatgttgaaaaaagttttaaagaattaaaagacgctatgggtaaagatgaaaaatataaagaacaacttaagaaattaggtatagatgatgagtttttaagagaccaacaagagaaagatttagcaatgcaaaactatcaaagtaactttgctaaaaagactaaaatatcagatgaagaaatgaaaaaatactatgatacacataaagatgaatttaaaaaagatgaggtagaagcttctcatattttattgaaaacagtagatgataataacaagccactttcagataaggaaaaagctgaagctaagaaaaaggctgaagaggctcttaaagaagttaaatcaggtgaggattttgcaaaagtagcaaaaaaatattcacaagatacttcagcaagtgatggtggtaaattaggattcttttcaaggggtcaaatggttgctgaatttgaagatgctgctttttctatgaaaaagggtgaagtatctgatttagttgaaactcaatatggataccacataattaaagtgacagacagaataaatgagcaaacatcatttgaagatgctaaagaaactataaaagaccaactgttgaaaaataaatatcaagaacaaatagaaaaattaactaaagaagctaaggtagaaaaagatgaaaaagtaataaataaaatcacaatctaa

SEQ ID NO: 6517 - protein, 331 aa, Clostridium difficile 630
MKKVITLVIAMILVVSVTACSSSKGETVATVEGTKISSDEFKKTIALYKDSMEQTYGKDIWDKEVEKGVKYKDKFKDLILDQLITTEVIYSQAKKDNLLPKKEDVEKSFKELKDAMGKDEKYKEQLKKLGIDDEFLRDQQEKDLAMQNYQSNFAKKTKISDEEMKKYYDTHKDEFKKDEVEASHILLKTVDDNNKPLSDKEKAEAKKKAEEALKEVKSGEDFAKVAKKYSQDTSASDGGKLGFFSRGQMVAEFEDAAFSMKKGEVSDLVETQYGYHIIKVTDRINEQTSFEDAKETIKDQLLKNKYQEQIEKLTKEAKVEKDEKVINKITI

SEQ ID NO: 6518 - DNA, 895 bp, Emericella nidulans
  CDS (55)..(585)
ctaagttttataccatttcacacctcaagtatccttcaaagcttaagaagcaaaatggtaaacaccggtcttccagcagggtgggaagttcgccattcgaactccaaaaaccttccctactacttcaaccccgctaccagagagtcacgatgggaacctccagcggataccgatatggagactcttaagatgtacatggcaacatatcacagcggcgccgctacttaccatgaagccccgagtcaagaaggcaagatccgttgcagtcacctcctagtcaagcacagagacagcaggcgaccgagcagctggagggaggccgagattactcgaacaaaagaggaggcgcgcgagattttgcgcggtcatcaggagcgaatcatgcgaggggagatccggctcggagatcttgcgatgtccgagtcggactgcagtagtgctaggaagaagggcgatctcggcttctttggccgtggtgaaatgcagaaagagttcgaggaggcagcgttcgcattgcaaccgggtcaagtcagtgacattgtcgaatcagggtctggtcttcatctcatcgagcggctacaatagatattgttgggcattgttattttggtatatttgagttgcatgggggaaaaacaatcaatccttcaatcaatcctttcgatcatatatactggctctctggttttaggcatgtgttgcgttgcacatacaaatcatcttgctctgtagaccctctatcatgctggagagacccctattacatgtttagatagtcctgactcctgaagctttggctaacattaacgcaactacttttcactgcctagaagttgtttcggcaactaatccatggcagttatttcgcctggtaaaaaaaaaaaaaaaaaaaaaa

SEQ ID NO: 6519 - protein, 176 aa, Emericella nidulans
MVNTGLPAGWEVRHSNSKNLPYYFNPATRESRWEPPADTDMETLKMYMATYHSGAATYHEAPSQEGKIRCSHLLVKHRDSRRPSSWREAEITRTKEEAREILRGHQERIMRGEIRLGDLAMSESDCSSARKKGDLGFFGRGEMQKEFEEAAFALQPGQVSDIVESGSGLHLIERLQ

SEQ ID NO: 6520 - DNA, 687 bp, Ostreococcus tauri
  CDS (1)..(687)
atgtctcgcagtatggcctcgatcgtcaccgcgtctcgagggatcgtcccgtcgtcggcgtcgtcgtcggcgacattcgtcgttcgcaccgccgtggcctcgagcgcgcgcacgagggatgcgggctcgtccgtcccgtgctcgacctcgcacgtcgcgatgacgcacgtcgccgtgacgcgtcacacgtcgtcacaccgcgacgacgacgacgcgcgcgcgatgggggatcaagcgcgcgcgcgcgcctcgcacgtcctcatcaaacaccgcgaatcgcggaatccaacgagcagactcgacgcgagcggtgacatcatccggggacgaacgaagagcgcggcgatcgaggagttgttggcgcacagagaacacatcgcgagcggacggtgcgcgttcgaggacgtggcgacgcgcgtgagcgattgttcgagcggcaaggtgcgtgatggagccgatggagacgcgggggggacgacgagcggggcgcgacgcgaaacgcggcgacggatgactaacgacgacgcgcggcgattcgacaaccagcggggaggtgatttaggcgagttcgggcgcgggcagatgcagaaaccgttcgaggacgcgacgttcgctctggcggtcggggagatgagcggggtggtggacacggattcgggcgtgcacgtaatcttacgcaccggctga

SEQ ID NO: 6521 - protein, 228 aa, Ostreococcus tauri
MSRSMASIVTASRGIVPSSASSSATFVVRTAVASSARTRDAGSSVPCSTSHVAMTHVAVTRHTSSHRDDDDARAMGDQARARASHVLIKHRESRNPTSRLDASGDIIRGRTKSAAIEELLAHREHIASGRCAFEDVATRVSDCSSGKVRDGADGDAGGTTSGARRETRRRMTNDDARRFDNQRGGDLGEFGRGQMQKPFEDATFALAVGEMSGVVDTDSGVHVILRTG

SEQ ID NO: 6522 - DNA, 372 bp, Oryza sativa
  CDS (1)..(372)
atggcgtcgtcggcgacggagacggagacggtgagggcgtcgcacatcctgatcaagcacgagggctcccgccgcaaggcctcctggaaggatcccgacggccgcgtcatctccgccaccacgcgcgccgacgccgccgcgcgcctcgccgacctccgcgaccagatcctctccggccgcgccaacttcgccgacctcgccgcccgccactccgactgctcctccgcgcgccgtggcggcgacctgggcacttttgggaggaggcagatgcagaaacccttcgaagatgcgacatttgctctcaaggttggtgagatgagtgacactgtggacactgacagtggtgttcacatcatcctgcgcactgcttaa

SEQ ID NO: 6523 - protein, 123 aa, Oryza sativa
MASSATETETVRASHILIKHEGSRRKASWKDPDGRVISATTRADAAARLADLRDQILSGRANFADLAARHSDCSSARRGGDLGTFGRRQMQKPFEDATFALKVGEMSDTVDTDSGVHIILRTA

SEQ ID NO: 6524 - DNA, 564 bp, Phaeosphaeria nodorum
  CDS (1)..(564)
atgtcttcagaggagacaggtctgccccagggctgggaggttcgccgctccaacaccaagaacttgccatactacttccatcccgaaaccaaagactcgcgatgggagcctccggcgggtaccgatcccgagaagctcaaggagttcatggcagcgaaccacagttcaaagggcgttgcgccggcaaactttacgcagacgggagataagattcgcgctgctcatctgctcgtgaagcatcgcgatagcaggcgcccagctagctggcgggaacccaaaatcacccggtccaagtcagaagcagaggaactgatcaagaaataccagtctcaaatcctggcatttgaggcacccgccgaacataatgaccccaaccccaagtcgctatcagagctcgcgacaacagagtcggactgtagcagcgcacgtaaagggggcgatcttggattctttggccacggagacatgcaaaaggaatttgagaacgcagcttttgatctgaaacctggaggtgtcagcgagatagtcgatacagcatcgggactgcatttgattcagaggtag

SEQ ID NO: 6525 - protein, 187 aa, Phaeosphaeria nodorum
MSSEETGLPQGWEVRRSNTKNLPYYFHPETKDSRWEPPAGTDPEKLKEFMAANHSSKGVAPANFTQTGDKIRAAHLLVKHRDSRRPASWREPKITRSKSEAEELIKKYQSQILAFEAPAEHNDPNPKSLSELATTESDCSSARKGGDLGFFGHGDMQKEFENAAFDLKPGGVSEIVDTASGLHLIQR

SEQ ID NO: 6526 - DNA, 369 bp, Medicago truncatula
  CDS (1)..(369)
atgtcttcatctcgcggcggcgctgaggttagggcttcacacatactgattaaacacgaaggttctagaagaaaagcttcgtggaaagatccagaaggttacgtcatcaagaacactactcgtgaaagtgccgttgctattcttacttcaatgaaagaggatatccttactggtaaggccaaatttgaggatcttgcttcgaggtattctgattgtagctctgctaaacgcggtggcgatcttggttcttttggtcgtggccagatgcagaagcctttcgaagatgcaacttatgctctccaagttggtgaaattagtgacattgtggatagtgacagtggatcccacataatcaagagaacaaattga

SEQ ID NO: 6527 - protein, 122 aa, Medicago truncatula
MSSSRGGAEVRASHILIKHEGSRRKASWKDPEGYVIKNTTRESAVAILTSMKEDILTGKAKFEDLASRYSDCSSAKRGGDLGSFGRGQMQKPFEDATYALQVGEISDIVDSDSGSHIIKRTN

SEQ ID NO: 6528 - DNA, 770 bp, Paracoccidioides brasiliensis
  CDS (86)..(658)
ggcacgagggatgtaatgccaacagtagccccttcattgtaacatcgactgtctccccgcccgctccaaagaacattttgacatcatgatcaaccaatccgaaaccggcctcccctccggctgggaagttcgacactccaactccaaaaacctcccatactacttcaaccccatcaccaaggaatcgagatgggaacccccctccaacactgacaccgaaaaactcaaagaatacatggctcagcaccacagcgggcttgcagagcgtaataatgccgccaccggagtcaccagcgcgggtgtgggctcgagctcagccgatggcaagattcgcgccagccatctcctaatcaagcatcaaggtagtcgccggccgagcagctggcgggaggcggagattacgcggtccaaggaggaggcgctggagattctgagaaggcatgaagagagtattcgatcgggggagaagacgttgggggatattgcgatgtcggaatcggattgtagtagtgcgaggaagaggggtgatttgggatttttcggtcgaggtgagatgcaggctgaattcgaagaggctgcgtttgctcttgagccgggacaggttagtgggattgtggagacggcttcaggggttcatctcattgaacgattgcagtgaatgtaaaagtttgcttttttggacagcaataccacaaagaaatgaatgttatgttttcttctctgtaactaggacaatcagaacaatgcaaagtataagtccaaaaaaaaaa

SEQ ID NO: 6529 - protein, 190 aa, Paracoccidioides brasiliensis
MINQSETGLPSGWEVRHSNSKNLPYYFNPITKESRWEPPSNTDTEKLKEYMAQHHSGLAERNNAATGVTSAGVGSSSADGKIRASHLLIKHQGSRRPSSWREAEITRSKEEALEILRRHEESIRSGEKTLGDIAMSESDCSSARKRGDLGFFGRGEMQAEFEEAAFALEPGQVSGIVETASGVHLIERLQ

SEQ ID NO: 6530 - DNA, 537 bp, Cryptococcus neoformans var
  CDS (1)..(537)
atgtcatcaaccggttgggagattcgtttttccaattctcgtcaaatcccctacttctacaactcggaacgtagcatctccacttgggaacccccttctgaactcagcgcagagcaaattcagcaattgcctggcgcggccaagtatatgaatgtacagttggctcaacctgcaggtggcaaggaaggtcaggtgagggccagtcatatcctggcaaagcatgctggaagcaggaggcccgcttcatggagaaatgtccgtatcacaatcacttccgacgaggctcaagctattatcgaacagcacatcgcatatcttcaatccctccctccggctgatcttcccaaggaatttgcaaagattgcctcaacagagagcgattgttcaagcgcgaggaagggtggtgatcttggatggtttgggaggggacaaatgcaaaagccctttgaggacgcgacgtttaacactcctgtcgggcagctgagcgggattgtcaagacggactctggtatccatgtcatcctgcgtactggatag

SEQ ID NO: 6531 - protein, 178 aa, Cryptococcus neoformans var
MSSTGWEIRFSNSRQIPYFYNSERSISTWEPPSELSAEQIQQLPGAAKYMNVQLAQPAGGKEGQVRASHILAKHAGSRRPASWRNVRITITSDEAQAIIEQHIAYLQSLPPADLPKEFAKIASTESDCSSARKGGDLGWFGRGQMQKPFEDATFNTPVGQLSGIVKTDSGIHVILRTG

SEQ ID NO: 6532 - DNA, 513 bp, Saccharomyces cerevisiae
  CDS (1)..(513)
atgccatctgacgtagcatcgaggaccgggctgccaaccccgtggaccgtcaggtatagtaagtccaagaaaagagagtattttttcaatccagagacgaagcactcgcaatgggaggagcctgagggcaccaacaaggaccagctacacaagcacttaagagaccatccagtgcgtgtaagatgcctgcacattctcatcaagcacaaggattcaagaagacccgcatcgcatagatccgagaacattacgatatccaagcaagacgctacggacgaactgaaaaccttaatcacgaggttggatgacgactctaagacgaactccttcgaggccctggctaaagagagatcagattgctcttcatacaagcgaggcggcgacctcggctggttcgggagaggcgagatgcagcctagctttgaagacgctgccttccagctcaaggtcggcgaggtaagcgatatcgttgaatcaggaagcggtgttcatgtgatcaagcgggtaggttag

SEQ ID NO: 6533 - protein, 170 aa, Saccharomyces cerevisiae
MPSDVASRTGLPTPWTVRYSKSKKREYFFNPETKHSQWEEPEGTNKDQLHKHLRDHPVRVRCLHILIKHKDSRRPASHRSENITISKQDATDELKTLITRLDDDSKTNSFEALAKERSDCSSYKRGGDLGWFGRGEMQPSFEDAAFQLKVGEVSDIVESGSGVHVIKRVG

SEQ ID NO: 6534 - DNA, 391 bp, Arabidopsis thaliana
  CDS (1)..(360)
atggcgtcgagagaccaagttaaggcatcgcacattttgattaagcatcaaggttctcggaggaaagcgtcgtggaaggatccagaagggaagattattctgactaccactagagaagccgccgttgagcagcttaaatcgatccgtgaagatattgtctccggcaaggcgaatttcgaagaagtggcgactcgtgtttctgactgtagctctgctaaacgcggcggtgatcttggttcctttggtagaggtcaaatgcagaaaccatttgaggaagcaacttacgcgctcaaggttggagatataagcgacattgtcgatacagacagtggagtccacatcattaagagaacagcttgaccttatctgatctgatagaaaatgtattgaa

SEQ ID NO: 6535 - protein, 119 aa, Arabidopsis thaliana
MASRDQVKASHILIKHQGSRRKASWKDPEGKIILTTTREAAVEQLKSIREDIVSGKANFEEVATRVSDCSSAKRGGDLGSFGRGQMQKPFEEATYALKVGDISDIVDTDSGVHIIKRTA

SEQ ID NO: 6536 - DNA, 707 bp, Digitalis lanata
  CDS (114)..(470)
ggcacgagtccgatcggaagaggaagaaggcctcgatctcgtccggagatcgggctagcgagcaccatcaccaccaccacaagaagcaagcgagcagcaccaagaagacgaaaatgtcatcggagaaggttagggcgtcccacatactcataaagcaccagggatcccgccgcaagtcctcctggaaggaccctgatggtagcctcatctccgccactacccgagacgacgctgtttctcagctccaatccctccgacaagaactcctttccgaccccgcctccttctccgacctcgcctcccgtcactcccactgcagctctgcaaagcgtggtggcgatcttggtccttttggaaggggccagatgcagaaacctttcgaagaagccacatttgcactaaaggttggtgagataagtgatatcgtggatactgacagtggagttcacatcatcaagagaacaggatagcaagtgatgcaaaatttgcaacttcagggtgctttggttgccagattgtgtgcctatatgtgagctttgcttttttgtttgagcaacaacagactcatgtcattgtaatgcctatagccgttccttgaggctacagtttttaatgattgtaatttattaccctattgcatttacacacaaaccaaattatctctctggctgctgtgcagtaattggtatattattgatccaaaaaaa

SEQ ID NO: 6537 - protein, 118 aa, Digitalis lanata
MSSEKVRASHILIKHQGSRRKSSWKDPDGSLISATTRDDAVSQLQSLRQELLSDPASFSDLASRHSHCSSAKRGGDLGPFGRGQMQKPFEEATFALKVGEISDIVDTDSGVHIIKRTG

SEQ ID NO: 6538 - DNA, 366 bp, Malus domestica
  CDS (1)..(366)
atgtcctcgtcagcggggaatcaggtgagggcgtcccatatactcatcaagcatcaggggtcgagaagaaaggcatcgtggaaggatcctgaagggcagatcatcaggaacaccacccgagactctgccgtctctcaactcaaggctctccgcgatgacatcctttctggaaaggccaagtttgatgatcttgccgctcgctactctgattgcagctctgccaaacgtggtggcgatctcggtccctttggtcggaaccagatgcagaagccttttgaagaagcaacatttgctctcaaggttggtgagatgagtgacattgtggatacggatagtggtgtccatatcatcaagagaactggatga

SEQ ID NO: 6539 - protein, 121 aa, Malus domestica
MSSSAGNQVRASHILIKHQGSRRKASWKDPEGQIIRNTTRDSAVSQLKALRDDILSGKAKFDDLAARYSDCSSAKRGGDLGPFGRNQMQKPFEEATFALKVGEMSDIVDTDSGVHIIKRTG

SEQ ID NO: 6540 - DNA, 528 bp, Schizosaccharomyces pombe
  CDS (1)..(528)
atgtctaatactgggttacccaaaccatggattgtcaagatttcacgctccagaaatcgtccctacttctttaatactgagacgcatgagtctttatgggagcctccggctgccactgatatggctgccctgaaaaagttcattgcaaacgagttgcaggagtcagttacacccaccgaggcaagcaattcacccaagattcgtgctagccatttactcgtaaagcatcgagaaagccgtcgtcccagctcatggaaggaggagcacattactaggagcaaggaggaggcgaggaagctggctgaacactatgaacaattgctaaagagtggctctgtaagcatgcatgatttagccatgaaagagtcggattgtagctccgctcgtcgcggaggtgaattaggcgaatttggaagagacgaaatgcaaaaaccgtttgaagacgctgcgtttgccttgaaacccggtgaaattagtggagtggttgaaacgagcagtgggtttcacatcattcaaagacacgcttaa

SEQ ID NO: 6541 - protein, 175 aa, Schizosaccharomyces pombe
MSNTGLPKPWIVKISRSRNRPYFFNTETHESLWEPPAATDMAALKKFIANELQESVTPTEASNSPKIRASHLLVKHRESRRPSSWKEEHITRSKEEARKLAEHYEQLLKSGSVSMHDLAMKESDCSSARRGGELGEFGRDEMQKPFEDAAFALKPGEISGVVETSSGFHIIQRHA

SEQ ID NO: 6542 - DNA, 597 bp, Zea mays
  CDS (1)..(597)
atggcggcgtcggatgttgagtaccgcggcgtcgtcggcgaccccgcctgggccgacaagatagggtcggaaagccccgccgccgacggcgtcggcgacgccgcgcgcaagcggcccagcggcgatgatggccccaccccggggccagccgacaagcgccgccgcccggagcacccttcttcctcctccgcgggctcccgcgaccgccaccaccaccaccacggccgccgcccgccgtcctcggccgacgagaaggtgcgcgcctctcacatcctgatcaagcacgagggctcccgccgcaaggcctcgtggcgggatcccgaaggcgtcgccatctccgccacgacacgcgacgacgcggccgacctcgcgcgcgcgctccgcgaccagatcgtctctggtgaccgcgagttcgaggacgtcgctgccgagaactccgactgcagctcggccaagcgcggcggtgacctcggttcatttgggaggggtaagatgcagaagccttttgagaaggccgcgtttgctctgaaggtcggggagatcagcgacgtggttgatacagagagcggggtgcacatcatcaagaggactggctga

SEQ ID NO: 6543 - protein, 198 aa, Zea mays
MAASDVEYRGVVGDPAWADKIGSESPAADGVGDAARKRPSGDDGPTPGPADKRRRPEHPSSSSAGSRDRHHHHHGRRPPSSADEKVRASHILIKHEGSRRKASWRDPEGVAISATTRDDAADLARALRDQIVSGDREFEDVAAENSDCSSAKRGGDLGSFGRGKMQKPFEKAAFALKVGEISDVVDTESGVHIIKRTG

SEQ ID NO: 6544 - DNA, 25 bp, Artificial sequence
  primer
atgatcattgtggtacttattccca

SEQ ID NO: 6545 - DNA, 23 bp, Artificial sequence
  primer
ctaacctacccgcttgatcacat

SEQ ID NO: 6546 - protein, 156 aa, Artificial sequence
  consensus sequence
  Variant (2)..(3): Xaa in position 2 to 3 is any amino acid
  Variant (5)..(5): Xaa in position 5 is any amino acid
  Variant (7)..(7): Xaa in position 7 is any amino acid
  Variant (10)..(11): Xaa in position 10 to 11 is any amino acid
  Variant (15)..(16): Xaa in position 15 to 16 is any amino acid
  Variant (18)..(29): Xaa in position 18 to 29 is any amino acid
  Variant (30)..(33): Xaa in position 30 to 33 is any or no amino acid
  Variant (35)..(54): Xaa in position 35 to 54 is any amino acid
  Variant (55)..(65): Xaa in position 55 to 65 is any or no amino acid
  Variant (67)..(69): Xaa in position 67 to 69 is any amino acid
  Variant (75)..(78): Xaa in position 75 to 78 is any amino acid
  Variant (79)..(113): Xaa in position 79 to 113 is any or no amino acid
  Variant (118)..(118): Xaa in position 118 is any amino acid
  Variant (121)..(121): Xaa in position 121 is any amino acid
  Variant (123)..(123): Xaa in position 123 is any amino acid
  Variant (126)..(127): Xaa in position 126 to 127 is any amino acid
  Variant (130)..(130): Xaa in position 130 is any amino acid
  Variant (132)..(132): Xaa in position 132 is any amino acid
  Variant (134)..(134): Xaa in position 134 is any amino acid
  Variant (136)..(137): Xaa in position 136 to 137 is any amino acid
  Variant (139)..(140): Xaa in position 139 to 140 is any amino acid
  Variant (142)..(143): Xaa in position 142 to 143 is any amino acid
  Variant (144)..(144): Xaa in position 144 is any or no amino acid
  Variant (146)..(148): Xaa in position 146 to 148 is any amino acid
  Variant (151)..(151): Xaa in position 151 is any amino acid
  Variant (153)..(153): Xaa in position 153 is any amino acid
  Variant (155)..(155): Xaa in position 155 is any amino acid
RXXHXLXKHXXSRRXXSXXXXXXXXXXXXXXXXAXXXXXXXXXXXXXXXXXXXXXXXXXXXXXXXAXXXSDCSSXXXXXXXXXXXXXXXXXXXXXXXXXXXXXXXXXXXXXXXGDLGXFGXGXMQXXFEXAXFXLXXGXXSXXXVXXXSGXHXIXR

SEQ ID NO: 6547 - protein, 43 aa, Artificial sequence
  protein pattern
  Variant (2)..(4): Xaa in position 2 to 4 is any amino acid
  Variant (10)..(12): Xaa in position 10 to 12 is any amino acid
  Variant (13)..(13): Xaa in position 13 is any or no amino acid
  Variant (15)..(15): Xaa in position 15 is any amino acid
  Variant (16)..(16): Xaa in position 16 is any or no amino acid
  Variant (19)..(19): Xaa in position 19 is any amino acid
  Variant (21)..(21): Xaa in position 21 is Gly, Gln or Ser
  Variant (22)..(22): Xaa in position 22 is His, Lys or Arg
  Variant (23)..(24): Xaa in position 23 to 24 is any amino acid
  Variant (27)..(27): Xaa in position 27 is any amino acid
  Variant (28)..(28): Xaa in position 28 is Glu, Pro or Ser
  Variant (31)..(31): Xaa in position 31 is any amino acid
  Variant (33)..(33): Xaa in position 33 is Ala, Ser or Thr
  Variant (34)..(34): Xaa in position 34 is Phe or Tyr
  Variant (35)..(35): Xaa in position 35 is Ala, Asp, Gly, Asn or Gln
  Variant (36)..(38): Xaa in position 36 to 38 is any amino acid
  Variant (39)..(39): Xaa in position 39 is Asp or Gly
  Variant (40)..(40): Xaa in position 40 is Asp, Glu, Gly or Gln
  Variant (41)..(41): Xaa in position 41 is Ile, Leu, Met or Val
  Variant (43)..(43): Xaa in position 43 is Asp, Glu, Gly, Asn or Ser
AXXXSDCSSXXXXGXXLGXFXXXXMQXXFEXAXXXXXXXXXSX

SEQ ID NO: 6548 - protein, 19 aa, Artificial sequence
  protein pattern
  Variant (2)..(3): Xaa in position 2 to 3 is any amino acid
  Variant (5)..(5): Xaa in position 5 is Ile, Leu or Val
  Variant (7)..(7): Xaa in position 7 is Ala, Ile or Val
  Variant (10)..(11): Xaa in position 10 to 11 is any amino acid
  Variant (14)..(16): Xaa in position 14 to 16 is any amino acid
  Variant (17)..(18): Xaa in position 17 to 18 is any or no amino acid
RXXHXLXKHXXSRXXXXXS

SEQ ID NO: 6549 - protein, 12 aa, Artificial sequence
  protein pattern
  Variant (2)..(2): Xaa in position 2 is Asp, Glu or Lys
  Variant (3)..(3): Xaa in position 3 is Ser or Thr
  Variant (4)..(4): Xaa in position 4 is Ala, Asp, Glu, Gly or Ser
  Variant (5)..(5): Xaa in position 5 is any amino acid
  Variant (7)..(7): Xaa in position 7 is any amino acid
  Variant (9)..(9): Xaa in position 9 is Ile, Leu or Val
  Variant (11)..(11): Xaa in position 11 is any amino acid
  Variant (12)..(12): Xaa in position 12 is Lys or Arg
VXXXXGXHXIXX

SEQ ID NO: 6550 - DNA, 444 bp, Saccharomyces cerevisiae
  CDS (1)..(444)
atggcagtacagtttatactgtgctttaataagcagggtgtggtgcggttggtgagatggttcgatgtacacagttcggatcctcagcgtagccaggatgccattgcgcagatttatagactcatatcttccagagatcataagcatcagagtaacttcgtagagttttccgattcgacgaaactcatatacaggaggtatgcgggtctgtattttgtcatgggtgtggacttacttgacgatgaacccatatatttgtgccacatccatctgtttgtggaggtgctagatgcatttttcggcaatgtctgtgaactggatatcgtattcaacttttacaaagtctatatgataatggacgagatgtttattggaggggaaatacaagaaatttcaaaggatatgctgttagaaagactaagtattttagatagactagactag

SEQ ID NO: 6551 - protein, 147 aa, Saccharomyces cerevisiae
MAVQFILCFNKQGVVRLVRWFDVHSSDPQRSQDAIAQIYRLISSRDHKHQSNFVEFSDSTKLIYRRYAGLYFVMGVDLLDDEPIYLCHIHLFVEVLDAFFGNVCELDIVFNFYKVYMIMDEMFIGGEIQEISKDMLLERLSILDRLD

SEQ ID NO: 6552 - DNA, 501 bp, Oryza sativa (japonica cultivar-group)
  CDS (1)..(501)
atgatccaggccgtgatggtgatgagcacgcagggcaagccgcgcctcctcaagttctacagctaccagccccccgagaagcatcaggacctcgtccgcggcgtcttccagttgttgtctgcaaggccggacagtgtcagcaatttcgtcaaggttgatgcaatctttggaccgggagcgaaattggtctacaaacatttggccacattgtactttgtttttgtctttgatagctctgaaaatgaacttgcggtgcttgatcttgtacaagtttttgttgaaacattggacagatgcttcaagaatgtgtgtgagcttgacatcgtatttaacttcaacaagctgcatacaattttagatgaaatgatacttgggggacaagtgattgaaacaagttcagagcaaataatgagatctgtcgaagagattgcaaggctggagaaacagtcaaacacaaccagcctcataccgaagtcgatttcagagcgtttcagccgttga

SEQ ID NO: 6553 - protein, 166 aa, Oryza sativa (japonica cultivar-group)
MIQAVMVMSTQGKPRLLKFYSYQPPEKHQDLVRGVFQLLSARPDSVSNFVKVDAIFGPGAKLVYKHLATLYFVFVFDSSENELAVLDLVQVFVETLDRCFKNVCELDIVFNFNKLHTILDEMILGGQVIETSSEQIMRSVEEIARLEKQSNTTSLIPKSISERFSR

SEQ ID NO: 6554 - DNA, 549 bp, Oryza sativa (japonica cultivar-group)
  CDS (1)..(549)
atggatctagtgttgggactgagatggatgaactttctgccatttgctgttgttggtcttctgcagatcaatttcgtgctcctgatcagccgccagggcaaggtgaggcttaccaagtggtactcgccttacacccagaaggagaggactaaggttatccgtgagctcagtgggctcattctaacacgcgggccaaaactctgcaactttgttgagtggaagggttacaaggttgtgtacagaaggtatgcgagcctgtatttctgcatgtgcattgatgctgaggacaatgagctcgaggtccttgaaattatccatcacttcgttgaagtactggaccgatattttggcagcgtatgcgagctggatttgatattcaatttccacaaggcctactacatacttgatgaaattctcatcgctggtgagcttcaagaatctagcaagaaaaatgttgcaagactaattgctgcacaggattcattggtagaggcagctaaagaggaagctagctctataagcaacatcattgcccaggctacaaaataa

SEQ ID NO: 6555 - protein, 182 aa, Oryza sativa (japonica cultivar-group)
MDLVLGLRWMNFLPFAVVGLLQINFVLLISRQGKVRLTKWYSPYTQKERTKVIRELSGLILTRGPKLCNFVEWKGYKVVYRRYASLYFCMCIDAEDNELEVLEIIHHFVEVLDRYFGSVCELDLIFNFHKAYYILDEILIAGELQESSKKNVARLIAAQDSLVEAAKEEASSISNIIAQATK

SEQ ID NO: 6556 - DNA, 486 bp, Oryza sativa (japonica cultivar-group)
  CDS (1)..(486)
atgatacattttgtgctcctcatcagcagacaagggaaggtgaggctgaccaaatggtacaatccatatcctcagaaggaaagatccaaggttatcaaagaagtaagtacgctcgtcctgacaagaggtccaaagatgtgcaattttgtcgattggcacggatacagagttgtatacaaaaggtatgcaagcctttacttctgcatgtgcattgatgctgctgataatgaactggagactcttcaaatcatccatcattttgttgagatattggaccgatattttggcaatgtctgcgagcttgacctgatattcaacttccacaaggcatactttatattggatgaggttctgattgccggtgagcttcaagaatcgaacaagaaagcagtactacgcctgatcactacacaggacaacttggtggaagcagcaaaggaagaggcaagctcattgaggaacataattgcacaggccaccaagtag

SEQ ID NO: 6557 - protein, 161 aa, Oryza sativa (japonica cultivar-group)
MIHFVLLISRQGKVRLTKWYNPYPQKERSKVIKEVSTLVLTRGPKMCNFVDWHGYRVVYKRYASLYFCMCIDAADNELETLQIIHHFVEILDRYFGNVCELDLIFNFHKAYFILDEVLIAGELQESNKKAVLRLITTQDNLVEAAKEEASSLRNIIAQATK

SEQ ID NO: 6558 - DNA, 432 bp, Oryza sativa (japonica cultivar-group)
  CDS (1)..(432)
atggggatccggttcgtggtgatggtgaacaagcaggggcagacgcgggtggcgcaatactacgagcacctctccgtcgacgagcgccgcgccctcgagggcgagatcgtccgcaagtgcctcgcccgcaccgaccaccagtgttctttcgtggagcaccgcaactacaaggtggtgtaccggcgctacgcctccctcttcttcctagtcggcgtcgacaacgatgagaatgagttagctatccttgaattcattcatcttttggttgaaactatggaccgtcactttggcaatgtgtgtgagctcgacattatgttccatctggagaaggtgcacttcatgctggaagagatggtgatgaatggttgcattgtcgaaactagtaaacagaacatcttggcaccaatccacctgatggagaaaacttcttag

SEQ ID NO: 6559 - protein, 143 aa, Oryza sativa (japonica cultivar-group)
MGIRFVVMVNKQGQTRVAQYYEHLSVDERRALEGEIVRKCLARTDHQCSFVEHRNYKVVYRRYASLFFLVGVDNDENELAILEFIHLLVETMDRHFGNVCELDIMFHLEKVHFMLEEMVMNGCIVETSKQNILAPIHLMEKTS

SEQ ID NO: 6560 - DNA, 429 bp, Oryza sativa (japonica cultivar-group)
  CDS (1)..(429)
atgatccggttcatcctgctgcagaatcggcaggggaagacgcggctggccaagtactacgtcccgctcgaggactcggagaagcacaaggtcgagtacgaggtgcatcggctggtggtcaaccgggatcccaagttcaccaacttcgttgagttccggacgcataaagttatatacaggcgatatgcaggactgtttttctcaatgtgtgtggatatcactgacaatgagttggcatacttggaatgcatccacttgtttgtcgagatattagatcatttcttcagcaatgtgtgtgaactcgacttagtatttaatttccacaaggtttatttgatattggatgagtttattctcgctggagaacttcaagagacaagcaaaagggcaataatagagcgaatgggtgagcttgagaagctggaataa

SEQ ID NO: 6561 - protein, 142 aa, Oryza sativa (japonica cultivar-group)
MIRFILLQNRQGKTRLAKYYVPLEDSEKHKVEYEVHRLVVNRDPKFTNFVEFRTHKVIYRRYAGLFFSMCVDITDNELAYLECIHLFVEILDHFFSNVCELDLVFNFHKVYLILDEFILAGELQETSKRAIIERMGELEKLE

SEQ ID NO: 6562 - DNA, 429 bp, Arabidopsis thaliana
  CDS (1)..(429)
atgatccgattcatattattgcagaacagacaaggtaagactcgtctagccaaatactatgtccctctcgaagaatccgagaaacacaaagtcgaatacgaggttcatagattagtggtgaatcgcgacgccaaattcaccaacttcgttgagtttagaacacacaaggtgatatacaggcgttatgctggattgtttttctctgtgtgcgtggatataaccgacaatgagttggcttacttggagagtatccatttgtttgtggagatattggaccatttcttcagcaatgtttgtgagctagatttggtgtttaatttccacaaggtgtacttgatactcgatgagttcattcttgctggggagctccaagaaacaagcaaaagggcaatcatcgaaaggatgtcagaactcgagaagctacagtga

SEQ ID NO: 6563 - protein, 142 aa, Arabidopsis thaliana
MIRFILLQNRQGKTRLAKYYVPLEESEKHKVEYEVHRLVVNRDAKFTNFVEFRTHKVIYRRYAGLFFSVCVDITDNELAYLESIHLFVEILDHFFSNVCELDLVFNFHKVYLILDEFILAGELQETSKRAIIERMSELEKLQ

SEQ ID NO: 6564 - DNA, 432 bp, Arabidopsis thaliana
  CDS (1)..(432)
atgggaataaggttcatattgatggtgaacaagcaaggccagactcgtcttgctcagtactacgaatggctcactctcgaggaacgtcgcgctctcgaaggcgaaatcgtccgtaaatgcctcgctcgcaacgaccaacagtgttcgtttgtcgagcatcgcaactacaagatagtctacaggcgttacgcatctctcttcttcatggttggggttgatgacgatgaaaacgagctggcgattctagagttcatacatcttttggtcgagacaatggacaagcattttggaaatgtgtgtgagctagacataatgttccatctggagaaagctcatttcatgctggaagaaatggtgatgaatggttgcattgtggagacaagcaaagccaacatactttcacctatacaacttatggacaaagcccattaa

SEQ ID NO: 6565 - protein, 143 aa, Arabidopsis thaliana
MGIRFILMVNKQGQTRLAQYYEWLTLEERRALEGEIVRKCLARNDQQCSFVEHRNYKIVYRRYASLFFMVGVDDDENELAILEFIHLLVETMDKHFGNVCELDIMFHLEKAHFMLEEMVMNGCIVETSKANILSPIQLMDKAH

SEQ ID NO: 6566 - DNA, 501 bp, Arabidopsis thaliana
  CDS (1)..(501)
atgattaaggcagtgatgatgatgaacacacaaggcaaaccacgtctagctaaattctacgattacttgcctgtggagaagcagcaggagcttattcgcggcgtgttttcagtattgtgcagtagacctgagaacgtaagcaattttctggagatcgaatcattgtttggaccggactcgcggcttgtatacaagcattatgctacactctattttgttcttgtatttgatggttcagaaaatgagcttgctatgcttgatctcattcaagttcttgttgaaacactggacaaatgcttcagcaatgtctgcgaactcgacattgtgttcaactacagcaagatgcacgcggtgttagatgagattgtatttggaggacaagtactggaaactagttctgctgaagtcatgaaggctgttgaagaaatatcaaaattagaagctgcctcaaattcgatttcacttgtccccaagtctgtttccgggtggcgtggccgttag

SEQ ID NO: 6567 - protein, 166 aa, Arabidopsis thaliana
MIKAVMMMNTQGKPRLAKFYDYLPVEKQQELIRGVFSVLCSRPENVSNFLEIESLFGPDSRLVYKHYATLYFVLVFDGSENELAMLDLIQVLVETLDKCFSNVCELDIVFNYSKMHAVLDEIVFGGQVLETSSAEVMKAVEEISKLEAASNSISLVPKSVSGWRGR

SEQ ID NO: 6568 - DNA, 489 bp, Arabidopsis thaliana
  CDS (1)..(489)
atgatacattttgtgcttctagttagccggcaaggaaaggtaaggctcaccaaatggtattctccttatgcacagaaggaaagatctaaggttatacgtgaactcagtggagtgattctgaatcgaggtccaaagctctgcaattttgttgaatggagaggatacaaagttgtttacaaaagatatgcaagtctctacttctgcatgtgcattgatcaggaggataacgagttagaggtccttgagatcattcatcactatgttgagattctcgatcgctattttggaagtgtgtgtgaactcgatttgatttttaacttccacaaggcatattacatattggatgagctcttgattgctggggagcttcaagagtcaagcaagaaaacagtagccaggattatatccgctcaggatcaactggtggaggttgcaaaagaggaggccagttcgataagtaatataatcgctcaggctactaatcgataa

SEQ ID NO: 6569 - protein, 162 aa, Arabidopsis thaliana
MIHFVLLVSRQGKVRLTKWYSPYAQKERSKVIRELSGVILNRGPKLCNFVEWRGYKVVYKRYASLYFCMCIDQEDNELEVLEIIHHYVEILDRYFGSVCELDLIFNFHKAYYILDELLIAGELQESSKKTVARIISAQDQLVEVAKEEASSISNIIAQATNR

SEQ ID NO: 6570 - DNA, 486 bp, Arabidopsis thaliana
  CDS (1)..(486)
atgatacatttcgtgttactagtcagtcgacaagggaaagtaaggctcaccaagtggtattcgccgtatacgcagaaggaaagatctaaggtcatacgtgaactcagtggagtgattctgaaccgaggtcccaagctctgcaattttattgaatggagaggatacaaggttgtctacaaaagatatgcaagcttgtacttctgcatgtgcattgatgaggcggataacgagttagaggtactggagataattcatcactacgtcgagattcttgaccgctactttggcagtgtgtgtgaactcgatttgatttttaacttccacaaggcgtattatatactcgatgagctgttgatcgccggagaacttcaagagtcaagcaagaaaacagttgcaaggataatatcagcccaggatcaattggtggaagttgcgaaagaggaggcgagttccataagtaatataattgctcaggctaccaagtag

SEQ ID NO: 6571 - protein, 161 aa, Arabidopsis thaliana
MIHFVLLVSRQGKVRLTKWYSPYTQKERSKVIRELSGVILNRGPKLCNFIEWRGYKVVYKRYASLYFCMCIDEADNELEVLEIIHHYVEILDRYFGSVCELDLIFNFHKAYYILDELLIAGELQESSKKTVARIISAQDQLVEVAKEEASSISNIIAQATK

SEQ ID NO: 6572 - DNA, 489 bp, Schizosaccharomyces pombe 972h-
  CDS (1)..(489)
atgtctataaagttctttctactcgtaagccgccagggaaaggtgcgtttagctaaatggttcaatactttgtcaatcaaggagagagccaaaataatccgtgatgtttcttcactggtgattacacgaaaaccaaaaatgtgcaattttgttgaatataaaggcgaaaaaattgtttaccgacgatatgcttccttgttttttgtttgtggaattgaacaggatgataatgagttaattatattagaagtcatccataagtttgttgaatgcttagacaaatactttggtaatgtttgtgagcttgacctcatttttaatttcgaaaaagcatattacgttatggaggaattactactcgcaggagagttacaggaatctagcaaaacaaatgttctttctgcagttctagctggtgatgcagaatcggaagctgatgcccagcaagatagcctccaaaaacttgtgggcagcgtgaagaagcgttaa

SEQ ID NO: 6573 - protein, 162 aa, Schizosaccharomyces pombe 972h-
MSIKFFLLVSRQGKVRLAKWFNTLSIKERAKIIRDVSSLVITRKPKMCNFVEYKGEKIVYRRYASLFFVCGIEQDDNELIILEVIHKFVECLDKYFGNVCELDLIFNFEKAYYVMEELLLAGELQESSKTNVLSAVLAGDAESEADAQQDSLQKLVGSVKKR

SEQ ID NO: 6574 - DNA, 375 bp, Arabidopsis thaliana
  CDS (1)..(375)
atgatacattttgtgcttctagttagccggcaaggaaaggtaaggctcaccaaatggtattctccttatgcacagaaggaaagatctaaggttatacgtgaactcagtggagtgattctgaatcgaggtccaaagctctgcaattttgttgaatggagaggatacaaagttgtttacaaaagatatgcaagtctctacttctgcatgtgcattgatcaggaggataacgagttagaggtccttgagatcattcatcactatgttgagattctcgatcgctattttggaagtgtgtgtgaactcgatttgatttttaacttccacaaggtaatagcatgctgcaaacactcaaggactctgccattcgtcacttga

SEQ ID NO: 6575 - protein, 124 aa, Arabidopsis thaliana
MIHFVLLVSRQGKVRLTKWYSPYAQKERSKVIRELSGVILNRGPKLCNFVEWRGYKVVYKRYASLYFCMCIDQEDNELEVLEIIHHYVEILDRYFGSVCELDLIFNFHKVIACCKHSRTLPFVT

SEQ ID NO: 6576 - DNA, 468 bp, Magnaporthe grisea 70-15
  CDS (1)..(468)
atggccattcaatacctgatcctgctctcaaggcagggcaaggtccgccttgcaaaatggttcactaccctcattcccaaagataaggccaagatcgtcaaggatgtcactcaggctgtcctggccaggcgcacacgcatgtgcaacttcttggaatacaaggatacgaaaatcgtctaccgtcgctatgcttcgctattcttcattgcaggctgttcctccgatgacaacgagctcataacgctagagatcatccaccgctacgtcgagcagatggacaagtattacggaaacgtttgcgaactggatattatcttctccttcaccaaggcctactacattctggacgagatcctactcgccggcgagatgcaggagagcagtaaaaaaaacatattgaggtgtatatcccagcaggactcgctggaagacatggaggtcgaggatgaagtgacgaggatcatgtag

SEQ ID NO: 6577 - protein, 155 aa, Magnaporthe grisea 70-15
MAIQYLILLSRQGKVRLAKWFTTLIPKDKAKIVKDVTQAVLARRTRMCNFLEYKDTKIVYRRYASLFFIAGCSSDDNELITLEIIHRYVEQMDKYYGNVCELDIIFSFTKAYYILDEILLAGEMQESSKKNILRCISQQDSLEDMEVEDEVTRIM

SEQ ID NO: 6578 - DNA, 432 bp, Magnaporthe grisea 70-15
  CDS (1)..(432)
atgctgtcgtttattttgattcaaaaccgccagggcaagacccgacttgcgaaatggtacgctccgtacagcgatgaggagaagataaagctcaagggcgaggtccaccgcctcgtggcgccgcgcgaccaaaagtatcaatccaactttgtcgagttccgcaacaacaagcttgtgtaccggcggtacgcggggctcttcttttgcgcgtgcgtggatacaaacgacaacgagctcgccttcctcgaggccatccacttcttcgtcgaggtgctcgacgcattctttggcaacgtgtgcgagctcgacctggtcttcaacttttacaaggtctacgctatcctagacgaggttttcttggctggcgagattgaggagacgagcaagacggtcgtgctcacgaggttggagcatctggacaagttggagtga

SEQ ID NO: 6579 - protein, 143 aa, Magnaporthe grisea 70-15
MLSFILIQNRQGKTRLAKWYAPYSDEEKIKLKGEVHRLVAPRDQKYQSNFVEFRNNKLVYRRYAGLFFCACVDTNDNELAFLEAIHFFVEVLDAFFGNVCELDLVFNFYKVYAILDEVFLAGEIEETSKTVVLTRLEHLDKLE

SEQ ID NO: 6580 - DNA, 564 bp, Magnaporthe grisea 70-15
  CDS (1)..(564)
atgatcaacgcgttcttggtctttaacggccaaggccagcctcggctgaccaaattctatactcagctagagacgaacatgcagcagcggctcatatccgaaatctttacgctcgtgtccaaccggcccacagggtcgtgcaacttcctcccgctccctccgctcctcgccgcctcgggcacctcgcacaccgactcgaccgagcagaacgacgtgccgtctctcgtgacgtacagaaactatgcaacactctacttcatcgtcatttcgaccgccaccgagtctcccctcgcgctcatcgacctgatccaggtctacgtcgaggcgctggacaagctctttgagaacgtgtgcgagctggacctgatcttcaactttgagactctgcactcgaccctgagcgagatgattgttggtggtgtcgtcgttgagacgaacctggataggatcgtcgccggtgtgcgtgcgcagggtactgttgccaagaggcagacaaatgacgggagaggcggcggcggcggtataggatctggtttgggtataggggtttggcatggaaggtga

SEQ ID NO: 6581 - protein, 187 aa, Magnaporthe grisea 70-15
MINAFLVFNGQGQPRLTKFYTQLETNMQQRLISEIFTLVSNRPTGSCNFLPLPPLLAASGTSHTDSTEQNDVPSLVTYRNYATLYFIVISTATESPLALIDLIQVYVEALDKLFENVCELDLIFNFETLHSTLSEMIVGGVVVETNLDRIVAGVRAQGTVAKRQTNDGRGGGGGIGSGLGIGVWHGR

SEQ ID NO: 6582 - DNA, 486 bp, Gibberella zeae PH-1
  CDS (1)..(486)
atggcgatccactaccttattctcctatctcgccaaggcaaagtgcgccttgccaaatggttctcaaccctctcacccaaagataaggccaagatcgtcaaggacgtatctcagcttgtgctcgctcgtagaacgcgcatgtgcaactttctcgaatacaaggatactaagattgtctaccgccgatatgcttcacttttcttcatcgccggctgctcctctgacgataacgagctgatcaccctcgaaattattcaccgatatgtcgaacagatggacaaatactacggcaatgtgtgcgagcttgatattatcttctccttcaccaaggcatattacattctcgacgaaatccttcttgcgggcgagctgcaggagacgagcaaaaagaacattcttcgctgcatcggtcagcaggattctcttgaagacatggagttcgacctcgcctcacgaaacgtcagatcgacccgtccactttcataa

SEQ ID NO: 6583 - protein, 161 aa, Gibberella zeae PH-1
MAIHYLILLSRQGKVRLAKWFSTLSPKDKAKIVKDVSQLVLARRTRMCNFLEYKDTKIVYRRYASLFFIAGCSSDDNELITLEIIHRYVEQMDKYYGNVCELDIIFSFTKAYYILDEILLAGELQETSKKNILRCIGQQDSLEDMEFDLASRNVRSTRPLS

SEQ ID NO: 6584 - DNA, 471 bp, Candida glabrata CBS 138
  CDS (1)..(471)
atgactcatctcaaatatctactcctcgtttcaagacaaggcaaagtaagattgtcaaaatggtacgcacctctgagtacaaaagagaaagcaaaaattatcaaggatttaaccccaacaatacttgcacgaaaacctaaaatgtgtaacatactggaatattctgatcataaagttgtattcaggagatacgctagtctatatttcatatgtgggataaccataggccatgataatgaactactcactttagagttaatccataggtatgtggagacaatggacacatattttgagaatgtttgtgaactagatataatattcaatttccacaaggcgtatgatatcctagatgagctagtcatgtgtgatggagcaatagctgaatcaagcaaaaaagaagtactacaccacattgcggtaatggatcaattggaaggaaacgacacactggagcgtgtactgagttaa

SEQ ID NO: 6585 - protein, 156 aa, Candida glabrata CBS 138
MTHLKYLLLVSRQGKVRLSKWYAPLSTKEKAKIIKDLTPTILARKPKMCNILEYSDHKVVFRRYASLYFICGITIGHDNELLTLELIHRYVETMDTYFENVCELDIIFNFHKAYDILDELVMCDGAIAESSKKEVLHHIAVMDQLEGNDTLERVLS

SEQ ID NO: 6586 - DNA, 597 bp, Candida glabrata CBS 138
  CDS (1)..(597)
atgatccatgctgtattaatctttaacaagaagtgccaacctaggctcataaaattctacacaccagtcgagataagcaagcaacggatactactgaagcaagtccatgaactgatatcacagaggaataacgagtaccaaagttctttcttggtatcacctcctgctgttttgaccaacgggacgcatactgaagataattcatttaatgaagacggagaagacatacagatcatttataaaaattacgctactttatacttcacgtttattgtcgatgaccaggaatcagaactggctatactagaccttatacagacatttgtggaggcgttagataggtgcttttcagaagtgaatgaactagacctgattttcaattggcagactctggagagtgttttagaagagattattcaaggtgggatggtgatagaaaccagcgtatcgaagattgtacagtctgtcgatgacctgaacaaggcttgtgaatccacagatggaaaggttggaggacttcttgggaactccagttttggaagtgctttccaggcatttgcaagtggtggatttgcaaattgggctggaagccaatag

SEQ ID NO: 6587 - protein, 198 aa, Candida glabrata CBS 138
MIHAVLIFNKKCQPRLIKFYTPVEISKQRILLKQVHELISQRNNEYQSSFLVSPPAVLTNGTHTEDNSFNEDGEDIQIIYKNYATLYFTFIVDDQESELAILDLIQTFVEALDRCFSEVNELDLIFNWQTLESVLEEIIQGGMVIETSVSKIVQSVDDLNKACESTDGKVGGLLGNSSFGSAFQAFASGGFANWAGSQ

SEQ ID NO: 6588 - DNA, 444 bp, Candida glabrata CBS 138
  CDS (1)..(444)
atggcgatacagtttatactatgtttcaacaagcaaggtgtggtgaggctgctgcggtggtatgagaaggtgcctgcaggccacgagcggacgcaggatgtgatagcgcagatatacaggctgatctcatctcgagatcacaggcatcagagcaacttcgttgagttctcggagaggacgaagctggtgtacaagcggtatgcggggctgtactttgtctttggtgttgatctgaaggacgaggagtcgatatacctgtcgcacatacacctgtttgtggaagtgctggatgctttcttcgggaacgtgtgcgagctggacattgtcttcaacttctacaaggcgtacatggtcatggacgagatgttcctcggcggcgaagtccaggaggtctccaaggacgcgctgttcgagaggctgagtgccctcgatagactggagtga

SEQ ID NO: 6589 - protein, 147 aa, Candida glabrata CBS 138
MAIQFILCFNKQGVVRLLRWYEKVPAGHERTQDVIAQIYRLISSRDHRHQSNFVEFSERTKLVYKRYAGLYFVFGVDLKDEESIYLSHIHLFVEVLDAFFGNVCELDIVFNFYKAYMVMDEMFLGGEVQEVSKDALFERLSALDRLE

SEQ ID NO: 6590 - DNA, 447 bp, Kluyveromyces lactis NRRL Y-1140
  CDS (1)..(447)
atgccagtgcaatttatattgtgtctaaacaaacaagggatagtgagactactcagatggttcgagaagctagatacttctcagtacgctacgcatcaagaatacatccgtcaagtgttcaaagtaatatcgcaacgagaccatagacgtcagagcaatttcattgaattctcgaagcatacgaaattagtgtacaagggatatgctggattatattttgtcatgggagtagataaacaggatgaagaattgatatatttgtcacaaatacatctttttgtagaagttttggattccttctttgggaacgtatgtgaattggacattctattcaacttttacaagacgtatttggtaatggatgaaatgttcattgcaggggagatacaaaccacgtcgaaaaaagagttattggaacgaatcggtcaattagataggttaaattag

SEQ ID NO: 6591 - protein, 148 aa, Kluyveromyces lactis NRRL Y-1140
MPVQFILCLNKQGIVRLLRWFEKLDTSQYATHQEYIRQVFKVISQRDHRRQSNFIEFSKHTKLVYKGYAGLYFVMGVDKQDEELIYLSQIHLFVEVLDSFFGNVCELDILFNFYKTYLVMDEMFIAGEIQTTSKKELLERIGQLDRLN

SEQ ID NO: 6592 - DNA, 564 bp, Kluyveromyces lactis NRRL Y-1140
  CDS (1)..(564)
atgattcatgcagtattaatatttaacaagaaatgtcaaccaagattgataaaattttatacacctgtagaggttgaaaagcaaacgcttttattacagcaagtatatgaacttatatctcagcgtaacagtcaggtgcagtcatctttcttagtaactcctccatctttattaatggactcaggtgataacgaagatattcaaatcatatacaagaactacgccacgttatacttcacatttatagttgatgaacaagaatcagaactagcaatcttagatttgattcaaacgtttgtagaggcattggataaatgtttcgaagaagtgaatgagctagacttaatcttcaattggcaaacattggaaagtgtacttgaagagattatccaaggtggattggtgatagagaccaatgtaaggaaaatcgtaagtgctgtagatgaattgaataacgctaatgaaagtgaaaattctttcaccaaactagcagggaatcgaatctctgaggcgttccaggcgttcagttattcaaatttcagtgcttgggggtcacatcaatga

SEQ ID NO: 6593 - protein, 187 aa, Kluyveromyces lactis NRRL Y-1140
MIHAVLIFNKKCQPRLIKFYTPVEVEKQTLLLQQVYELISQRNSQVQSSFLVTPPSLLMDSGDNEDIQIIYKNYATLYFTFIVDEQESELAILDLIQTFVEALDKCFEEVNELDLIFNWQTLESVLEEIIQGGLVIETNVRKIVSAVDELNNANESENSFTKLAGNRISEAFQAFSYSNFSAWGSHQ

SEQ ID NO: 6594 - DNA, 471 bp, Kluyveromyces lactis NRRL Y-1140
  CDS (1)..(471)
atgtcacagattaagtacatgcttctcacgtcgaggcaaggcaagactaggttaatcagatggtatcaacccttcgatataaagtacaagcataaaatactaagggaagtgacgactaacgtactgtccaggaagtcaaaaatgtgcaatattctagaatatcaagatcacaaagtcgtgtacaagaaatatgccagtttatacttcattgcagggattgatttggattcggacaacgaattgttgactttagaaattatacacagatttgtggaaactatggatagatattttgggaacgtctgcgagttagatatcatattcaattttagcaaggcatacagcatattggatgaaatgataatgtgtgacggatctataatagaaactagtaaagatgaagttatacatgttgtggaggccatggatgcaattgaatcaaatgatgaccttgatagggtattgagttga

SEQ ID NO: 6595 - protein, 156 aa, Kluyveromyces lactis NRRL Y-1140
MSQIKYMLLTSRQGKTRLIRWYQPFDIKYKHKILREVTTNVLSRKSKMCNILEYQDHKVVYKKYASLYFIAGIDLDSDNELLTLEIIHRFVETMDRYFGNVCELDIIFNFSKAYSILDEMIMCDGSIIETSKDEVIHVVEAMDAIESNDDLDRVLS

SEQ ID NO: 6596 - DNA, 438 bp, Debaryomyces hansenii CBS767
  CDS (1)..(438)
atggctattcatttcattctagtgcttaacaggcagggtaaaacaaggcttgctaagtggtttgataataactatactacccaggataagcaaagatatacaacagagatacataggttgatatcttctagggacctgaaatatcagtccaattttattgaataccaacagaacaagttggtctacaggcgatacgctggattgtattttatatcttccatagatctcattgacagtgaattggattcgttagagtcgctacattttttggtggaagtgttagacgtttatttcgataatgtttgtgaactagacttaatatttaacttctataaattgtattctatattagatgaaatattcttgggaggagagtttcaagagatactgaaggataaaatcttggaaaggttggcatatttagacaaattagactag

SEQ ID NO: 6597 - protein, 145 aa, Debaryomyces hansenii CBS767
MAIHFILVLNRQGKTRLAKWFDNNYTTQDKQRYTTEIHRLISSRDLKYQSNFIEYQQNKLVYRRYAGLYFISSIDLIDSELDSLESLHFLVEVLDVYFDNVCELDLIFNFYKLYSILDEIFLGGEFQEILKDKILERLAYLDKLD

SEQ ID NO: 6598 - DNA, 462 bp, Debaryomyces hansenii CBS767
  CDS (1)..(462)
atggctgcgcaatttttgctattactatcgagacaaggaaaggtaagattatccaaatggtatcaaaccatttctcaaaaagagaaatccaaaatcaccagagaattgacaaccctaatcttatcaagacgagctaaaatgtgtaatgtgttggaatacaaggatatcaagattgtctaccgtcgttatgcttcgttgttctttatagtgggcattgaatctggtgacaatgaattaatatcgttagaaattatacatagatttgttgaacaaatggataaagtatacggtaatgtttgtgaattagatattatttttggatttgacaaagcttaccatattcttgatgaacttctcctagatggttacatacaagaatcttctaggagagaagtattgaaaagagttgctcaacaagacgaattggagaacatggacgagtttgacaaaatattagcatga

SEQ ID NO: 6599 - protein, 153 aa, Debaryomyces hansenii CBS767
MAAQFLLLLSRQGKVRLSKWYQTISQKEKSKITRELTTLILSRRAKMCNVLEYKDIKIVYRRYASLFFIVGIESGDNELISLEIIHRFVEQMDKVYGNVCELDIIFGFDKAYHILDELLLDGYIQESSRREVLKRVAQQDELENMDEFDKILA

SEQ ID NO: 6600 - DNA, 570 bp, Yarrowia lipolytica CLIB122
  CDS (1)..(570)
atgatccactcggtactgatcttcaacaattcgggcttgccacgattgactaaattctacgctcccgtggacctggcaacacaacaaacgcttctcaagcaggtgcattctctgctggtggcaagaaaaccagacgcatgtctgttcctcacccctcctcctcttctccagggccaggaggatgttgacaccatccgtgtcatatacaagcactacgccacgttatactttgtgtttgtagtcgacgagcaggaatccgaactcggcatcttggatctgatccaggtcatggtggagtgcctggaccggtgcttcgagaacgtctgtgagctggatctggtattcgggtggcaaacacttgaaaccgtgctgggagaaatcattcagggaggcatggtcgtggagacttcagtgaccaagatcgtcgctgctgtcgacgaggctaacagaggtaacggtagtgcggaaatgaaggagggaggtgcgagcggaggattcgccaacgctctcagtggagccacaaacgccatcagtcaaatggccaaggagggacgatggtcctaccgataa

SEQ ID NO: 6601 - protein, 189 aa, Yarrowia lipolytica CLIB122
MIHSVLIFNNSGLPRLTKFYAPVDLATQQTLLKQVHSLLVARKPDACLFLTPPPLLQGQEDVDTIRVIYKHYATLYFVFVVDEQESELGILDLIQVMVECLDRCFENVCELDLVFGWQTLETVLGEIIQGGMVVETSVTKIVAAVDEANRGNGSAEMKEGGASGGFANALSGATNAISQMAKEGRWSYR

SEQ ID NO: 6602 - DNA, 558 bp, Aspergillus nidulans FGSC A4
  CDS (1)..(558)
atgatcaacgccgtgctagtcttcaataacaacggccagccccgcttgaccaagttctacacgcaaatcgacacacaaacgaaacaatcccttatcgcccaaatatatgaccttgttgcccagcgtccccctacagcctgcaatttcctcccgctccctccgatactcgcccgcggcgccagttccagcgcaagcactggtccttctgacgctccaactcaaattacctaccgtacatacgcgactctctcatttatcatgatctcaacgtccactgagtccccgctggccctgatcgacctcatccaagtttttgtcgaggcgctcgaccgcatcttcgagaacgtatgcgagctggacctcatatttggctttgagactatgcatgcggttcttagtgaaatgatcgtcggtggagtggttgttgagacgaatattgataaaatcgttgctggggtacagagccaggagggaagtctggggaagaagagggctatacaggcggcaagttctggggtagggaggggtgggctgtctggactggctgcttggcggtga

SEQ ID NO: 6603 - protein, 185 aa, Aspergillus nidulans FGSC A4
MINAVLVFNNNGQPRLTKFYTQIDTQTKQSLIAQIYDLVAQRPPTACNFLPLPPILARGASSSASTGPSDAPTQITYRTYATLSFIMISTSTESPLALIDLIQVFVEALDRIFENVCELDLIFGFETMHAVLSEMIVGGVVVETNIDKIVAGVQSQEGSLGKKRAIQAASSGVGRGGLSGLAAWR

SEQ ID NO: 6604 - DNA, 531 bp, Aspergillus nidulans FGSC A4
  CDS (1)..(531)
atggcaattcactacctgatcctgctctcccgccagggcaaagtgcgcctcgcaaagtggttcaccaccctttcgcccaaggagaaggccaagattatcaaggatgtgactcaactcgtgctgtcccgccggacgcggatgtgcaatttccttgagtacaaagacaccaaagtcgtctaccgccgatatgcctctctcttcttcatcgccggatgcgcctcgactgataacgagctgatcacccttgaaatcgtgcaccgatacgtcgagcagatggacaagtattacggcaacgtatgcgagctggacatcatttttaatttccagaaggcgtacttcatcctggatgaactgttgctggcgggcgagatgcaggagagcagcaagaagaacgtgctgaggtgtattagccagcaggacagtttggaggatatggagtccactcgtacccccagaccccatggcagcattgtctgtatcggcttctcgatttcagaccttccccattttaatcacacaacgcacgattga

SEQ ID NO: 6605 - protein, 176 aa, Aspergillus nidulans FGSC A4
MAIHYLILLSRQGKVRLAKWFTTLSPKEKAKIIKDVTQLVLSRRTRMCNFLEYKDTKVVYRRYASLFFIAGCASTDNELITLEIVHRYVEQMDKYYGNVCELDIIFNFQKAYFILDELLLAGEMQESSKKNVLRCISQQDSLEDMESTRTPRPHGSIVCIGFSISDLPHFNHTTHD

SEQ ID NO: 6606 - DNA, 462 bp, Candida albicans SC5314
  CDS (1)..(462): transl_table=12
atggccattcaatttttatttctcatatctcgacaaggtaaaaccagattatcaaaatggtatcaaacgatcctgcaaaaggagaaatccaagattatacgagaattaagcacaataatattatcaagacgagccaaaatgtgtaatgttttagaatataaagatttaaagataatttatcgaagatatgctagtttatttttcgtcattggggtgaattctgatgataatgaattgattggattagaaataattcatcgatttgttgaacaaatggataaaatatatggtaatgtttgtgaattggatattatttttggatttgataaggcatatcatatattggatgaattgttgattgatggatatttacaagaaagttcgaaacgagaagtgttgaaacgagttaatcaacaagatgaattggaaaatatggatgaatttgaaaacatattggcatga

SEQ ID NO: 6607 - protein, 153 aa, Candida albicans SC5314
MAIQFLFLISRQGKTRLSKWYQTISQKEKSKIIRELSTIILSRRAKMCNVLEYKDLKIIYRRYASLFFVIGVNSDDNELIGLEIIHRFVEQMDKIYGNVCELDIIFGFDKAYHILDELLIDGYLQESSKREVLKRVNQQDELENMDEFENILA

SEQ ID NO: 6608 - DNA, 438 bp, Candida albicans SC5314
  CDS (1)..(438): transl_table=12
atgtcaatacattttatattagttcttaatcgtcaaggaaaatcacgattagtcaaatggtttgataactcatatacaccacaacaaaaacaacaatatattctggatattcatcgattaatcagtagtcgagattctaaacatcaatcgaattttgttgaatttcaacaaaataaattagtttatagacgatacgcaggattatattttttatgtggtattgatttaattgattcagaattaagttatttggaaagcttacatttttttgtcgaaattttggatgtttattttgatagtgtttgcgaagttgatcttgtatttaatttttataaattatattatatattagatgaaatttatcttggtggagaaatacaagaactactgaaaaagaaaattctaaatcgattaagttatttagatggattagattaa

SEQ ID NO: 6609 - protein, 145 aa, Candida albicans SC5314
MSIHFILVLNRQGKSRLVKWFDNSYTPQQKQQYISDIHRLISSRDSKHQSNFVEFQQNKLVYRRYAGLYFLCGIDLIDSELSYLESLHFFVEILDVYFDSVCEVDLVFNFYKLYYILDEIYLGGEIQELSKKKILNRLSYLDGLD

SEQ ID NO: 6610 - DNA, 759 bp, Ustilago maydis 521
  CDS (1)..(759)
atgacaatacgagcagcgctcattgtcaacaaccacggcaagccgcggctcaccaagttctatacccagcttcccgcttcgaggcagcaagcactgatcaaggagatctttcgacttgtatccaagcgacccgagggtgtgtgtaactttctcgacgcaacagagcttactgctctgcttccaccgcccgccgacgcagttcgcttttcgtcttgtctcagcaaagtcaagagcgaaaagggttcagtctcatccggctcaccttccgctgcatcgcaagatcagctgcgtgttatctatcgacactacgcaacgctttactttgtgtttgttgtcgattcgagtgaaagcgaactgggtatattggatctcatccaggttttcgtggagagcttggaccgatgttttgagaatgtatgcgagctggatctcatcttccactttgatgaggtgcacgctatcctcaacgaggtcattcagggaggattggtggtggagaccaacatcaacgagatcgttgcagcggcgcaggcgaccgcaagagcaaggaaggcttccgtggctcagtctggcgctggtggagtagcagcaggtgcagcaggtctcgcaaacctcacccctgcaagcttgaacctgtccataccaggttcaaattcctcaatcccttggccaagaggtactttcatggtagatgctatctccaacttgggcaaccagtacctgggtcgctcttccagtcgtcgttcaagtcgtcagtaa

SEQ ID NO: 6611 - protein, 252 aa, Ustilago maydis 521
MTIRAALIVNNHGKPRLTKFYTQLPASRQQALIKEIFRLVSKRPEGVCNFLDATELTALLPPPADAVRFSSCLSKVKSEKGSVSSGSPSAASQDQLRVIYRHYATLYFVFVVDSSESELGILDLIQVFVESLDRCFENVCELDLIFHFDEVHAILNEVIQGGLVVETNINEIVAAAQATARARKASVAQSGAGGVAAGAAGLANLTPASLNLSIPGSNSSIPWPRGTFMVDAISNLGNQYLGRSSSRRSSRQ

SEQ ID NO: 6612 - DNA, 507 bp, Cryptococcus neoformans var. neoformans B-3501A
  CDS (1)..(507)
atgatcaagtttatcctcgtacaaaatagacaaggcaagacacggctctcaaaatggtatgccccgtacgacgacgacgaaaaggtcagacatgttcccctctctactttcatccacgactatccacaaccactgctaatatccacacccactctgcaggtcaggttacggggcgaagtacaccgactcatagcgcctagagaccaaaagtaccaatccaactttgtcgagttccgggacgacaaggtcatctaccgacgatacgccggtctcttcttctgtgtctgcgtggactccaacgacaatgagctcgcgtacctcgaggcgatccatctctttgtagaggttctcgacgcctttttccaaaacgtctgtgaactggacctggtattctcgttttacaaggtgtatgcgatcctggacgaagtgttcttggccggggagattgaagagacgagcaagcaagtggtgctggaccggctggattacctggagaagctggattaa

SEQ ID NO: 6613 - protein, 168 aa, Cryptococcus neoformans var. neoformans B-3501A
MIKFILVQNRQGKTRLSKWYAPYDDDEKVRHVPLSTFIHDYPQPLLISTPTLQVRLRGEVHRLIAPRDQKYQSNFVEFRDDKVIYRRYAGLFFCVCVDSNDNELAYLEAIHLFVEVLDAFFQNVCELDLVFSFYKVYAILDEVFLAGEIEETSKQVVLDRLDYLEKLD

SEQ ID NO: 6614 - DNA, 663 bp, Cryptococcus neoformans var. neoformans B-3501A
  CDS (1)..(663)
atgatccacgccgtcctaattttcaacaccaacggcaaacctcgtctctccaagtttttcacccccctccctccactcgtccagcaatcgctcatctcccagatcttctcactcatctccgaccgtcctgcaggggtgtgcaactttctagatgcacccgatcttgtgtttcccacgcccaagtctatggtaaaaactaggcaggaggagaggaatggcctggggttggaaggcggaagggatggagaagaggtgaaagagatggaggacgatacgagggtgatttacaggcattatgcgacactatactttgtttttgtggttgatggagcggaaagcgagctaggtattttggacttgattcaggtctttgtagagtcattagatcgagcctttgagaatgtgtgtgaattggatctgatctttcactttgacgaagtatatcatgtcctatccgaaataatacaaggtggactcgtgctcgagacaaatatcaatgaaatatccgcctgcgtgcgtgctgccaccaagaaccgtaaagaatcttctgcctcttccaatccactcataccgtccgtcttggcagctcccggaggaagaggtggaaatagaggaggaagcgccgatggtgcgaggagatggttggccgctatgggtgtttag

SEQ ID NO: 6615 - protein, 220 aa, Cryptococcus neoformans var. neoformans B-3501A
MIHAVLIFNTNGKPRLSKFFTPLPPLVQQSLISQIFSLISDRPAGVCNFLDAPDLVFPTPKSMVKTRQEERNGLGLEGGRDGEEVKEMEDDTRVIYRHYATLYFVFVVDGAESELGILDLIQVFVESLDRAFENVCELDLIFHFDEVYHVLSEIIQGGLVLETNINEISACVRAATKNRKESSASSNPLIPSVLAAPGGRGGNRGGSADGARRWLAAMGV

SEQ ID NO: 6616 - DNA, 477 bp, Cryptococcus neoformans var. neoformans B-3501A
  CDS (1)..(477)
atgctcaactatgtcatgctcgtctctcgacagggaaaagtaagacttgcaaaatggttccaaacccttccaaccaagacgaagaataagattgtaaaggatgtcactcagcttgtacttgctaggcgaacgagaatgtgcaactttttggaatacaaagacaccaaagttatctacagacgttatgcgagcttattcttcatcacttctatttcaccgggtgataacgagttgattactttggaaattatacatcgttacgtggaagtcttggatcgatatttcggtaatgtgtgtgaattggatttaatcttcaactttcagaaagcctatgccgtccttgacgagcttatcattgctggagaaatacaagaatcgtccaagaaaactgtactcaaaattgttgcgcaatctgatgctattgaagagggtgagtcgttgcgcgagagtatgaagcaaagtggtttgtcgttttga

SEQ ID NO: 6617 - protein, 158 aa, Cryptococcus neoformans var. neoformans B-3501A
MLNYVMLVSRQGKVRLAKWFQTLPTKTKNKIVKDVTQLVLARRTRMCNFLEYKDTKVIYRRYASLFFITSISPGDNELITLEIIHRYVEVLDRYFGNVCELDLIFNFQKAYAVLDELIIAGEIQESSKKTVLKIVAQSDAIEEGESLRESMKQSGLSF

SEQ ID NO: 6618 - DNA, 495 bp, Cryptococcus neoformans var. neoformans B-3501A
  CDS (1)..(495)
atgctcaactatgtcatgctcgtctctcgacagggaaaagtaagacttgcaaaatggttccaaacccttccaaccaagacgaagaataagattgtaaaggatgtcactcagcttgtacttgctaggcgaacgagaatgtgcaactttttggaatacaaagacaccaaagttatctacagacgttatgcgagcttattcttcatcacttctatttcaccgggtgataacgagttgattactttggaaattatacatcgttacgtggaagtcttggatcgatatttcggtaatgtgtgtgaattggatttaatcttcaactttcagaaagcctatgccgtccttgacgagcttatcattgctggagaaatacaagaatcgtccaagaaaactgtactcaaaattgttgcgcaatctgatgctattgaagaggctgaagtagctgaagactcattggcgcgattgggtagcttggcaagaggcgggcaagttggatag

SEQ ID NO: 6619 - protein, 164 aa, Cryptococcus neoformans var. neoformans B-3501A
MLNYVMLVSRQGKVRLAKWFQTLPTKTKNKIVKDVTQLVLARRTRMCNFLEYKDTKVIYRRYASLFFITSISPGDNELITLEIIHRYVEVLDRYFGNVCELDLIFNFQKAYAVLDELIIAGEIQESSKKTVLKIVAQSDAIEEAEVAEDSLARLGSLARGGQVG

SEQ ID NO: 6620 - DNA, 762 bp, Arabidopsis thaliana
  CDS (80)..(565)
gaattcggcacgaggcttctggagatctcttctgggaatcgagcttcactgttaaagattttccttcaatcggctaaaaatgatacatttcgtgttactagtcagtcgacaagggaaagtaaggctcaccaagtggtattcgccgtatacgcagaaggaaagatctaaggtcatacgtgaactcagcggagtgattctgaaccgaggtcccaagctctgcaattttattgaatggagaggatacaaggttgtctacaaaagatatgcaagcttgtacttctgcatgtgcattgatgaggcggataacgcgttagaggtactggagataattcatcactacgtcgagattcttgaccgttactttggcagtgtgtgtgaactcgatttgatttttaacttccacaaggcgtattatatactggacgagctgttgatcgccggagaacttcaagagtcaagcaagaaaacagttgcaaggataatatcagcccaggatcaattggtggaagttgcgaaagaggaggcgagttccataagtaatataattgctcaggctaccaagtagtccttctctgaacttctcttatgcagctgaaacaatcgtaaatgagttaatattttccttcaactctgagaaattctcttctgaatcacactttgtttgtcatgccatgtcatgtgattgtttgattgattagaagaaagaagcattcatcgttttgggtttaaaaaaaaaaaaaaaaaaaaaaaaaaaaaaaaaaa

SEQ ID NO: 6621 - protein, 161 aa, Arabidopsis thaliana
MIHFVLLVSRQGKVRLTKWYSPYTQKERSKVIRELSGVILNRGPKLCNFIEWRGYKVVYKRYASLYFCMCIDEADNALEVLEIIHHYVEILDRYFGSVCELDLIFNFHKAYYILDELLIAGELQESSKKTVARIISAQDQLVEVAKEEASSISNIIAQATK

SEQ ID NO: 6622 - DNA, 885 bp, Camptotheca acuminata
  CDS (87)..(572)
ggaattcggcacgaggtgcgttcgggccagagaaggagagtcgtggatcgttcttcagcgtgattgtgtgctcgaaacaattcacaatgattcactttgtgcttcttattagccgacaaggaaaagtgaggttgacaaagtggtattcaccccatacccagaaggaaagaaataaggtgatccgagaactcagtggtttaattctcacacgaggccccaagctttgcaacttcgtagaatggaggggttttaaggttgtttataaaagatatgccagcctgtatttctgcatgtgcattgaccaggatgacaatgaattagaggtccttgaaattatacatcattatgtagaaatactagaccgctattttggaagtgtatgtgagctggatttgatcttcaattttcacaaggcttattatatattagatgagctcttaattgccggcgagcttcaagaatcaagcaagaaaactgttgcacgtcttatagcagcacaggattctttagtagaagctgctaaggaacaggccagttcaataagcaatatgatcgctcaggccaccaaataaacttatatgctggtttgttagattacttggcatgggtctgactcatgccagtctatgtgtcgtaaatgtgtctgtgcttgttagctgtgactttgatttttctcatatgagcggtttgaaagtttgatattcagcaggcatatgaccatgggaaatcaggaattcctttcaagtggcattatgtatgtgcatttcatccctgtatatgtctcggggttgctacgccgaactcattttgttaaaaaactttttttttaatagcaaaatgctggtttgtatgaattgccttaaaaaaaaaaaaaaaaaactcgag

SEQ ID NO: 6623 - protein, 161 aa, Camptotheca acuminata
MIHFVLLISRQGKVRLTKWYSPHTQKERNKVIRELSGLILTRGPKLCNFVEWRGFKVVYKRYASLYFCMCIDQDDNELEVLEIIHHYVEILDRYFGSVCELDLIFNFHKAYYILDELLIAGELQESSKKTVARLIAAQDSLVEAAKEQASSISNMIAQATK

SEQ ID NO: 6624 - DNA, 594 bp, Phaeosphaeria nodorum
  CDS (1)..(594)
atgatcaacgccgtgctcgtcttcaacaacgccggccagccgcggctgaccaagttctacactcagctggaaaccagcgtgcagcagcgcctcatctctgagatcttcactctcgtcgccaaccgcccgaactcggcatgcaacttcctcccactaccgccgctcctcgctagcgcctccaaatcctccactccgaccacccagcacaacgacactccctcgctcgtgacgtaccggcactatgccactctctacttcatcgtcatcagcacctctacagaatcacccctcgcccttctcgacctcatccaagtctttgtacaggcgctcgacggcctcttcgaaaatgtctgcgagctcgacttgatcttcaatttcgaaacgctacatgccactctgggagagatgatagtgggcggtgtcgttgtcgaaactcaactcgagcatgtcatcaagggcgtcaaggcacaaggcagagtcgcaaagaggccggtgaacgagagcagagggggaggcggcaaaggcgggctcggtggcttgacttttggtggacttggaagaggtggtggcgagggcatctggaccgggcgatga

SEQ ID NO: 6625 - protein, 197 aa, Phaeosphaeria nodorum
MINAVLVFNNAGQPRLTKFYTQLETSVQQRLISEIFTLVANRPNSACNFLPLPPLLASASKSSTPTTQHNDTPSLVTYRHYATLYFIVISTSTESPLALLDLIQVFVQALDGLFENVCELDLIFNFETLHATLGEMIVGGVVVETQLEHVIKGVKAQGRVAKRPVNESRGGGGKGGLGGLTFGGLGRGGGEGIWTGR

SEQ ID NO: 6626 - DNA, 519 bp, Phaeosphaeria nodorum
  CDS (1)..(519)
atgacgataaaatacctcatcctgctctcgcggcagggcaaagtgcgcctagccaaatggttcaccaccctcgcgcccaaagacaaggccaagattgtcaaagacgtctcgcagctcgtcctcgcccgccgcacgcgcatgtgcaacttcctagagtataaagacaccaaggtcgtctaccgccgctatgcctcactcttcttcatcgccggatgcgacgcgaccgacaatgagctgatcacgctcgaaatcgtccatcgctatgtcgagcagatggacaaatactacgggaacgtgtgcgaactcgacattatcttcaacttccagaaggcatacttcatcctcgatgagcttctgttggcgggcgaaatgcaagagagtagcaaaaagaacgtgctccgctgtataggccagcaagacagccttgaggacatggagtcgcttcgtcccggcaccatctggctgacgcgcactttccctggccaggccgaggacgacatcgtcaccaagatcatgtag

SEQ ID NO: 6627 - protein, 172 aa, Phaeosphaeria nodorum
MTIKYLILLSRQGKVRLAKWFTTLAPKDKAKIVKDVSQLVLARRTRMCNFLEYKDTKVVYRRYASLFFIAGCDATDNELITLEIVHRYVEQMDKYYGNVCELDIIFNFQKAYFILDELLLAGEMQESSKKNVLRCIGQQDSLEDMESLRPGTIWLTRTFPGQAEDDIVTKIM

SEQ ID NO: 6628 - DNA, 432 bp, Medicago truncatula
  CDS (1)..(432)
atggggatccgattcgtgttaatggtgaacaaacaaggacagacccgtcttgctcagtattacgaatacctcactgttgaagaacgacgaacccttgaaggcgaaattgttcgtaaatgtctcgcccgtaatgaaaaccagtgttcatttgttgagcatcgcaactacaaaattgtatataggcgctatgcatctttgtttttccttgttggagttgatgatggcgagaatgaacttgctattttggaattcatacatctcttagtcgaaaccatggatcgacattttggcaacgtgtgtgagctagatatcatgtttcatttagaaaaggtacattttatgttggaggaaatggtcatgaatggttgtattgtggaaacgagcaaatcaaatattctgactcctattcaactgatggataaaacatcgtaa

SEQ ID NO: 6629 - protein, 143 aa, Medicago truncatula
MGIRFVLMVNKQGQTRLAQYYEYLTVEERRTLEGEIVRKCLARNENQCSFVEHRNYKIVYRRYASLFFLVGVDDGENELAILEFIHLLVETMDRHFGNVCELDIMFHLEKVHFMLEEMVMNGCIVETSKSNILTPIQLMDKTS

SEQ ID NO: 6630 - DNA, 381 bp, Medicago truncatula
  CDS (1)..(381)
atgattcactttgtgcttctcattagtcgacaaggaaaagtgaggctcacaaaatggtattcaccatattctcaaaaggaacgatccaaggtaattagagaattaagtggcctaattatctctagaggcccaaagctatgcaactttgtggagtggaggggactcagagttgtttataaaagatatgctagtctttacttttgcatctgcaatgatcaagaagacaatgaattggagaccctctccattattcatcactatgttgagacattggatcgctattttggcagtgtttgtgagctagatttgatctttaatttccataaggtaatgtacattttttcaaaaacattattttctcttcttgtcactaaactttaa

SEQ ID NO: 6631 - protein, 126 aa, Medicago truncatula
MIHFVLLISRQGKVRLTKWYSPYSQKERSKVIRELSGLIISRGPKLCNFVEWRGLRVVYKRYASLYFCICNDQEDNELETLSIIHHYVETLDRYFGSVCELDLIFNFHKVMYIFSKTLFSLLVTKL

SEQ ID NO: 6632 - DNA, 480 bp, Botryococcus braunii
  CDS (1)..(480)
atgatccggttcgtgctccttctgagcaggcaaggcaaagtgcggttgtccaagtggtacacgacttgcactcaaaaggagagggccaagatcgtccgagacatcactcccttggtacttgggcgggcggtgaagctctgcaactttctggactatcaagacatcaaggtcgtttacaaacggtatgcaagcctctactttgtcatggggattgaggcaacggacaacgagttgattacgctggaagtcatacacgaatttgtagaagtcttggatcggtactttggaaacgtgtgcgagctggatctcatcttcaacttccacaaggcttatttcatgcttgatgagatggtcttggctggcgaactgcaagagcccagcaagaaggcaatcactcgggccattgaagcgcaggacaagctggtggaagaagcaaagacaggtcttgtggagcaggctttaggaacacaggagtactag

SEQ ID NO: 6633 - protein, 159 aa, Botryococcus braunii
MIRFVLLLSRQGKVRLSKWYTTCTQKERAKIVRDITPLVLGRAVKLCNFLDYQDIKVVYKRYASLYFVMGIEATDNELITLEVIHEFVEVLDRYFGNVCELDLIFNFHKAYFMLDEMVLAGELQEPSKKAITRAIEAQDKLVEEAKTGLVEQALGTQEY

SEQ ID NO: 6634 - DNA, 549 bp, Oryza sativa subsp
  CDS (1)..(549)
atgatccaggccgtgatggtcatgagcacgcagggcaagccgcgcctcctcaagttctacagctaccatgcccccgagaagcatcaggaactcgtccgcgccgtcttccagttgttgtctgcaaggccggacagtgtaagcaatttcgtcaaggttgatgcaatctttggaccgggagcgaaattgatctacaaacatttggccacattgtacttaggttttgtctttgatggctctgaaaatgaacttgcggtgcttgatcttgtgcaagtttttgttgaaacattggacagatgcttcaagaatgtgtgtgagcttcacattgtatttaacttcaacaaggtaaataaagcatgcttgggctggagaaacagtcaaacacaaccagcctcataccgaagtcgatttcagagcgtttcaggtcgcgttgcaattctctcaagtctcgagcatctaccatttgacatggacatgagagcttgtagccattgtgaatgtctcttgtgtatcacgcatgaaattggtgtgccttattgtgttaagttttag

SEQ ID NO: 6635 - protein, 182 aa, Oryza sativa subsp
MIQAVMVMSTQGKPRLLKFYSYHAPEKHQELVRAVFQLLSARPDSVSNFVKVDAIFGPGAKLIYKHLATLYLGFVFDGSENELAVLDLVQVFVETLDRCFKNVCELHIVFNFNKVNKACLGWRNSQTQPASYRSRFQSVSGRVAILSSLEHLPFDMDMRACSHCECLLCITHEIGVPYCVKF

SEQ ID NO: 6636 - DNA, 432 bp, Oryza sativa subsp
  CDS (1)..(432)
atggggatccggttcgtgctgttcgtgaacaagcaggggcagacgcggctggcccagtactacgagcacctctccatcgacgagcgccgcgccctcgagggcgagatcgtccgcaagtgcctcgcccgcaccgaccagcagtgttcgttcgtggagcaccggaactacaaggtggtgtaccggcggtacgcttccctcttcttcctcgtcggcgtcgacaacgacgagaatgagctagctattctcgaattcattcatctttttgtggaaactatggaccgccacttcggaaatgtgtgtgaactcgacatcatgttccatctagagaaggtgcacttcatgctggaagagatggtgatgaatggctgcatagtagagacaagtaaacagaacatcttagcaccaatccagcttatggagaaaacttcttag

SEQ ID NO: 6637 - protein, 143 aa, Oryza sativa subsp
MGIRFVLFVNKQGQTRLAQYYEHLSIDERRALEGEIVRKCLARTDQQCSFVEHRNYKVVYRRYASLFFLVGVDNDENELAILEFIHLFVETMDRHFGNVCELDIMFHLEKVHFMLEEMVMNGCIVETSKQNILAPIQLMEKTS

SEQ ID NO: 6638 - DNA, 721 bp, Gossypium barbadense
  CDS (54)..(482)
  misc_feature (561)..(561): n is a, g, c or t
  misc_feature (699)..(699): n is a, g, c or t
ggcggatttttgctattttgccaattaaaccctagaactctttggttccaacaatgatccgattcgtttcgttgcaaaatagacaaggcaagactcgtctcgccaaatactatgttcccctcgaagattccgagaagcacaaggtcgaatacgaggttcatcgattggttgttaatagagatccaaaatttaccaatttcgttgagtttcgtacgcataaggtaatatacaggcggtatgccggattgttcttctccttgtgtgttgacataaccgataacgagttggcatacttggaatgcatccatttatttgtggagatattggatcatttcttcagcaatgtttgtgagcttgacttggttttcaattttcacaaggtctatctgatactcgatgaattcattcttgctggagagcttcaagaaacaagcaaaaaggctataatagagagaatgggagagctggagaagctagagtaaagatgattctgcatgaaacagagattagtgcaatttgtgttgaatttttcccatttgttgcttttctttttgtgtgtgngatattattaatttgtgtgcaacttgaaaactgaaatacatgggggtcccctttactcctgttttcctttgctacaatactgactaccaaaatagagctgtggggacagtttttttaaggattgttgatatataaaanaaaaaaaaaaaaaaaaaaaaaa

SEQ ID NO: 6639 - protein, 142 aa, Gossypium barbadense
MIRFVSLQNRQGKTRLAKYYVPLEDSEKHKVEYEVHRLVVNRDPKFTNFVEFRTHKVIYRRYAGLFFSLCVDITDNELAYLECIHLFVEILDHFFSNVCELDLVFNFHKVYLILDEFILAGELQETSKKAIIERMGELEKLE

SEQ ID NO: 6640 - DNA, 681 bp, Oryza sativa subsp
  CDS (1)..(681)
atgatccaggccgtgatggtgatgagcacgcagggcaagccgcgcctcctcaagttctacagctaccagccccccgagaagcatcaggacctcgtccgcggcgtcttccagttgttgtctgcaaggccggacagtgtcagcaatttcgtcaaggttgatgcaatctttggaccgggagcgaaattggtctacaaacatttggccacattgtactttgtttttgtctttgatagctctgaaaatgaacttgcggtgcttgatcttgtacaagtttttgttgaaacattggacagatgcttcaagaatgtgtgtgagcttgacatcgtatttaacttcaacaaggctgggcttgaagaatataaaagggtcaagttcataaagcatgcttatggtcctttacaagagaggaccaatattgttttgctagctggagaaacagtcaaacacaaccagcctcataccgaagtcgatttcagagcgtttcagccgttgagccgtgagagcttcactcatgttatggacagaaactttgaatgcgtgagcagaagaaatcagattgcatttttctccagtcgcgttgcgattctctcaagtcgcgagcatctaccatttgacatgaatatgagagcttgtagccatcgtgaatatctctgtgtatcccgcatgaaattgaatatgtga

SEQ ID NO: 6641 - protein, 226 aa, Oryza sativa subsp
MIQAVMVMSTQGKPRLLKFYSYQPPEKHQDLVRGVFQLLSARPDSVSNFVKVDAIFGPGAKLVYKHLATLYFVFVFDSSENELAVLDLVQVFVETLDRCFKNVCELDIVFNFNKAGLEEYKRVKFIKHAYGPLQERTNIVLLAGETVKHNQPHTEVDFRAFQPLSRESFTHVMDRNFECVSRRNQIAFFSSRVAILSSREHLPFDMNMRACSHREYLCVSRMKLNM

SEQ ID NO: 6642 - DNA, 504 bp, Arabidopsis thaliana
  CDS (1)..(504)
atggtacactgctttatttctcttccactttgttttcctttgttcatacaaggtaagactcgtctagccaaatactatgtccctctcgaagaatccgagaaacacaaagtcgaatacgaggttcatagattagtggtgaatcgcgacgccaaattcaccaacttcgttgaggtttgctgttttcatttttttagaacacacaaggtgatatacaggcgttatgctggattgtttttctctgtgtgcgtggatataaccgacaatgagttggcttacttggagagtatccatttgtttgtggagatattggaccatttcttcagcaatgtttgtgagctagatttggtgtttaatttccacaagaattctcatatattaagcttacaagggtatatcaaactaagcttttgtttgcgaaaatcaaaagctagcaatcatcgaaaggatgtcagaactcgagaagctacagtgatgacggttaagaatcacattctacttggttaa

SEQ ID NO: 6643 - protein, 167 aa, Arabidopsis thaliana
MVHCFISLPLCFPLFIQGKTRLAKYYVPLEESEKHKVEYEVHRLVVNRDAKFTNFVEVCCFHFFRTHKVIYRRYAGLFFSVCVDITDNELAYLESIHLFVEILDHFFSNVCELDLVFNFHKNSHILSLQGYIKLSFCLRKSKASNHRKDVRTREATVMTVKNHILLG

SEQ ID NO: 6644 - DNA, 471 bp, Saccharomyces cerevisiae
  CDS (1)..(471)
atgacgcaattaaaatatttgttgctggtttctaggcaaggaaaaatcagattaaagaaatggtacacggcaatgtccgctggtgaaaaggcaaaaattgtgaaagacttgacacctacgatattagcaagaaaacccaaaatgtgtaacatcatcgagtataatgaccacaaagtagtatacaagcgatatgctagtctatattttattgttgggatgacgcccgatgttgacaatgaactgctgaccttggaaattatccatcggtttgtcgaaacaatggacacatatttcggcaatgtttgtgagctagacattatatttaacttcagtaaggtctacgatatcttgaatgagatgattatgtgcgatggctccatcgcagagagcagtaggaaggaagtactgcaccatgtgaccgtgatggacaccatggagagcaacgataatcttgaaagggtattgagttag

SEQ ID NO: 6645 - protein, 156 aa, Saccharomyces cerevisiae
MTQLKYLLLVSRQGKIRLKKWYTAMSAGEKAKIVKDLTPTILARKPKMCNIIEYNDHKVVYKRYASLYFIVGMTPDVDNELLTLEIIHRFVETMDTYFGNVCELDIIFNFSKVYDILNEMIMCDGSIAESSRKEVLHHVTVMDTMESNDNLERVLS

SEQ ID NO: 6646 - DNA, 399 bp, Zea mays
  CDS (1)..(399)
atgatccgcttcatcctgctgcagaaccggcaggggaagactcgactggccaagtattacgtcccgctcgaggactcggaaaagcacaaggttgaatacgaggtacaccggctcgtggtcaatcgggaccctaagttcaccaacttcgtcgagtttcgcacacacaaagttatctataggagatatgctggactgtttttttcaatatgtgtggacataactgataatgaattggcatacttggaatgcattcacttgtttgtcgagatattggaccatttctttagcaatgtttgtgagctcgatttagtgtttaattttcacaaggtttaccgttacctgatactagatgaatttattcttgctggggagctgcaagaaacaagcaaaaggcaataa

SEQ ID NO: 6647 - protein, 132 aa, Zea mays
MIRFILLQNRQGKTRLAKYYVPLEDSEKHKVEYEVHRLVVNRDPKFTNFVEFRTHKVIYRRYAGLFFSICVDITDNELAYLECIHLFVEILDHFFSNVCELDLVFNFHKVYRYLILDEFILAGELQETSKRQ

SEQ ID NO: 6648 - DNA, 438 bp, Aspergillus fumigatus
  CDS (1)..(438)
atggttctttcatttatactggtgcaaaaccgccagggtaagacacgcctggcgaagtggtatgcgccttatagcgatgaggagaaagtaaaactcaagggcgaggtccaccgccttgtcgccccccgggatcagaagtatcagtcgaactttgttgagtttaaacggagtacaaagattgtgtaccggagatatgcagggctgttcttctgtgtgtgtgttgacgccacggacaatgagctagcctatctggaggctatacatttcttcgtcgaggtcctagaccagttctttggcaatgtctgtgagctggatctggtattcaacttttacaaggtatatgcgattcttgatgaggtgtttctcgcgggcgaaatcgaggaaacaagcaaacaggttgtgcttacgaggctggaacacttggacaagctcgagtga

SEQ ID NO: 6649 - protein, 145 aa, Aspergillus fumigatus
MVLSFILVQNRQGKTRLAKWYAPYSDEEKVKLKGEVHRLVAPRDQKYQSNFVEFKRSTKIVYRRYAGLFFCVCVDATDNELAYLEAIHFFVEVLDQFFGNVCELDLVFNFYKVYAILDEVFLAGEIEETSKQVVLTRLEHLDKLE

SEQ ID NO: 6650 - DNA, 438 bp, Emericella nidulans
  CDS (1)..(438)
atggttttatcatttatacttgttcagaaccgtcagggcaagacccgacttgcgaagtggtatgcgccgtacagtgacgaggagaaagtgaagcttaagggagaggtccatcgcttggtggctcctcgggatcagaagtatcagtcgaactttgtcgaattcaaacgaagcacgaagatcgtttaccggagatatgcaggcctcttcttctgcgcgtgcgtcgacgccacagacaatgaactagcatacctcgaggcaattcatttctttgtcgaggtcctggatcaattcttcggcaacgtgtgcgagctggacttggttttcaatttctacaaggtatatgcgatcctggacgaagttttccttgccggggagatagaagagacgagcaaacaagtcgttttaacaaggctagaacatctggataaactggagtga

SEQ ID NO: 6651 - protein, 145 aa, Emericella nidulans
MVLSFILVQNRQGKTRLAKWYAPYSDEEKVKLKGEVHRLVAPRDQKYQSNFVEFKRSTKIVYRRYAGLFFCACVDATDNELAYLEAIHFFVEVLDQFFGNVCELDLVFNFYKVYAILDEVFLAGEIEETSKQVVLTRLEHLDKLE

SEQ ID NO: 6652 - DNA, 432 bp, Gibberella zeae
  CDS (1)..(432)
atgctgtcttttatcctcattcaaaaccgacagggcaagactcgtctcgccaaatggtacgcccctttcagcgatgagcaaaagatcaagctcaagggcgaagtccaccgcctcgttgcgccccgcgatcaaaaataccagtccaactttgtcgagttccgtaacaacaagatcgtctatcgtcgctatgccggtctcttcttctgcgcctgcgtcgacacaaacgataacgaactcgcattcctcgaggccattcacttcttcgtcgaggtcctcgatgcctttttcggaaacgtctgcgagcttgaccttgtcttcaacttctacaaggtctatgctatcctcgacgaggtgttcctggcaggcgagatcgaagagacgagtaagcaggttgtgctcacgcggttggagcatctcgacaaattagaataa

SEQ ID NO: 6653 - protein, 143 aa, Gibberella zeae
MLSFILIQNRQGKTRLAKWYAPFSDEQKIKLKGEVHRLVAPRDQKYQSNFVEFRNNKIVYRRYAGLFFCACVDTNDNELAFLEAIHFFVEVLDAFFGNVCELDLVFNFYKVYAILDEVFLAGEIEETSKQVVLTRLEHLDKLE

SEQ ID NO: 6654 - DNA, 432 bp, Schizosaccharomyces pombe
  CDS (1)..(432)
atgattcaattcattttgatacaaaaccggcatggaaagaatcgactttctaaatactacgtgccattcgatgatgatgaaaaagttcgattaaaggctcgtatccatcaattgatatctcaaagaaaccaaaaatttcaggcaaatttcctagaatgggagaacagcaagcttgtataccgtcggtatgctggcctttatttttgtttttgtgtggattcaaccgataatgatttagccattctagagatgattcatttttttgtagaaattcttgattccttctttgggaatgtctgtgaattagaccttattttcaatttctataaagtcagtgctattcttgacgagataatccttggtggcgaaattggagaatcaaacaaaaaatctgttcttgaaagaattgaagctttagagaaacttgaataa

SEQ ID NO: 6655 - protein, 143 aa, Schizosaccharomyces pombe
MIQFILIQNRHGKNRLSKYYVPFDDDEKVRLKARIHQLISQRNQKFQANFLEWENSKLVYRRYAGLYFCFCVDSTDNDLAILEMIHFFVEILDSFFGNVCELDLIFNFYKVSAILDEIILGGEIGESNKKSVLERIEALEKLE

SEQ ID NO: 6656 - DNA, 558 bp, Ashbya gossypii
  CDS (1)..(558)
atgattcacgccgtcctgatatttaacaagaagtgccaacctaggcttgtaaagtactatactcctgtcgatctcccgaagcagaagctactactggagcaggtttacgagctgatcagccagcgcaacagttcaattcagtcttcattcttaattacgccgccctcgctactatcgagtggtagtgaaaccattaacgaagatatccaaataatctacaagaactatgcaacactctattttactttcattgtcgacgaccaggagtcagaactggccatcttggatctgatccagacgtttgttgaagcgcttgacaggtgttttgcggaagttaacgaactagatctaatattcaattggcaaactcttgagagtgtcttggaggaaattattcaagggggtatggtaattgaaacgaacgtgaagaaaattgtggagaccgtcgacgagctcaatagaacttctaaccaggaagccaggtttgggaatggactaggaaacgcttttcaggccatcaccatgggtggcttttcaaattggggtgcgcggcagtga

SEQ ID NO: 6657 - protein, 185 aa, Ashbya gossypii
MIHAVLIFNKKCQPRLVKYYTPVDLPKQKLLLEQVYELISQRNSSIQSSFLITPPSLLSSGSETINEDIQIIYKNYATLYFTFIVDDQESELAILDLIQTFVEALDRCFAEVNELDLIFNWQTLESVLEEIIQGGMVIETNVKKIVETVDELNRTSNQEARFGNGLGNAFQAITMGGFSNWGARQ

SEQ ID NO: 6658 - DNA, 498 bp, Schizosaccharomyces pombe
  CDS (1)..(498)
atgatttacgctgtttttatatttaacaataaagggaaacctcgtctcacaaagttttacactccaattgatgaatccattcaacaaaagttaataggagatatatatgcagctgtatccactaggcccccaaccgcttgtaattttttggaaagtaatttaattgcaggtaaaaatagaataatttatcgccagtacgctactctctacttcgtttttgtagtagatgaaggtgaaagtgaactaggaattctcgatctcattcaagtatttgttgaagcattagatcgatgctttaataatgtttgcgagcttgatttggtttttaaattccaagaaatacatgctattcttgctgaggtagtatctggtggtcttgtcttagagacaaatctgaatgaaattgttttggcagctcagaatcaaatgccaaaaaccaaacggtccaatgcaatgccattcagcaatacattaagttcttttgctactaggttctag

SEQ ID NO: 6659 - protein, 165 aa, Schizosaccharomyces pombe
MIYAVFIFNNKGKPRLTKFYTPIDESIQQKLIGDIYAAVSTRPPTACNFLESNLIAGKNRIIYRQYATLYFVFVVDEGESELGILDLIQVFVEALDRCFNNVCELDLVFKFQEIHAILAEVVSGGLVLETNLNEIVLAAQNQMPKTKRSNAMPFSNTLSSFATRF

SEQ ID NO: 6660 - DNA, 585 bp, Saccharomyces cerevisiae
  CDS (1)..(585)
atgattcatgcagttctaatattcaataagaaatgccaaccaagattagtgaaattctacacgccggtcgaccttccaaagcaaaaactgctattagagcaagtatatgaattgatttctcaaaggaatagcgattttcaaagttcttttttagtcacgccaccatcgcttctgttaagcaatgaaaataataatgatgaggtaaacaatgaagatattcaaatcatctataaaaactacgctacactatatttcactttcatcgtggatgatcaagaatcagaactggccatattagatctgatccaaacttttgtggaatcattggaccgttgttttactgaagtcaatgaacttgatttgatttttaactggcaaactttggaaagtgtattagaagaaatcgtgcaggggggcatggtcattgaaacaaatgtgaacagaatagttgcttctgttgacgaactcaacaaagctgccgagtccacagatagtaaaattggaagactaacgtccactggatttggaagcgcactacaagcgtttgctcaaggcggatttgcacaatgggcaacggggcaataa

SEQ ID NO: 6661 - protein, 194 aa, Saccharomyces cerevisiae
MIHAVLIFNKKCQPRLVKFYTPVDLPKQKLLLEQVYELISQRNSDFQSSFLVTPPSLLLSNENNNDEVNNEDIQIIYKNYATLYFTFIVDDQESELAILDLIQTFVESLDRCFTEVNELDLIFNWQTLESVLEEIVQGGMVIETNVNRIVASVDELNKAAESTDSKIGRLTSTGFGSALQAFAQGGFAQWATGQ

SEQ ID NO: 6662 - DNA, 486 bp, Brassica napus
  CDS (1)..(486)
atgatacattttgtgcttctcgttagccgccaaggaaaagtcaggctcaccaaatggtactcgccttatacgcagaaggaaagatctaaggttatacgtgagctcagtggagtgattctgaaccgaggtcccaagctctgcaactttatcgagtggagaggatacaaagtcgtctacaaaagatacgcgagcctctacttctgtatgtgcattgatgcggaggataacgagttggaggtccttgagatcattcatcactacgttgagatcctcgaccgctatttcggaagtgtgtgtgagctcgatttgatttttcacttccacaaggcgtattacatattggacgagcttttgattgccggtgagctccaagagtcaagcaagaaaacagttgccaggattatctctgctcaggatcaaatggtggaagctgcaaaagaggaggctggttccattagctacatcatcgctcagactaccaagtag

SEQ ID NO: 6663 - protein, 161 aa, Brassica napus
MIHFVLLVSRQGKVRLTKWYSPYTQKERSKVIRELSGVILNRGPKLCNFIEWRGYKVVYKRYASLYFCMCIDAEDNELEVLEIIHHYVEILDRYFGSVCELDLIFHFHKAYYILDELLIAGELQESSKKTVARIISAQDQMVEAAKEEAGSISYIIAQTTK

SEQ ID NO: 6664 - DNA, 432 bp, Brassica napus
  CDS (1)..(432)
atgggaataaggttcatactaatggtgaacaagcaaggccagactcgcctcgctcagtactacgaatggctcactctcgagcaacgccgagctctcgaaggcgagatcgttcgtaaatgcctcgcccgcaacgaccagcagtgttcatttgtggagcatcgcaactacaagatcgtctacagacgttacgcatctctgtttttcatggttggtgttgatgacgatgaaaacgagctggccattctagagttcatacatcttttggttgagactatggacaagcattttggaaatgtgtgtgagctggacataatgttccatctggagaaagctcatttcatgctcgaggaaatggtcatgaatggttgcattgtcgagactagcaaagccaacatactttcacctatacagctcatggacaaagcccattaa

SEQ ID NO: 6665 - protein, 143 aa, Brassica napus
MGIRFILMVNKQGQTRLAQYYEWLTLEQRRALEGEIVRKCLARNDQQCSFVEHRNYKIVYRRYASLFFMVGVDDDENELAILEFIHLLVETMDKHFGNVCELDIMFHLEKAHFMLEEMVMNGCIVETSKANILSPIQLMDKAH

SEQ ID NO: 6666 - DNA, 429 bp, Brassica napus
  CDS (1)..(429)
atgatccgattcatattgttgcagaacagacaaggcaagactcgtcttgcaaagtactatgttcctctcgaggagtccgagaaacacaaggttgaatacgaggttcacagattggtggtcaatcgcgactcgaagttcaccaatttcgtcgagtttagaacgcataaggttatatacaggagatatgcagggttgtttttctcattgtgcgttgacataacagacaatgagttggcttaccttgaatgcatccacttgttcgttgagattttggaccatttcttcagcaatgtctgtgagcttgatttggttttcaacttccacaaggtgtacttaatactggatgaattcattcttgctggagagcttcaagaaacaagcaagcgggcgatcattgagaggatgtcagaactggagaagctcgagtga

SEQ ID NO: 6667 - protein, 142 aa, Brassica napus
MIRFILLQNRQGKTRLAKYYVPLEESEKHKVEYEVHRLVVNRDSKFTNFVEFRTHKVIYRRYAGLFFSLCVDITDNELAYLECIHLFVEILDHFFSNVCELDLVFNFHKVYLILDEFILAGELQETSKRAIIERMSELEKLE

SEQ ID NO: 6668 - DNA, 486 bp, Brassica napus
  CDS (1)..(486)
atgatacatttcgtgcttctagttagtcggcaaggaaaagtgaggctcaccaagtggtattcgccttatacacagaaggaaaggtctaaggtcatacgcgaactcagcggtgtcatccttaaccgaggccccaagctctgcaatttcatcgaatggagaggatacaaggttgtctacaagaggtatgcaagcctgtatttctgcatgtgcattgatgaggcggataacgagttagaggtactggagattattcatcactatgtcgagattcttgaccgttactttggcagtgtttgtgaactcgatttgatttttaacttccacaaggcgtattatatactggatgagctgttgatcgccggtgagcttcaagagtcgagcaagaaaacagtggcgaggataatatcagctcaggatcaattggtggaggctgcgaaagaggaggctagttccataagtaacatcattgctcaggctaccaagtag

SEQ ID NO: 6669 - protein, 161 aa, Brassica napus
MIHFVLLVSRQGKVRLTKWYSPYTQKERSKVIRELSGVILNRGPKLCNFIEWRGYKVVYKRYASLYFCMCIDEADNELEVLEIIHHYVEILDRYFGSVCELDLIFNFHKAYYILDELLIAGELQESSKKTVARIISAQDQLVEAAKEEASSISNIIAQATK

SEQ ID NO: 6670 - DNA, 504 bp, Brassica napus
  CDS (1)..(504)
atgataaaggcagtgatgatgatgaacacacaaggcaagccacgcctagccaaattctacgacttcttgcctgtagagaagcaacaagagctcatccgcggcgtgttctcagtgttgagcagcagacctgagaacgtaagcaactttctggagattgattcattgtttggtccggattctcggcttgtgtacaaacactatgctactctctacttcgtgcttgtatttgatggatcagaaaatgagcttgctatgcttgatctcattcaagttcttgttgaaacactggacaaatgcttcagcaatgtttgtgaactcgacattgtgttcaactacagcaagatgcacacagtgttagatgagattgtgtttggaggacaggtactggaaactaggtccgatgaagtcatgaaggctgttgaagaaatatcaaaattagaggctgcctcaaactcgatttcacttgtccccaagtctgtttccgggtggcgaggaggccgatag

SEQ ID NO: 6671 - protein, 167 aa, Brassica napus
MIKAVMMMNTQGKPRLAKFYDFLPVEKQQELIRGVFSVLSSRPENVSNFLEIDSLFGPDSRLVYKHYATLYFVLVFDGSENELAMLDLIQVLVETLDKCFSNVCELDIVFNYSKMHTVLDEIVFGGQVLETRSDEVMKAVEEISKLEAASNSISLVPKSVSGWRGGR

SEQ ID NO: 6672 - DNA, 486 bp, Glycine max
  CDS (1)..(486)
atgatcaactttgtgcttctcattagtcgccaagggaaggtgagattgacaaaatggtactcaccttattctcagaaagaaaggagtaaggtaatccgtgagctcagtggaatgattctttcccgtgcgcccaagcaatgtaattttgtggaatggcgaggacataaagttgtttataaaaggtatgctagtctctatttctgcatgtgcattgatcaagatgacaatgaattagaagtccttgaaatgattcatcattttgtggagattcttgaccggtattttggcagtgtctgtgaactggacttaatattcaactttcacaaggcctactatatactagatgaaattctaattgccggtgagcttcaagagtccagcaagaaaacagttgcccgattgatagcagcacaggattcgttggtggagaatgcaaaggaagaagccagttcgtttagtaatataattgcacaagccactaagtga

SEQ ID NO: 6673 - protein, 161 aa, Glycine max
MINFVLLISRQGKVRLTKWYSPYSQKERSKVIRELSGMILSRAPKQCNFVEWRGHKVVYKRYASLYFCMCIDQDDNELEVLEMIHHFVEILDRYFGSVCELDLIFNFHKAYYILDEILIAGELQESSKKTVARLIAAQDSLVENAKEEASSFSNIIAQATK

SEQ ID NO: 6674 - DNA, 486 bp, Glycine max
  CDS (1)..(486)
atgatcaactttgtgcttctcattagtcgccaagggaaggtgagactgacaaaatggtactcaccttattctcagaaagaaaggagtaaggtaatccgtgagctcagtggaatgattctttcccgtgctcccaagcaatgtaattttgtagaatggcgaggacataaagttgtttataaaaggtatgctagtctctatttctgcatgtgcattgatcaagatgacaatgaattagaagtccttgaaataattcatcattttgtggagattcttgaccggtattttggcagtgtctgtgaactggacttaatattcaactttcacaaggcctactatatactagatgaaattctaattgccggtgagcttcaagagtccagcaagaaaacagttgctcgattgatagcagcacaggattcgttggtggagaatgcgaaggaagaagtcagttcattaagtaatataattgcacaagccactaagtga

SEQ ID NO: 6675 - protein, 161 aa, Glycine max
MINFVLLISRQGKVRLTKWYSPYSQKERSKVIRELSGMILSRAPKQCNFVEWRGHKVVYKRYASLYFCMCIDQDDNELEVLEIIHHFVEILDRYFGSVCELDLIFNFHKAYYILDEILIAGELQESSKKTVARLIAAQDSLVENAKEEVSSLSNIIAQATK

SEQ ID NO: 6676 - DNA, 486 bp, Glycine max
  CDS (1)..(486)
atgatcaactttgtgcttctcattagtcgccaagggaaggtgagactgacaaaatggtactcaccttattctcagaacgaaaggagtaaggtaatccgtgagctcagtggaatgattctttcccgtgcgcccaagcaatgtaattttgtggaatggcgaggacataaagttgtttataaaaggtatgctagtctctatttctgcatgtgcattgatcaagatgacaatgaattacaagtccttgaaatgattcatcattttgtggagattcttgaccggtattttggcagtgtctgtgaactggacttaatattcaactttcacaaggcctactatatactagatgaaattctaattgccggtgagcttcaagagtccagcaagaaaacagttgcccgattgatagcagcacaggattcgttggtggagaatgcaaaggaagaagccagttcgtttagtaatataattgcacaagccactaagtga

SEQ ID NO: 6677 - protein, 161 aa, Glycine max
MINFVLLISRQGKVRLTKWYSPYSQNERSKVIRELSGMILSRAPKQCNFVEWRGHKVVYKRYASLYFCMCIDQDDNELQVLEMIHHFVEILDRYFGSVCELDLIFNFHKAYYILDEILIAGELQESSKKTVARLIAAQDSLVENAKEEASSFSNIIAQATK

SEQ ID NO: 6678 - DNA, 501 bp, Glycine max
  CDS (1)..(501)
atgataaaagcagtgctggtgttgaacacgcaggggaagcctcgtctcgccaaattctacgaatttcagtctgtggagaagcagcatgaagctattcgcaatgtgttttcagtcttatgcagtagacctgaacatgtcagcaattttgtggatgccgagtccttctttggcccggactctcgcctggtctacaagcactttgcaactttatatttcatgttcatatttgatagttctgaaaacgagcttgctatgcttgacttgatacaagtgtttgttgaaacattggacaaatgcttcagaaatgtatgtgagcttgatatcgtgttcaactatagtaagatgcataccatactagatgagatcattctcggaggccaggtgttggagacaagttcaaacgaggttatgaaggctattgaagaaatatcaaggcttgaatcagcatccaatgcaatcaaccttgttccaaaatctgtttctggttggaggtcacgataa

SEQ ID NO: 6679 - protein, 166 aa, Glycine max
MIKAVLVLNTQGKPRLAKFYEFQSVEKQHEAIRNVFSVLCSRPEHVSNFVDAESFFGPDSRLVYKHFATLYFMFIFDSSENELAMLDLIQVFVETLDKCFRNVCELDIVFNYSKMHTILDEIILGGQVLETSSNEVMKAIEEISRLESASNAINLVPKSVSGWRSR

SEQ ID NO: 6680 - DNA, 429 bp, Glycine max
  CDS (1)..(429)
atgatccgattcattctgttgcagaacaggcagggcaagacccgtcttgccaaatactacgttcctctcgaggactccgagaagcacaaggtcgaatacgaggttcatcggctcgtcgtaaacagagaccctaaatacacaaatttcgtcgagtttcgtacgcacaagataatatacaggcgatatgctgggttatttttctcactctgtgttgatatcactgataatgagttggcgtatttagagtgcatccatttgtttgtggaaatattggatcacttcttcagcaatgtctgtgagctcgatttggtttttaacttccacaaggtctatcttatacttgatgaattcattctagcgggtgaactgcaagaaacaagcaagaaggctatcattgagagaatgggggaacttgaaaaactagaatga

SEQ ID NO: 6681 - protein, 142 aa, Glycine max
MIRFILLQNRQGKTRLAKYYVPLEDSEKHKVEYEVHRLVVNRDPKYTNFVEFRTHKIIYRRYAGLFFSLCVDITDNELAYLECIHLFVEILDHFFSNVCELDLVFNFHKVYLILDEFILAGELQETSKKAIIERMGELEKLE

SEQ ID NO: 6682 - DNA, 432 bp, Glycine max
  CDS (1)..(432)
atggggatccgattcgtactgatggtgaacaagcaaggccaaactcgtcttgctcaatactacgaatatctcaccctcgaagagcgacgtgccctcgaaggcgaaatcgttcgcaaatgcctcgcccgcaacgaacagcagtgttccttcgttgagcatcgcaactacaaaattgtatatcgtcgctacgcctctttgtttttcctcgttggagttgacgatgatgagaatgagctggctattttggaatttatacatctcttggttgaaaccatggatcgtcatttcggcaatgtgtgcgagctagatattatgttccatttagaaaaggcgcattttatgttggaggagatggtcatgaatggttgtattgtggagacaagcaaatcaaatattttgactccaattcagctgatggataaaacatcttga

SEQ ID NO: 6683 - protein, 143 aa, Glycine max
MGIRFVLMVNKQGQTRLAQYYEYLTLEERRALEGEIVRKCLARNEQQCSFVEHRNYKIVYRRYASLFFLVGVDDDENELAILEFIHLLVETMDRHFGNVCELDIMFHLEKAHFMLEEMVMNGCIVETSKSNILTPIQLMDKTS

SEQ ID NO: 6684 - DNA, 429 bp, Glycine max
  CDS (1)..(429)
atgatccgattcattctgttgcagaacaggcagggcaagacccgtcttgccaaatactacgttcctctcgaggattccgagaagcacaaggtggaatacgaggttcaccgcctcgtcgtaaacagagaccctaaatacacaaatttcgtcgagtttcgtacgcacaagataatatacaggcgatatgctgggttgtttttctcaatctgtgttgatatcactgataatgagttggcgtatttagagtgcatccatttgtttgtggaaatattggatcacttcttcagcaatgtctgtgagcttgatttggtttttaacttccacaaggtctatcttatacttgatgaattcattctagcgggtgaactgcaagaaacaagcaagaaggctattattgagagaatgggggaattggaaaaactagaatga

SEQ ID NO: 6685 - protein, 142 aa, Glycine max
MIRFILLQNRQGKTRLAKYYVPLEDSEKHKVEYEVHRLVVNRDPKYTNFVEFRTHKIIYRRYAGLFFSICVDITDNELAYLECIHLFVEILDHFFSNVCELDLVFNFHKVYLILDEFILAGELQETSKKAIIERMGELEKLE

SEQ ID NO: 6686 - DNA, 429 bp, Zea mays
  CDS (1)..(429)
atgatccgcttcatcctgctgcagaaccggcaggggaagactcgactggccaagtactacgtcccgctcgaggactcggaaaagcacaaggttgaatacgaggtacaccggctcgtggtcaatcgggaccctaagttcaccaacttcgtcgagtttcgcacacacaaagttatctacaggagatatgctggactgtttttttcaatatgtgtggacataactgataatgaattggcatacttggaatgcattcacttgtttgtcgagatattggaccatttctttagcaatgtttgtgagctcgatttagtgtttaattttcacaaggtttacctgatactagatgaatttattcttgctggggagctgcaagaaacaagcaaaaaggcaataattgagcgaatgggtgaactggagaagctggaatga

SEQ ID NO: 6687 - protein, 142 aa, Zea mays
MIRFILLQNRQGKTRLAKYYVPLEDSEKHKVEYEVHRLVVNRDPKFTNFVEFRTHKVIYRRYAGLFFSICVDITDNELAYLECIHLFVEILDHFFSNVCELDLVFNFHKVYLILDEFILAGELQETSKKAIIERMGELEKLE

SEQ ID NO: 6688 - DNA, 486 bp, Zea mays
  CDS (1)..(486)
atgattaatttcgtgctcctgatcagccgccagggcaaggtgaggctcaccaagtggtattctccttacacccagaaagagaggaccaaggtcattcgcgaactcagtggactcattcttacacgagggcccaaactctgcaattttgttgagtggagaggttacaaggtcgtataccggaggtatgctagcctgtatttctgcatgtgcattgatgccgaggacaatgagcttgaagtccttgagatcatccatcatttcgtcgagatactggaccgctattttggcagtgtatgtgagttggatttgatattcaattttcataaggcctactacatactggatgagattctcatcgctggtgaacttcaagaatctagcaagaagaatgttgcaagacttattgctgcacaggattcattggtcgaggctgctaaagaggaagccagctccataagtaacatcattgctcaggctacaaaatga

SEQ ID NO: 6689 - protein, 161 aa, Zea mays
MINFVLLISRQGKVRLTKWYSPYTQKERTKVIRELSGLILTRGPKLCNFVEWRGYKVVYRRYASLYFCMCIDAEDNELEVLEIIHHFVEILDRYFGSVCELDLIFNFHKAYYILDEILIAGELQESSKKNVARLIAAQDSLVEAAKEEASSISNIIAQATK

SEQ ID NO: 6690 - DNA, 501 bp, Zea mays
  CDS (1)..(501)
atgatccaggcggtgatggtgatcagcacccaggccaagccccgccttctcaagttctacagtttccagccacccgagaagcatcaggacctcgtccgctgtgtcttccaattactctctgcaaggcccgagagcgcgagcaattttgtcaaggtggactccatctttggcccgggaacaaaaatggtctacaagcatttggccacactatactttgtttttgtctttgatagctctgagaacgagcttgccatgctcgacctcgtacaagtgtttgttgaaacattggacagatgcttcaagaatgtatgcgagcttgacatcgtatttaacttcaacaagctgcacaccattttggatgagatgatatcggggggacaggtgatcgaaacaagttcagaacagataatgaaatctgtggaagagattgaaaggctggagaaacaatcgagcacaaccagcttcatacccaagtcgattacagagcgttttacccgttga

SEQ ID NO: 6691 - protein, 166 aa, Zea mays
MIQAVMVISTQAKPRLLKFYSFQPPEKHQDLVRCVFQLLSARPESASNFVKVDSIFGPGTKMVYKHLATLYFVFVFDSSENELAMLDLVQVFVETLDRCFKNVCELDIVFNFNKLHTILDEMISGGQVIETSSEQIMKSVEEIERLEKQSSTTSFIPKSITERFTR

SEQ ID NO: 6692 - DNA, 432 bp, Zea mays
  CDS (1)..(432)
atgacgatccggttcgtgctgttcgtcaacaagcagggccagacgcggctggcgcagtactacgagcacctctccctcgacgagcgacgggccctcgagggcgagatcgtccgcaagtgcctcgcccgcactgaccagcagtgttcgtttgtggagcaccggaactacaaggtcgtttacaggcgctacgcctcccttttcttcctcgtcggcgtcgacagcgatgagaatgagttagctatccttgaattcatacatcttctggtggaaactatggatcgccacttcggcaatgtgtgcgagctcgatatcatgttccatctggagaaagtgcacttcatgttggaagagatggtgatgaatggttgcattgtggagacaagtaaacagaacatcttggcaccaatacaacttatggagaaaacttcctaa

SEQ ID NO: 6693 - protein, 143 aa, Zea mays
MTIRFVLFVNKQGQTRLAQYYEHLSLDERRALEGEIVRKCLARTDQQCSFVEHRNYKVVYRRYASLFFLVGVDSDENELAILEFIHLLVETMDRHFGNVCELDIMFHLEKVHFMLEEMVMNGCIVETSKQNILAPIQLMEKTS

SEQ ID NO: 6694 - DNA, 429 bp, Zea mays
  CDS (1)..(429)
atgatccggttcatcctgctgcagaaccggcaggggaaaacacggctggccaagtactatgtcgctctcgaggactccgagaagcacaaggttgagtacgaggtgcatcggctcgtggtcaaccgggaccccaagttcaccaacttcgtcgagttccgcacgcacaaagttatatataggagatatgcaggactttttttctctatatgtgtggacatcaccgacaacgaattggcatacttggaatgtatccatctgtttgttgagatattggaccatttcttcagcaatgtgtgtgaacttgatttagtatttaatttccacaaggtttacttgatattggatgagttcattcttgctggagagcttcaagaaacaagcaaaagggcaattatagagaggatgggcgagcttgagaagctggaatga

SEQ ID NO: 6695 - protein, 142 aa, Zea mays
MIRFILLQNRQGKTRLAKYYVALEDSEKHKVEYEVHRLVVNRDPKFTNFVEFRTHKVIYRRYAGLFFSICVDITDNELAYLECIHLFVEILDHFFSNVCELDLVFNFHKVYLILDEFILAGELQETSKRAIIERMGELEKLE

SEQ ID NO: 6696 - DNA, 25 bp, Artificial sequence
  primer
atggcagtacagtttatactgtgct

SEQ ID NO: 6697 - DNA, 27 bp, Artificial sequence
  primer
ctagtctagtctatctaaaatacttag

SEQ ID NO: 6698 - protein, 218 aa, Artificial sequence
  consensus sequence
  Variant (3)..(4): Xaa in position 3 to 4 is any amino acid
  Variant (7)..(7): Xaa in position 7 is any amino acid
  Variant (9)..(9): Xaa in position 9 is any amino acid
  Variant (11)..(31): Xaa in position 11 to 31 is any amino acid
  Variant (32)..(56): Xaa in position 32 to 56 is any or no amino acid
  Variant (58)..(62): Xaa in position 58 to 62 is any amino acid
  Variant (63)..(64): Xaa in position 63 to 64 is any or no amino acid
  Variant (67)..(75): Xaa in position 67 to 75 is any amino acid
  Variant (76)..(115): Xaa in position 76 to 115 is any or no amino acid
  Variant (117)..(118): Xaa in position 117 to 118 is any amino acid
  Variant (121)..(121): Xaa in position 121 is any amino acid
  Variant (123)..(123): Xaa in position 123 is any amino acid
  Variant (125)..(128): Xaa in position 125 to 128 is any amino acid
  Variant (130)..(133): Xaa in position 130 to 133 is any amino acid
  Variant (134)..(134): Xaa in position 134 is any or no amino acid
  Variant (137)..(138): Xaa in position 137 to 138 is any amino acid
  Variant (140)..(141): Xaa in position 140 to 141 is any amino acid
  Variant (143)..(145): Xaa in position 143 to 145 is any amino acid
  Variant (148)..(149): Xaa in position 148 to 149 is any amino acid
  Variant (151)..(152): Xaa in position 151 to 152 is any amino acid
  Variant (154)..(155): Xaa in position 154 to 155 is any amino acid
  Variant (161)..(162): Xaa in position 161 to 162 is any amino acid
  Variant (164)..(166): Xaa in position 164 to 166 is any amino acid
  Variant (168)..(171): Xaa in position 168 to 171 is any amino acid
  Variant (172)..(182): Xaa in position 172 to 182 is any or no amino acid
  Variant (184)..(184): Xaa in position 184 is any amino acid
  Variant (186)..(193): Xaa in position 186 to 193 is any amino acid
  Variant (194)..(217): Xaa in position 194 to 217 is any or no amino acid
QGXXRLXKXYXXXXXXXXXXXXXXXXXXXXXXXXXXXXXXXXXXXXXXXXXXXXXXRXXXXXXXNFXXXXXXXXXXXXXXXXXXXXXXXXXXXXXXXXXXXXXXXXXXXXXXXXXYXXYAXLXFXXXXDXXXXXELXXLXXIXXXVEXXDXXFXXVCELDXXFXXXKXXXXXXXXXXXXXXXLXEXXXXXXXXXXXXXXXXXXXXXXXXXXXXXXXXE

SEQ ID NO: 6699 - protein, 9 aa, Artificial sequence
  protein pattern
  Variant (2)..(2): Xaa in position 2 is Lys or Arg
  Variant (3)..(3): Xaa in position 3 is His, Lys or Arg
  Variant (6)..(6): Xaa in position 6 is Gly, Ser or Thr
  Variant (8)..(8): Xaa in position 8 is Phe or Tyr
YXXYAXLXF

SEQ ID NO: 6700 - DNA, 1362 bp, Saccharomyces cerevisiae
  CDS (1)..(1362)
atgtttgatcttaagacgattctcgaccatcctaatatcccgtggaaattaatcatttctgggttctcgattgcccaattttctttcgaatcttacttgacgtacagacagtaccagaagctatctgaaacaaagttgccacctgtgctggaagacgaaattgatgatgaaacttttcataaatcaaggaactactcccgggccaaggccaagttctccattttcggtgacgtctataacctagcccaaaagctagttttcatcaaatacgacctcttccctaaaatctggcacatggccgtttctttattgaatgcagtcctgccagtcagatttcatatggtctccactgtcgcacagagtttatgcttcttgggtctcttatccagtttgtctaccttggttgatttgccactctcttactatagccattttgtcctggaagaaaaatttggtttcaataaattgaccgtccaactatggatcaccgatatgatcaagagtctgactttggcgtatgctattggtggcccaatcctttacctgttccttaagatctttgataaattccctactgatttcctttggtacattatggtcttcttgttcgttgtccaaatcttagccatgacaatcattccagtcttcatcatgcccatgtttaataagttcactccattggaggacggtgaactgaaaaaatctattgaaagtttggccgatagagttgggttccctctagataagatttttgtcattgacggctcaaaaagatcttctcattcaaacgcatatttcacaggtttgccattcacctccaagagaattgttttgttcgacactttagtgaacagtaattctactgatgaaattacggctgttttggcccatgaaatcggtcactggcaaaaaaaccacatcgttaatatggtcatctttagtcaattgcacaccttcctcattttctcccttttcaccagcatctacagaaatacatcattttacaacaccttcggctttttcttagagaagtccactggcagttttgttgatcccgttatcactaaggaattccccattatcattggatttatgttatttaacgacttattaactccactcgaatgtgccatgcaattcgtgatgagtttaatttccagaactcatgaatatcaagctgatgcttatgctaaaaaattgggctacaagcaaaatctatgtagggctctaattgatctacaaatcaaaaacctttccaccatgaatgtagatcctctgtattctagctatcattattcccatccaactctagctgaaagattgaccgctctagactatgttagtgaaaagaagaaaaactaa

SEQ ID NO: 6701 - protein, 453 aa, Saccharomyces cerevisiae
MFDLKTILDHPNIPWKLIISGFSIAQFSFESYLTYRQYQKLSETKLPPVLEDEIDDETFHKSRNYSRAKAKFSIFGDVYNLAQKLVFIKYDLFPKIWHMAVSLLNAVLPVRFHMVSTVAQSLCFLGLLSSLSTLVDLPLSYYSHFVLEEKFGFNKLTVQLWITDMIKSLTLAYAIGGPILYLFLKIFDKFPTDFLWYIMVFLFVVQILAMTIIPVFIMPMFNKFTPLEDGELKKSIESLADRVGFPLDKIFVIDGSKRSSHSNAYFTGLPFTSKRIVLFDTLVNSNSTDEITAVLAHEIGHWQKNHIVNMVIFSQLHTFLIFSLFTSIYRNTSFYNTFGFFLEKSTGSFVDPVITKEFPIIIGFMLFNDLLTPLECAMQFVMSLISRTHEYQADAYAKKLGYKQNLCRALIDLQIKNLSTMNVDPLYSSYHYSHPTLAERLTALDYVSEKKKN

SEQ ID NO: 6702 - DNA, 1278 bp, Oryza sativa (japonica cultivar-group)
  CDS (1)..(1278)
atggcgcttccttacctggaggccgtgctgtgctttatgattctcatgtatatatttgagacatatcttgacatccgtcagcatagagcccttaagttgccaacactgccaaaacccctggtaggagtaattagtggtgaaaagtttgagcgctccagagcttatagccttgataaaagcaaattccattttatccatgaagctgtaactatattaatggataccacaattctgtactatagagttcttccctgggtttggaagaaatctggagagctagcaaccaatgctggcctaaatgctgaaaatgagatactacacactcttgcattcttagcaggtgtcatgatttggtcacagatcacagacttaccattctctctttattcaacatttgttattgaagctaaacatggttttaacaagcaaactatttggctcttcattagggacatgatcaaagggattttgctatccatcttacttggacctcctattgtggctgctattatcatcatagtacagaatggagggccctacctggcaatatatctatggggttttatgtttgcattatctcttgtgatgatgacaatataccccatcgtgatagcacctctgttcaacaaattcactccgcttccagaaggagtactcagagagaaaatagagaaattagcagcttcactcagttttccattgaaaaagcttttcgtggtggatgggtctaccagatcaagccacagtaatgcttacatgtatgggtttttcaagaacaagcgcattgttctctatgacacgttgattcagcagtgtagtagtgaggatgaaatagtttctgttattgcacatgaacttgggcactggaaactcaaccacactgtgtattcctttgtagctgtccagctccttatgttcctacaatttggaggatatacgctagtaaggaactccaaagacctttttgaaagttttggtttcgaggatcagcctgtaataattgggctgatcatatttcagcacactataatacctgtccagcaccttctgagtttttgtctgaaccttgtcagtcgggcatttgaatttcaggctgatgcttttgccaagaaccttgggtatgctcctcagctccgtgcagcccttgttaaactacaggaagagaacttatctgcaatgaacacagatccgtggtattcagcctaccactactcccatccaccccttgttgaaaggctctctgctcttgaagacgcagacagcaaaaaggaaaactaa

SEQ ID NO: 6703 - protein, 425 aa, Oryza sativa (japonica cultivar-group)
MALPYLEAVLCFMILMYIFETYLDIRQHRALKLPTLPKPLVGVISGEKFERSRAYSLDKSKFHFIHEAVTILMDTTILYYRVLPWVWKKSGELATNAGLNAENEILHTLAFLAGVMIWSQITDLPFSLYSTFVIEAKHGFNKQTIWLFIRDMIKGILLSILLGPPIVAAIIIIVQNGGPYLAIYLWGFMFALSLVMMTIYPIVIAPLFNKFTPLPEGVLREKIEKLAASLSFPLKKLFVVDGSTRSSHSNAYMYGFFKNKRIVLYDTLIQQCSSEDEIVSVIAHELGHWKLNHTVYSFVAVQLLMFLQFGGYTLVRNSKDLFESFGFEDQPVIIGLIIFQHTIIPVQHLLSFCLNLVSRAFEFQADAFAKNLGYAPQLRAALVKLQEENLSAMNTDPWYSAYHYSHPPLVERLSALEDADSKKEN

SEQ ID NO: 6704 - DNA, 1188 bp, Campylobacter jejuni subsp. jejuni NCTC 11168
  CDS (1)..(1188): transl_table=11
atgactttaattgcaattttatgtctttacacagcacttttatcttggatttcctatgctcaaattcgtttcttagaaagagaaaaagacaaacaagctcaaattttaagcgaaaaagactatcaaaatgcagcagatattgccatcgaaaatgaaaaatttaaactattttccaatttttataatttaatcatcagtattgcatggataggttttggatttttataccttaaagaattacttatcttaaacaacactcgttttgaaaatactttatttttattatcttttttaataatcacaagtattttaaatctacctttaagtatttatgaaagttttatcaaagataaagcccatggtttttcaaatatgactgtaaaactttttatcaaagatactatgaaaagtcttattttaactttaatatttggatttttaatcctttatactttgcttttttgctatgatttttttggaactttttggtggattgcggcctttatttttgccttttgtattatagtgattataaatctcatctaccctaccttaatagcacctatttttaataaaatgaaaaaactagacgatgaaaatttgctgaaaaaaatcagctctttgatgaaacaatgtgggtttagtgcaaatggggtttatgttattgatgcaagcaaaagagataagcgtttaaatgcttattttggtggactttttaaaagcaaaagagtggtgctttttgatacattattaaaagccttaaatgaaagagaacttttagctgttttaggacatgagcttggacattttgttcataaggatattatcaaagctttatttaacggcgctataactatgtttttacttttttttgtttttgcaaatttacctgaatttgtttacttagaaagtcatctagaaggagtaaatggtggcgtgtttgctcttttgtttatcttggcgaatatttttagctttttaatctctcctatgcttaatgccttaagtagaaaaaatgaatttgcagctgatcaacacggagctaaagttacaagcaaagaagatatgaaaaatgcattgatagctctagcaagagaaaataaagcttttatcaaaacaagtaaaatatatacatttttttatctcagtcatccaagtattagtgatagaatcaaggctctttcttga

SEQ ID NO: 6705 - protein, 395 aa, Campylobacter jejuni subsp. jejuni NCTC 11168
MTLIAILCLYTALLSWISYAQIRFLEREKDKQAQILSEKDYQNAADIAIENEKFKLFSNFYNLIISIAWIGFGFLYLKELLILNNTRFENTLFLLSFLIITSILNLPLSIYESFIKDKAHGFSNMTVKLFIKDTMKSLILTLIFGFLILYTLLFCYDFFGTFWWIAAFIFAFCIIVIINLIYPTLIAPIFNKMKKLDDENLLKKISSLMKQCGFSANGVYVIDASKRDKRLNAYFGGLFKSKRVVLFDTLLKALNERELLAVLGHELGHFVHKDIIKALFNGAITMFLLFFVFANLPEFVYLESHLEGVNGGVFALLFILANIFSFLISPMLNALSRKNEFAADQHGAKVTSKEDMKNALIALARENKAFIKTSKIYTFFYLSHPSISDRIKALS

SEQ ID NO: 6706 - DNA, 1257 bp, Ralstonia solanacearum GMI1000
  CDS (1)..(1257): transl_table=11
atgcccaccttcaccgccgtcttcctgatcgccctcgtgctgatggccgccacacgcctgtggctggccgcccggcagatccgccacgtggcgcgccaccgtgacaccgtgcccgcgcagttcgccgaatccatcacactggacatgcaccacaaggccgccgactacaccatcgcccgcacgcgcctggcgatgctggaagtccccgtgcaggccacgctgctgatcgcgctgacgctgctgggcgggctgaacgggctcaaccaggcctggctgtccgccttcggccccggctacgcgtatggcgtggccctgatcgcctcggtcatcgccatcagcagcctgatcgagctgccgttctcgctgtacagccagttcgtcgtcgaagagcgcttcggcttcaaccgcatgacctggaagctgtggctggccgacaacctcaaggggctggccatcggcaccgcgctggggctgccgctgctgctggcggtgctgtggctgatgcactcgatgggcgagcgctggtggctgtacacctggctggtgtggatggccttcacgctgttcgtccaggcgatctaccccaacgtgatcgccccgctctacaacaagttcaccccgctcgaggacggcgagatgcgcacgcgcatcgagggcttgctcaagcgctgcggctttgccagcaagggcctgttcgtgatggacggcagccgccgcagcgcccacggcaacgcctatttcagcggcttcggcgccaccaagcgcatcgtcttcttcgacacgctgctcgcgcggctggatgcccccgagatggaagccgtgctggcgcatgagctgggccatttcaagcgccaccacgtcaccaagcgcatcgccgtgatgttcgtgctgagcctggggctgctggccctgctcggctggctgatgacgcgcgcgtggttctacctgggcctgggcgtggcgcccaacctgctcgccgacaaccatgcgctggcgctgatgctgttcttcctggtactgccggtcttcatgttcttcgtctcgccgctgtcgagcctgtcgtcccgcaagcacgagttcgaggcggatgccttcgcggcgcagcatgccgatgcgtcgcgcctggtctcggcgctggtcaagctgttccaggacaatgcttcgaccctgacgcccgacccggtctactcggcgttctactactcccaccccaccgcgtcgcagcgcgtggcacgactggtgcaggctgccgcatga

SEQ ID NO: 6707 - protein, 418 aa, Ralstonia solanacearum GMI1000
MPTFTAVFLIALVLMAATRLWLAARQIRHVARHRDTVPAQFAESITLDMHHKAADYTIARTRLAMLEVPVQATLLIALTLLGGLNGLNQAWLSAFGPGYAYGVALIASVIAISSLIELPFSLYSQFVVEERFGFNRMTWKLWLADNLKGLAIGTALGLPLLLAVLWLMHSMGERWWLYTWLVWMAFTLFVQAIYPNVIAPLYNKFTPLEDGEMRTRIEGLLKRCGFASKGLFVMDGSRRSAHGNAYFSGFGATKRIVFFDTLLARLDAPEMEAVLAHELGHFKRHHVTKRIAVMFVLSLGLLALLGWLMTRAWFYLGLGVAPNLLADNHALALMLFFLVLPVFMFFVSPLSSLSSRKHEFEADAFAAQHADASRLVSALVKLFQDNASTLTPDPVYSAFYYSHPTASQRVARLVQAAA

SEQ ID NO: 6708 - DNA, 1275 bp, Arabidopsis thaliana
  CDS (1)..(1275)
atggcgattcctttcatggaaaccgtcgtgggttttatgatagtgatgtacatttttgagacgtatttggatctgaggcaactcactgctctcaagcttccaactctcccgaaaaccttggttggtgtaattagccaagagaagtttgagaaatcacgagcatacagtcttgacaaaagctattttcactttgttcatgagtttgtaactatacttatggactctgcaattttgttctttgggatcttgccttggttttggaagatgtctggagctgttttaccgaggttgggccttgatccagagaatgaaatactgcatactctttcattcttggctggtgttatgacatggtcacagatcactgatttgccattttctttgtactcaactttcgtgatcgagtctcggcatgggttcaacaaacaaacaatatggatgttcattagggacatgatcaaaggaacattcctctctgtcatactaggcccacccattgttgctgcgataattttcatagtccagaaaggaggtccttatcttgccatctatctgtgggcattcatgtttatcctgtctctagtgatgatgactatatacccggtcttgatagcaccgctcttcaacaagttcactcctcttccagatggagacctccgggagaagattgagaaacttgcttcttctctaaagtttcctttgaagaagctgtttgttgtcgatggatctacaaggtcaagccatagcaatgcttacatgtatggtttctttaagaacaaaaggattgttctttatgatacgttgattcagcagtgcaagaatgaggatgaaattgtggcggttattgcacacgagcttggacattggaaactgaatcacactacatactcgttcattgcagttcaaatccttgccttcttacaatttggaggatacactcttgtcagaaactccactgatctcttcaggagtttcggatttgatacacagcctgttctcattggtttgatcatatttcagcacactgtaataccactgcaacatctagtaagctttggcctgaacctcgttagtcgagcgtttgagtttcaggctgatgcttttgctgtgaagcttggctatgcaaaagatcttcgtcctgctctagtgaaactacaggaagagaacttatcagcaatgaacactgatccattgtactcagcttatcactactcacatcctcctcttgttgaaaggcttcgagccattgatggagaagacaagaagacagattaa

SEQ ID NO: 6709 - protein, 424 aa, Arabidopsis thaliana
MAIPFMETVVGFMIVMYIFETYLDLRQLTALKLPTLPKTLVGVISQEKFEKSRAYSLDKSYFHFVHEFVTILMDSAILFFGILPWFWKMSGAVLPRLGLDPENEILHTLSFLAGVMTWSQITDLPFSLYSTFVIESRHGFNKQTIWMFIRDMIKGTFLSVILGPPIVAAIIFIVQKGGPYLAIYLWAFMFILSLVMMTIYPVLIAPLFNKFTPLPDGDLREKIEKLASSLKFPLKKLFVVDGSTRSSHSNAYMYGFFKNKRIVLYDTLIQQCKNEDEIVAVIAHELGHWKLNHTTYSFIAVQILAFLQFGGYTLVRNSTDLFRSFGFDTQPVLIGLIIFQHTVIPLQHLVSFGLNLVSRAFEFQADAFAVKLGYAKDLRPALVKLQEENLSAMNTDPLYSAYHYSHPPLVERLRAIDGEDKKTD

SEQ ID NO: 6710 - DNA, 1233 bp, Encephalitozoon cuniculi GB-M1
  CDS (1)..(1233)
atgaaaggaagttttttgttgggcatctctataatgagctatctctttgtggtttacctgaaagtccgcgagctaagacagctatccaagccaccatccaaggtataccttaagctaacaacactcgagcaggtaaagaaaaccaaggcgtataacagagacaagctaatcatgtcgatctttgagcttactcttcttcttatgagagacctttatctgatcaaaaggggagtgcttgagaatgtgtacaccaagcactttatgggcagctggtacggagatgccttgttcttggtgggatatgctcatctccagaggctttttgacctcccacttggagttatttcgacgttttacatcgaggctaagcatggatttaacaagacaacactctcgacatttttgatggatttcctgaagatgtcacttataatcacggttctattcgggcctttttcttatgtttcaacaaacatcatcaagaagtactataagacgtctttctacatctatctgtgggtcttcatggctgttttccagatagggctcgtcatcgtatatccgattgccattcaacctctgttcaacaagtttgaggagatggaggagtccaatctcaagacaaagatcgagaagttggctgaaagggttggaatttgtgccaagaagatactggtaatggatgcatcgaagaggtctgggcattctaatgcctacttcataggacttaccaaggaaaaaaggattgtgatatacgacactttgctgaaacaagtggatgaggaggaaactcttgctattctatgtcacgagcttggacattggaagcataaccatgttgtaaagatgacatcccttgtccttctcatccagctgctgtatctgtatgtattgaatgtttcattgaactccaaactctttggggatgttgtgttaggaaaagatctgccgttgctgataagatgcatctacttccttatggtaattggggccttcagtgttcccgttgatgtgctaaggaatttcatatccaggtactttgaagcccaggcagacaggttttctgtgtcacttggatatgggaaagagctttcgtctgggctggtcaagcttttcgaaaagaacagcagcaacatggagccggatccgctttatgcagcaattgttcatacacatcccaccgtgattgagagaatcaaactgattgaggatgagatgaataaaaccaagtag

SEQ ID NO: 6711 - protein, 410 aa, Encephalitozoon cuniculi GB-M1
MKGSFLLGISIMSYLFVVYLKVRELRQLSKPPSKVYLKLTTLEQVKKTKAYNRDKLIMSIFELTLLLMRDLYLIKRGVLENVYTKHFMGSWYGDALFLVGYAHLQRLFDLPLGVISTFYIEAKHGFNKTTLSTFLMDFLKMSLIITVLFGPFSYVSTNIIKKYYKTSFYIYLWVFMAVFQIGLVIVYPIAIQPLFNKFEEMEESNLKTKIEKLAERVGICAKKILVMDASKRSGHSNAYFIGLTKEKRIVIYDTLLKQVDEEETLAILCHELGHWKHNHVVKMTSLVLLIQLLYLYVLNVSLNSKLFGDVVLGKDLPLLIRCIYFLMVIGAFSVPVDVLRNFISRYFEAQADRFSVSLGYGKELSSGLVKLFEKNSSNMEPDPLYAAIVHTHPTVIERIKLIEDEMNKTK

SEQ ID NO: 6712 - DNA, 1248 bp, Chlorobium tepidum TLS
  CDS (1)..(1248): transl_table=11
atgatgatgaacctgttcggccaaatcattctttttacgcttatcggcacctggctcatcaaacttgccgccgatcttttgaaccttcgtgctgcgtcgccgacgcttcctgaggcgtttcgcgacgtgtatgatccggcggactatcgccgttcgcaggagtacctccgggccaacaccaaattctcacttatcagctcgactttcgatctcgccctgctgctcgttttctggttcgcgggcggcttcaacgcgctcgaccagcttattcgcgcctggggtttcgatccggtcatcaacggcgtgctctacatcggcgcgctgctgttgcttcaaagcgttgccgacctgccgttcagcatctaccacaccttcgtgctcgaagagcgcttcggcttcaaccagaccacgccgaaggtgttcgtaattgatctcatcaagacgcttctgcttgccgtgctgatcggcacaccggtgctggcggcgatcctctggtttttccagagtgccgggccgctcggctggctctgggcgtgggggggcgtgacagcgttcagtctgcttctgcaatatgttgcgccgacctggatcatgccgatgttcaacaagttcgagccgctcgaagatggcgagcttcgcaagtcgatcatggattacgctgccgaggtgcgctttccgctcaccggaatctacgtcatggacggctccaaacgctcggcgaagggcaacgcctttttcaccggattcggcaagaacaagcgcatcgtgctgttcgacacgctcatcaaaaaccactcgaccggcgagctggtcgccgtgctggcccatgaaatcggccacttcaagaagaagcacattttcatgtcgatggggctcagtatgctcaacctcggcgtggttttttacctgctctcactcttcatgaacaaccggatgctctttgatgccttcgccatgcaggagacttcggtctatgcgagcctgcttttcttcatgctgctctacaatccggtggagttcatcatttcgatcctgatgcagatgctctcgcggcgcaacgaattcgaggccgacaactacgccgtgaagacgtaccggaacggcgcattgctggctgacgcgctcaagaagctttcgcggcagaacctctcgaacctgacgccgcacccgtttaacgtcttcctgaactactctcatccgccggtgttgcagcgtgttgaaaggatcgaagcggcggcccggcactga

SEQ ID NO: 6713 - protein, 415 aa, Chlorobium tepidum TLS
MMMNLFGQIILFTLIGTWLIKLAADLLNLRAASPTLPEAFRDVYDPADYRRSQEYLRANTKFSLISSTFDLALLLVFWFAGGFNALDQLIRAWGFDPVINGVLYIGALLLLQSVADLPFSIYHTFVLEERFGFNQTTPKVFVIDLIKTLLLAVLIGTPVLAAILWFFQSAGPLGWLWAWGGVTAFSLLLQYVAPTWIMPMFNKFEPLEDGELRKSIMDYAAEVRFPLTGIYVMDGSKRSAKGNAFFTGFGKNKRIVLFDTLIKNHSTGELVAVLAHEIGHFKKKHIFMSMGLSMLNLGVVFYLLSLFMNNRMLFDAFAMQETSVYASLLFFMLLYNPVEFIISILMQMLSRRNEFEADNYAVKTYRNGALLADALKKLSRQNLSNLTPHPFNVFLNYSHPPVLQRVERIEAAARH

SEQ ID NO: 6714 - DNA, 1305 bp, Nitrosomonas europaea ATCC 19718
  CDS (1)..(1305): transl_table=11
atgatatttcaggaacttaatttttcagacagttttatgcacacttttacccttgtttttattcttgcattgatattgaccacgctggctcaatggtggcttgctgcccgacacatacgtcatataacggcacaccgcaatcaggttccggatgcatttgtctcgcagatcgatttagctgctcaccagaaagcggcagattatacttgtgccaaggcacgcttgagtttcccgggaattctgctccacgccggtttgttgctggtacttacgctgggtggtggactggagtggctgtccggtttctggcacacctggttcagtgattcgctgtggcatgggatggtactcattttcagcgtagtagccctgttgagtatagtggaaatccccttcagttattaccgcacattcgtaatcgagcagcagtacgggttcaacaagatgactcgagccatgttttttgctgatcttgtcagaaagtatgtgttgggcacattgctgggagcgccactgctgttgagtgtcctgtggttgatggagaaagccggggatagctggtggctttatacctggctgatctggataggtttcaatctgtttctgctggcagtttaccctaactggatcgcaccgctgttcaacaagttctcaccgctggagaacgattcactcaaaactcgtattgaaaatctgctgcagaagtgtggtttcgaatccagcggattgttcgtcatggatggttcccgccgcagcagtcatggaaatgcctattttacgggttttggcaaaaccaaacgcatcgtgttcttcgatacgttgctgaatcgtctggaggctgaggaaatcgaagcagtattggcgcatgaactgggccatttcaagcgtcatcatgtaatcaagcggatcgtgctgtcgtttgcagtcagcctgctgtttctgtgggtgctgggttatctgatgcagcagccatggttttatcaggggctgggtgttcaggtgactgcggtgccttcgactgccatggcgctgctgctgttttttctggtgatgccggtattcacctttctgctgcatccactatccagtatctattcacgcaaacatgagttcgaagcagatgaatacgcggccgaacaggcttctgctgcagacatgattcgggcactggttaaactgtatcaggacaacgctgccacactgacccccgatccgctgcattcggctttttatgattcccacccgccagcggcaatccgggtggctcatctcaagaaattgattacgacaggagctgaggtatga

SEQ ID NO: 6715 - protein, 434 aa, Nitrosomonas europaea ATCC 19718
MIFQELNFSDSFMHTFTLVFILALILTTLAQWWLAARHIRHITAHRNQVPDAFVSQIDLAAHQKAADYTCAKARLSFPGILLHAGLLLVLTLGGGLEWLSGFWHTWFSDSLWHGMVLIFSVVALLSIVEIPFSYYRTFVIEQQYGFNKMTRAMFFADLVRKYVLGTLLGAPLLLSVLWLMEKAGDSWWLYTWLIWIGFNLFLLAVYPNWIAPLFNKFSPLENDSLKTRIENLLQKCGFESSGLFVMDGSRRSSHGNAYFTGFGKTKRIVFFDTLLNRLEAEEIEAVLAHELGHFKRHHVIKRIVLSFAVSLLFLWVLGYLMQQPWFYQGLGVQVTAVPSTAMALLLFFLVMPVFTFLLHPLSSIYSRKHEFEADEYAAEQASAADMIRALVKLYQDNAATLTPDPLHSAFYDSHPPAAIRVAHLKKLITTGAEV

SEQ ID NO: 6716 - DNA, 1227 bp, Helicobacter hepaticus ATCC 51449
  CDS (1)..(1227): transl_table=11
ttgttacatactctcattatttttgttggcttgtttatctgtgcttatgccttgccaagtattattttagctattttacaaatacgtcatattaaagctgaattacaaaaacctgccattttgttagaatctgaggattaccaccaagcaggagagtatgctattgcttcattacgtcttgatataataaatcgtgtccttgaaattattacttttattctatgggtaagttttggctttagcttacttcaaaaacaacttgatatatttatgccacattctttgaatcctatatggcaaagtgtggctttagtgcttagttttatgcttataagcagtatcattgaattacccttatctatttataaaacttttgggcttgataagaaatttggattctccaaacaaacaccgaaactttttattattgatttatataaacattttcttttgagtttaattgttggtggtttgattgtatttttgctcatttttatcattgaaaaagttgtattatggtggattgtgggctttatcgttctgcttagtgtagttattctagctaattttgtttatcctacactcattgctccactttttaataaattcactccccttgatgatgaaaacctcaaagctcgcatagaatccttactcaacaccataggttttaaaagtaatggtatttttgttattgacgcttctcggcgcgatggacgacttaatgcttattttggtggacttggcaaaaataaaagagtggtgctttttgatactttgcttgataaaattagtgctgatggcttaattgcgattttaggacacgaactcgggcatttcaaacacaaagacatacttaaaaacattgcaattatggcgtgtgtgctttttgtgctcttttttattgtaggacatttacctccacaactctttgacgcactgagtttggcacataatggtgcagggatacttatcgtaatgctccttatttcacctatgattgctttttggtttatgcctttaattggttattttagtcgtgaggcagaatacgcagctgatgaatttggagcgaatctttcaagcaaacattgccttgctgatgctctagtatgtcttgtgaatgaaaataaaagctttccaagctctcaccctgcttatattttcttctactatactcacccaccactactgcaacgacttaaagcattagattatgatatgtag

SEQ ID NO: 6717 - protein, 408 aa, Helicobacter hepaticus ATCC 51449
MLHTLIIFVGLFICAYALPSIILAILQIRHIKAELQKPAILLESEDYHQAGEYAIASLRLDIINRVLEIITFILWVSFGFSLLQKQLDIFMPHSLNPIWQSVALVLSFMLISSIIELPLSIYKTFGLDKKFGFSKQTPKLFIIDLYKHFLLSLIVGGLIVFLLIFIIEKVVLWWIVGFIVLLSVVILANFVYPTLIAPLFNKFTPLDDENLKARIESLLNTIGFKSNGIFVIDASRRDGRLNAYFGGLGKNKRVVLFDTLLDKISADGLIAILGHELGHFKHKDILKNIAIMACVLFVLFFIVGHLPPQLFDALSLAHNGAGILIVMLLISPMIAFWFMPLIGYFSREAEYAADEFGANLSSKHCLADALVCLVNENKSFPSSHPAYIFFYYTHPPLLQRLKALDYDM

SEQ ID NO: 6718 - DNA, 1266 bp, Bordetella bronchiseptica RB50
  CDS (1)..(1266): transl_table=11
gtgaccgcacccgtgccccttttcacgcttttcttcgttgtcctgctgctggccgatatcggcgtgcgcctgtggctggccacccgccagatccgccacgtggcggccaaccgccagtccgtcccgcccgagttcgccccgcgcatcgggctgcacagccaccagcgcgcggccgactacaccgtggcgcgcgtgcgcctgggcatgctcgaacgcgtctacgacgcggccatcctggtggcgctgacgctgctgggcggcctgcagttcatcgacctgtggctggggcagctgacccagcacgacttcctgcgccaattgctgctgctggcctgcgtgccgctgttgctgggcctgctcggcctgcccttcaccctgtggcggcaattccgcctggaggggcgcttcggcttcaaccgcatgacgcccgccctgtttttcagcgatgccgtcaagggcgtgctggtggccctggtcctgggcctgccgctggccgccgccgtgctgtggctgatggccggcgccggcgcctactggtggctgtgggcctggggcctgtggctgggctacaacctgctgctgctgctcatctatcccaccttcatcgcgccgctgttcaacaagttcaccccgctcaacgaccccgaactggccggccgcatccgccagttggcgcagcgctgcggctttgccctgaacgggctgttcgtgatggacggctcgcgccgctcggcccacggcaacgcctacttcaccgggttcggcaaatcgcgccgcatcgtcttcttcgataccctgctcgcgcgcctgaacggcgacgagatcgaagcggtgctggcccacgagctgggccacttcgcgcgccgccacatcatcaagcggctggcgctcagctttgccggcgcgctggtcttcttcgccgcgctgggctggctggcccgccagccctggttctacgaaggactgggcgtcctgcccaacctgggcggacgcaacgacgccatggcgctggtgctgttcttcctggtcgtgccggtgttcaccttcatgctgaccccgctggccagctggtactcgcgccgcgacgaattcgaggccgaccgctacgccgcggcccagagttcgccggatcggctggtatcggcgctggtcaaactgtacgatgacaacgccgccaccctgacgcccgatcctgtgcactccgccttctacgacagccatcctccagccgcggtacgcatccgccacctgatggcgggcgcatga

SEQ ID NO: 6719 - protein, 421 aa, Bordetella bronchiseptica RB50
MTAPVPLFTLFFVVLLLADIGVRLWLATRQIRHVAANRQSVPPEFAPRIGLHSHQRAADYTVARVRLGMLERVYDAAILVALTLLGGLQFIDLWLGQLTQHDFLRQLLLLACVPLLLGLLGLPFTLWRQFRLEGRFGFNRMTPALFFSDAVKGVLVALVLGLPLAAAVLWLMAGAGAYWWLWAWGLWLGYNLLLLLIYPTFIAPLFNKFTPLNDPELAGRIRQLAQRCGFALNGLFVMDGSRRSAHGNAYFTGFGKSRRIVFFDTLLARLNGDEIEAVLAHELGHFARRHIIKRLALSFAGALVFFAALGWLARQPWFYEGLGVLPNLGGRNDAMALVLFFLVVPVFTFMLTPLASWYSRRDEFEADRYAAAQSSPDRLVSALVKLYDDNAATLTPDPVHSAFYDSHPPAAVRIRHLMAGA

SEQ ID NO: 6720 - DNA, 1248 bp, Chromobacterium violaceum ATCC 12472
  CDS (1)..(1248): transl_table=11
atgaccgaggctttctccctactgttcgccgccgcgctgacgctaaccctatgcctgaagctttggctgggctggcgccatatccgacacatcgcccgccatcgcgaccaggttccggcggccttccgcgacagcatcaccttggagcagcaccggcacgccgccgactacaccatcgccaagaccaagctgggcctgctgtccgcctgggtggacaccgcgctgatcgcggctttcactttcggcggtggattgcaatggctggccgtccacagcatgcaatggctcgccaacccgctgctgtcgggcatggcgctgatcgtgtcggtcgccgtgatcagcagcttggtttcgctgcccttcactctgtacggcaccttcggcattgaaagccgcttcggcttcaataagaccaccatcgcgctgttcatggccgacatgatcaagggcgctctggtcggcgcggcgatcggcctgcccttgctggcgctggtgctgtggctgatggagatctccggcccgctgtggtggctgtgggtatggctggtctggtccggcttccagttgctgatggtcgcgttgtacccgacgctgatcgcgccgctgttcaacaagttcaaaccgctggaggatgagatgctcaaaacccgcattgaagccttgctccagcgcgccggcttcaaaagccagggcgtgttcgtgatggacggctcgcgccgctccagccacggcaatgcctacttcaccggcttcggctccgccaagcgcattgtgttcttcgacacgctgctatcccagctcagccacgccgagatcgaagcggtgctggcgcacgagctgggccacttcaagcgccgccacatcgtcaagcgcatcgccttggccttcgccttgtctctggccttgctgtggctgctgggccaattgctgcatgcgccatggttctacgccggcctcggcgtcgccgcgcccagcacggcgatggcgctgatcctgttccttaccgcgacgccggccttcactttcccgctgacgccgctgtccagccggatgtcccgcgtccatgaatacgaggccgacgatttcgcgtcggaacagacccgggcggacgacctggtcagcgccttggtcaagctgtaccgcgacaacgcgtccacgctgacgccggaccccatccattccgccttctacgattcgcacccgccagcggcgctgcgcatccaacacctgaaaggaaaccacgcatga

SEQ ID NO: 6721 - protein, 415 aa, Chromobacterium violaceum ATCC 12472
MTEAFSLLFAAALTLTLCLKLWLGWRHIRHIARHRDQVPAAFRDSITLEQHRHAADYTIAKTKLGLLSAWVDTALIAAFTFGGGLQWLAVHSMQWLANPLLSGMALIVSVAVISSLVSLPFTLYGTFGIESRFGFNKTTIALFMADMIKGALVGAAIGLPLLALVLWLMEISGPLWWLWVWLVWSGFQLLMVALYPTLIAPLFNKFKPLEDEMLKTRIEALLQRAGFKSQGVFVMDGSRRSSHGNAYFTGFGSAKRIVFFDTLLSQLSHAEIEAVLAHELGHFKRRHIVKRIALAFALSLALLWLLGQLLHAPWFYAGLGVAAPSTAMALILFLTATPAFTFPLTPLSSRMSRVHEYEADDFASEQTRADDLVSALVKLYRDNASTLTPDPIHSAFYDSHPPAALRIQHLKGNHA

SEQ ID NO: 6722 - DNA, 1245 bp, Geobacter sulfurreducens PCA
  CDS (1)..(1245): transl_table=11
atgactttgacgatcctcgcctgttacctcgcggtcctcaccttcgagcatctgctccgcataatgaacctcaaacatctcaggcgccagggtacaacggtccccgatggcttcgccggcgcggtggatgaagggagccttcgcactgcaactgcctataccctcgaccggagtcgcctggggattgcggaatcactggtcgacagcggcctccttgtcgggtttctcttcgcggggatccttcctctcttcgaccgctgggttgcctcgctgacctcctcgttcatcctcgggggtgtcgtcttctttctgcttctctccctcgttcagagtgcactggcgatccccttcggactctatgaaacattcgtcattgagcgtcggtacggctttaccaccataacgccgaagctctggtggtccgacctgcttaagtcgacatgtatttcaatgacgcttgccacgctcatgatttccggcgctttcgccctggttgcatggagtcccctgcactggtggctctgggtctggggctttctcgcgtttctgaccctgtttctcatgtacctctcaccgtatgtcatcgagccgttgttcaaccgctacgagccggtgaagaccgaagggctggaagaagagatccgtgccatggccgagcgggccggactcagggtgagccgggttatgcaggtggatgcctcccggcgcagccgccactccaatgcctactttaccggcatcggccgggtgaagcgcatcgtgctgtacgatacgctgctgggccagatgacccacgcggagattctggcggtcctggcccatgagatcggccactggaagctcggacacatccgccggaggcttattgccggtcaggcaggtgcccttgccgctgcctggctggcgtggcgggtcacatcatgggaggggctgcccggacttctcgggatgacggaggcgacgtttccggcccggctcgtgatcgtcggcttcatcggtaccttggcgctctttccgctcacgcccctgtttgcctggttgtcgcgccggcaggagcgggaggccgaccgattcgcagtggagctctgcgaaaatcccgcatcgctcgctacggcgctggttaaactttcccgggaaaatctctccaatctccatccgcaccccctctacgcagcatttcactattcccacccgccggtggttgaacgggtgcaagggctgctggcgctggcgcgaaaagaatga

SEQ ID NO: 6723 - protein, 414 aa, Geobacter sulfurreducens PCA
MTLTILACYLAVLTFEHLLRIMNLKHLRRQGTTVPDGFAGAVDEGSLRTATAYTLDRSRLGIAESLVDSGLLVGFLFAGILPLFDRWVASLTSSFILGGVVFFLLLSLVQSALAIPFGLYETFVIERRYGFTTITPKLWWSDLLKSTCISMTLATLMISGAFALVAWSPLHWWLWVWGFLAFLTLFLMYLSPYVIEPLFNRYEPVKTEGLEEEIRAMAERAGLRVSRVMQVDASRRSRHSNAYFTGIGRVKRIVLYDTLLGQMTHAEILAVLAHEIGHWKLGHIRRRLIAGQAGALAAAWLAWRVTSWEGLPGLLGMTEATFPARLVIVGFIGTLALFPLTPLFAWLSRRQEREADRFAVELCENPASLATALVKLSRENLSNLHPHPLYAAFHYSHPPVVERVQGLLALARKE

SEQ ID NO: 6724 - DNA, 1545 bp, Magnaporthe grisea 70-15
  CDS (1)..(1545)
atgcctactcctttggacaacgcaatgaagtcaaagaatgctattctcgcattcacgggtttggtaaccggtgccgccgtctgggccatctggggcggtgatatgtttcccaaggagtccgatcccaaaggcgacccggatacgtggacgcatgaagagatgagaagatggcttgctgctcgtctcgcgcggttcttggaccgtccgctatttccctggaagaagctgatcgttggcttctccctcgcccactacttcttcgaaagcttcttgtctctccgccagtaccaggtcctccaaaagaccaagcctcccaaagttctcgagcagcaaatctcgcaggaagtctttgacaagagtcaggcttatggtcgcgcaaaggccaagtacggtttcgtcagcaagctttggggccagatccagaacatcgcctttatacaatatgacgtcctgcccaagctttgggcgtggtcgggtagactgctgctcagctatgcgcctgcccgcttcaccggagaaatctcgcagtccatcgtcttcgtcctcgccttcgtcatgatccaacaggttctctcgctgcccacctcgatctatcacaccttcgtcctcgaggagaagttcggattcaacaagcaaacccccaagctcttcatcacggatctcatcaagtctcagctgctcaccgtcgtccttaccccgcccatcctggctggtttcctcaagatcatccaaaagactggtgaccagttcttctactacctctggatgttcggtgccttcctccaggtcttcatgattaccgtctacccgatcgccattctgcctctgtttaacaagctgtctccgctggaacctggcgagctcaagacaggagtcgaggctttggccaagaggctcaactttccgctgcacgagctctatgtgattgatggtagcaagcgctctgctcacagcaacgcctatttctttggcctgccgtggaagaagcacattgtcatctacgataccttgattgagaagagcgaaacccaggaggtcgttgctgtgctcgcgcacgagcttggccactggaagctaggccacaccaccagcctgtttggcattgctcaggcgcacttcttctacatcttcacgctcttttccgttttcatcaacaacaagtctctctatgccgactttgggtttgttcttgagcgacccatcatcattggcttcctgctcttctctgatgcgctcgcgcctatggatgttcttatccagctgggtatgaacattcttagccgcaagttcgagttccaggccgatgacttcgccaagggccttggatacccggttgaactggcacggtctctcattaagctccagattcagaacctgagcaacatggacgccgactggatgtacgctagctaccacttctcgcacccgattctgtcagagaggcttagggcgcttggatggcagtcaaacgagaagattgatatcaaggagaagaagaagacagatgagggtgtggtcaaggcctcgggcagagatgaattgtag

SEQ ID NO: 6725 - protein, 514 aa, Magnaporthe grisea 70-15
MPTPLDNAMKSKNAILAFTGLVTGAAVWAIWGGDMFPKESDPKGDPDTWTHEEMRRWLAARLARFLDRPLFPWKKLIVGFSLAHYFFESFLSLRQYQVLQKTKPPKVLEQQISQEVFDKSQAYGRAKAKYGFVSKLWGQIQNIAFIQYDVLPKLWAWSGRLLLSYAPARFTGEISQSIVFVLAFVMIQQVLSLPTSIYHTFVLEEKFGFNKQTPKLFITDLIKSQLLTVVLTPPILAGFLKIIQKTGDQFFYYLWMFGAFLQVFMITVYPIAILPLFNKLSPLEPGELKTGVEALAKRLNFPLHELYVIDGSKRSAHSNAYFFGLPWKKHIVIYDTLIEKSETQEVVAVLAHELGHWKLGHTTSLFGIAQAHFFYIFTLFSVFINNKSLYADFGFVLERPIIIGFLLFSDALAPMDVLIQLGMNILSRKFEFQADDFAKGLGYPVELARSLIKLQIQNLSNMDADWMYASYHFSHPILSERLRALGWQSNEKIDIKEKKKTDEGVVKASGRDEL

SEQ ID NO: 6726 - DNA, 1383 bp, Candida glabrata CBS 138
  CDS (1)..(1383)
atgacggtatttgaactctttgcctctttggtggatagcccaagcatcccatggaaatctataattactggtttttgcatcagtcaatttgcatttgagacatatctaacctatagacaatacaaagttcttcaaaagaatcaactaccacctgttctagttaatgaaattgataaggaaacctttgaaaagtcccaagaatactccaaggctaaggccaaattctcagtattcactgatctgttttcgctagtccaaaatttggcgtttattaaatatgactttctaccaagattatggcatatcggtgtgaaagtcagtgctcgtatactacctgccaaatatgctgctgtgtcaacaattgctcaaagtttatggttcttggctgttttgtctaatctgtcaacgattattggcttgccaatctcatactataagcattttgtgcttgaagagaaatttggtttcaacaaattgactgtaaagctgtggataactgatatgataaagagcactgtcttaagcgctgcatttggtattcctatcttatttgtctttttgaaaatttttgagaaattccaaactaatttcttgtggtacatttgtctatttgtttttgttgttcagattttggctatcactataattccagttttcattatgccattgtttaacaaattcactccactagaagacggtgaattgaagacatcaatagaaaatttggctgctaaggttggctttccactagacaagatcttcgtaatagacggttcaaagagatcatctcactcaaatgcttacttcaccggtttaccttttactaataagagaattgtcttatttgataccctaatcaatgaaagttctgtggaagaaatcacagctgttttggcacatgaaataggtcactggcaaaagaaccatattgtcaacatgctgttcattagtcaagtgcacatttttgccatcttttcattgtttaccagtgtttaccgtaacgtttctttctacaagacctttggtttcaacgttggattcaacgagattttaaatgctgcaggaagttctaccactgtgtatacccctgatttcccaattattattggtttcatgctatttaatgatcttttgacaccaatggaatgtggtatgaactttgtcatgagcttgatctccagacttcacgaatatcaggcagatgcttatgccaaagcactaggatatactcaaaacttgggtagagccttgattaatttgcaaatcaagaatctatccacaatggatgttgacccattatactcaagctatcattattctcatccaacattagctgaaagattaactgctatcgactttgttaatgagaagaagaaagaatga

SEQ ID NO: 6727 - protein, 460 aa, Candida glabrata CBS 138
MTVFELFASLVDSPSIPWKSIITGFCISQFAFETYLTYRQYKVLQKNQLPPVLVNEIDKETFEKSQEYSKAKAKFSVFTDLFSLVQNLAFIKYDFLPRLWHIGVKVSARILPAKYAAVSTIAQSLWFLAVLSNLSTIIGLPISYYKHFVLEEKFGFNKLTVKLWITDMIKSTVLSAAFGIPILFVFLKIFEKFQTNFLWYICLFVFVVQILAITIIPVFIMPLFNKFTPLEDGELKTSIENLAAKVGFPLDKIFVIDGSKRSSHSNAYFTGLPFTNKRIVLFDTLINESSVEEITAVLAHEIGHWQKNHIVNMLFISQVHIFAIFSLFTSVYRNVSFYKTFGFNVGFNEILNAAGSSTTVYTPDFPIIIGFMLFNDLLTPMECGMNFVMSLISRLHEYQADAYAKALGYTQNLGRALINLQIKNLSTMDVDPLYSSYHYSHPTLAERLTAIDFVNEKKKE

SEQ ID NO: 6728 - DNA, 1371 bp, Kluyveromyces lactis NRRL Y-1140
  CDS (1)..(1371)
atgatgggaattgttgacatacttcaagatatcctggattcatcttccataccatggaaaaccattattacggggttcactgtggcgcaatttggatttgaaacctatttgacttaccgtcaatatttggctctatccaataagaatttgcctcccgtgctagttggtgaaattgatgatgagacgttccaaaaatcggaagcttactcaagagccaagtctaagttttcaattgtatcgaatgtcattaacttggctcagaatttgatcttcatcaagttcgatattttaccaaagctatggcacctgggcaacagctttgcccaatatttcccaagcaggttctttcctacttctaccattgcccaatccttgtactttttaaccgtcatgtccaatttgtccgctttgatgggtctgccattgagttattaccaacatttcgtcttggaagagaagtttggtttcaacaaattgaccattaagttatggatctctgatatgattaagagcagtctgctaggtgctgtcattggtactccggtattgtacttgttcttaaagatttttgaaaaattcccatccaatttcttgtggtacatctgtctattcattcttgtggttcaaatccttgctttgactattatcccagtgtttatcatgccattgttcaacaaattcactccattagaagatggcgagttgaagaccgaaattgaaaacttggctaaaaaggtaggatttccattggacaaaattttcatcgtggatggttccaagagatcttctcattctaacgcttatttcacgggtctcccatttaccagtaagcgtattgtcttatatgataccttagtcaacgattctaccaccgatgaaattgttgctgttttggctcatgaaattggtcactggcaaaaatctcatttgttgcggatgctagccttcagtgaaactcatattttcttggtattttccctcttcaccgctgcttatcaaaacaaatcattatacaacgcatttggattcttcgccggttctggttcctcatctgatatctccaaggttattacccctcaatatccaattatcatcggattccttttgttcaatgacttattacaaccgctagactgtctttctacatttttgacaaacttagtctcaagagctcatgaataccaatctgatgcttacgctaaggaattgggctacgcccctcatttagccagagcattgatcaaccttcaaatcaagaatctttctactatgaatgttgatccattatattcaagttatcattactctcatccaacgttggccgaaagattgatcgctatcgaatacaagaacgagaagaaagaccagtag

SEQ ID NO: 6729 - protein, 456 aa, Kluyveromyces lactis NRRL Y-1140
MMGIVDILQDILDSSSIPWKTIITGFTVAQFGFETYLTYRQYLALSNKNLPPVLVGEIDDETFQKSEAYSRAKSKFSIVSNVINLAQNLIFIKFDILPKLWHLGNSFAQYFPSRFFPTSTIAQSLYFLTVMSNLSALMGLPLSYYQHFVLEEKFGFNKLTIKLWISDMIKSSLLGAVIGTPVLYLFLKIFEKFPSNFLWYICLFILVVQILALTIIPVFIMPLFNKFTPLEDGELKTEIENLAKKVGFPLDKIFIVDGSKRSSHSNAYFTGLPFTSKRIVLYDTLVNDSTTDEIVAVLAHEIGHWQKSHLLRMLAFSETHIFLVFSLFTAAYQNKSLYNAFGFFAGSGSSSDISKVITPQYPIIIGFLLFNDLLQPLDCLSTFLTNLVSRAHEYQSDAYAKELGYAPHLARALINLQIKNLSTMNVDPLYSSYHYSHPTLAERLIAIEYKNEKKDQ

SEQ ID NO: 6730 - DNA, 1341 bp, Debaryomyces hansenii CBS767
  CDS (1)..(1341)
atgttttccttagcaaattcattttcctttcttgatagtgccagtattaactggaaatccattatagtaggatttaccgttggtcagtttttatttgaaaactatttagattaccgtcagtaccaagtcttaaagagaacaactcctccagacaccttaaaggccgaagtttcacaagaaacattcgataaatcacaagattattcccgtgctaaagctaaatttggcttcctttcagattcgattaacttattccaaaatttagctatcatcaagtatgatttgttgccaaagttttggaacattgctggtaccttaatggccaagagttctttcattcttccaaaatttatgggaggtatcattacgcagtcattatttttcttattttccactcagattattagtacaattgtttcgcttccattatcttattattctaactttgttttagaagagaagtatggattcaacaagcttactgttgggttatggcttaccgataaggtcaagggcattgctttaggtattgcgctcggatctcctgttgttgcagctttcttgaagattattgactattttggtgattctttcatcttgtatacctgtggattcctttttgtggttcaattggtgggtatgactattttcccaactttgattcaaccattgtttaataagtttactaccttagatgaaggcgaattaaaaactgctattgaaaacttggcatgtgaacaaaaattccctttgaccaagttgtatgtcattgacggttcaaaaagatcttcccattctaatgcttattttactggtttaccatggagtaaacagattgttttgtatgatactttgatcaagcactcaaccaaggaagaaactgtcgctgtcttggctcatgaaattggccattggaaattgtcacacttaccacaaatgttggtcttctcccaagctcatttatttttaagtttctctatgttttctgctttcattcacaacaactctttgtactcttcattcggatttacctctgttcaaccaattatgattgggtttatgttgtttaacgatattttccaaccagttgaatgtgttgcacaatttggtatgaatttattatcaagaaagaacgaatatgaagcagatgcatacgctaagaaatgtggctactcggatgatttggccaaggcattgattaaattattgagtgaaaacttatcaacaatggatgctgactggttatattcctcgtaccatcattctcatccaattttatctgaaagattgcgtgccattaattacgtttctaaagaaaaagttggtaagaaagatgaatga

SEQ ID NO: 6731 - protein, 446 aa, Debaryomyces hansenii CBS767
MFSLANSFSFLDSASINWKSIIVGFTVGQFLFENYLDYRQYQVLKRTTPPDTLKAEVSQETFDKSQDYSRAKAKFGFLSDSINLFQNLAIIKYDLLPKFWNIAGTLMAKSSFILPKFMGGIITQSLFFLFSTQIISTIVSLPLSYYSNFVLEEKYGFNKLTVGLWLTDKVKGIALGIALGSPVVAAFLKIIDYFGDSFILYTCGFLFVVQLVGMTIFPTLIQPLFNKFTTLDEGELKTAIENLACEQKFPLTKLYVIDGSKRSSHSNAYFTGLPWSKQIVLYDTLIKHSTKEETVAVLAHEIGHWKLSHLPQMLVFSQAHLFLSFSMFSAFIHNNSLYSSFGFTSVQPIMIGFMLFNDIFQPVECVAQFGMNLLSRKNEYEADAYAKKCGYSDDLAKALIKLLSENLSTMDADWLYSSYHHSHPILSERLRAINYVSKEKVGKKDE

SEQ ID NO: 6732 - DNA, 1371 bp, Candida albicans SC5314
  CDS (1)..(1371): transl_table=12
atgtatataagtttgcaatgtaatgaccaacaatatactaacttttacaagtcatttgcctttcttgactcaccatcaattaattggaaaacaattattgttggctttactattggccaatatgttttcgagacttatttagatcttagacaatatagagtgttacaactgaaaacagcaccaaagtcaattgaaaaagaagtttcacaagaaacattcgacaaatcccaagagtattcccgtgctaaagcacagttttcagtcttttccagtacgttcagcttgttgcagaacttggcaatctttaaatatgacttgttacctaaaacctggacattggctgggactatcatgaagagcagtgctgcagttttacctaaggccatgagtggtgttattactcaatcgcttttttttgttttcaccacccaaatcttgacaactttgattggattaccattgagctactacaaaaactttgtgttagaggagagattcggattcaacaagcaaacaattggtttgtgggttagcgatatgttaaaaggaattggtatctctatagttttgggatcgccagttattgccggatttttgaaaattattgattactttgatgataagttcattttctatctcatgggattcattttagtagtcaacttgattgctatgaccatagttccaacattgattatgccattatttaacaagtttactcccttggaagatggtgagttgaaaaccgccattgaaaaattagctttagaacaaaaattcccattgacaaaattgtttgtcattgatggatcaaaaagatcgtcccattcaaatgcttatttcacaggattgccatggagcaaacaaattgttttgtttgacactttaattgaacacaattcaactgaagaaactgttgctgtcttggctcatgaaattggtcactggaaattgaaccatttgccaaagatgataaccatgatgcaaggccatttgtttttgattttttccttgtattctgctttcattcataacaaatcattatacacaagttttgggtttgtcaagcaacaaccaatcttgatcggatttatgttattcaacgacattttccaaccagtggaatgtctcttgacattcgtcctgaacttgatttcaagaaagcatgaatatgaggccgacaagtatgctagtgactgtggatattctgaggaattgagcagatctttgatcaagttatccaatgaaaacttgtcaagtatgaatgccgattggttgttttcctcttaccattattctcatcctatattaccagaaagattaagtgcattggggtacgtttcaaaggtaaaggttaagaaagatgaataa

SEQ ID NO: 6733 - protein, 456 aa, Candida albicans SC5314
MYISLQCNDQQYTNFYKSFAFLDSPSINWKTIIVGFTIGQYVFETYLDLRQYRVLQSKTAPKSIEKEVSQETFDKSQEYSRAKAQFSVFSSTFSLLQNLAIFKYDLLPKTWTLAGTIMKSSAAVLPKAMSGVITQSLFFVFTTQILTTLIGLPLSYYKNFVLEERFGFNKQTIGLWVSDMLKGIGISIVLGSPVIAGFLKIIDYFDDKFIFYLMGFILVVNLIAMTIVPTLIMPLFNKFTPLEDGELKTAIEKLALEQKFPLTKLFVIDGSKRSSHSNAYFTGLPWSKQIVLFDTLIEHNSTEETVAVLAHEIGHWKLNHLPKMITMMQGHLFLIFSLYSAFIHNKSLYTSFGFVKQQPILIGFMLFNDIFQPVECLLTFVSNLISRKHEYEADKYASDCGYSEELSRSLIKLSNENLSSMNADWLFSSYHYSHPILPERLSALGYVSKVKVKKDE

SEQ ID NO: 6734 - DNA, 1494 bp, Ustilago maydis 521
  CDS (1)..(1494)
atgctttccctcgtccaggacaagattgcgtttctgcagtcagcgctcgatgacccggcgattcagtggaagaagctcgttcttgcactcttatggctcgtgtacgctttcgagacactcctctcacttcgacagtaccgcctttacagcctggaaactcctcctgccacgcttgccagccatgtcgatttggacaccttcaagaaatcacaggtgtatggcagagacaaagcacgttttggcttcttctcgtctgctgtgagccagctaatcagcgtcgcgctcgtacattacgacatctatgcttggagctggacgcttgccggcactatcctcactcactttggccagagcgatagcgaaattccgcggtcgatcgtgtggatggtgatcatgtttgtgattcgagaggtgccaggcatgccactcaccctgtaccgcaactttgtcatcgaagaacgacacggtttcaacaagatgaccatccgcacctttgtaacagacacactcaaagagtggatgcttggattcgtcattggcgtgccactcatctctgctttgctgtggatcatccgatgggctggatcggcgttcgtatcgtacgtcgtcgttttcctctttagctttcagatgatcgcaatggttctctatccaaccgtcatccagccgctgttcaacaagctcactccgttgccccagggtgctcttcgagatcgtgtcgtagcacttgcaacgtcactcaaattccctctgaagcacatctacgtgattgatggcagtaaacgctcgtctcactcgaatgcctactttttcggcgtgattcccggcggcaacaagcacattgtcatctttgatacactcatcgaaaagtcgagcgcggacgagatcgaagcggtgctggcgcacgagctaggccactacgccaacaacgaccctaccaagcttctcgtcctgtcgcaagtacagatctggttcaccatgagtctctttacgctgttcatcaacaacgtttcgctctaccggtcgtttggcttccaggtaggcccttcgcttcttgaaaaggtggcaggaacgcgctcgtcgcagctgctcaactatcttcctgtgattattggtttggagttgtttcagctcgtgctgaatccgacggatgctctggtcaagttcctcctcaactcggcgattcgcaggatggagtatgctgccgatcggttcgctgcgacgctgactcgacctggtcctacccggtctgaactggctgcggccgccgaattcaacgctgacagccacaatgctgcagtcaaggtggatccaaatcagaaacaagagtatgtcgatctgcttggtagggcgcttatcaagctgcatgtgcacaacctttccacgatgcatcacgatcctctcttttcagcctaccactactcacatcccacgttggccgagcgacttgacgctctgcaagctctacgaccccatctcaaaaagcacaagtag

SEQ ID NO: 6735 - protein, 497 aa, Ustilago maydis 521
MLSLVQDKIAFLQSALDDPAIQWKKLVLALLWLVYAFETLLSLRQYRLYSLETPPATLASHVDLDTFKKSQVYGRDKARFGFFSSAVSQLISVALVHYDIYAWSWTLAGTILTHFGQSDSEIPRSIVWMVIMFVIREVPGMPLTLYRNFVIEERHGFNKMTIRTFVTDTLKEWMLGFVIGVPLISALLWIIRWAGSAFVSYVVVFLFSFQMIAMVLYPTVIQPLFNKLTPLPQGALRDRVVALATSLKFPLKHIYVIDGSKRSSHSNAYFFGVIPGGNKHIVIFDTLIEKSSADEIEAVLAHELGHYANNDPTKLLVLSQVQIWFTMSLFTLFINNVSLYRSFGFQVGPSLLEKVAGTRSSQLLNYLPVIIGLELFQLVLNPTDALVKFLLNSAIRRMEYAADRFAATLTRPGPTRSELAAAAEFNADSHNAAVKVDPNQKQEYVDLLGRALIKLHVHNLSTMHHDPLFSAYHYSHPTLAERLDALQALRPHLKKHK

SEQ ID NO: 6736 - DNA, 1257 bp, Herminiimonas arsenicoxydans
  CDS (1)..(1257): transl_table=11
atgtcatcactcgcgtttaccgttttgtttatcagcttcctgcttattagcctggtcgttcgcttctggcttgcctcgcgccacatccgccacatccttgccaatcgcgccactgtacctgcgcaatttgccggccagatttcactggaagcacaccaaaaagcagctgattactcgattgcgaaaaccaagttcgcactctttatcgtgctgctgaatgctgccgtgctgatcggtttcacgctgatgggcggtttgcaatggctggcgagtgcttcgttttccgtcttcggcgacggctggcgttatcaattggcgctggtgctggcgtttgcattgatctccggcctgattgaattgcccttcgattatttccgccagttcgtactggaagcccgcttcggcttcaatcgcatgtcgcccgcgctgttctttgccgatctgtttaaaagcactgtgctgtcgctggcgctaggcctcagcctggtatggatcacactgatcctgatggaaaaatccggcgacctatggtggctgtatgcatggatagtctggtgttctttccagatgttgatgctggtactggtgccgctcttcattgcacccatgttcaacaagttcaaaccgctggaagacgagaatctgcgcacacgcattgaaaacctgatgcagcgcatcggctttgcatccagcggcttgtttgtgatggatggctcacgccgcagtgcgcatggcaatgcgtatttttccggcttcggtgcggccaagcgcatcgtctttttcgataccctgctggaacgtctggcgccgcatgaaattgaagccgtactggcgcatgaactcggccacttcaaactcaagcacatcgtcaagcgtatctgcgtgatgtttgctgcatcgctggccctgctggcgttgctcggctacctgaaaacccaggcatggttctttaccggtctgggcgtagagcccatgatgggcgccagcaacgacgcaatggcgctgatcctgtttgcactggtactcccggtgttctccttcctgttttcgccgctgacttcgctcagctcgcgcaagcatgaatttgaagccgatgcctttgctgcgcaacacacgagctcgcaggatctggtgtcggcgctggtcaaactgtatgaagacaatgcatcgacactgacgcccgatcccctgcattcggcattttacgattcgcatccaccggccagcgtgcgtatcaacaagctgctttccacttga

SEQ ID NO: 6737 - protein, 418 aa, Herminiimonas arsenicoxydans
MSSLAFTVLFISFLLISLVVRFWLASRHIRHILANRATVPAQFAGQISLEAHQKAADYSIAKTKFALFIVLLNAAVLIGFTLMGGLQWLASASFSVFGDGWRYQLALVLAFALISGLIELPFDYFRQFVLEARFGFNRMSPALFFADLFKSTVLSLALGLSLVWITLILMEKSGDLWWLYAWIVWCSFQMLMLVLVPLFIAPMFNKFKPLEDENLRTRIENLMQRIGFASSGLFVMDGSRRSAHGNAYFSGFGAAKRIVFFDTLLERLAPHEIEAVLAHELGHFKLKHIVKRICVMFAASLALLALLGYLKTQAWFFTGLGVEPMMGASNDAMALILFALVLPVFSFLFSPLTSLSSRKHEFEADAFAAQHTSSQDLVSALVKLYEDNASTLTPDPLHSAFYDSHPPASVRINKLLST

SEQ ID NO: 6738 - DNA, 1317 bp, Bacillus thuringiensis serovar konkukian str. 97-27
  CDS (1)..(1317): transl_table=11
atgtacgaacttacaataataatagacaggcagcatagaggagggaatagcgtgaggaaggttattgggtggtcgctttttttgtacgttggatttgcgttatttatatattggtatttatttggatggagtcatgaattgattccggacatgtataaaggaacgagtgcagatccagaaacgtttatgaatgcaagagagcttacgctaagccaagattattcgcgcgtgaaaaatttactgtattttttagcgacgcctcttgaatggattattttattatttgtacttgtgctcggtatttcaaaaaagtttgagaaatggtcgaaggaaacgacgaaaataagtgtcctgcaagttgcgatttatttcttttatttatcactgcttacaacagttcttgccttgccgatgcaatggattagccgaaaagtttctgttgattacggcatttcaacgcaaagtacacaaagctggataaaagatcatgttatcggtttttgggagagttatgcgacgatgttaatcgtagttaccgttctgttatggcttatccgtaaattcccaaagagatggtggctagcagggtgggcgctctctgtaccatttacaatctttttaacatttatacagcctgtcgttattgatccactttataacgacttttcgacgctgaaaaataaggaattagaaacgaaaattttagcgatagcagataaagcggacattcctgctaaacacgtgtatgaagtaaatatgtcagagaaaacgaatgcgttaaatgcatatgtaacaggaattggccctaacgctcgtattgtaatgtgggatacaacgcttaagcaattaaaagataaagagattttatttataatggctcatgaaatggggcattatgttatgaaacatatatattggggcgttgcgagttatatgttgctatcgtttatagggatgtatcttattagtcgtattatcaatatgtgtattcgaaaatgggggaatacgctgcaaatttcaaaagcagcatgtttttcaattttacctttatttttcttaatttcttctatactctcttttgcatcacagccagcaacaaactatgtttctcgtatagaagaacgagcggcagaccaatatgctttagacatgacgaaagacgggaaatctggtgtaaagacgtttcaatatttatcaaaaacgagcttaagccaagtaaatccgcctgcgttagtaaagtttttcttatatacacacccaccaatttttgaaagaattcatgcgtttgaacaatatgaaaaagaaaagaagcagtag

SEQ ID NO: 6739 - protein, 438 aa, Bacillus thuringiensis serovar konkukian str. 97-27
MYELTIIIDRQHRGGNSVRKVIGWSLFLYVGFALFIYWYLFGWSHELIPDMYKGTSADPETFMNARELTLSQDYSRVKNLLYFLATPLEWIILLFVLVLGISKKFEKWSKETTKISVLQVAIYFFYLSLLTTVLALPMQWISRKVSVDYGISTQSTQSWIKDHVIGFWESYATMLIVVTVLLWLIRKFPKRWWLAGWALSVPFTIFLTFIQPVVIDPLYNDFSTLKNKELETKILAIADKADIPAKHVYEVNMSEKTNALNAYVTGIGPNARIVMWDTTLKQLKDKEILFIMAHEMGHYVMKHIYWGVASYMLLSFIGMYLISRIINMCIRKWGNTLQISKAACFSILPLFFLISSILSFASQPATNYVSRIEERAADQYALDMTKDGKSGVKTFQYLSKTSLSQVNPPALVKFFLYTHPPIFERIHAFEQYEKEKKQ

SEQ ID NO: 6740 - DNA, 1239 bp, Desulfotalea psychrophila LSv54
  CDS (1)..(1239): transl_table=11
atgaatatctggctcgctcttattgtcatcttcctcatcaccacctggttcctggaaacaatcctcaccctcttaaacctgcgcaaccaacccgcgcagctgccaaaaaaatttgcggatatctatagtcccgacaaatatcaagactccctcctatataataaggcaacgactcgttgctctcttctagaaaaaacaacaagcaccctactctctcttggttttctcctcctcggtggttttaacgccctcgaccagatagcacgaagaggaggatatggagaaattatcaccggcctcctctttattggcctgctcctccttgtcttttttattatcggacttcccttccagctctactcaacctttgtcattgaggaaggttttggttttaaccgcaccaccctaaaaacattcgcagaagataccatcaaggcctgcctgcttgccattatcctcggcggaccatttctggccgcaatattctggttctttttaaaagcagggccacatgcctggatatactgctggcttggcaccactctcttctctttctgcctgcagcttctggctccaaccctcatcatgcccctcttcaataagttctcccccttgcaggagggatcactgaaggagaagatcagctcctacgtcaaggcccagaagttttccgtcggcgggatttttaccatggatggctccaaaagatctgcaaagctcaacgcctatttcaccggctttggcaaactgcgcaaaatagttctctttgataccctcgttgcaaaactccatgagaaagaaatagtggcagtgctcgcccacgaagtgggccatgcaaaatgcaatcatctctggaaaaacatccttctctccaccctgcacagcggactggtcttcttcctcctctcccttggcctcacccaaaaagattttgccgtagcctttaacatggaggcaagctctatctatgccagcctcttcttctttagctacctcctcaagcctatggattttatcatctccctatttttcaacagtctatcacgtagccatgaatacgaggcagacaactatgcggcaaaaacaacaggctcaggcgctgagctcatctctgccctgaaaaagctcagccaagaaaactatagcaacctctcaccccaccccctctatgttcgtttttactatagtcatccacccgtaagagatcgtatagaaaatctggagaggaaaaacgcctaa

SEQ ID NO: 6741 - protein, 412 aa, Desulfotalea psychrophila LSv54
MNIWLALIVIFLITTWFLETILTLLNLRNQPAQLPKKFADIYSPDKYQDSLLYNKATTRCSLLEKTTSTLLSLGFLLLGGFNALDQIARRGGYGEIITGLLFIGLLLLVFFIIGLPFQLYSTFVIEEGFGFNRTTLKTFAEDTIKACLLAIILGGPFLAAIFWFFLKAGPHAWIYCWLGTTLFSFCLQLLAPTLIMPLFNKFSPLQEGSLKEKISSYVKAQKFSVGGIFTMDGSKRSAKLNAYFTGFGKLRKIVLFDTLVAKLHEKEIVAVLAHEVGHAKCNHLWKNILLSTLHSGLVFFLLSLGLTQKDFAVAFNMEASSIYASLFFFSYLLKPMDFIISLFFNSLSRSHEYEADNYAAKTTGSGAELISALKKLSQENYSNLSPHPLYVRFYYSHPPVRDRIENLERKNA

SEQ ID NO: 6742 - DNA, 1362 bp, Methylococcus capsulatus str. Bath
  CDS (1)..(1362): transl_table=11
ttgtgcgtcctgagccatgccgtccttccaagtgcctgggagggttccaaacttgtcacggattttatcaaaggctaccctctagcgccgattgacgaaaccgatttccgacaataccgcatgaataccgtcaccaccctgttcctgacggctctggccgtctcctccgggcttgaatactggctggcccggcgccaggcccgccatgtgcgcctgcaccgcgaccatgtgccggacgcattccgggacagagtgtcgctggaggaccaccagaaggcagcggactataccctggccaaggggagtctcgacgatgtcgggcgcatcgtcggcatcgcgatcctgctgggattcaccctgggcggcgggatcgatgcgattgccgcagtctggaacggttgggggcttccgccgatcaccaccggcgtgggcatcgtcctgaccacgctgctggcttcccaactgctggaactgccgctcaacctctaccaaaccttccggatcgaggaacgcttcggcttcaaccgcaccactccacgccagttcgccatcgacctggcgctgcaaaccgggctctccctcgtcatcggcgccccgctgctggccttgatcctctgggtgatggacagcgccggcgcccagtggtggatcgtcgcctgggccatcctgatggccttctcgatcctgatgagctgggccttcccgaccctcatcgcccccttgttcaacaaattcaccccgctcgcggacgcgacgctcaaggcgcgtatcgaggcactcctcgaacgctgcggcttccgctcggaaggcatcttcgtcatggacggctccagacgctccggccacggcaacgcctacttcacggggtttggcagcaacaagcgcatcgtgttcttcgacaccctggtcgattcgctcgaccacgacgagatcgaagccgtgctggcccatgaactcggtcacttcaaacgccgccacgtactgaagatgctggccggcaccgcgctggtgacgctggccggtttcgccctgctcggctggctgacgggggaggactggttctatcagggcctcggcgtcagggagcagtcccatgccaccgctctcctgttgttcatgttggtgtcgccggtgttctccgtcttcctgcaaccggtcgtggcctatgtgcagcgacgctatgaattcgaggccgacgatttcgccgccagccagacccgtgcccgctacctggtccatgccctggtcaagttgtaccgggaaaacgccagcacgctcactccggacccgctgtacgccgcttttcactacagccatccgcccgccgcgatacgcatcgatcatctgagcgcgaagatctag

SEQ ID NO: 6743 - protein, 453 aa, Methylococcus capsulatus str. Bath
MCVLSHAVLPSAWEGSKLVTDFIKGYPLAPIDETDFRQYRMNTVTTLFLTALAVSSGLEYWLARRQARHVRLHRDHVPDAFRDRVSLEDHQKAADYTLAKGSLDDVGRIVGIAILLGFTLGGGIDAIAAVWNGWGLPPITTGVGIVLTTLLASQLLELPLNLYQTFRIEERFGFNRTTPRQFAIDLALQTGLSLVIGAPLLALILWVMDSAGAQWWIVAWAILMAFSILMSWAFPTLIAPLFNKFTPLADATLKARIEALLERCGFRSEGIFVMDGSRRSGHGNAYFTGFGSNKRIVFFDTLVDSLDHDEIEAVLAHELGHFKRRHVLKMLAGTALVTLAGFALLGWLTGEDWFYQGLGVREQSHATALLLFMLVSPVFSVFLQPVVAYVQRRYEFEADDFAASQTRARYLVHALVKLYRENASTLTPDPLYAAFHYSHPPAAIRIDHLSAKI

SEQ ID NO: 6744 - DNA, 1188 bp, Campylobacter jejuni RM1221
  CDS (1)..(1188): transl_table=11
atgactttaattgcaattttatgtctttacacagcacttttatcttggatttcctatgctcaaattcgtttcttagaaagagaaaaagacaaacaagctcaaattttaagcgaaaaagactatcaaaatgcagcagatattgccatcgaaaatgaaaaatttaaactattttccaatttttataatttaatcatcaatattgcatggataggttttggatttttatatcttaaagaattgcttatcttaaacaacactcgttttgaaaatactttatttttattatcttttttaataatcacaagtattttaaatctacctttaagtatttatgaaagttttatcaaagataaagcccatggtttttcaaatatgactgtaaaactttttatcaaagacactatgaaaagtcttattttaactttaatatttggatttttaatcctttatgctttgcttttttgctatgatttttttggaactttttggtggattgcggcctttatttttgccttttgtattatagtgattataaatctcatctaccctaccttaatagcacctatttttaataaaatgaaaaaactagacgatgaaaatttattgaaaaaaatcagctctttaatgaaacaatgcgggtttagtgcaaatgggatttatgttattgatgcaagcaaaagagataagcgtttaaatgcttattttggtggactttttaaaagcaaaagagtggtgctttttgatacattattaaaagccttaaatgaaagagaacttttagctgttttaggacacgagcttggacattttgttcataaggatattatcaaagctttatttaacggcgctataactatgtttttacttttttttgtttttgcaaatttacctgaatttgtttacttagaaagtcatctagaaggagtaaatggcggtgtgtttgctcttttatttatcttggcaaatatttttaactttttaatctctcctatgcttaatgccttaagtagaaaaaatgaatttgcggctgatcaacacggagctaaagttacaagcaaagaagatatgaaaaatgcattgatagccctagcaagagaaaataaagcttttatcaaaacaagtaaaatatatgcatttttttatctcagccatccaagtattagtgatagaatcaaggctctttcttga

SEQ ID NO: 6745 - protein, 395 aa, Campylobacter jejuni RM1221
MTLIAILCLYTALLSWISYAQIRFLEREKDKQAQILSEKDYQNAADIAIENEKFKLFSNFYNLIINIAWIGFGFLYLKELLILNNTRFENTLFLLSFLIITSILNLPLSIYESFIKDKAHGFSNMTVKLFIKDTMKSLILTLIFGFLILYALLFCYDFFGTFWWIAAFIFAFCIIVIINLIYPTLIAPIFNKMKKLDDENLLKKISSLMKQCGFSANGIYVIDASKRDKRLNAYFGGLFKSKRVVLFDTLLKALNERELLAVLGHELGHFVHKDIIKALFNGAITMFLLFFVFANLPEFVYLESHLEGVNGGVFALLFILANIFNFLISPMLNALSRKNEFAADQHGAKVTSKEDMKNALIALARENKAFIKTSKIYAFFYLSHPSISDRIKALS

SEQ ID NO: 6746 - DNA, 1251 bp, Dechloromonas aromatica RCB
  CDS (1)..(1251): transl_table=11
gtgaccgaaaccttcaagcttttctttctcgccttctttgcgctaacgctcgccactcgcctgtggctgaagctgcggcacatccgcttcgttaccgcccaccgcgaaaaactgccggcggatttcgccgaacgggtgacgctggcggcccaccaaaaggcggccgattacaccgtggaccgcagcaaggtagcggttatcagtacacttattgaagccacactgctgctggcactgaccctcggcggcgggctgaccagccttcacgaattctggattctccgaaccgatggcctgggctatggcctggcgatgattttcagcctgatgttcatttccggactgatcgacctgccgctgtcgctctacagccagttcgtcatcgaggcccgccatggtttcaaccgcatgacgctcggcctgttcattgccgatctgatcaaacagacgctgctcggcatcgcgatcggcaccccggtgatcctcgccgtgctctggctgatgggcgcgatggggcaatactggtggctttatgtctggctgttctggagcagcttcaatctgctgatcatgttcgtttatccgacctggatcgccccgctgttcaacaagttttcgccccttgaggatggcgaaatgaaagcccgcatcgaagccctgctggtccgctgcggcttccgctcctccggcctcttcgtcatggatggctcgaagcgctccagtcatggcaacgcctacttcaccggcttcggcaacaacaaacggatcgttttcttcgacaccctgctatcccgtctcgaaccgccagaaatcgaagccgtactggcccacgaactcggccacttccgcaagaaacatgtagtcaagcgcatggtcatcatgttcgccggatcgctcggctttctctggctgctcggccaactgatcgatgcgccgtggttttatgccggccttggcgtgacagcacaaaataccgccctggcactgatcctctttttcctcgtcatgccggtactcacctttccatttaccccgctgatgagtcatttttcccgccagcacgaattcgaggcggatgcctatgcggccgaacacgccgagggcggcgatctcgtctgcgccctgaccaagctctaccaggacaatgcttcaacgctgacgcccgacccgctacactcgctgttctatgactcccacccgccagctgcccagcgcatcgcgcatctgcaacttcaggaaaaaaccgcatga

SEQ ID NO: 6747 - protein, 416 aa, Dechloromonas aromatica RCB
MTETFKLFFLAFFALTLATRLWLKLRHIRFVTAHREKLPADFAERVTLAAHQKAADYTVDRSKVAVISTLIEATLLLALTLGGGLTSLHEFWILRTDGLGYGLAMIFSLMFISGLIDLPLSLYSQFVIEARHGFNRMTLGLFIADLIKQTLLGIAIGTPVILAVLWLMGAMGQYWWLYVWLFWSSFNLLIMFVYPTWIAPLFNKFSPLEDGEMKARIEALLVRCGFRSSGLFVMDGSKRSSHGNAYFTGFGNNKRIVFFDTLLSRLEPPEIEAVLAHELGHFRKKHVVKRMVIMFAGSLGFLWLLGQLIDAPWFYAGLGVTAQNTALALILFFLVMPVLTFPFTPLMSHFSRQHEFEADAYAAEHAEGGDLVCALTKLYQDNASTLTPDPLHSLFYDSHPPAAQRIAHLQLQEKTA

SEQ ID NO: 6748 - DNA, 1284 bp, Ralstonia eutropha JMP134
  CDS (1)..(1284): transl_table=11
atggtcgccgctgcgtccccgacaaggcttttgccgatgttcacgcttattttcctcgccgcgctggtcgtcatggtgctgaccaagctgtggctggcggcccgccaggtccgctatgttggccagcaccgcaacgccgtgccgccccgctttgccgataccatcgcgctgccttcgcaccagaaggcagccgattacaccatcgcccgaacgcggctgtcgatgctcgaagtgctggccggcgccgccgtactgatcggcttcaccatgctcggcggcctgcagtggctgaaccagttctggctcgacatgttcggtcccggctacgcgtacggcgtggcgctgatcgccagcgtcgcgctgatcggcgggctggtggacctgcccttctcgctgtacggccagttcggtatcgaagaacgcttcggcttcaacaagatgaccttcggcctgtggctcgccgacatggtcaagatgctgctggttgcgtgcgtgctgggactgccgctgctgctcgcggtgctctggctgatggaccgcaccggcagcctgtggtgggtgtggacatggctggtatggatggcgttcaacctgttgctgctgatcgtgttcccgacgttcatcgcgccgctgttcaacaagttcgaaccgctcaccgatgagtcgctgcgccagcgcatcgaggcactcatgaagaagtgcggcttcgccagcaaaggcctgttcgtgatggatggcagcaagcgcagcgcgcatggcaatgcctatttcacgggtttcggcgcggccaagcgcatcgtgttcttcgacacgctgctcgggcgcctgtccggcgacgagatcgaggccgtgctggcccatgagctcggccacttcaagcgccgccacgtggccaagcgcattgccgtgacgttcgcgctgagcctggtgttcctggcattgctcggctggctttcgacgcgcacgtggttctatacggggctcggcgtggcgccgaaccttggtgtctcgaacagcgcgctggcgctggtgctgttcttcctgacgctgccggtgttcacgttcctgctcgggccgttgtcgagccagtcgtcgcgcaagcatgagtttgaagccgatgcctttgccgccgaccagaccaatgcgggccacctggtctcggcactggtcaagctgtacaaggacaacgcctccacgctgacccccgacccgctctacagcgccttctactactcgcacccgcccgccgcgcagcggatcgaccggctgctggcgcacgcatga

SEQ ID NO: 6749 - protein, 427 aa, Ralstonia eutropha JMP134
MVAAASPTRLLPMFTLIFLAALVVMVLTKLWLAARQVRYVGQHRNAVPPRFADTIALPSHQKAADYTIARTRLSMLEVLAGAAVLIGFTMLGGLQWLNQFWLDMFGPGYAYGVALIASVALIGGLVDLPFSLYGQFGIEERFGFNKMTFGLWLADMVKMLLVACVLGLPLLLAVLWLMDRTGSLWWVWTWLVWMAFNLLLLIVFPTFIAPLFNKFEPLTDESLRQRIEALMKKCGFASKGLFVMDGSKRSAHGNAYFTGFGAAKRIVFFDTLLGRLSGDEIEAVLAHELGHFKRRHVAKRIAVTFALSLVFLALLGWLSTRTWFYTGLGVAPNLGVSNSALALVLFFLTLPVFTFLLGPLSSQSSRKHEFEADAFAADQTNAGHLVSALVKLYKDNASTLTPDPLYSAFYYSHPPAAQRIDRLLAHA

SEQ ID NO: 6750 - DNA, 1266 bp, Geobacter metallireducens GS-15
  CDS (1)..(1266): transl_table=11
atgaccgccgtcatcatccttttctacctcattacccttggcgccggctttttccttcggacgctgaatctccgccatctgaaacggtacggctccaccgtcccctccggtttcgagggggcggtggagccggaaaccctccgcaaaacggttgcctatacccttgaccagagccgcctggggctcgccgagtccctcttcgacgcggcgctcctcctcatttttctcttcgggcttctgccggcctatgaccggtggctcgcctccctgggaggctccttcgtcctctcgggtgtcctcttcttcctgggtctcaccctcatccagacgttcctcggcatccccttcgacctttacgggacctttcgcctcgaagtccgctacggcttcaacaccacgactcccggcctctggctctcggacctggcaaagtcgaccctcatcgcggtggtgctgaccgggctcctggtggccggggcctttgccctcgtggcgtggagtccccgcttctggtggctctgggtctgggggttcttcgccatggtctccctcttcctcatgtacctctccccctacgtcatcgaacccctcttcaaccggttcgagccggtcgccgaggaggggctggaggaggagatccgcgccttgtgtgaacgggccgggctgcgggtcagccgggtcatgcaggtggacgcctcccggcgcagccgccactccaatgcctacttcaccggcatcggccgggtaaagcgtatcgtcctttacgacaccctcatccgccagatgagccaccgggagatcctggcggtccttgcccacgagatcggccactggaagaaggggcatatccgccggcggttgatcctcacggaagccggtgccctggccggctcgtggtttgcctggaaactcacgggatgggagggatttccggggctcatcggcctgacggacgcctccttcgcggcgcgactcgtcatcctcggtttcctgggctccatcgtttccttccccttcacccccctttccagttggctctcccgccgccacgagcgggaggcggaccgtttcgccaccgacattacgggggatgcggaggccttggcctcagccctcgtgaagctctccacggagaatctctccaatctccaccctcatcccctttatgcggcgttctactattcccatcctcccgtggttgagcgggtgggcaggctgagggccgccatgcctccggcaggaaaagcgggagagaccacgatgtaa

SEQ ID NO: 6751 - protein, 421 aa, Geobacter metallireducens GS-15
MTAVIILFYLITLGAGFFLRTLNLRHLKRYGSTVPSGFEGAVEPETLRKTVAYTLDQSRLGLAESLFDAALLLIFLFGLLPAYDRWLASLGGSFVLSGVLFFLGLTLIQTFLGIPFDLYGTFRLEVRYGFNTTTPGLWLSDLAKSTLIAVVLTGLLVAGAFALVAWSPRFWWLWVWGFFAMVSLFLMYLSPYVIEPLFNRFEPVAEEGLEEEIRALCERAGLRVSRVMQVDASRRSRHSNAYFTGIGRVKRIVLYDTLIRQMSHREILAVLAHEIGHWKKGHIRRRLILTEAGALAGSWFAWKLTGWEGFPGLIGLTDASFAARLVILGFLGSIVSFPFTPLSSWLSRRHEREADRFATDITGDAEALASALVKLSTENLSNLHPHPLYAAFYYSHPPVVERVGRLRAAMPPAGKAGETTM

SEQ ID NO: 6752 - DNA, 1362 bp, Syntrophus aciditrophicus SB
  CDS (1)..(1362): transl_table=11
ttgacttttttcctccgaactgttagaggcatccctgtctctaccgcttccgagaggcttcagcaggcagagaataatcaagaactgcgagaaatcgagaacccgatgatagaatggaacgcgttgctggtgacttttctgattcttttccttgcccgcagccttttcaaggaagcgttgacccggatcaacatccggcatctccagcatcacggccgccgggtgccggaacttttccgcggtgaaatcgatgaagccaccctctcccggatgacggattatacggtgacgacctcccgttttacttcgtttgaagggatcgtcgatgatctgttgacgctgacagttctcctcagcggtgtccttccctggctgaccggcattctttcaggccggcagcttccctttatcctgtcgggtctgctctttttcagtgtcctgatgctggccagcggtgtaatcgctgtgcctttcgatctctaccgcatcttcgggattgaaaaacggtatggcttcagcacgatgactttccggctgtgggtgatggacagcctgaaaagcctggggatttccgtcatcctgctgggtgcgctgggaagcgcttttctggcactgatacaatacgccagggaatcctggtggttctggtcctggctgctgttcgccgcctttcaactgttgatgctctggctttatccggtggtcatcgccccccttttcaaccgctacgaaccgatccaggaccaggatctcaaaagggccgtgatggatctggcgagacgggcggaactggaagtggccggaatttatcaggtcgatgaagggaaacggagtcgtcacaccaatgcgtactttaccggtctggggaaaacccggcggatcgtcctgttcgacaccctccttgcttcttcgacccgggaggaaatcctggccgtgctggctcatgaaatcgggcactggaaaaagaggcacatactcaaacagctgattttcacggaactgacctccctggggatactttacctcttttcccgtctgctgaaatggcctcttctctattcgaccttcggcttttcggaacccgtcacttatgccggcctgctgcttatcgggatcctgaccgggccctttttcttctttctgaagcctttcagcgccgcaatgctccgccggttcgaacgggaagcggatgactacagccggaatctgatcggaacggcagcccccatgatatcggccctgaaacgcctggcaaaggacaacctcgccaacctctttccccatccgctttatgtgtggtttcactattcccacccgccgctgctggaacggatcggccgccttgtggaccgccgggcttga

SEQ ID NO: 6753 - protein, 453 aa, Syntrophus aciditrophicus SB
MTFFLRTVRGIPVSTASERLQQAENNQELREIENPMIEWNALLVTFLILFLARSLFKEALTRINIRHLQHHGRRVPELFRGEIDEATLSRMTDYTVTTSRFTSFEGIVDDLLTLTVLLSGVLPWLTGILSGRQLPFILSGLLFFSVLMLASGVIAVPFDLYRIFGIEKRYGFSTMTFRLWVMDSLKSLGISVILLGALGSAFLALIQYARESWWFWSWLLFAAFQLLMLWLYPVVIAPLFNRYEPIQDQDLKRAVMDLARRAELEVAGIYQVDEGKRSRHTNAYFTGLGKTRRIVLFDTLLASSTREEILAVLAHEIGHWKKRHILKQLIFTELTSLGILYLFSRLLKWPLLYSTFGFSEPVTYAGLLLIGILTGPFFFFLKPFSAAMLRRFEREADDYSRNLIGTAAPMISALKRLAKDNLANLFPHPLYVWFHYSHPPLLERIGRLVDRRA

SEQ ID NO: 6754 - DNA, 1257 bp, Methylobacillus flagellatus KT
  CDS (1)..(1257): transl_table=11
atgatggcaacgaacctgactatcctgttcatctctctcctcgtattcactacccttgtccggatctggctgggtaggcggcatgtccactatatccagcgtcaccgagacaaagtaccggatgcattcagctccagcatcagtctgggtgctcaccagaaagcagcagattactcttcggccaagacgcgtcttgcccttgtggaaaccacggttcaggccgtgctgttattactgctgacgataggcggggggctgcagctgatagatgaaatatggcgcggcctattgccagatcacgacatcatccgcggggctgcggtcattctgagtgcattgctggtgagcagcgtggtggacctgcccttcgactattaccgtaccttcgtgatcgaccaacatttcggctttaataaaatgacgcctgcgatgtacttcaaggacatggtcaaacatgggatcgtcggattgttgcttggtgcccctctgctgtttgccgcgctctggctcatgcagggtgctggcgactactggtggttttacttgtgggtggtatggagcttgttcaatctgttgatgctggcgatttatccgacattcattgcgcctatgttcaacaaattctccccgctgggcgatgagtcgctgaaacagcgcatcgaagccctgttgactaagtgcggattcaagtcgcaaggattgttcgtcatggacggttccacccgaagcagtcatggcaacgcctacttcaccggtttcggcgcaagcaagcgagtcgtctttttcgacaccttgctggagcgcctgaatggaaatgaaattgaagctgtcctcgctcatgagctcggtcacttcaagcacaaacatgtgatcaagcgtatcgccttgatgtttttcgtcagcttcattgggctagctttgcttggatggcttgcccgccaggattggttttatgccgggctcggcgttcaacagcccagcgactatatggcgctgatcttgttcctgctggttactccagtgttcttgttcctgttgcgccccctacttgcaggttactcgcgcaagaacgagttcgaggcagatgaatatgctgcacagaatgccgacgcacgctacctggtcgaggcattggtcaagctttaccgtgacaacgcgtccacgctgacaccagacccgctgcattcggcattttatgattcacatccgccagccagcattcgtatttcccggcttaatgcattgatcgtacactag

SEQ ID NO: 6755 - protein, 418 aa, Methylobacillus flagellatus KT
MMATNLTILFISLLVFTTLVRIWLGRRHVHYIQRHRDKVPDAFSSSISLGAHQKAADYSSAKTRLALVETTVQAVLLLLLTIGGGLQLIDEIWRGLLPDHDIIRGAAVILSALLVSSVVDLPFDYYRTFVIDQHFGFNKMTPAMYFKDMVKHGIVGLLLGAPLLFAALWLMQGAGDYWWFYLWVVWSLFNLLMLAIYPTFIAPMFNKFSPLGDESLKQRIEALLTKCGFKSQGLFVMDGSTRSSHGNAYFTGFGASKRVVFFDTLLERLNGNEIEAVLAHELGHFKHKHVIKRIALMFFVSFIGLALLGWLARQDWFYAGLGVQQPSDYMALILFLLVTPVFLFLLRPLLAGYSRKNEFEADEYAAQNADARYLVEALVKLYRDNASTLTPDPLHSAFYDSHPPASIRISRLNALIVH

SEQ ID NO: 6756 - DNA, 1257 bp, Cytophaga hutchinsonii ATCC 33406
  CDS (1)..(1257): transl_table=11
atggacgcaataactattaaatacctcattatcggaattcttatttttgatttcctggttgaacgcatattggattacctcaacattaaaaatctaagtgccgcacttccatccaatgttgctgatgtatatgatacagctgaatataaccgctcgcaggaatatcagaaggaaaaagaaaaagcagaacagtttcaatcgtattttcaatttgccctatacatattgctgcttacacaaggctaccttggaggcttatacgattacatacaggcatccgtgcttcaatcttcgttaagcacttacagcttttatgcatcaaacttattattcttcggtgtactgtttattgcaagcgatcttatctctacaccattttcaatttataatacgtttgtgatcgaagaaaagtacggctttaataaaagtacggtgaagcttttcattatggataaaattaaaggctacctgcttgcaatcatccttggcggcgtgattatcgctttactcttattcttaattcaaacacttgatacatcgttctggtggatcttctggttaatcatcagtgtactgattgtgacattgaacatgttttataccagcctccttcttccgttgttcaacaaacttaccccgctgggtgatggcgaattaaaaacagcgattcaggcatattgtgtaaaggagaatttccctgtagataatatttacatcatggatggttctaaacgatcgaataaagcgaatgcctttttctccggatttggcaagaagaaaaaaattgtcttatttgatacgttagtggatcagcattccatacctgagcttatcgcaatactggcgcatgaagcaggacatttcaaaaagaaacacatcatacagatgatggtattatccgtatttcaaatgggtgtatatttattcctgttatcgttattgattaaaaatgaaaacgtatctgtcgcgttgggttcaacaggcaacagtattgctctgaacttaattggctttggcttattattctctccggtatcttcaattactggcatactggtaaatgtattatcgagaaaaaatgaatacgaagcagatgcatttgccgcgtcaacttcaagcgctgccgatttaggaatagcgctaaagaatttaagtaaaaagaatttaagtaatttaacgcctcacccggcgtatgtatttcttcattactcccacccgccggttacacaacgtctggatgcgatgggaataaagtaa

SEQ ID NO: 6757 - protein, 418 aa, Cytophaga hutchinsonii ATCC 33406
MDAITIKYLIIGILIFDFLVERILDYLNIKNLSAALPSNVADVYDTAEYNRSQEYQKEKEKAEQFQSYFQFALYILLLTQGYLGGLYDYIQASVLQSSLSTYSFYASNLLFFGVLFIASDLISTPFSIYNTFVIEEKYGFNKSTVKLFIMDKIKGYLLAIILGGVIIALLLFLIQTLDTSFWWIFWLIISVLIVTLNMFYTSLLLPLFNKLTPLGDGELKTAIQAYCVKENFPVDNIYIMDGSKRSNKANAFFSGFGKKKKIVLFDTLVDQHSIPELIAILAHEAGHFKKKHIIQMMVLSVFQMGVYLFLLSLLIKNENVSVALGSTGNSIALNLIGFGLLFSPVSSITGILVNVLSRKNEYEADAFAASTSSAADLGIALKNLSKKNLSNLTPHPAYVFLHYSHPPVTQRLDAMGIK

SEQ ID NO: 6758 - DNA, 1254 bp, Azoarcus sp. BH72
  CDS (1)..(1254): transl_table=11
atgaccgccgacgccttctccctgcttttcgtcaccttcctgctgcttggcgtgcttgcgcgcggcggcctgatgctgcgccagatccgccatgtacgcgcacgccgcgacgaggtgcccgccgccttcgcgcaggacatcagcctcgacagccaccgccgcgccgccgactacacctgcgcgcggatgcgcttggcgctggccgacaccgtcaccggcgcactgcttgcactggtattgacgctgggtggcggcctgcaggccatccacgacgtctgggcgcggcttttcgatgcggggggcattgcgcacggcaccgcgctgctcgcctcgctcgcggtcgtcggctgggtggtcgaactgcccttcggcctctatcgcaccttcgtcgtcgagaagcgcttcggcttcaaccgcatgacgcccgcgctgttcgttgccgacacgatcaagagcaccgccctcgccgcgttgatcgggttgcccctgctgggcggcgtactgtggttgatgggcgcgatgggcacgctgtggtggctgtgggtgtgggcggtatggatggccttcaacctgctggtgctgctggtgtggcccaccttcatcgcgccgctgttcaacaccttcacgccgcttgcggacgaggcgctcaaggcgcgggtcgaagccctgctcgcccgttgcggcttccagtcgaaaggcctgttcgtgatggacggctcgcggcgctcggcgcacggcaatgcctacttcacgggctttggggcctccaagcgcatcgtgttcttcgacacgctgctcgccaagctgcagcctgaagaggtcgaagcggtgctcgcgcacgaactcggtcacttccgccaccatcacatcttcaagcggctggcggtgctcgcccccgccgcgctcgcgctgttcgcgctgctcggcgggttgatgcagacggactggttctacgccggcctgggcgtgaacagcgctggcaccgcgatggccctggcgctgttttccctggtgctgccggccttcagctttccgttcgtgccacttgccagccactggtcgcgcacgcacgaattcgaggccgaccgctacgctgcccggcaggcgagcgccggccacctggtcgccgcgctggtcaagctgtaccgcgacaacgccgccacgctgacacccgatccgctgtattcgagcgtattcgattcgcacccgccggcggcggtccgcatcctgcggctgcaggcgcagggtcgctga

SEQ ID NO: 6759 - protein, 417 aa, Azoarcus sp. BH72
MTADAFSLLFVTFLLLGVLARGGLMLRQIRHVRARRDEVPAAFAQDISLDSHRRAADYTCARMRLALADTVTGALLALVLTLGGGLQAIHDVWARLFDAGGIAHGTALLASLAVVGWVVELPFGLYRTFVVEKRFGFNRMTPALFVADTIKSTALAALIGLPLLGGVLWLMGAMGTLWWLWVWAVWMAFNLLVLLVWPTFIAPLFNTFTPLADEALKARVEALLARCGFQSKGLFVMDGSRRSAHGNAYFTGFGASKRIVFFDTLLAKLQPEEVEAVLAHELGHFRHHHIFKRLAVLAPAALALFALLGGLMQTDWFYAGLGVNSAGTAMALALFSLVLPAFSFPFVPLASHWSRTHEFEADRYAARQASAGHLVAALVKLYRDNAATLTPDPLYSSVFDSHPPAAVRILRLQAQGR

SEQ ID NO: 6760 - DNA, 1314 bp, Acidovorax sp. JS42
  CDS (1)..(1314): transl_table=11
atgcagcctccttccgcctccctcctctcgccatcccacctgaccacactggtgttcgccggactgctgctcgcaggccttgccttgcgcctgtggctggccacgcgccagatccgccacgtggcgcagcaccgcggcgccgtgcccacggccttcgcccaccgcattccgctcgccgcgcaccagaaggcagccgactacaccattgccaaggcgcgcttcggcctgctggaaatggcgctggctaccgccgtggtgctgggctggacgctgctgggtgggctggatgcgctgaaccaggcgctgctgtcctggctgggcggtggcatgctgcagcagttggcgctgctggcctgcttcgtgctcatcgggggtgccatcgacctgcccgtcgcgctgtaccagaccttcgtgatcgagcagcgcttcggcttcaaccagatgaccccgcgcctgtggctggccgacctgctcaagtccacgctgctgggcgcggtgatcggcctaccgatcgcggcgctgatcctgtggctcatgggcgccgccggaccgctgtggtggctgtgggcctggggcacgtggatgggcttcaatctgctgctgatggtggtcttcccgctgttcatcgcgccgctgttcaacaagttccagccgctggaggacgaatcgctcaaggcgcgcgtcaccgcgctgatgcaacgctgcggcttcgcagccaagggcctgttcgtgatggacggcagccgccgcagcgcgcacgccaacgcctatttcaccggcgtgggcaaggccaagcgcgtggtgttctacgacacgctgctcaagcagctgtcgcccggcgaagtggaagccgtgctcgcgcacgaactcggccacttcaagcacaagcacatcacgcggcgcctggtcggcatgttcgccatcagcctggcgggctttgcgttgctgggctggctgtccacgcgcacgtggttctacacgggcctgggcgtgcaacccaacctgatgctgccgggcgtgcccggcgccgcgcccaacgacgcgctggcgctgctgctgttcctgcttgcagcgcccgtgttcacgctgttcgtcacgcccgtactggcacagctctcgcggcgccatgagttccaggccgacgcctacgccgcggcccagagcagcggcggcgacctggcgtccgccctgctcaagctctacgaagacaatgcctccacgctcacgcccgatccggtgtttgcgaagttctactactcccaccctcccgccacggaacgcctggcgcgtctgcccgtggccttgcagccatga

SEQ ID NO: 6761 - protein, 437 aa, Acidovorax sp. JS42
MQPPSASLLSPSHLTTLVFAGLLLAGLALRLWLATRQIRHVAQHRGAVPTAFAHRIPLAAHQKAADYTIAKARFGLLEMALATAVVLGWTLLGGLDALNQALLSWLGGGMLQQLALLACFVLIGGAIDLPVALYQTFVIEQRFGFNQMTPRLWLADLLKSTLLGAVIGLPIAALILWLMGAAGPLWWLWAWGTWMGFNLLLMVVFPLFIAPLFNKFQPLEDESLKARVTALMQRCGFAAKGLFVMDGSRRSAHANAYFTGVGKAKRVVFYDTLLKQLSPGEVEAVLAHELGHFKHKHITRRLVGMFAISLAGFALLGWLSTRTWFYTGLGVQPNLMLPGVPGAAPNDALALLLFLLAAPVFTLFVTPVLAQLSRRHEFQADAYAAAQSSGGDLASALLKLYEDNASTLTPDPVFAKFYYSHPPATERLARLPVALQP

SEQ ID NO: 6762 - DNA, 1236 bp, Bacillus anthracis str. A2012
  CDS (1)..(1236): transl_table=11
ttgtacgttgggtttgcgttatttatatattggtatttatttggatggagtcatgaactgattccggacatgtataaaggaacgagtgcagatccagaaacgtttatgaatgcaagagagcttacgctaagccaagattattcgcgcgtgaaaaatttactgtactttttagcgacgcctctagaatggattatattattgtttgtacttgtgctcggtgtttcgaaaaagtttgagaaatggtcgaaggaaacgacgaaaataagtgttctgcaagttgcgatttatttcttttatttatcactactcacaacagttcttgccttgccgatgcaatggattagccgaaaagtgtccgttgattacggcatttcaacgcaaagtacacaaagctggataaaagatcacgttatcggtttttgggaaagttatgcgacgatgttaattgtagttgccgttctgttatggcttatccgtaaattcccgaagagatggtggctagcagggtgggcgctctctgtaccatttacaatctttttaacatttatacagcctgtcgttattgatccactttataacgacttttcgacgctgaaaaataaggaattagaaacgaaaattttagcgatagcagataaagcggacattcctgctaaacacgtgtatgaagtaaatatgtcagagaaaacgaatgcgttaaatgcatatgtaacaggaattggccctaacgctcgtattgtaatgtgggatacaacgcttaagcaattaaaagataaagagattttatttataatggcccatgaaatggggcattacgttatgaaacatatatattggggcgttgcgagttatgtattgttatcgtttatagggatgtatctcattagtcgtattataaatatgtgtattcgaaaatggggagatacgctgcaagtttcaaaagcagcatgtttctcaattttacctttatttttcttaatttcttctgtactctcttttgcatcacagccagcaacaaactatgtttctcgtatagaagaacgagcggcagatcaatatgctttagacatgacgaaagacggaaaccggtgtaaagggtttcaatatttatcaaaaacgagcttaagccaagtaaatccgcctgcgttagtaaaatttttcttatatacacacccaccaatttttgaaagaattcatgcgtttgaacaatatgagaaacaaagcaaaaagaagtag

SEQ ID NO: 6763 - protein, 411 aa, Bacillus anthracis str. A2012
MYVGFALFIYWYLFGWSHELIPDMYKGTSADPETFMNARELTLSQDYSRVKNLLYFLATPLEWIILLFVLVLGVSKKFEKWSKETTKISVLQVAIYFFYLSLLTTVLALPMQWISRKVSVDYGISTQSTQSWIKDHVIGFWESYATMLIVVAVLLWLIRKFPKRWWLAGWALSVPFTIFLTFIQPVVIDPLYNDFSTLKNKELETKILAIADKADIPAKHVYEVNMSEKTNALNAYVTGIGPNARIVMWDTTLKQLKDKEILFIMAHEMGHYVMKHIYWGVASYVLLSFIGMYLISRIINMCIRKWGDTLQVSKAACFSILPLFFLISSVLSFASQPATNYVSRIEERAADQYALDMTKDGNRCKGFQYLSKTSLSQVNPPALVKFFLYTHPPIFERIHAFEQYEKQSKKK

SEQ ID NO: 6764 - DNA, 1239 bp, Prosthecochloris aestuarii DSM 271
  CDS (1)..(1239): transl_table=11
atgaatgtttttggtgttattattttctcaacccttttttttacttttctgctcagaattgttgccaatgttgtcaaccttcgcttcgcaggagcgggacttcctgatgagttcaagggtgttttcgatgggaaagcctatgagaagtctcagcgttatcttcgtaagaacactgctttttcgatggtgagcggtggttttgatctggcggttcttctgattttctggttttcaggtggttttggcgctatcgataccgttgtaagaggttttggtcagtcctcgatcgtaaccggtcttctgtttttcggagtgctgctgctttttcagagcctgatctctctcccttttacgctctacagaatatttgtgatcgaagagaaattcggttttaataaaacgactccctcgacgtttatcgtcgataccctcaaatcggttgttcttggtgtgacgcttggcggtccggtgcttgccgctctgctctggtttttcgagtacacgggggctatggcctggctctgggcctgggcgggaataacttttttcagcctcctgcttcagtatgcggcaccttctctcatcatgcctcttttcaatcgttttacgccgcttgaggacggagaactcaagtctgctatcatgcgctacgccaaaagcgtcgggtttcctcttgaggggatttatgtgattgacggctcgaggcgctcctccaaagccaacgcattttttaccggatttggccgccagaaacgtattgctctcttcgatacgctcatcgaacagcacagtgtcgaggaacttgtcgctgtacttgctcatgagatcggacattacaaaaaaaagcacattcttatttccatggtgcttaatgcgctcaatacaggcgtcatattttttctcctctcggtctttatgaacaaccgcctgctgtttgacgccttttatgtgcaggagacatcggtctatgccagtctcgtcttttttttcctcctctatagtccgattgagtttttattgtctatcgttttgcagatgctttcgagaaagcatgaattcgaagcagattactatgctgcaaccacctatagcaatggaggcgctctggttgatgctttgaaaaaactctcgcgcagcagcctgtcgaaccttacgcctcaccctttctatgtgtttctcaattattcacatccgcccgttctggagcggatacgtcgcatcacgaacgttacctcataa

SEQ ID NO: 6765 - protein, 412 aa, Prosthecochloris aestuarii DSM 271
MNVFGVIIFSTLFFTFLLRIVANVVNLRFAGAGLPDEFKGVFDGKAYEKSQRYLRKNTAFSMVSGGFDLAVLLIFWFSGGFGAIDTVVRGFGQSSIVTGLLFFGVLLLFQSLISLPFTLYRIFVIEEKFGFNKTTPSTFIVDTLKSVVLGVTLGGPVLAALLWFFEYTGAMAWLWAWAGITFFSLLLQYAAPSLIMPLFNRFTPLEDGELKSAIMRYAKSVGFPLEGIYVIDGSRRSSKANAFFTGFGRQKRIALFDTLIEQHSVEELVAVLAHEIGHYKKKHILISMVLNALNTGVIFFLLSVFMNNRLLFDAFYVQETSVYASLVFFFLLYSPIEFLLSIVLQMLSRKHEFEADYYAATTYSNGGALVDALKKLSRSSLSNLTPHPFYVFLNYSHPPVLERIRRITNVTS

SEQ ID NO: 6766 - DNA, 1236 bp, Croceibacter atlanticus HTCC2559
  CDS (1)..(1236): transl_table=11
atgactcctactaccctattttttatactaattgcaattatcattatagagtttgttatcgatacaactttagatgttttaaatgctaaacactatggtgataaacttccggaaccattacaagatgtttacgacacagaggaatatttaaaatctcaggcttataaaaaagagcgttttaaatttagtatggtctccagtgtattttccttagtattgcttttagcttttttcttcctagatggctttgcttttgttgatgagttagcaagacaatatacagatcatcccattttaatagcgcttatcttttttggtattattatgttgggtagcgacattcttactacaccattttcatattacagcacatttgttatcgaagaaaaatatggttttaataaaacaacgctaaaaacctttgcacttgacaaaattaagggctggtttatgctcataatagtaggtggcgcgcttttatctttaataatctggttttaccaatgggcaggatcttcattctggttatatgcttgggcagttatcgctgtattttctgttgtgatgaatatgttttatgcaaaactcatagtcccattatttaacaaacaaacacctttagaagatggttcactaagacaaaaaatagaagcatatgcaagtaaagttgggtttaagttagataacatatttgtaatagatggttctaaacgaagtacaaaagcaaatgcctacttctcaggatttggtcgtgaaaaacgcataacactatacgataccttaataaatgatttagaagaagaagaaatagtagcagttcttgcacatgaggttggacattataagaaaaaccatattataattaatttagtcacctccatagcattaacaggtcttacgctttggttactttctttgtgtattggtagtccattattatcacaggcattaggagtagctacaccaagttttcatattggtttaattgcctttggaatactatatagcccaatctcagaaatcacgagcttacttatgaattttatttcaagagcttttgaatatcaagcagataactttgccaaagaaacctatgctggagcgccattaatttcaggattaaaaacactgtctaaaaatagtttaagcaatttaacaccacatcctgcttatgtttttatgcattattcacatccaacattattacagcgttttcgtaatatttcttctacataa

SEQ ID NO: 6767 - protein, 411 aa, Croceibacter atlanticus HTCC2559
MTPTTLFFILIAIIIIEFVIDTTLDVLNAKHYGDKLPEPLQDVYDTEEYLKSQAYKKERFKFSMVSSVFSLVLLLAFFFLDGFAFVDELARQYTDHPILIALIFFGIIMLGSDILTTPFSYYSTFVIEEKYGFNKTTLKTFALDKIKGWFMLIIVGGALLSLIIWFYQWAGSSFWLYAWAVIAVFSVVMNMFYAKLIVPLFNKQTPLEDGSLRQKIEAYASKVGFKLDNIFVIDGSKRSTKANAYFSGFGREKRITLYDTLINDLEEEEIVAVLAHEVGHYKKNHIIINLVTSIALTGLTLWLLSLCIGSPLLSQALGVATPSFHIGLIAFGILYSPISEITSLLMNFISRAFEYQADNFAKETYAGAPLISGLKTLSKNSLSNLTPHPAYVFMHYSHPTLLQRFRNISST

SEQ ID NO: 6768 - DNA, 1236 bp, Flavobacteria bacterium BBFL7
  CDS (1)..(1236): transl_table=11
atggacgctatttcattgttctaccttattataggaatacttgtttttgactttatcttagatcaactactaggttatcttaattatacttggtattcgaatgagctacctcaagagttaaatgatgtctatgatgccgatgagtatgctaaatcgcaagaatataaaaagaccaattatcggttcagtctattaagcagcagtgtttcatttattgctattttaatctttttattctatgatgggtttgctttgatagacacttgggctcgtacgttagtaaatcacgatatactagttggcctattgttcttcacagttattgcagcagctggcgagatcatttctttaccattttcctattattccacttttgtgattgaagagaaatttggttttaataaaacaacacataaaacatttgtaatcgataaaattaaaggatggttacttactgcaatcttaggtggcggaatcttgtctttagttatcgtctgttataattgggctggagcaaacttctggtggtatgtatggattttgatttttgtgatttctctattgatgaacatgttttatgcgcgatggtttgtaccgctatttaataagcaaactccacttgaagaaggaactttaaaagccgcaattgcaacctatgcaaaaggcgtagggtttcaactagataaaattttagtaattgatggtagtaaacgatctactaaggctaatgcatatttcagcggttttggaagtgaaaaacgtgtgacactctatgacactttaatttctaaactaactgaagatgaaattgttgctgtgctcgctcatgaagtcggacattataaacgtaaacacatcatttacaatttgatagcaagtactcttacgacaggatttacactgtggttattttcattatttgttgatagtgcaaccttatcagaggcattaggcgttatgactccttcatttcacgttgggttagtagcatttgggttgctctactctcctatttctacagttactggaatagtgatgagttcgctttcgcgaaaatttgaatacgaagcagatgcttatgccaaagacacatttgaaggcgaaccgttgattacagccttaaaaaaattgaataaaactagcttgagtaatcttactccgcatccagcatatgtattttttaattactcgcatcctactctttatcaacgtatgatggctatgaggaatgtttaa

SEQ ID NO: 6769 - protein, 411 aa, Flavobacteria bacterium BBFL7
MDAISLFYLIIGILVFDFILDQLLGYLNYTWYSNELPQELNDVYDADEYAKSQEYKKTNYRFSLLSSSVSFIAILIFLFYDGFALIDTWARTLVNHDILVGLLFFTVIAAAGEIISLPFSYYSTFVIEEKFGFNKTTHKTFVIDKIKGWLLTAILGGGILSLVIVCYNWAGANFWWYVWILIFVISLLMNMFYARWFVPLFNKQTPLEEGTLKAAIATYAKGVGFQLDKILVIDGSKRSTKANAYFSGFGSEKRVTLYDTLISKLTEDEIVAVLAHEVGHYKRKHIIYNLIASTLTTGFTLWLFSLFVDSATLSEALGVMTPSFHVGLVAFGLLYSPISTVTGIVMSSLSRKFEYEADAYAKDTFEGEPLITALKKLNKTSLSNLTPHPAYVFFNYSHPTLYQRMMAMRNV

SEQ ID NO: 6770 - DNA, 1242 bp, Candidatus Desulfococcus oleovorans Hxd3
  CDS (1)..(1242): transl_table=11
atgaccggaatcggctggataattcttgtgttgctgtgtgtgcattacggggtggagcggctggccgatcttctcaacctcagggccctctcccggaaagtgccgccatcttttgccggatggtatgacccggaccgtcatgcaaaatcccgggcctacctgaaaaacaccaccggcctggccatggtggaagcatccgtggatctggcaatcctgctggccttctggtccgcccggggttttagctttctggaccggtgggtgtccggcctcggcttttcaccaattgtttccgggctggtgtttatcggggttctggtcagcgcccgggcagttttttctcttcctttttccatctattcaacctttgtgatagaggagcggttcgggttcaaccgcaccacctggccacttttccttagcgaccggatcaagagcctgtttctggcccttctgctgggcgcgcccctgctgaccggcctgctgtggttttttgaaaaccttgggaaaacggcctggctctggtgctggatcgggttctgcctggtggtgctggtgctacaggtggtggtgccggcatggattctgccgctgtttaaccggtttaccccccttgaacccggggacctgaaaaacgccgtgctggcctgtgcccgggccgcgggctttcccgttcaaaccgtttttgtgatggatggatcaaaacggagcgcaaaatccaacgctttttttgccggcctgggccggcaccggcgtctggtgctgtttgacacgctgattgacaaccatcctgttttcgaagtcgtggcggttgtggcccatgaaatcggccactacaaaaagagacacctgcagtggcaaacccttgcggccatgggccaggccggggtgatgttttttctgctgtcggtggcggtctcgtggccggatctttttaccgccttttatgtctccaatgtgtcggtgtatggagggctggtctttttttccattctctatggtccggtagcctgggccctgggcctgccggtccaggcgctgtcccggcaccacgagtaccaggccgacgcctttgccgtgaaccttaccggtaacggcccggccctggccgatgccctgaagcggctctccgcggacaacatggcaaacctcaccccccatcctttttacgtgctgctgcactactcccatccaccggtaatcgatagagtacaggcgattgagaaacacgagggccactaa

SEQ ID NO: 6771 - protein, 413 aa, Candidatus Desulfococcus oleovorans Hxd3
MTGIGWIILVLLCVHYGVERLADLLNLRALSRKVPPSFAGWYDPDRHAKSRAYLKNTTGLAMVEASVDLAILLAFWSARGFSFLDRWVSGLGFSPIVSGLVFIGVLVSARAVFSLPFSIYSTFVIEERFGFNRTTWPLFLSDRIKSLFLALLLGAPLLTGLLWFFENLGKTAWLWCWIGFCLVVLVLQVVVPAWILPLFNRFTPLEPGDLKNAVLACARAAGFPVQTVFVMDGSKRSAKSNAFFAGLGRHRRLVLFDTLIDNHPVFEVVAVVAHEIGHYKKRHLQWQTLAAMGQAGVMFFLLSVAVSWPDLFTAFYVSNVSVYGGLVFFSILYGPVAWALGLPVQALSRHHEYQADAFAVNLTGNGPALADALKRLSADNMANLTPHPFYVLLHYSHPPVIDRVQAIEKHEGH

SEQ ID NO: 6772 - DNA, 1371 bp, Penicillium marneffei
  CDS (1)..(1371)
atgattaacaacttgctacaggcactcgcgcggttcctggaccgcccgctcttcccatggaagacggtgctggttggcttctctctaggtcaatatgtctttgagagcttcctttcgttacgccaatatcgtgttctccagcataccaagcccccaaaggtcctagaaggtgaaatcacagagaaagtgtttgaggatagtcagacatacggtcgcgcaaaagcaaaattcggtttcttctctggtatctatggtcagctccagaacttggttttcatctactacgacttcttgccgaaaatatgggcattgactggcgtttggctcgttcgttacttcccatcctggtcacagggtgaaattggacatacattgctgttcttcttcgccttcaacattctgaccactatcttgtcgcttccaatttcatactacagcacattcgttctcgaggaaaaattcggttttaacaaacagactgtgggactatggattacggatatgttgaagggtcaggctcttggtcttgttctaggtggtcccatcatggctgctgtgctcaagatcatccagaagactggtaacgaattcttctactacctttggatcttcagcattcttgttcaggtcttcgctattacgatctacccgattgttatcttgcccatgttcaacaaactctcgcctttagagcctggcctcatcaagactggggttgaagatctcgctcaaaagctcaaattcccgttgcatgacatttactctattgatggcagtaagcgaagcgcccatagcaatgcctatttctttggattcccctggaagaagcacattgtgatctacgacactcttatggagaagagcgagcctgaagaggttgttgctgttcttagccatgaattaggtcactggaagcttggacacactaccaagttgtttggaattgctcaggcccacatgctttatatctttgctttgttcactgcgtttgtcaacaataaatccttattccaatcattcggtttccacaacgaacagcctatcatgattggcttcttgctcttttcagacgctttggcacctatggatgctgttgtgaaattcttgatgaacattctcagccgcaagtttgaatttgaagcggatgcctttgcagccaaccttggacagtcaaagctccttgcacaatcgcttctcaagctccaaatccaaaatctcagcacaatggatgctgactggatgtacgctagttaccactattcccaccccattctcacggagcgtttggctgcgcttggatggaagggtaaaggagcagaaaaggccgaggatagtgagaagcctgttaaggctgcggatagggagttgtaa

SEQ ID NO: 6773 - protein, 456 aa, Penicillium marneffei
MINNLLQALARFLDRPLFPWKTVLVGFSLGQYVFESFLSLRQYRVLQHTKPPKVLEGEITEKVFEDSQTYGRAKAKFGFFSGIYGQLQNLVFIYYDFLPKIWALTGVWLVRYFPSWSQGEIGHTLLFFFAFNILTTILSLPISYYSTFVLEEKFGFNKQTVGLWITDMLKGQALGLVLGGPIMAAVLKIIQKTGNEFFYYLWIFSILVQVFAITIYPIVILPMFNKLSPLEPGLIKTGVEDLAQKLKFPLHDIYSIDGSKRSAHSNAYFFGFPWKKHIVIYDTLMEKSEPEEVVAVLSHELGHWKLGHTTKLFGIAQAHMLYIFALFTAFVNNKSLFQSFGFHNEQPIMIGFLLFSDALAPMDAVVKFLMNILSRKFEFEADAFAANLGQSKLLAQSLLKLQIQNLSTMDADWMYASYHYSHPILTERLAALGWKGKGAEKAEDSEKPVKAADREL

SEQ ID NO: 6774 - DNA, 1266 bp, Candidatus Kuenenia stuttgartiensis
  CDS (1)..(1266): transl_table=11
atgaataactatctcatcattgtattgtcagcatatatctttgtggtaattgcggggtactggctagattaccttaatctttcccacttaaagaaacatgggaacaaaatccctccggacttcgagggctacatagaccaggaattactcaataagacgcaaaggtacgttattgaaaacacaaagttcaattttgtaagttctctcttccataacgcaattctgctggcctttctatttggcggtttgcttgatagttacaactcatggattgtatctttgaaaatgcccttcattgtatcagggttagtcttcttcctgatactgctttatgcagataccgttttgatgattcccttcaaactgtaccatacatttgtcattgagaataaatatggcttcacaaccacaacaatgaagctatggataacagacttgtggaaatcacttttaataacaaccatcatggtttctttcataatcgcaacgggatttttcatcgtacaggccagccctggtttatggtggttctggatatggtgctttttcttattattcagcattctcatgatgtatatattcccgtatgtaatagcgcctatctttaacacatttactcccgtagaagacgaatcgcttcaaaaagggataagggaacttatgcaaaaggtgggcattaaagtaaagagcgtcttccaaatggacgcatcaaagagaacgaagcacacgaacgcctattttaccggcattggaaaagtaaaaaggatcgttctttatgatacgcttatcgggcagatggaaaaagacgaaattattgcagtacttgcacatgaagcaggacactggaagaaaaaacatcttatgaaacaccttattgtttctgaaattattgcaattattgtaatgtttatttcattcaatataatgcagaaagaaggcctgatacagctcttccaattgaaggaaagcactttttttgcgaagattgttatcattggatttttaggctctatagcagcattccccttcagccccctttcacactatttttcccggaaacacgaatatgaggcggatgcgttttcttatgaaatgacaaaggacaataagagcatgataaacatgcttgtaaagctctcaaaggataatctttccaatctctatccacatccactctacgcggcttttcattattcccatccgccgatattggaaagaatacaatcgatcaggcgaaggaagaataaagaattaattgatagttga

SEQ ID NO: 6775 - protein, 421 aa, Candidatus Kuenenia stuttgartiensis
MNNYLIIVLSAYIFVVIAGYWLDYLNLSHLKKHGNKIPPDFEGYIDQELLNKTQRYVIENTKFNFVSSLFHNAILLAFLFGGLLDSYNSWIVSLKMPFIVSGLVFFLILLYADTVLMIPFKLYHTFVIENKYGFTTTTMKLWITDLWKSLLITTIMVSFIIATGFFIVQASPGLWWFWIWCFFLLFSILMMYIFPYVIAPIFNTFTPVEDESLQKGIRELMQKVGIKVKSVFQMDASKRTKHTNAYFTGIGKVKRIVLYDTLIGQMEKDEIIAVLAHEAGHWKKKHLMKHLIVSEIIAIIVMFISFNIMQKEGLIQLFQLKESTFFAKIVIIGFLGSIAAFPFSPLSHYFSRKHEYEADAFSYEMTKDNKSMINMLVKLSKDNLSNLYPHPLYAAFHYSHPPILERIQSIRRRKNKELIDS

SEQ ID NO: 6776 - DNA, 1630 bp, Paracoccidioides brasiliensis
  CDS (73)..(1434)
acgcgtgtcggaacgaacttcttcctctctcctgctgccaccatccaccagcatcacggcagcagtctggcaatgaatatcctccagcaactcgcacagctcctcgatcgcccattcttcccctggaagaaggtcatcgtgggcttttccgtcgggcagtatctcatcgagggattcctgtctctccgacaattcagggtactccaacagacgaagccgccaaaggtgttggcggaggaggtttcgcagtctgtctttgataagagtcaggcatacggacgagcaaaggccaaattcgggttcgtgtccgctctctatggccaaatccagaaccttgcattcatctattatgacgcccttcccaagctgtgggctataaccggcctcctcctcacccgttacatgcccgcacgcttcacgggtgagatctcccatacgctagctttcgtctttacattcaacatcatcaccacgatcctctccctgcccacatcgtactacagcaccttcgtcatcgaggagaaattcggcttcaacaagcaaaccatcaagctatgggtgacggatatgctcaagggacaatttctgggtatcgtactgggagcaccaattatcagcgccatcttgaaaatcgtcaagaagactggcaccagcttcttctattacctctggctgtttggcatggcacgaggcattactatctacccaattgccatcttgccgttgtttaacaaattgacaccgctgaaacctgggattctcaagactggcgttgaggatttagctaggagactcaagttccctctcaaagagctgcatgtgattgacggaagcaagaggagcgctcatagcaatgcgtatttctatggcctcccgtggaagaagcatatcgtcatttacgataccctgatcgagaagagcgaacctgaggaagtcgttgcggttctgggacatgagctgggacactggagtcttaatcatactacaaagctgtttggaatcgctcagttccacatgttctacatctttgcccttttctccgcctttgtgaacaacaaatcgctgtaccaggacttcggatttgccaatgaaatgcccattatgatcggtttcattctattctctgatgcgcttgcacctatggacgctgtggtgaagctattgatgaacgttctaagcagaaaatttgaatttgaagctgacgcatttgccgtaaacctcggatactccactgagctcgccaagtcgttgctcaagctccagatccaaaacttgtccaccatggacgcagattggatgtatgccagctatcattactcccacccaattcttccagaaagacttgctgcacttgggtggagcggggggaaagtgactggggggaagtatgaagatagcgagaagccagtaaagactgctgatcgggagttgtaggttgaactgaggctgtcaggggtgtagagttacatcggtttaatatattgaggatatataatttaaattgggacaaaacaaagcgtgctgtctgttattttaggtagtgtgttgttttgcttgatatgagggaagttttaggggaaatcttaccagaaaggagcgagcgggtggttgactcgctcaaatataccta

SEQ ID NO: 6777 - protein, 453 aa, Paracoccidioides brasiliensis
MNILQQLAQLLDRPFFPWKKVIVGFSVGQYLIEGFLSLRQFRVLQQTKPPKVLAEEVSQSVFDKSQAYGRAKAKFGFVSALYGQIQNLAFIYYDALPKLWAITGLLLTRYMPARFTGEISHTLAFVFTFNIITTILSLPTSYYSTFVIEEKFGFNKQTIKLWVTDMLKGQFLGIVLGAPIISAILKIVKKTGTSFFYYLWLFGMARGITIYPIAILPLFNKLTPLKPGILKTGVEDLARRLKFPLKELHVIDGSKRSAHSNAYFYGLPWKKHIVIYDTLIEKSEPEEVVAVLGHELGHWSLNHTTKLFGIAQFHMFYIFALFSAFVNNKSLYQDFGFANEMPIMIGFILFSDALAPMDAVVKLLMNVLSRKFEFEADAFAVNLGYSTELAKSLLKLQIQNLSTMDADWMYASYHYSHPILPERLAALGWSGGKVTGGKYEDSEKPVKTADREL

SEQ ID NO: 6778 - DNA, 1371 bp, Emericella nidulans
  CDS (1)..(1371)
atgtggattctcgatcaactggcgcgtctactggaccgccccttcttcccatggaagaacgtactcgtcggcttttctttaggccagttcattcttgaggggattctctcgttccgtcagtataaggttctccagcgaaccaaggcccctaaggtgcttgaaggcgaagtgtctcaaaaggtttatgatcagagccaagcgtacggtcgcgcaaaggcaaaatttggtttcatctctgggttatatggtcaaattcagaatctcgcattcatctacggcgatgtcctccccaagctatggggactcagcggctttttgttggcgcaatacctcccagctcggttccagggcgaaataccccagactctcctgtttctttttggatttaaccttataagtactgttctctccctcccgatctcctactacaacacattcgtgcttgaggagaaatttggctttaacaagcagacggttaagctatgggtatccgacatgcttaagggccagatgttgggtattgttctgggcgcgcccatcattagcgccgttctgaagattgtccagaagactgggacttcatgcttttactacctttggctttttggtgtctttgttcaggttttcgccatcaccatctaccctatcgccattttgcctttgtttaacaagctttcccctcttgaacctggtgcgatcaagactggcgttgagaatcttgccaagaagctcaacttcccgctccaggaactccatgtgatcgatggtagcaagcgcagcgcacacagcaatgcttatttttacggtctcccttggaagaagcacattgtcatttatgataccttgattgagaagagtgagcctgaggaggttgtcgctgtattgagccacgagttgggccactggagcctcagccacactacgaagctcttcggcatcgctcaattccacatgttctatatctttgctctcttctcggcgttcgtgaataacagatcactctaccagtcgttcggcttccacactgaacagcctattatgattggattcctcctcttctctgacgccctcgcgcctatggatgctgtcgttaaacttctgatgaatatccttagtcgcaaatttgaatttgaagcggatgcatttgcagtcaacctcggatactcggaggagctctcccagtcccttctcaagctccagatccagaacctgagcactatggatgcggactggatgtacgccagctaccactactctcatcccatccttcctgagagactcaaggctctaggctggaagggcagaaaagttacagaccacaaggaggaagacagtgaaaagcctgtcaaggctgccgaccgtgaactctaa

SEQ ID NO: 6779 - protein, 456 aa, Emericella nidulans
MWILDQLARLLDRPFFPWKNVLVGFSLGQFILEGILSFRQYKVLQRTKAPKVLEGEVSQKVYDQSQAYGRAKAKFGFISGLYGQIQNLAFIYGDVLPKLWGLSGFLLAQYLPARFQGEIPQTLLFLFGFNLISTVLSLPISYYNTFVLEEKFGFNKQTVKLWVSDMLKGQMLGIVLGAPIISAVLKIVQKTGTSCFYYLWLFGVFVQVFAITIYPIAILPLFNKLSPLEPGAIKTGVENLAKKLNFPLQELHVIDGSKRSAHSNAYFYGLPWKKHIVIYDTLIEKSEPEEVVAVLSHELGHWSLSHTTKLFGIAQFHMFYIFALFSAFVNNRSLYQSFGFHTEQPIMIGFLLFSDALAPMDAVVKLLMNILSRKFEFEADAFAVNLGYSEELSQSLLKLQIQNLSTMDADWMYASYHYSHPILPERLKALGWKGRKVTDHKEEDSEKPVKAADREL

SEQ ID NO: 6780 - DNA, 1640 bp, Arabidopsis thaliana
  CDS (110)..(1384)
aaaaacgaaaaacctctcttttgtcgttcctctgctttcttcgatttgcttctgctttcttcgatttgcttctgctttcatcgcggttcaggtcactcttttctcagccatggcgattcctttcatggaaaccgtcgtgggttttatgatagtgatgtacatttttgagacgtatttggatctgaggcaactcactgctctcaagcttccaactctcccgaaaaccttggttggtgtaattagccaagagaagtttgagaaatcacgagcatacagtcttgacaaaagctattttcactttgttcatgagtttgtaactatacttatggactctgcaattttgttcttttggatcttgccttggttttggaagatgtctggagctgttttaccgaggttgggccttgatccagagaatgaaatactgcatactctttcattcttggctggtgttatgacatggtcacagatcactgatttgccattttctttgtactcaactttcgtgatcgagtctcggcatgggttcaacaaacaaacaatatggatgttcattagggacatgatcaaaggaacattcctctctgtcatactaggcccacccattgttgctgcgataattttcatagtccagaaaggaggtccttatcttgccatctatctgtgggcattcatgtttatcctgtctctagtgatgatgactatatacccggtcttgatagcaccgctcttcaacaagttcactcctcttccagatggagacctccgggagaagattgagaaacttgcttcttctctaaagtttcctttgaagaagctgtttgttgtcgatggatctacaaggtcaagccatagcaatgcttacatgtatggtttctttaagaacaaaaggattgttctttatggtacgttgattcagcagtgcaagaatgaggatgaaattgtggcggttattgcacacgagcttggacattggaaactgaatcacactacatactcgttcattgcagttcaaatccttgccttcttacaatttggaggatacactcttgtcagaaactccactgatctcttcaggagtttcggatttgatacacagcctgttctcattggtttgatcatatttcagcacactgtaataccactgcaacatctagtaagctttggcctgaacctcgttagtcgagcgtttgagtttcaggctgatgcttttgctgtgaagcttggctatgcaaaagatcttcgtcctgctctagtgaaactacaggaagagaacttatcagcaatgaacactgatccattgtactcagcttatcactactcacatcctcctcttgttgaaaggcttcgagccattgatggagaagacaagaagacagattaagtccgcttaactcgtctcttgtacgggttgatgtcttttaggtgacaggtcgaaacaaaacaaaaaaaagtgtaaaaccatataggcagaggcctcttttgtttgttttttacttttacagtgggttttgcctagttactactagtttttgagtttcttaaaagtggaatcactcgcacggttcgatatgatcatttctgattcgtcttcttttattaaaatgaggagaatctaacgtgtaaaaaaaaaaaaaaaa

SEQ ID NO: 6781 - protein, 424 aa, Arabidopsis thaliana
MAIPFMETVVGFMIVMYIFETYLDLRQLTALKLPTLPKTLVGVISQEKFEKSRAYSLDKSYFHFVHEFVTILMDSAILFFWILPWFWKMSGAVLPRLGLDPENEILHTLSFLAGVMTWSQITDLPFSLYSTFVIESRHGFNKQTIWMFIRDMIKGTFLSVILGPPIVAAIIFIVQKGGPYLAIYLWAFMFILSLVMMTIYPVLIAPLFNKFTPLPDGDLREKIEKLASSLKFPLKKLFVVDGSTRSSHSNAYMYGFFKNKRIVLYGTLIQQCKNEDEIVAVIAHELGHWKLNHTTYSFIAVQILAFLQFGGYTLVRNSTDLFRSFGFDTQPVLIGLIIFQHTVIPLQHLVSFGLNLVSRAFEFQADAFAVKLGYAKDLRPALVKLQEENLSAMNTDPLYSAYHYSHPPLVERLRAIDGEDKKTD

SEQ ID NO: 6782 - DNA, 1275 bp, Arabidopsis thaliana
  CDS (1)..(1275)
atggcgattcctttcatggaaaccgtcgtgggttttatgatagtgatgtacatttttgagacgtatttggatctgaggcaactcactgctctcaagcttccaactctcccgaaaaccttggttggtgtaattagccaagagaagtttgagaaatcacgagcatacagtcttgacaaaagctattttcactttgttcatgagtttgtaactatacttatggactctgcaattttgttctttgggatcttgccttggttttggaagatgtctggagctgttttaccgaggttgggccttgatccagagaatgaaatactgcatactctttcattcttggctggtgttatgacatggtcacagatcactgatttgccattttctttgtactcaactttcgtgatcgagtctcggcatgggttcaacaaacaaacaatatggatgttcattagggacatgatcaaaggaacattcctctctgtcatactaggcccacccattgttgctgcgataattttcatagtccagaaaggaggtccttatcttgccatctatctgtgggcattcatgtttatcctgtctctagtgatgatgactatatacccggtcttgatagcaccgctcttcaacaagttcactcctcttccagatggagacctccgggagaagattgagaaacttgcttcttctctaaagtttcctttgaagaagctgtttgttgtcgatggatctacaaggtcaagccatagcaatgcttacatgtatggtttctttaagaacaaaaggattgttctttatgatacgttgattcagcagtgcaagaatgaggatgaaattgtggcggttattgcacacgagcttggacattggaaactgaatcacactacatactcgttcattgcagttcaaatccttgccttcttacaatttggaggatacactcttgtcagaaactccactgatctcttcaggagtttcggatttgatacacagcctgttctcattggtttgatcatatttcagcacactgtaataccactgcaacatctagtaagctttggcctgaacctcgttagtcgagcgtttgagtttcaggctgatgcttttgccgtgaagcttggctatgcaaaagatcttcgtcctgctctagtgaaactacaggaagagaacttatcagcaatgaacactgatccattgcactcagcttatcactactcacatcctcctcttgttgaaaggcttcgagccattgatggagaagacaagaagacagattaa

SEQ ID NO: 6783 - protein, 424 aa, Arabidopsis thaliana
MAIPFMETVVGFMIVMYIFETYLDLRQLTALKLPTLPKTLVGVISQEKFEKSRAYSLDKSYFHFVHEFVTILMDSAILFFGILPWFWKMSGAVLPRLGLDPENEILHTLSFLAGVMTWSQITDLPFSLYSTFVIESRHGFNKQTIWMFIRDMIKGTFLSVILGPPIVAAIIFIVQKGGPYLAIYLWAFMFILSLVMMTIYPVLIAPLFNKFTPLPDGDLREKIEKLASSLKFPLKKLFVVDGSTRSSHSNAYMYGFFKNKRIVLYDTLIQQCKNEDEIVAVIAHELGHWKLNHTTYSFIAVQILAFLQFGGYTLVRNSTDLFRSFGFDTQPVLIGLIIFQHTVIPLQHLVSFGLNLVSRAFEFQADAFAVKLGYAKDLRPALVKLQEENLSAMNTDPLHSAYHYSHPPLVERLRAIDGEDKKTD

SEQ ID NO: 6784 - DNA, 1389 bp, Neurospora crassa
  CDS (1)..(1389)
atggagttccttcagcgtctcgcgaggttcctcgaccggcctctctttccctggaagaagctgatcatcggcttctccctcgccaactacttcatcgaaggtttcctcggttatcgtcagtatcaggtcctcaagaagaccaaggtccccaaggtgttggagcatgaggtgtcccaggaggtctttgacaagagtcaggcatacggacgcgccaaggcaaagttcgagttcttcagcggtatctacggtcaaatccaaaacatcttgttctatcagttcgacgtcctcccgaagctatggtcattcgccggcaacctcctcgttcggttcgcgccagccaggttctccggcgaaatctcgcaatctatcgtcttcgtcctgtcctttgtcgtcatctcccagattctctcgctaccgactagcctctaccacacttttgtcttggaggagaagttcggtttcaacaagtcgtctgccaagctttggattaccgacaagatcaagtccctcttcttgaccttcgttctcacgcctccgatcctcgccggctttttagctatcgtgcaaaagactggaaaccagttcttctactatctctgggttttcgtcgctggtctccaggttgtcatgatcaccatctacccgattttcattctgcctctgtttaacaagctctctcctcttgaggagggtgagctcaagagcagcgtggaggatctcgccaagaagctcaagttccccctctccgagttgcacgtcattgatggcagcaagcgcagtgcccacagcaacgcttatttcttcggcatgccctggaagaagcacattgtcatttatgataccctaattgaaaagagcgagacccaggaagttgttgccgttcttgcacacgagctgggtcactggaagttgggtcacaccactagtctctttggcatctcccaggcccacttcttcgccattttctctctcttctccgttttcatcaacaacaactccctttatgccgactttggcttccacacggtgcaccctatcatcgttggattccttctcttctcggacgtccttggccctaccgacaccctcatcaagctgggcatgaatgttctcagccgcaagttcgagttccaggctgatgagttcgccaacaagcttggctacaatgcggagctcgctcgctccttgatcaagctccagatccagaacctcagcactatggatgctgattggatgttcgccacttaccacttctcgcaccccattttgaccgagagactgaaggctctcaactggcagtccactggaaaggttgagggcaaggagaaggccaaggatggtgaagagaagattgatgttgctactgccactgggcgggatgagctctaa

SEQ ID NO: 6785 - protein, 462 aa, Neurospora crassa
MEFLQRLARFLDRPLFPWKKLIIGFSLANYFIEGFLGYRQYQVLKKTKVPKVLEHEVSQEVFDKSQAYGRAKAKFEFFSGIYGQIQNILFYQFDVLPKLWSFAGNLLVRFAPARFSGEISQSIVFVLSFVVISQILSLPTSLYHTFVLEEKFGFNKSSAKLWITDKIKSLFLTFVLTPPILAGFLAIVQKTGNQFFYYLWVFVAGLQVVMITIYPIFILPLFNKLSPLEEGELKSSVEDLAKKLKFPLSELHVIDGSKRSAHSNAYFFGMPWKKHIVIYDTLIEKSETQEVVAVLAHELGHWKLGHTTSLFGISQAHFFAIFSLFSVFINNNSLYADFGFHTVHPIIVGFLLFSDVLGPTDTLIKLGMNVLSRKFEFQADEFANKLGYNAELARSLIKLQIQNLSTMDADWMFATYHFSHPILTERLKALNWQSTGKVEGKEKAKDGEEKIDVATATGRDEL

SEQ ID NO: 6786 - DNA, 1380 bp, Arabidopsis thaliana
  CDS (1)..(1380)
atggcgattcctttcatggaaaccgtcgtgggttttatgatagtgatgtacatttttgagacgtatttggatctgaggcaactcactgctctcaagcttccaactctcccgaaaaccttggttggtgtaattagccaagagaagtttgagaaatcacgagcatacagggatatcatcactgagaactttaatatatgcagctattttcactttgttcatgagtttgtaactatacttatggactctgcaattttgttctttgggatcttgccttggttttggaagatgtctggagctgttttaccgaggttgggccttgatccagagaatgaaatactgcatactctttcattcttggctggtgttatgacatggtcacagatcactgatttgccattttctttgtactcaactttcgtgatcgagtctcggcatgggttcaacaaacaaacaatatggatgttcattagggacatgatcaaaggaacattcctctctgtcatactaggcccacccattgttgctgcgataattttcatagtccagaaaggaggtccttatcttgccatctatctgtgggcattcatgtttatcctgtctctagtgatgatgactatatacccggtcttgatagcaccgctcttcaacaagttcactcctcttccagatggagacctccgggagaagattgagaaacttgcttcttctctaaagtttcctttgaagaagctgtttgttgtcgatggatctacaaggtcaagccatagcaatgcttacatgtatggtttctttaagaacaaaaggattgttctttatgatacgttgattcagcagtgcaagaatgaggatgaaattgtggcggttattgcacacgagcttggacattggaaactgaatcacactacatactcgttcattgcagttcaaatccttgccttcttacaatttggaggatacactcttgtcagaaactccactgatctcttcaggagtttcggatttgatacacagcctgttctcattggtttgatcatatttcagcacactgtaataccactgcaacatctagtaagctttggcctgaacctcgttagtcgagcgtttgagtttcaggctgatgcttttgctgtgaagcttggctatgcaaaagatcttcgtcctgctctagtgaaactacaggtcagagaagataacaacagaacacaaactgttacctcaatttgtgtcacacacttaaatggattttttgttgggattttgcaggaagagaacttatcagcaatgaacactgatccattgtactcagcttatcactactcacatcctcctcttgttgaaaggcttcgagccattgatggagaagacaagaagacagattaa

SEQ ID NO: 6787 - protein, 459 aa, Arabidopsis thaliana
MAIPFMETVVGFMIVMYIFETYLDLRQLTALKLPTLPKTLVGVISQEKFEKSRAYRDIITENFNICSYFHFVHEFVTILMDSAILFFGILPWFWKMSGAVLPRLGLDPENEILHTLSFLAGVMTWSQITDLPFSLYSTFVIESRHGFNKQTIWMFIRDMIKGTFLSVILGPPIVAAIIFIVQKGGPYLAIYLWAFMFILSLVMMTIYPVLIAPLFNKFTPLPDGDLREKIEKLASSLKFPLKKLFVVDGSTRSSHSNAYMYGFFKNKRIVLYDTLIQQCKNEDEIVAVIAHELGHWKLNHTTYSFIAVQILAFLQFGGYTLVRNSTDLFRSFGFDTQPVLIGLIIFQHTVIPLQHLVSFGLNLVSRAFEFQADAFAVKLGYAKDLRPALVKLQVREDNNRTQTVTSICVTHLNGFFVGILQEENLSAMNTDPLYSAYHYSHPPLVERLRAIDGEDKKTD

SEQ ID NO: 6788 - DNA, 1425 bp, Schizosaccharomyces pombe
  CDS (1)..(1425)
atgtcacctggcctttgcttcctaaaagaaatttcagtcatacaagctacaccaaagcctactacaagaagttttgccaattgttgtaaaatgggaattctacagcatttgatgcacattttagacattccaggcttcccttggaaaatagtaattgctggattttctattggaaagtatgcctgggatttgtatcttcgtcgcaggcaagtgccatatttgttgagagaaaagcctcctgctattttagctgaacacgttgatgaaaaaaagtaccaaaaagcattgtcttatgctcgtgataaaagttggttttctactattgtttccacatttactttagccgttgatcttttgattattaaatatgatggactttcatacctttggaatatcactaagtttccttggatggataaattagctgcttcatcctcaaggtttagtctatcgacttcgattacgcattcctgtgttttcatgtttggacttactctgttttctcgtttaattcaaattcctttcaatctttactcaacctttgtgatcgaggaaaagtatggttttaataaatcgactttaaagatcttcgtaattgatcttttaaaggaattaagccttggtggtttacttatgagtgttgtcgttggtgttttcgttaaaattttgaccaagtttggtgataattttattatgtatgcatggggtgcctatattgtttttggcctcattttacaaactattgctccttctctaattatgcccttgttttacaagtttacaccgcttgaaaatggaagtcttagaacacaaattgaagagttagctgccagtatcaattttcccttgaagaagctttatgtgattgatgctagtcgtagatcaactcactccaacgctttcttttatgggcttccatggaacaaaggaattgtactttttgatactcttgtgaaaaatcatacggaaccggaacttattgcaattcttggtcacgaacttggtcattggtacatgtctcataatttaattaatactattatagactacggaatgagtctgttccacctcttcttatttgctgcttttattcgaaataatagcttatacacttccttcaatttcattaccgaaaaacctgtaattgttggacttctccttttttcggacgcattaggtcctttatcctccatccttacgtttgcctccaacaaagtttctcgcctttgtgagtatcaagcggatgcttttgctaaacaattagggtacgcaaaggatttgggtgatggtttaatacgcattcatgatgacaatctttctcctttggagtttgattctttatatacctcgtattaccatagtcatcccatcttggttgatcgtttgaatgcaattgattacacgacgctaaaaaagaacaattag

SEQ ID NO: 6789 - protein, 474 aa, Schizosaccharomyces pombe
MSPGLCFLKEISVIQATPKPTTRSFANCCKMGILQHLMHILDIPGFPWKIVIAGFSIGKYAWDLYLRRRQVPYLLREKPPAILAEHVDEKKYQKALSYARDKSWFSTIVSTFTLAVDLLIIKYDGLSYLWNITKFPWMDKLAASSSRFSLSTSITHSCVFMFGLTLFSRLIQIPFNLYSTFVIEEKYGFNKSTLKIFVIDLLKELSLGGLLMSVVVGVFVKILTKFGDNFIMYAWGAYIVFGLILQTIAPSLIMPLFYKFTPLENGSLRTQIEELAASINFPLKKLYVIDASRRSTHSNAFFYGLPWNKGIVLFDTLVKNHTEPELIAILGHELGHWYMSHNLINTIIDYGMSLFHLFLFAAFIRNNSLYTSFNFITEKPVIVGLLLFSDALGPLSSILTFASNKVSRLCEYQADAFAKQLGYAKDLGDGLIRIHDDNLSPLEFDSLYTSYYHSHPILVDRLNAIDYTTLKKNN

SEQ ID NO: 6790 - DNA, 1275 bp, Brassica napus
  CDS (1)..(1275)
atggcgattccttacatggaaaccgtcgtgggttttatggtagtgatgtacgtttttgagacgtatttggatctgaggcaacacactgctctcaagctcccaactctccctaaaaccttggttggagtcattagccaagacaagtttgagaaatctcgtgcatacagtcttgacaaaagccattttcactttgttcatgagtttgtgactatccttatggactctgccattttgttcttcgggatcttgccttggttctggaagatatctggagcctttctaccaatggtgggactggatccagagaatgaaatcctgcacactctttcattcttggctggtgttatgacatggtcacagatcactgatttgccattttctttgtactcaactttcgtgattgagtctcggcatgggttcaacaaacaaacaatatggatgttcattagggacatgatcaaaggaatacttctctctgtcatacttgcccctcctatcgttgccgcaataattgttatagttcagaaaggaggtccttaccttgccatctatctgtgggcattcatgtttatcctgtctctagtgatgatgactatataccctgttttgattgcacctcttttcaacaagttcactcctcttccagatggagacctccgggagaagattgagaaacttgcttcttctctaaagtttcctctaaagaagctgtttgttgtcgatggatctacaaggtcaagccatagtaatgcttacatgtatggtttcttcaagaacaaaaggattgttctttatgacacattgattcagcagtgcaagaatgagaatgaaattgtggcggttattgcacacgagctgggacactggaagctgaatcacactacatactcgttcattgctgttcaaatccttgctttcttgcaatttggaggatacactcctgtcagaaactccactgatctcttcaggagttttggatttgatacacaaccagttctcattggtttgatcatatttcagcacactgtaataccacttcaacacctagtaagctttggcctcaaccttgttagtcgagcgtttgagtttcaggctgatgcttttgcagtgaatcttgggtatgcaaaggatctacgtcctgcgctagtgaagctacaggaagagaacttatcagcgatgaacactgacccattgtactcagcttatcactactcacaccctcctcttgtagagaggcttcgagccattgatggacaagacaagaagacagattaa

SEQ ID NO: 6791 - protein, 424 aa, Brassica napus
MAIPYMETVVGFMVVMYVFETYLDLRQHTALKLPTLPKTLVGVISQDKFEKSRAYSLDKSHFHFVHEFVTILMDSAILFFGILPWFWKISGAFLPMVGLDPENEILHTLSFLAGVMTWSQITDLPFSLYSTFVIESRHGFNKQTIWMFIRDMIKGILLSVILAPPIVAAIIVIVQKGGPYLAIYLWAFMFILSLVMMTIYPVLIAPLFNKFTPLPDGDLREKIEKLASSLKFPLKKLFVVDGSTRSSHSNAYMYGFFKNKRIVLYDTLIQQCKNENEIVAVIAHELGHWKLNHTTYSFIAVQILAFLQFGGYTPVRNSTDLFRSFGFDTQPVLIGLIIFQHTVIPLQHLVSFGLNLVSRAFEFQADAFAVNLGYAKDLRPALVKLQEENLSAMNTDPLYSAYHYSHPPLVERLRAIDGQDKKTD

SEQ ID NO: 6792 - DNA, 1278 bp, Linum usitatissimum
  CDS (1)..(1278)
atggcgatccctttcttggaactcgttgtaggttttatgataatgatgtacatctttgaaacgtatcttgatcttcgtcaacttgctgcgtacaagctccttaccttaccaagacctttaaaaggagtcattagccaggagaagtttgagaaatctcgagcatatagccttgataaaagctactataattttgttcacgactttgtgagtattgtgttggactcggccattttatggtatggtgtattgccttgggtttggaagaaatcggagagctttctggcctctgttggacttaatgcagagaatgagataatccttactcttgcctttttgggcagtatgatgatgtggtcacagatcaccgatttgccattttccctatattcaacatttgtgatcgaagcacgtcatggttttaacaaacaaacaatatggatgttcattaaggacttgttcaagggaatcctgctcgctgtcatacttggcccacctattgttgctgcaataatctttattgtgcagaaaggaggtccatacttggccatatatctttgggccttcatgtttgtactctctcttgtgatgatgacaatctatccagtgttaatcgctccactgttcaacacgttcacccctcttccagaaggaaacctcagggagaaaatcgagaaacttgctgcatctctcaagttccctttaaagaagttgtttgttgtagacggttccacaagatccagccacagcaatgcttacatgtatggcttcttcaagaacaagcggattgtcctctatgacacattgattcagcagtgcaaagatgatgaggaaattgtagctgttattgcccacgaactggggcattggaaacttaatcatacaatgtacacattcgtagcaatgcagattcttactttcctgcaatttggagggtacacccttgtgaggaattcaactgatctgtttagaagttttgggtttgattctcagccagtacttatcggtttgatcatatttcagcatattataataccattccagcatctagtgagctttgggcttaatctcattagcagatcttttgaatttcaggctgatgcctttgctaagaagcttgggtatgctgttccccttcgtgctggactagtgaaactccaggaagagaatctgtcagcgatgaacacggatccatggtactcggcatatcactactctcatcctcctttggttgaaaggctggcagcacttgatgaagtggagggtaaaaaggatgagtaa

SEQ ID NO: 6793 - protein, 425 aa, Linum usitatissimum
MAIPFLELVVGFMIMMYIFETYLDLRQLAAYKLLTLPRPLKGVISQEKFEKSRAYSLDKSYYNFVHDFVSIVLDSAILWYGVLPWVWKKSESFLASVGLNAENEIILTLAFLGSMMMWSQITDLPFSLYSTFVIEARHGFNKQTIWMFIKDLFKGILLAVILGPPIVAAIIFIVQKGGPYLAIYLWAFMFVLSLVMMTIYPVLIAPLFNTFTPLPEGNLREKIEKLAASLKFPLKKLFVVDGSTRSSHSNAYMYGFFKNKRIVLYDTLIQQCKDDEEIVAVIAHELGHWKLNHTMYTFVAMQILTFLQFGGYTLVRNSTDLFRSFGFDSQPVLIGLIIFQHIIIPFQHLVSFGLNLISRSFEFQADAFAKKLGYAVPLRAGLVKLQEENLSAMNTDPWYSAYHYSHPPLVERLAALDEVEGKKDE

SEQ ID NO: 6794 - DNA, 1275 bp, Brassica napus
  CDS (1)..(1275)
atggcgattccttacatggaaaccgtcgtgggttttatgatagtgatgtacatttttgagacgtatttggatatgaggcaacacactgctctcaagcttccaactctcccaaaaaccttggttggagtcattagccaagagaagtttgagaaatctcgagcatacagtcttgacaaaagccattttcactttgttcatgagtttgtgactatccttatggactctgcgatgttgttctttgggatcttgccttggttttggaagatatctggaggctttctaccaatggtgggactcgatccagagaatgaaatcctgcacactctttcattcttggctggtgttatgacatggtcacagatcactgatttgccattttctttgtactcaactttcgtgattgagtctcgacatgggttcaacaaacaaacaatatggatgttcattagggacatgatcaaaggaatactactctctgtcatactagcccctcccatcgttgccgcaattattgttatagttcagaaaggaggtccttaccttgccatctatctatgggcattcatgtttatcctgtctctagtgatgatgactatatacccagttttgattgcacctcttttcaacaagttcactcctcttccagatggagacctccgggagaaaattgagaaacttgcttcttctctaaagtttcctctgaagaagctgtttgtcgtcgatggatctacaaggtcaagccatagcaatgcttacatgtatggtttcttcaagaacaaaaggattgttctttatgacacattgattcagcagtgcaagaatgagaatgaaattgtggcggttattgcacacgagctgggacactggaagctgaatcacactacatactcgttcattgctgttcaaatccttgccttcttgcaatttggaggatacactcttgtcagaaactccactgatctcttcaggagttttggatttgatacacaaccagttctcattggtttgatcatatttcagcacactgtaataccacttcaacacctagtaagctttggcctcaaccttgttagtcgagcgtttgagtttcaggctgatgcttttgcagtgaatcttggttatgcaaaggatctacgtcctgccctagtgaagctacaggaagagaacttatcagcgatgaacactgacccattgtactcagcttatcactactcacaccctcctcttgtagagaggcttcgagccattgatggacaagacaagaagacagattaa

SEQ ID NO: 6795 - protein, 424 aa, Brassica napus
MAIPYMETVVGFMIVMYIFETYLDMRQHTALKLPTLPKTLVGVISQEKFEKSRAYSLDKSHFHFVHEFVTILMDSAMLFFGILPWFWKISGGFLPMVGLDPENEILHTLSFLAGVMTWSQITDLPFSLYSTFVIESRHGFNKQTIWMFIRDMIKGILLSVILAPPIVAAIIVIVQKGGPYLAIYLWAFMFILSLVMMTIYPVLIAPLFNKFTPLPDGDLREKIEKLASSLKFPLKKLFVVDGSTRSSHSNAYMYGFFKNKRIVLYDTLIQQCKNENEIVAVIAHELGHWKLNHTTYSFIAVQILAFLQFGGYTLVRNSTDLFRSFGFDTQPVLIGLIIFQHTVIPLQHLVSFGLNLVSRAFEFQADAFAVNLGYAKDLRPALVKLQEENLSAMNTDPLYSAYHYSHPPLVERLRAIDGQDKKTD

SEQ ID NO: 6796 - DNA, 1275 bp, Brassica napus
  CDS (1)..(1275)
atggcgattccttacatggaaaccgtcgtgggttttatggtagtgatgtacgtttttgagacgtatttggatctgaggcaacacactgctctcaagctcccaactctccctaaaaccttggttggagtcattagccaagacaagtttgagaaatctcgtgcatacagtcttgacaaaagccattttcactttgttcatgagtttgtgactatccttatggactctgccattttgttcttcgggatcttgccttggttctggaagatatctggagcctttctaccaatggtgggactggatccagagaatgaaatcctgcacactctttcattcttggctggtgttatgacatggtcacagatcactgatttgccattttctttgtactcaactttcgtgattgagtctcggcatgggttcaacaaacaaacaatatggatgttcattagggacatgatcaaaggaatacttctctctgtcatacttgcccctcctatcgttgccgcaattattgttatagttcagaaaggaggtccttaccttgccatctatctatgggcattcatgtttatcctgtctctcgtgatgatgactatatacccagttttgattgcacctcttttcaacaagttcactcctcttccagatggagacctccgggggaaaattgagaagcttgcttcttctctaaagtttcctctgaagaagctgtttgtcgtcgatggatctacaaggtcaagccatagcaatgcttacatgtatggtttcttcaagaacaaaaggattgttctttatgacacattgattcagcagtgcaagaatgaggatgaaattgtggcggttattgcacacgagcttggacactggaagctaaatcacactacatactcgttcattgcagttcaaatccttaccctcttacagtttggaggatacactcttgtcagaaactccactgatctcttcaggagttttggatttgatacacaaccagttctcattggtttgatcatatttcagcacactgtaataccacttcaacacctagtaagctttggcctcaaccttgttagtcgagcgtttgagtttcaggctgatgcttttgcggtgaagcttggttatgctaaagatctccgtcctgctctagtgaagctacaggaagagaacttatcagcgatgaacactgatccattgtactcagcttatcactactcacatcctcctcttgttgagaggcttcgagccattgatggacaggacaagaagacagattaa

SEQ ID NO: 6797 - protein, 424 aa, Brassica napus
MAIPYMETVVGFMVVMYVFETYLDLRQHTALKLPTLPKTLVGVISQDKFEKSRAYSLDKSHFHFVHEFVTILMDSAILFFGILPWFWKISGAFLPMVGLDPENEILHTLSFLAGVMTWSQITDLPFSLYSTFVIESRHGFNKQTIWMFIRDMIKGILLSVILAPPIVAAIIVIVQKGGPYLAIYLWAFMFILSLVMMTIYPVLIAPLFNKFTPLPDGDLRGKIEKLASSLKFPLKKLFVVDGSTRSSHSNAYMYGFFKNKRIVLYDTLIQQCKNEDEIVAVIAHELGHWKLNHTTYSFIAVQILTLLQFGGYTLVRNSTDLFRSFGFDTQPVLIGLIIFQHTVIPLQHLVSFGLNLVSRAFEFQADAFAVKLGYAKDLRPALVKLQEENLSAMNTDPLYSAYHYSHPPLVERLRAIDGQDKKTD

SEQ ID NO: 6798 - DNA, 1275 bp, Glycine max
  CDS (1)..(1275)
atggcgtttccctacatggaagccgttgtcggatttatgatattaatgtacatttttgaaacttacttggatgtgcgacaacatagggccctcaaacttcctactcttccaaagactttagaaggtgttatcagccaagagaaatttgagaaatctagagcctatagtcttgataaaagccacttccattttgttcacgagtttgtgacaatagtgacagactctacaattttgtactttggggtattgccctggttttggaagaaatcaggagattttatgacaatagctggtttcaatgctgagaatgaaatactgcatacccttgccttcttagcagggctgatgatttggtcacagataacagatttgcccttttctctgtactcaacttttgtgattgaggcccgtcatggttttaataagcaaacaccatggttattctttagggacatgcttaaaggaattttcctttctgtaataattggtccacctattgtggctgcaatcattgtaatagtacagaaaggaggtccatacttggccatctatctttgggtttttacgtttggtctttctattgtgatgatgaccctttatccagtactaatagctccactcttcaataagttcactccacttccagatggtcaactcagggagaaaatcgagaaacttgcttcctccctcaactatccgttaaagaaactatttgttgtcgatggatccacaagatcaagtcacagcaatgcctatatgtatggattcttcaagaacaagaggattgtcctttatgacacattaattcaacagtgcaaagacgatgaggaaattgttgctgttattgcccatgagttgggacactggaagctcaaccatactgtgtacacatttgttgctatgcagattcttacacttctacaatttggaggatatacactagtgcgaaattcagctgatctgtatcgaagctttgggtttgatacgcagccagtcctcattgggctcatcatatttcagcatactgtaatcccacttcagcaattggtcagctttggtctgaacctagtcagccgatcatttgaatttcaggctgatggctttgccaagaagcttggatatgcatctggattacgcggtggtcttgtgaaactacaggaggagaatctgtcagctatgaatacagatccttggtactctgcttatcactattctcatcctccccttgttgaaagattggctgtgctggacgaaccggataagaaggaagactaa

SEQ ID NO: 6799 - protein, 424 aa, Glycine max
MAFPYMEAVVGFMILMYIFETYLDVRQHRALKLPTLPKTLEGVISQEKFEKSRAYSLDKSHFHFVHEFVTIVTDSTILYFGVLPWFWKKSGDFMTIAGFNAENEILHTLAFLAGLMIWSQITDLPFSLYSTFVIEARHGFNKQTPWLFFRDMLKGIFLSVIIGPPIVAAIIVIVQKGGPYLAIYLWVFTFGLSIVMMTLYPVLIAPLFNKFTPLPDGQLREKIEKLASSLNYPLKKLFVVDGSTRSSHSNAYMYGFFKNKRIVLYDTLIQQCKDDEEIVAVIAHELGHWKLNHTVYTFVAMQILTLLQFGGYTLVRNSADLYRSFGFDTQPVLIGLIIFQHTVIPLQQLVSFGLNLVSRSFEFQADGFAKKLGYASGLRGGLVKLQEENLSAMNTDPWYSAYHYSHPPLVERLAVLDEPDKKED

SEQ ID NO: 6800 - DNA, 1278 bp, Zea mays
  CDS (1)..(1278)
atggcgttgccctacctggaggccgtgctttgctttatgattttcatgtacatatttgagacatatcttgacatccgtcagcatagagccctcaagctgccaactttgccaaaacccctgctgggagtaattagtgacgaaaagtttgaacgctctagagcttatagcctcgacaaaagctatttccattttgttcatgaggctgtgactattttaatggatactacaatactatactatagagttcttccctggttttggaagaaatctggagagttagttaccagtgttgggctgagtgctgagaatgagataatacacacccttgctttcttagctggttccatggtttggtcgcagattacagacttgccgttctctctctattcaacttttgttatagaggctcgacatggttttaacaagcaaactatatggctcttcattagggatatgatcaaaggaattttactatccatgatattggggccaccaatcgtggctgctatcatctacatagtacagattggaggaccttacctggctatatatctctggggttttatgtttgtattagctctactgatgatgacaatataccccattgtgatagctcctctgttcaacaagttcactcctcttcctgaaggagtcctcagggaaaaaatagagaagctggcagcttccctcaagtttcctttgaaaaagcttttcgtggtagatgggtctaccagatcaagccacagtaatgcctacatgtatggttttttcaagaacaagcgcatagtactctatgacacattgattcagcagtgtagcaatgaggatgagatagtttctgttatagcacatgaacttggacactggaaactcaatcatactgtctattcctttgtagctgtccagctgcttatgtttcttcaatttggaggatatactctagtaaggagctccaaagatctatttggaagttttggcttcaaggaccagccagtaataattggattgatcattttccagcacaccataatacccatccaacaccttctgagcttttgcctgaaccttgtcagcagagcatttgaatttcaggctgatgcctttgccaagaaccttggatatgcccctcagctccgagcagcccttgttaaactacaggaggagaacttgtctgcgatgaacaccgatccttggtattcggcatatcactactcccacccaccactcgtcgagaggctgcaagctcttgaagattcagacagcaaaaaagaagattag

SEQ ID NO: 6801 - protein, 425 aa, Zea mays
MALPYLEAVLCFMIFMYIFETYLDIRQHRALKLPTLPKPLLGVISDEKFERSRAYSLDKSYFHFVHEAVTILMDTTILYYRVLPWFWKKSGELVTSVGLSAENEIIHTLAFLAGSMVWSQITDLPFSLYSTFVIEARHGFNKQTIWLFIRDMIKGILLSMILGPPIVAAIIYIVQIGGPYLAIYLWGFMFVLALLMMTIYPIVIAPLFNKFTPLPEGVLREKIEKLAASLKFPLKKLFVVDGSTRSSHSNAYMYGFFKNKRIVLYDTLIQQCSNEDEIVSVIAHELGHWKLNHTVYSFVAVQLLMFLQFGGYTLVRSSKDLFGSFGFKDQPVIIGLIIFQHTIIPIQHLLSFCLNLVSRAFEFQADAFAKNLGYAPQLRAALVKLQEENLSAMNTDPWYSAYHYSHPPLVERLQALEDSDSKKED

SEQ ID NO: 6802 - DNA, 1278 bp, Zea mays
  CDS (1)..(1278)
atggcgttgccctacctggaggccgtgctttgctttatgattttcatgtacatatttgagacatatcttgacatccgtcagcatagagccctcaagctgccaactttgccaaaacccctgctgggagtaattagtgacgaaaagtttgaacgctctagagcttatagcctcgacaaaagctatttccattttgttcatgaggctgtgactattttaatggatactacaatactatactatagagttcttccctggttttggaagaaatctggagagttagttaccagtgttgggctgagtgctgagaatgagataatacacacccttgctttcttagctggttccatggtttggtcacagattacagacttgccgttctctctctattcaacttttgttatagaggctcgacatggttttaacaagcaaactatatggctcttcattagggatatgatcaaaggaattttactatccatgatattggggccaccaatcgtggctgctatcatctacatagtacagattggaggaccttacctggctatatatctctggggttttatgtttgtattagctctactgatgatgacaatataccccattgtgatagctcctctgttcaacaagttcactcctcttcctgaaggagtcctcagggaaaaaacagagaagctggcagcttccctcaagtttcctttgaaaaagcttttcgtggtagatgggtctaccagatcaagccacagtaatgcctacatgtatggttttttcaagaacaagcgcatagtactctatgacacattgattcagcagtgtagcaatgaggatgagatagtttctgttatagcacatgaacttggacactggaaactcaatcatactgtctattcctttgtagctgtccagctgcttatgtttcttcaatttggaggatatactctagtaaggagctccaaagatctatttggaagttttggcttcaaggaccagccagtaataattggattgatcattttccagcacaccataatacccatccaacaccttctgagcttttgcctgaaccttgtcagcagagcatttgaatttcaggctgatgcctttgccaagaaccttggatatgcccctcagctccgagcagcccttgttaaactacaggaggagaacttgtctgcgatgaacaccgatccttggtattcggcatatcactactcccacccaccactcgtcgagaggctgcaagctcttgaagattcagacagcaaaaaagaagattag

SEQ ID NO: 6803 - protein, 425 aa, Zea mays
MALPYLEAVLCFMIFMYIFETYLDIRQHRALKLPTLPKPLLGVISDEKFERSRAYSLDKSYFHFVHEAVTILMDTTILYYRVLPWFWKKSGELVTSVGLSAENEIIHTLAFLAGSMVWSQITDLPFSLYSTFVIEARHGFNKQTIWLFIRDMIKGILLSMILGPPIVAAIIYIVQIGGPYLAIYLWGFMFVLALLMMTIYPIVIAPLFNKFTPLPEGVLREKTEKLAASLKFPLKKLFVVDGSTRSSHSNAYMYGFFKNKRIVLYDTLIQQCSNEDEIVSVIAHELGHWKLNHTVYSFVAVQLLMFLQFGGYTLVRSSKDLFGSFGFKDQPVIIGLIIFQHTIIPIQHLLSFCLNLVSRAFEFQADAFAKNLGYAPQLRAALVKLQEENLSAMNTDPWYSAYHYSHPPLVERLQALEDSDSKKED

SEQ ID NO: 6804 - DNA, 1314 bp, Zea mays
  CDS (1)..(1314)
atggcgctgtcctacctggaggccgtgctttgctttatgattctcatgttcatatttgagacgtatcttgacatccgtcagcatagggccctcaagctgccaactttgcccaaacccctgctgggagtaatcagtgatgaaaagtttgaacgctctagagcttatagccttgataaaagctacttccattttgtccatgagtttgtgactattttaatggataccacaatactgtactacagatccgttccctggttttggaagaaatctggagagttagttaccaatgttgggctgaatgctgagaatgagataatacacacccttgcattcttagctggtgccatggtttggtcaaagattacagacttgtcgttctctatttattcaacttttgttatagaggctcgacatggttttaacaagcaaactatatggctcttcatcagggatatgatcaaaggagttttactattcatgatactggggccaccaatcgtggctgctatcatctacatagtacagattggaggaccctacctggatatatatctctttggttttatgtttgcattagctcttctgatgatgacaatataccccattgtgatagctcctctgttcaacaagttcacccctcttcctgaaggagtcctcagggagaaaatagagaagctggcagcttccctcaaatttcctttgaaaaaacttttcgtggtagatgggtctaccagatcaagccacagtaatgcttacatgtatggattttttaagaataaacgcatagtactctatgacacattgattcagcagtgtaccaatgaggatgagatagtttctgttattgcacatgaacttgggcactggaaactcaatcatattgtctattcctttgtagctgtccagctgcttatgtttcttcaatttggaggatatactctactgcttatgtttcttcaatttggaggatatactctagtaaggaactccaaagatctatttcaaagttttggcttcgaggatcagccaataataactggactgatcattttccagcacaccagaatacccatccaacaccttctgagcttttgcctgaaccttgtcagcagagcatttgaatttcaggctgatgcctttgccaagaaccttggatatgcccctccgctccgagcggcccttgttaaactacatgaggagaacttgtttgcaatgaacaccgatccttggtattcggcatatcactactcccacccacctctcgtcgaaaggctgcaagctcttgaagattcagacgccaaaaaaaatgactaa

SEQ ID NO: 6805 - protein, 437 aa, Zea mays
MALSYLEAVLCFMILMFIFETYLDIRQHRALKLPTLPKPLLGVISDEKFERSRAYSLDKSYFHFVHEFVTILMDTTILYYRSVPWFWKKSGELVTNVGLNAENEIIHTLAFLAGAMVWSKITDLSFSIYSTFVIEARHGFNKQTIWLFIRDMIKGVLLFMILGPPIVAAIIYIVQIGGPYLDIYLFGFMFALALLMMTIYPIVIAPLFNKFTPLPEGVLREKIEKLAASLKFPLKKLFVVDGSTRSSHSNAYMYGFFKNKRIVLYDTLIQQCTNEDEIVSVIAHELGHWKLNHIVYSFVAVQLLMFLQFGGYTLLLMFLQFGGYTLVRNSKDLFQSFGFEDQPIITGLIIFQHTRIPIQHLLSFCLNLVSRAFEFQADAFAKNLGYAPPLRAALVKLHEENLFAMNTDPWYSAYHYSHPPLVERLQALEDSDAKKND

SEQ ID NO: 6806 - DNA, 1278 bp, Zea mays
  CDS (1)..(1278)
atggcgttgccctacctggaggccgtgctttgctttatgattttcatgtacatatttgagacatatcttgacatccgtcagcatagagccctcaagctgccaactttgccaaaacccctgctgggagtaattagtgacgaaaagtttgaacgctctagagcttatagcctcgacaaaagctatttccattttgttcatgaggctgtgactattttaatggatactacaatactatactatagagttcttccctggttttggaagaaatctggagagttagttaccagtgttgggctgagtgctgagaatgagataatacacacccttgctttcttagctggttccatggtttggtcgcagattacagacttgccgttctctctctattcaacttttgttatagaggctcgacatggttttaacaagcaaactatatggctcttcattagggatatgatcaaaggaattttactatccatgatattggggccaccaatcgtggctgctatcatctacatagtacagattggaggaccttacctggctatatatctctggggttttatgtttgtattagctctactgatgatgacaatataccccattgtgatagctcctctgttcaacaagttcactcctcttcctgaaggagtcctcagggaaaaaatagagaagctggcagcttccctcaagtttcctttgaaaaagcttttcgtggtagatgggtctaccagatcaagccacagtaatgcctacatgtatggttttttcaagaacaagcgcatagtactctatgacacattgattcagcagtgtagcaatgaggatgagatagtttctgttatagcacatgaacttgggcactggaaactcaatcatactgtctattcctttgtagctgtccagctgcttatgtttcttcaatttggaggatatactctagtaaggagctccaaagatctatttggaagttttggcttcaaggaccagccagtaataattggattgatcattttccagcacaccataatacccatccaacaccttctgagcttttgcctgaaccttgtcagcagagcatttgaatttcaggctgatgcctttgccaagaaccttggatatgcccctcagctccgagcagcccttgttaaactacaggaggagaacttgtttgcgatgaacaccgatccttggtattcggcatatcactactcccaccccccactcgtcgagaggctgcaagctcttgaagattcagacagcaaaaaagaagattag

SEQ ID NO: 6807 - protein, 425 aa, Zea mays
MALPYLEAVLCFMIFMYIFETYLDIRQHRALKLPTLPKPLLGVISDEKFERSRAYSLDKSYFHFVHEAVTILMDTTILYYRVLPWFWKKSGELVTSVGLSAENEIIHTLAFLAGSMVWSQITDLPFSLYSTFVIEARHGFNKQTIWLFIRDMIKGILLSMILGPPIVAAIIYIVQIGGPYLAIYLWGFMFVLALLMMTIYPIVIAPLFNKFTPLPEGVLREKIEKLAASLKFPLKKLFVVDGSTRSSHSNAYMYGFFKNKRIVLYDTLIQQCSNEDEIVSVIAHELGHWKLNHTVYSFVAVQLLMFLQFGGYTLVRSSKDLFGSFGFKDQPVIIGLIIFQHTIIPIQHLLSFCLNLVSRAFEFQADAFAKNLGYAPQLRAALVKLQEENLFAMNTDPWYSAYHYSHPPLVERLQALEDSDSKKED

SEQ ID NO: 6808 - DNA, 25 bp, Artificial sequence
  primer
atgtttgatcttaagacgattctcg

SEQ ID NO: 6809 - DNA, 28 bp, Artificial sequence
  primer
ttagtttttcttcttttcactaacatag

SEQ ID NO: 6810 - protein, 482 aa, Artificial sequence
  consensus sequence
  Variant (2)..(13): Xaa in position 2 to 13 is any amino acid
  Variant (14)..(16): Xaa in position 14 to 16 is any or no amino acid
  Variant (18)..(31): Xaa in position 18 to 31 is any amino acid
  Variant (32)..(34): Xaa in position 32 to 34 is any or no amino acid
  Variant (36)..(93): Xaa in position 36 to 93 is any amino acid
  Variant (94)..(110): Xaa in position 94 to 110 is any or no amino acid
  Variant (113)..(115): Xaa in position 113 to 115 is any amino acid
  Variant (117)..(118): Xaa in position 117 to 118 is any amino acid
  Variant (120)..(121): Xaa in position 120 to 121 is any amino acid
  Variant (123)..(125): Xaa in position 123 to 125 is any amino acid
  Variant (129)..(130): Xaa in position 129 to 130 is any amino acid
  Variant (132)..(137): Xaa in position 132 to 137 is any amino acid
  Variant (139)..(140): Xaa in position 139 to 140 is any amino acid
  Variant (142)..(171): Xaa in position 142 to 171 is any amino acid
  Variant (172)..(173): Xaa in position 172 to 173 is any or no amino acid
  Variant (175)..(185): Xaa in position 175 to 185 is any amino acid
  Variant (186)..(188): Xaa in position 186 to 188 is any or no amino acid
  Variant (190)..(191): Xaa in position 190 to 191 is any amino acid
  Variant (193)..(193): Xaa in position 193 is any amino acid
  Variant (199)..(200): Xaa in position 199 to 200 is any amino acid
  Variant (203)..(206): Xaa in position 203 to 206 is any amino acid
  Variant (208)..(213): Xaa in position 208 to 213 is any amino acid
  Variant (215)..(219): Xaa in position 215 to 219 is any amino acid
  Variant (221)..(226): Xaa in position 221 to 226 is any amino acid
  Variant (228)..(228): Xaa in position 228 is any amino acid
  Variant (230)..(230): Xaa in position 230 is any amino acid
  Variant (232)..(232): Xaa in position 232 is any amino acid
  Variant (235)..(237): Xaa in position 235 to 237 is any amino acid
  Variant (241)..(242): Xaa in position 241 to 242 is any amino acid
  Variant (244)..(247): Xaa in position 244 to 247 is any amino acid
  Variant (248)..(249): Xaa in position 248 to 249 is any or no amino acid
  Variant (251)..(251): Xaa in position 251 is any amino acid
  Variant (254)..(255): Xaa in position 254 to 255 is any amino acid
  Variant (259)..(265): Xaa in position 259 to 265 is any amino acid
  Variant (266)..(266): Xaa in position 266 is any or no amino acid
  Variant (268)..(269): Xaa in position 268 to 269 is any amino acid
  Variant (272)..(272): Xaa in position 272 is any amino acid
  Variant (276)..(276): Xaa in position 276 is any amino acid
  Variant (279)..(282): Xaa in position 279 to 282 is any amino acid
  Variant (284)..(325): Xaa in position 284 to 325 is any amino acid
  Variant (326)..(347): Xaa in position 326 to 347 is any or no amino acid
  Variant (349)..(366): Xaa in position 349 to 366 is any amino acid
  Variant (369)..(370): Xaa in position 369 to 370 is any amino acid
  Variant (372)..(373): Xaa in position 372 to 373 is any amino acid
  Variant (376)..(377): Xaa in position 376 to 377 is any amino acid
  Variant (379)..(386): Xaa in position 379 to 386 is any amino acid
  Variant (387)..(419): Xaa in position 387 to 419 is any or no amino acid
  Variant (421)..(423): Xaa in position 421 to 423 is any amino acid
  Variant (425)..(426): Xaa in position 425 to 426 is any amino acid
  Variant (428)..(430): Xaa in position 428 to 430 is any amino acid
  Variant (431)..(458): Xaa in position 431 to 458 is any or no amino acid
  Variant (460)..(460): Xaa in position 460 is any amino acid
  Variant (462)..(474): Xaa in position 462 to 474 is any amino acid
  Variant (478)..(481): Xaa in position 478 to 481 is any amino acid
LXXXXXXXXXXXXXXXPXXXXXXXXXXXXXXXXXYXXXXXXXXXXXXXXXXXXXXXXXXXXXXXXXXXXXXXXXXXXXXXXXXXXXXXXXXXXXXXXXXXXXXXXXXXXXLPXXXYXXFXXEXXXGFNXXTXXXXXXDXXKXXXXXXXXXXXXXXXXXXXXXXXXXXXXXXXXWXXXXXXXXXXXXXXPXXIXPLFNKXXPLXXXXLXXXXXXLXXXXXFXXXXXXVXDXSXRSXXXNAYXXGXXXXXXKXIVXXDTLXXXXXXXXEXXAVXAHEXGHXXXXHXXXXXXXXXXXXXXXXXXXXXXXXXXXXXXXXXXXXXXXXXXXXXXXXXXXXXXXXXXXXXXXXFXXXXXXXXXXXXXXXXXXSRXXEXXADXXAXXXXXXXXXXXXXXXXXXXXXXXXXXXXXXXXXXXXXXXXXLXXXLXXLXXXXXXXXXXXXXXXXXXXXXXXXXXXXXXXNXSXXXXXXXXXXXXXSHPXXXXR

SEQ ID NO: 6811 - protein, 51 aa, Artificial sequence
  protein pattern
  Variant (2)..(7): Xaa in position 2 to 7 is any amino acid
  Variant (10)..(10): Xaa in position 10 is any amino acid
  Variant (11)..(11): Xaa in position 11 is Asp, Glu, Asn, Pro or Gln
  Variant (12)..(13): Xaa in position 12 to 13 is any amino acid
  Variant (14)..(14): Xaa in position 14 is Ile, Leu or Met
  Variant (15)..(26): Xaa in position 15 to 26 is any amino acid
  Variant (27)..(27): Xaa in position 27 is Phe or Tyr
  Variant (28)..(31): Xaa in position 28 to 31 is any amino acid
  Variant (32)..(32): Xaa in position 32 is Ile, Leu or Val
  Variant (33)..(34): Xaa in position 33 to 34 is any amino acid
  Variant (35)..(35): Xaa in position 35 is Ile, Met or Val
  Variant (37)..(37): Xaa in position 37 is Ala or Gly
  Variant (39)..(39): Xaa in position 39 is any amino acid
  Variant (41)..(41): Xaa in position 41 is Asp or Ser
  Variant (42)..(42): Xaa in position 42 is Ala, Gly, Asn, Ser or Thr
  Variant (43)..(43): Xaa in position 43 is His, Lys or Arg
  Variant (44)..(44): Xaa in position 44 is any amino acid
  Variant (47)..(47): Xaa in position 47 is Phe or Tyr
  Variant (48)..(48): Xaa in position 48 is Phe or Met
  Variant (49)..(49): Xaa in position 49 is any amino acid
  Variant (51)..(51): Xaa in position 51 is Phe, Leu, Met or Val
PXXXXXXPLXXXXXXXXXXXXXXXXXXXXXXXXXXDXSXRXXXXNAXXXGX

SEQ ID NO: 6812 - protein, 20 aa, Artificial sequence
  protein pattern
  Variant (2)..(3): Xaa in position 2 to 3 is any amino acid
  Variant (4)..(4): Xaa in position 4 is Ala, Glu or Ser
  Variant (6)..(6): Xaa in position 6 is Ile, Leu or Val
  Variant (8)..(10): Xaa in position 8 to 10 is any or no amino acid
  Variant (13)..(13): Xaa in position 13 is Ile, Leu or Val
  Variant (16)..(19): Xaa in position 16 to 19 is any amino acid
EXXXVXAXXXHEXGHXXXXH

SEQ ID NO: 6813 - protein, 17 aa, Artificial sequence
  protein pattern
  Variant (2)..(4): Xaa in position 2 to 4 is any amino acid
  Variant (6)..(7): Xaa in position 6 to 7 is any amino acid
  Variant (9)..(9): Xaa in position 9 is any amino acid
  Variant (10)..(10): Xaa in position 10 is Ile, Leu or Val
  Variant (12)..(13): Xaa in position 12 to 13 is any amino acid
  Variant (14)..(14): Xaa in position 14 is Phe, His or Tyr
  Variant (17)..(17): Xaa in position 17 is Asn, Ser or Thr
PXXXYXXFXXEXXXGFX

SEQ ID NO: 6814 - protein, 18 aa, Artificial sequence
  protein pattern
  Variant (3)..(4): Xaa in position 3 to 4 is any amino acid
  Variant (6)..(6): Xaa in position 6 is any amino acid
  Variant (7)..(7): Xaa in position 7 is Glu or Gln
  Variant (10)..(11): Xaa in position 10 to 11 is any or no amino acid
  Variant (13)..(17): Xaa in position 13 to 17 is any amino acid
  Variant (18)..(18): Xaa in position 18 is Ala, Asp, Gly, Asn, Pro, Ser or Thr
SRXXEXXADXXAXXXXXX

SEQ ID NO: 6815 - protein, 10 aa, Artificial sequence
  protein pattern
  Variant (2)..(2): Xaa in position 2 is any amino acid
  Variant (3)..(3): Xaa in position 3 is Ile or Val
  Variant (5)..(5): Xaa in position 5 is Phe, Ile or Leu
  Variant (6)..(6): Xaa in position 6 is Phe or Tyr
  Variant (10)..(10): Xaa in position 10 is Ile, Leu, Met or Val
KXXVXXDTLX

SEQ ID NO: 6816 - DNA, 1536 bp, Saccharomyces cerevisiae
  CDS (1)..(1536)
atggttttgccaagactatatactgctacatcccgtgctgcttttaaagcagccaaacaatccgctccgcttctatccacttcgtggaaaagatgtatggcctcagctgctcaatctactccaatcaccggtaaagttaccgctgtcattggtgccattgttgacgttcattttgaacaatcagagttgcccgctattttgaacgctttagaaattaaaacacctcaaggtaagttggttttggaagttgctcaacatttgggtgaaaacactgtcagaaccattgctatggatggtaccgaaggtttggtccgtggtgaaaaggttcttgacactggtggccctatctccgtcccagttgggagagaaactttagggagaatcatcaacgttatcggtgaacctattgatgaaagaggtccaattaagtccaaactaagaaagccaattcacgcagaccctcctagttttgcagaacaatctacttcggctgaaattttggaaacaggtatcaaagtcgtcgatctattagctccttatgccagaggtggtaagattggtcttttcggtggtgcaggtgtcggtaagactgtgttcattcaagaattgattaacaatatcgccaaggcccatggtggtttttccgttttcaccggtgttggtgaaagaacaagagaaggtaatgacttgtaccgtgaaatgaaggaaactggtgtcattaacttggaaggtgaatccaaggtcgccttagtgttcggtcaaatgaacgaacctccaggagccagagccagagtcgctttaactggtttgacgatcgctgaatatttcagagatgaagaaggtcaagatgtcttgttgtttatcgacaatatctttagatttactcaagctggttcagaagtctctgcccttttgggtcgtattccatctgccgtcggttatcaaccaactttggccactgatatgggtctcttacaagaaagaattaccaccacaaagaagggttctgtcacttctgtgcaagccgtttatgttccagccgatgatttaacagatcctgctcctgccactacttttgcccatttggacgctactaccgtcttgtcaagaggtatttcagaattaggtatttaccctgcagtggatccattggattctaaatcaaggttattggatgccgccgttgtcggtcaagaacattatgacgtcgcctccaaggttcaagaaactttacagacctataaatctttacaagatatcattgctattttgggtatggatgaattgtccgaacaagataaactaactgtcgaaagggcaagaaagattcaaagattcttatctcaaccatttgctgtcgccgaagtctttactggtatcccaggtaaattagtgagattaaaggacaccgttgcctcgttcaaagccgttttggaaggtaaatacgataatataccagaacatgctttctatatggttggtggtattgaagatgttgttgctaaagctgaaaagttagccgctgaagccaactag

SEQ ID NO: 6817 - protein, 511 aa, Saccharomyces cerevisiae
MVLPRLYTATSRAAFKAAKQSAPLLSTSWKRCMASAAQSTPITGKVTAVIGAIVDVHFEQSELPAILNALEIKTPQGKLVLEVAQHLGENTVRTIAMDGTEGLVRGEKVLDTGGPISVPVGRETLGRIINVIGEPIDERGPIKSKLRKPIHADPPSFAEQSTSAEILETGIKVVDLLAPYARGGKIGLFGGAGVGKTVFIQELINNIAKAHGGFSVFTGVGERTREGNDLYREMKETGVINLEGESKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDAAVVGQEHYDVASKVQETLQTYKSLQDIIAILGMDELSEQDKLTVERARKIQRFLSQPFAVAEVFTGIPGKLVRLKDTVASFKAVLEGKYDNIPEHAFYMVGGIEDVVAKAEKLAAEAN

SEQ ID NO: 6818 - DNA, 1443 bp, Bradyrhizobium sp. ORS278
  CDS (1)..(1443): transl_table=11
atggctaccgcagccaaccagatcggtcgcgtcacccaggtgatcggcgctgtcgtcgacgttcagttcgaaggtcacctgcccgcaattctcaactcgctggaaacgaagaacggcggcaaccgcctcgtgctcgaggtcgcgcagcatctcggtgaatccaccgtgcgcgcgatcgcgatggacacgaccgaaggtctggtccgtggccaggaagtgaccgacaccggcgctccgatccgcgttcccgtcggcgaaggcacgctcggccgcatcatcaacgtgatcggcgagccgatcgacgaagccggcccggtgaaggccgacaacgtccgcgccattcaccaggaagcgccgacctacaccgaccagtcgaccgaggccgagatcctcgtgaccggcatcaaggtcgtcgacctgctcgccccctacgccaagggcggcaagatcggtctgttcggcggcgccggcgtcggcaagaccgtgctgattcaggagctgatcaacaacgtcgccaaggcacacggcggctactcggtgttcgccggcgtcggtgagcgcacccgcgagggcaacgacctctatcacgagttcatcgagtccaaggtcaatgccgatccgcacaacccggatccgagcgtgaagtcgaagtgcgcgctggtgttcggccagatgaacgagccgccgggcgcccgcgcccgcgtcgcgctcaccggtctgaccatcgcggaagacttccgcgacaagggccaggacgtgctgttcttcgtcgacaacatcttccgcttcacccaggccggctcggaagtgtcggcgctgctcggccgtattccttcggcggtgggttatcagccgacgctcgccaccgacatgggcgcgctgcaggagcgcatcaccaccaccaccaagggctcgatcacctcggtgcaggccatctacgtgccggccgacgacttgaccgacccggccccggcgacgtcgttcgcgcacttggacgcgaccacgacgctgtcgcgctcgatcgccgaaaagggcatctacccggccgtcgacccgctcgactcgacgtcgcgcatgctctccccgctggtcgtcggcgaggagcactatgcggtcgcccgccaggtgcagcaggtgcttcagcgctacaaggcgctgcaggacatcatcgccatcctgggcatggacgagctctcggaagaggacaagctgactgtcgcgcgcgcccgcaaggtcgagcgcttcatgtcgcagccgttccacgtcgccgaaatcttcacgggatcgccgggcaagttcgtcgagctcgccgacaccatcaagggcttcaagggcctggtggaaggcaagtacgaccacctgccggaggctgccttctacatggtcggcaccatcgaagaggcggtcgagaagggcaagaagctggcggcggaagccgcctaa

SEQ ID NO: 6819 - protein, 480 aa, Bradyrhizobium sp. ORS278
MATAANQIGRVTQVIGAVVDVQFEGHLPAILNSLETKNGGNRLVLEVAQHLGESTVRAIAMDTTEGLVRGQEVTDTGAPIRVPVGEGTLGRIINVIGEPIDEAGPVKADNVRAIHQEAPTYTDQSTEAEILVTGIKVVDLLAPYAKGGKIGLFGGAGVGKTVLIQELINNVAKAHGGYSVFAGVGERTREGNDLYHEFIESKVNADPHNPDPSVKSKCALVFGQMNEPPGARARVALTGLTIAEDFRDKGQDVLFFVDNIFRFTQAGSEVSALLGRIPSAVGYQPTLATDMGALQERITTTTKGSITSVQAIYVPADDLTDPAPATSFAHLDATTTLSRSIAEKGIYPAVDPLDSTSRMLSPLVVGEEHYAVARQVQQVLQRYKALQDIIAILGMDELSEEDKLTVARARKVERFMSQPFHVAEIFTGSPGKFVELADTIKGFKGLVEGKYDHLPEAAFYMVGTIEEAVEKGKKLAAEAA

SEQ ID NO: 6820 - DNA, 1392 bp, Dichelobacter nodosus VCS1703A
  CDS (1)..(1392): transl_table=11
atgagcactggaaagattgttcaaatcattggcgcggttgtcgatattgaatttccggcagcggaaatgccaaatattaatgatgctttagtttctcaagaagcaaatgttacatttgaagtgcaacaacttttgggcgatggcgtcgtgcgtaccattgcgatgggatcttctgatggattaagacgcggtatggtgatcgaaaatacgggtgacgcgattaaagtccctgttggcaaggcaactttagggcggattatgaacgttttaggggaacccgttgatcacggcggcgcaatcaacgctgaagataaatggtcaattcaccgcgcggctcctgcttacgatgaattatccaactcaactgaattactggaaaccggtattaaagtgattgatttactgtgtccttttgctaaaggcggtaaagtgggattattcggcggcgcgggcgtgggcaaaaccgtcaatatgatggaattgattcgcaatattgccgttgaacatagcggttattctgtttttgctggcgtcggtgaacgtacccgtgaaggtaacgacttctactacgaaatgaaagaatcagacgtgctcgataaagtttctttggtatacggacaaatgaacgagccggctggtaaccgtttccgcgtcgctttaactggtttaacaatggcagagtatttccgcgaagaagggcgtgacgttttatttttcgtggataatatttaccgctacactttggctggaacggaagtttctgcgctattgggacgaatgccgtccgcggtgggttatcaaccaacgctcgccgaagaaatgggtaaattacaagaacgaattgcctcaactaagaaaggctcaattacttcaattcaagctgtttacgtgcccgcggacgacttaaccgacccttcaccagcaacaacttttgcgcatttggactctaccgttgttttgtcgcggcaaattgctgaattgggtatttatccggcggttgatccgttggattccacttctcgtcagctcgatccactggttgttggcgaagaacattattccaccgcgcgccgtgtgcaaggtgttttgcaacgctataaagaattgcgcgatattattgctattttgggtatggacgaattatccgaagacgataaagccgtggttacacgggcgcgtaaagtgcaacggtttttgtcacaaccctttttcgttgctgaagtatttaccggcgcgccgggaaaatatgtgccgctcaaagataccattcgcgattttaaagcgattgttgatggcgaatatgatcatttgccggaacaagcgttttatatggtgggatcgatggaagaagccgtggctaaagcagaaaaaatgcaagcagaacataaataa

SEQ ID NO: 6821 - protein, 463 aa, Dichelobacter nodosus VCS1703A
MSTGKIVQIIGAVVDIEFPAAEMPNINDALVSQEANVTFEVQQLLGDGVVRTIAMGSSDGLRRGMVIENTGDAIKVPVGKATLGRIMNVLGEPVDHGGAINAEDKWSIHRAAPAYDELSNSTELLETGIKVIDLLCPFAKGGKVGLFGGAGVGKTVNMMELIRNIAVEHSGYSVFAGVGERTREGNDFYYEMKESDVLDKVSLVYGQMNEPAGNRFRVALTGLTMAEYFREEGRDVLFFVDNIYRYTLAGTEVSALLGRMPSAVGYQPTLAEEMGKLQERIASTKKGSITSIQAVYVPADDLTDPSPATTFAHLDSTVVLSRQIAELGIYPAVDPLDSTSRQLDPLVVGEEHYSTARRVQGVLQRYKELRDIIAILGMDELSEDDKAVVTRARKVQRFLSQPFFVAEVFTGAPGKYVPLKDTIRDFKAIVDGEYDHLPEQAFYMVGSMEEAVAKAEKMQAEHK

SEQ ID NO: 6822 - DNA, 1464 bp, Synechococcus sp. WH 7803
  CDS (1)..(1464): transl_table=11
atggccgctgctgctcccgcctccgccggtaccaagggcgttgttcgccaagttattggcccggttctggacgtggaatttccagccggcaagctgcccaagattctcaatgcgctccggatcgagggaactaacacggcgggacagccggtagccctcaccgcagaagtgcagcagctgctgggtgaccatcgcgtccgtgccgtggccatgagtggcaccgacggcctcgtccgcggcatggaagcgctcgatacaggcgctccgatcagcgttcccgtgggtgaagcaaccctcggccgaatcttcaacgttctcggcgagcccgtcgatgaacagggccctgtgaacgcttcggcaacggcacccattcaccgttcagcccccaaactcaccgaactggaaaccaagcccaaggttttcgaaaccggtatcaaggtgatcgaccttctcgccccctatcgccagggcggaaaagtcggcctcttcggaggtgccggtgtgggcaaaaccgttctgattcaggaactcatcaacaacatcgccaaggagcacggtggcgtgtccgtgttcggtggcgtgggtgagcgcacccgcgaaggcaacgacctctacgaggagttcaaggattccggcgtgatcaatgccgaagacctctccaagtcgaaggtggccctttgctacggccagatgaatgagccccccggcgcccgcatgcgcgtgggtctctccgctctcaccatggctgagcacttccgtgatgtgaacaagcaggacgttctcctgttcgtcgacaacatcttccgcttcgtgcaggccggctctgaggtttccgctctcctgggccgcatgccgtccgcagtgggttatcagcccaccctgggcaccgacgtgggtgagcttcaggagcgcatcacgtccaccctggaagggtccatcacttccattcaggccgtttacgttcccgctgacgacctcacagacccggctcctgcgaccacctttgctcacctcgacgccaccaccgtgctgagccgcggcctggcctccaagggcatttatcccgctgtggatcccctggactccaccagcaccatgctccagcccgccgttgtgggtgaggagcactacaaaacagcgcgtgccgtgcagtccacactgcagcgctacaaggagcttcaagacatcatcgccattcttggtcttgatgaactttctgaagatgaccgacgcaccgtggatcgcgcccgcaagatcgagaaattcctctcccagcccttcttcgtggctgagatcttcaccggaatgccaggtgtgtacgtgaagctggaagaaaccatcgccggattcaaccagatcctcgctggtgagctcgaccacctccccgaacaggccttctacctcgtcggcaacatcgaccaggtcaaggccaaggccgagaagatcgcggcagaagccaagtga

SEQ ID NO: 6823 - protein, 487 aa, Synechococcus sp. WH 7803
MAAAAPASAGTKGVVRQVIGPVLDVEFPAGKLPKILNALRIEGTNTAGQPVALTAEVQQLLGDHRVRAVAMSGTDGLVRGMEALDTGAPISVPVGEATLGRIFNVLGEPVDEQGPVNASATAPIHRSAPKLTELETKPKVFETGIKVIDLLAPYRQGGKVGLFGGAGVGKTVLIQELINNIAKEHGGVSVFGGVGERTREGNDLYEEFKDSGVINAEDLSKSKVALCYGQMNEPPGARMRVGLSALTMAEHFRDVNKQDVLLFVDNIFRFVQAGSEVSALLGRMPSAVGYQPTLGTDVGELQERITSTLEGSITSIQAVYVPADDLTDPAPATTFAHLDATTVLSRGLASKGIYPAVDPLDSTSTMLQPAVVGEEHYKTARAVQSTLQRYKELQDIIAILGLDELSEDDRRTVDRARKIEKFLSQPFFVAEIFTGMPGVYVKLEETIAGFNQILAGELDHLPEQAFYLVGNIDQVKAKAEKIAAEAK

SEQ ID NO: 6824 - DNA, 1674 bp, Oryza sativa (japonica cultivar-group)
  CDS (1)..(1674)
atggcgacccgccgggccctcacctccgtcctccgctccgcctcccgcctccgcgccgcctccccttccccgtgcccgcgccgcgcgccgctccacccccaccgccgcccgtcccccgcgggcttcctcctgaaccgcgccgccgccgcctacgcgtcgtccgccgcggcgcaggcggcccccgcgcctccccccgcgtcgggcaaggccaccgggggcggcaagatcaccgatgagttcacgggcgctggcgccgtcgggcaggtgtgccaggtgattggcgccgtcgtggacgtgcggttcgacgagggcctgcccccgatcctgaccgcgctggaggtgctcgaccacaacatccgcctcgtgctcgaggtggcgcagcatctcggggagaacatggtgcgcaccatcgccatggacgggaccgaggggctcgttcgcggccagcgcgtgctcaacaccggctctcccatcactgttcctgttggtagggccacacttgggcgtattatgaatgtcatcggtgagcctattgatgagaagggagatatcacaacaaaccacttcctccctatccatcgtgaagcccctgcttttgttgagcaagctacagagcaacagattcttgttactggaattaaggtcgtggatctccttgcaccctatcaaagaggtggtaaaattggtctcttcggtggtgctggggtgggcaaaactgtacttattatggagttgatcaacaatgttgcgaaggctcatggtggtttctctgtctttgctggtgttggagaacgtactcgtgagggtaatgacttgtacagggaaatgattgagagtggtgtgattaagcttggtgacaagcagagtgagagcaagtgtgctcttgtctacgggcaaatgaatgagcccccgggtgctcgtgctcgtgttggactgactggtttgactgttgccgagcatttccgtgatgctgaagggcaggatgtgcttctcttcattgataacattttccgtttcactcaggcaaactccgaggtgtctgccctgcttggacgtatcccatctgctgtgggataccagccaacccttgctactgatcttggaggactgcaggagcggattaccaccacaaagaagggttctatcacatctgttcaagctatttatgtgcctgctgatgacttgacagatcctgcccctgctactacatttgcccatcttgatgctactactgtgttgtcacgacagatttctgagcttggtatttatcctgctgtcgatcctttggattccacatccagaatgttgtctccccatgtactgggtgaggaccactacaacacagctcgtggtgttcagaaggttcttcagaattacaagaatcttcaagatattattgccattctgggaatggacgagctcagtgaggatgataagttgacagtcgctcgtgctaggaagattcagcggttccttagccagcccttccacgttgccgaagttttcacgggtgcacctggaaagtatgttgagctgaaggagagcgttcaaagtttccagggtgtattggacgggaagtatgatgaccttcctgagcagtcattctacatggttggaggaatcgatgaggtcattgccaaggcagagaagattgccaaggagtccgcttcataa

SEQ ID NO: 6825 - protein, 557 aa, Oryza sativa (japonica cultivar-group)
MATRRALTSVLRSASRLRAASPSPCPRRAPLHPHRRPSPAGFLLNRAAAAYASSAAAQAAPAPPPASGKATGGGKITDEFTGAGAVGQVCQVIGAVVDVRFDEGLPPILTALEVLDHNIRLVLEVAQHLGENMVRTIAMDGTEGLVRGQRVLNTGSPITVPVGRATLGRIMNVIGEPIDEKGDITTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVQSFQGVLDGKYDDLPEQSFYMVGGIDEVIAKAEKIAKESAS

SEQ ID NO: 6826 - DNA, 1497 bp, Oryza sativa (japonica cultivar-group)
  CDS (1)..(1497): transl_table=11
atgagaaccaatcctactacttctcgtcccggggtttctacaattgaagaaaaaagtacagggcgtatcgatcaaattattggacccgtgctggatgtcacttttccccggggcaagttaccttatatttataatgctttggtagtcaagagtcgagacactgacggtaagcaaattaatgtaacttgtgaggtacaacaattattaggaaataatcgagttagagctgtagctatgagtgctacagatgggttgatgagaggaatggaagtgattgacacgggagctcctctcagtgttcctgtcggtggagctactcttggacgaattttcaacgttcttggggagcctgttgacaatttgggtcctgtagatactagtgcaacattccctattcatagatccgcgcccgcctttatcgagttagatacgaaattatccatctttgaaactggtattaaggtggtcgatcttttagctccttatcggcgtggaggaaaaatcggactatttgggggagctggagtaggtaaaacagtactcatcatggaattaatcaacaatattgctaaagctcacgggggcgtatccgtatttggcggagtaggggaacggactcgtgaaggaaatgatctttatatggaaatgaaggaatctggagtaattaatgaaaaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgaccgaccctgctcctgctacaacatttgcacatttggatgctactaccgtactttccagaggattagcttccaaagggatttatcctgcagtagatcctttagattcaacctcaactatgttacaacctcggatcgttggcaacgaacattatgaaactgcgcaaagagttaagcaaactttacaacgttacaaagaacttcaggacattatcgcaattcttgggttggatgaattatcggaggaggatcgtttaactgtagcaagagcacgaaaaattgagcgcttcttatcacaaccgttttttgtggcagaagtttttaccggttctccgggaaagtatgttggtcttgcagaaactattaggggatttcaactaatcctttccggagaattagacggcctacccgaacaggctttttatttggtgggtaacatcgatgaagctagcacgaaagctataaacttagaagaggagaacaaattgaagaaatga

SEQ ID NO: 6827 - protein, 498 aa, Oryza sativa (japonica cultivar-group)
MRTNPTTSRPGVSTIEEKSTGRIDQIIGPVLDVTFPRGKLPYIYNALVVKSRDTDGKQINVTCEVQQLLGNNRVRAVAMSATDGLMRGMEVIDTGAPLSVPVGGATLGRIFNVLGEPVDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNLEESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVGNEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEASTKAINLEEENKLKK

SEQ ID NO: 6828 - DNA, 1500 bp, Rickettsia conorii str. Malish 7
  CDS (1)..(1500): transl_table=11
ttgctcttttccacattaaactgcgtctatctgttcttcattttatttgtattatattttttaacaaaagaaaaaatcatgacaaaaaatattggaaaaattactcagattatttcagcggtggtggatgtaaaatttacgaataacggtgagttaccgaaaattttaaatgctctagagtgctataacgataaacaaaggatagtcctggaagtagcacaacatataggtgatgatacagtgcgttgtattgctatggattctatggaagggttagtgcggggcgtagaagtaatagatacaggcagtcctattcgtattcctgtaggtactgagacgcttgggcgtattatgaatgttgtaggtgagccgattgacggtaaaggagacattaaaagctcaaatatttcttctatatataagcctgctcctgattttacccatcagtcaaccgagtgtaatatattagtaactggtattaaagttattgatttacttgctccttatactaaaggcggtaaaataggactattcggtggtgcaggagtcggtaaaaccgtgcttataatggagcttattaataacgtagctaaagcacacggcggttatacggtatttgcaggagttggtgagagaactagagaaggtaatgatctttaccatgaaatgattgactcgggtgttattaaccttgcagagcctgaaaagtcaaaagtagctttagtttatggacaaatgaacgagccgccgggagcaagggcaagagttgcgttaagcggtctgaccattgcagagagttttagagatatgaatgaagggcaagatgttttgttttttgtagataatattttccgttttactcaagcaggttctgaagtatcggcgttactcggtaggattccgtcagcggtagggtatcagcctactcttgcaaccgatatgggtgagctacaagagcgtatcacctctactaagtacggctcaataacttccgtgcaggctatatatgtaccggcggatgatttaactgatcctgctcctgctacttcttttgcacatttagatgctacaacggtacttagccgtcagatagctgagtttgggatttatccggcagttgatccgttagatagtaattcgcaggtacttgatccgatgattgtcggtgaagaacattatagtgtagcaagacaagtgcagcaggttttacaaacttataaatcgttgcaggatattatcactattttaggtatggatgagctatccgaagaagataaactaaccgtggcacgtgctagaaaaatacagcgtttcttatcgcagcctttccatgtcgctgaagtatttaccggagctgcaggcaaatttgttaatctagccgatactatcgcaggctttaaaggacttgtagagggtaaatacgatgatttaccggaagctgctttttatatggtcggaactatagacgaggctatagagaaggcgcagacgttgaagtga

SEQ ID NO: 6829 - protein, 499 aa, Rickettsia conorii str. Malish 7
MLFSTLNCVYLFFILFVLYFLTKEKIMTKNIGKITQIISAVVDVKFTNNGELPKILNALECYNDKQRIVLEVAQHIGDDTVRCIAMDSMEGLVRGVEVIDTGSPIRIPVGTETLGRIMNVVGEPIDGKGDIKSSNISSIYKPAPDFTHQSTECNILVTGIKVIDLLAPYTKGGKIGLFGGAGVGKTVLIMELINNVAKAHGGYTVFAGVGERTREGNDLYHEMIDSGVINLAEPEKSKVALVYGQMNEPPGARARVALSGLTIAESFRDMNEGQDVLFFVDNIFRFTQAGSEVSALLGRIPSAVGYQPTLATDMGELQERITSTKYGSITSVQAIYVPADDLTDPAPATSFAHLDATTVLSRQIAEFGIYPAVDPLDSNSQVLDPMIVGEEHYSVARQVQQVLQTYKSLQDIITILGMDELSEEDKLTVARARKIQRFLSQPFHVAEVFTGAAGKFVNLADTIAGFKGLVEGKYDDLPEAAFYMVGTIDEAIEKAQTLK

SEQ ID NO: 6830 - DNA, 1434 bp, Tropheryma whipplei str. Twist
  CDS (1)..(1434): transl_table=11
ttggagattatgacaggggatgcagttgggcggatagtgcgggttacgggctctgtcgtagatgtggagttttcacgcaataaccttcctggcgtttttaacgccttgaagacccgtgtaaaccgttctggaaaagaaattgagataacccttgaagttgctcagcatcttggtgacgacttggtccgtacggttgccatgcaatctactgatggtctaataaggggtcaagaggtgcttgataccggtggacatatcactgtccctgtaggtgatgcgacaaagggaagggtttttaacgttgttggtgaggtcttaaacagtaacggcgaagatatcaaatttgatgagtattggtctatacaccgcaagccgccagaatttagtcttcttgaaagtaagactcagctttttgaaactggcattaaagttattgatcttctaaccccgtatgttcagggcggtaaaatcggactctttggtggtgctggtgttggtaaaactgttcttattcaggaaatgatacaaagagtggcccaggatcatggcggtgtatcggtttttgccggggttggtgagcgtacgcgcgagggtaacgacctgattcgcgagatgcaggatgctggtgtttttgataaaaccgctcttgtttttggacaaatggatgaacctcccggcacacgccttcgtgtcgccctaagtgcccttacgatggcagaatacttccgagatgtccagaagcaggatgtcttattgttcatagataacattttccgtttcacgcaagcaggatcagaggtgtctactttgcttggacgtataccctcggctgttggatatcagccaaatttagctgatgaaatgggtgtcttgcaggagagaattacatcaacacgaggtcactcaattacttctcttcaggcgatctatgtgccggcagatgattatacggacccagccccggcaacaacttttgctcatcttgatgcgacaactgaactaagtcgtgagattgcctcaaaaggcttgtatcctgctgttgacccgcttgcgtcaaccagtcgcatacttgatccaaaatacattggtaaggatcattacagggtcgcagttacagtgaaacagattctgcaaagagataaggagctgcgggaaataattgcaattctcgggattgatgagctatcagaagaggacagagttacagttgcccgcgccaggcggattgagcagttcctgagtcagaatacatatatggcaaagaaatttacgggtgtggacggatcaactgtcccgcttcaggaaacaatcgatggatttgatgcaatctgcagaggtgactgcgatcatattccagaacaggcctttttcaatgtcggcggacttgaggatgttgagcgcaagtggagtaagctgcaaaaggaattaggttaa

SEQ ID NO: 6831 - protein, 477 aa, Tropheryma whipplei str. Twist
MEIMTGDAVGRIVRVTGSVVDVEFSRNNLPGVFNALKTRVNRSGKEIEITLEVAQHLGDDLVRTVAMQSTDGLIRGQEVLDTGGHITVPVGDATKGRVFNVVGEVLNSNGEDIKFDEYWSIHRKPPEFSLLESKTQLFETGIKVIDLLTPYVQGGKIGLFGGAGVGKTVLIQEMIQRVAQDHGGVSVFAGVGERTREGNDLIREMQDAGVFDKTALVFGQMDEPPGTRLRVALSALTMAEYFRDVQKQDVLLFIDNIFRFTQAGSEVSTLLGRIPSAVGYQPNLADEMGVLQERITSTRGHSITSLQAIYVPADDYTDPAPATTFAHLDATTELSREIASKGLYPAVDPLASTSRILDPKYIGKDHYRVAVTVKQILQRDKELREIIAILGIDELSEEDRVTVARARRIEQFLSQNTYMAKKFTGVDGSTVPLQETIDGFDAICRGDCDHIPEQAFFNVGGLEDVERKWSKLQKELG

SEQ ID NO: 6832 - DNA, 1545 bp, Magnaporthe grisea 70-15
  CDS (1)..(1545)
atgttcaagagcggcctttctcccatcgcgagggcagctcgcccggcctcgcgcctcgctgcgcgccccagcttaagactccccaaatactctctcggtgccaggttcgccagcacacagggtgtcggtgatggaaagattcaccaggtcattggtgccgtcgtggatgtgaaattcgacactgccaagctccccccgattcttaacgcccttgagaccaccaacaacaaccagaagctcgtccttgaggtttcgcaacatctgggcgagaatgtcgtccgctgcattgccatggacggtactgagggtctcactcgtggcgccaaggccaaggacacaggtgctcccatcaccattcccgtcggctctggaacccttggtcgtatcatgaacgtcactggtgaccccattgacgagcgtggtcccatcaagaccgacaagtaccttcccattcacgctgaggctcccgagttcgtcgagcagtcgaccactgccgagattctggttaccggtatcaaggtcgtcgatctgcttgccccctacgctcgtggtggaaagattggtctgttcggtggtgccggtgtcggcaagaccgtcttcatccaggagcttatcaacaacatcgccaaggcccacggtggttactccgtcttcactggtgtcggtgagaggacccgtgagggtaacgatttgtaccacgaaatgcaggagacctccgtcattcagcttgatggcgagtccaaggtgtcgctggtcttcggtcagatgaacgagcccccgggagcccgtgcccgtgtcgcccttaccggtcttactgttgctgagcaattcaggaacgagggccaggatgtgctcctgttcattgacaacattttccgatttactcaggccggttccgaggtctcggctctgctgggtcgtatcccctctgccgtcggttaccagcccaccctcgccgtcgacatgggtggtatgcaagagcgtattaccaccacccagaagggttctattacctccgtccaggccgtctacgtccctgctgacgatttgaccgaccctgcccccgccaccacctttgcccacttggacgccaccactgtgttgtcccgtggtatttccgagctgggtatctacccggctgtcgaccctctcgactccaagtcgcgtatgcttgacccccgtatcgtcggtcaggagcactacgaggtcgccacccgcgtccagcaaatcctccaggagtacaagtcgctccaggacatcatcgccattctgggtatggacgagttgtctgaggccgacaagctcactgtcgagcgtgcccgtaagatccagcgtttcctgagccagcctttcactgtcgcccaggtcttcactggtatcgagggcaagcttgtcgaccttaaggacaccattgcctcgttcaaggctatcctggctggtgagggtgactcccttcccgagggtgctttctacatggttggtgaccttgcgtcggcacgtgagaagggtgagaagattctggctgagctcgagaaggacgcgtaa

SEQ ID NO: 6833 - protein, 514 aa, Magnaporthe grisea 70-15
MFKSGLSPIARAARPASRLAARPSLRLPKYSLGARFASTQGVGDGKIHQVIGAVVDVKFDTAKLPPILNALETTNNNQKLVLEVSQHLGENVVRCIAMDGTEGLTRGAKAKDTGAPITIPVGSGTLGRIMNVTGDPIDERGPIKTDKYLPIHAEAPEFVEQSTTAEILVTGIKVVDLLAPYARGGKIGLFGGAGVGKTVFIQELINNIAKAHGGYSVFTGVGERTREGNDLYHEMQETSVIQLDGESKVSLVFGQMNEPPGARARVALTGLTVAEQFRNEGQDVLLFIDNIFRFTQAGSEVSALLGRIPSAVGYQPTLAVDMGGMQERITTTQKGSITSVQAVYVPADDLTDPAPATTFAHLDATTVLSRGISELGIYPAVDPLDSKSRMLDPRIVGQEHYEVATRVQQILQEYKSLQDIIAILGMDELSEADKLTVERARKIQRFLSQPFTVAQVFTGIEGKLVDLKDTIASFKAILAGEGDSLPEGAFYMVGDLASAREKGEKILAELEKDA

SEQ ID NO: 6834 - DNA, 1542 bp, Gibberella zeae PH-1
  CDS (1)..(1542)
atgttcaagagcggcatttcctccttcgcccgcgcggctcgcccggccgtccttcctcgacgtgccctccgaccttccgctctccgacttcccatctccagccgatgggccagcactggcgttggcgccggcaagattcaccaggtcatcggtgccgtcgttgacgtcaagttcgatggtgctaagctccctgccattctcaactctcttgagtgccagaacaatggccagaagcttgtcctcgaggtttcccaacatttgggtgagagcgtcgtccgttgcattgccatggacggtactgagggtctcgtccgaggcgctactgtccaggacaccggtgctcccatcactattcccgtcggccccgcgactcttggtcgtatcatgaacgttactggtgaccccattgacgagcgtggtcctatcaagactgacaagcgccttcctatccacaccgaagcccccgagttcgttgagcagtccacctctgctgaggtcctcgtcactggtatcaaggttgtcgatcttcttgccccctacgcccgtggtggaaagattggtctcttcggtggtgccggtgtcggcaagactgtcttcattcaggagcttatcaacaacatcgccaaggcccacggtggttactccgtcttcactggtgtcggtgagcgtacccgtgagggtaacgatctgtaccacgaaatgcaggagacttccgtcattcagcttgatggcgagtccaaggtcgccctggttttcggtcagatgaatgagccccctggagcccgtgcccgtgtcgcccttactggattgactgttgctgagtacttcagagatgctgaaggtcaggacgtgcttctcttcattgataacattttccgattcactcaagccggttctgaggtgtctgcccttttgggtcgtatcccctctgccgtcggttaccagcccactctcgccgtcgatatgggtggtatgcaggagcgtattaccaccacccagaagggttccattacctcggtccaggctgtctacgtccctgctgacgatttgactgatcctgcccctgccaccactttcgcccatttggacgccaccactgtcttgtctcgtggtatctctgagttgggtatctaccccgctgtcgaccctctcgactccaagtcccgtatgttggacccccgagttgttggtcaggagcactacgacaccgccacccgtgttcagcagatcctccaggagtacaagtctcttcaggatatcattgctattctgggtatggatgagttgtctgaggccgacaagcttactgtcgagcgtgcccgtaagatccagcgtttcctgagccagcctttcactgttgcccaggttttcactggtattgagggtaagctcgtcgaccttaaggagaccatcaactccttcaaggccattctgagcggtgagggtgataaccttcccgagggtgccttctacatggttggtgacttcgcctccgccaaggccaagggtgagaagattcttgctgagcttgagggtcagtaa

SEQ ID NO: 6835 - protein, 513 aa, Gibberella zeae PH-1
MFKSGISSFARAARPAVLPRRALRPSALRLPISSRWASTGVGAGKIHQVIGAVVDVKFDGAKLPAILNSLECQNNGQKLVLEVSQHLGESVVRCIAMDGTEGLVRGATVQDTGAPITIPVGPATLGRIMNVTGDPIDERGPIKTDKRLPIHTEAPEFVEQSTSAEVLVTGIKVVDLLAPYARGGKIGLFGGAGVGKTVFIQELINNIAKAHGGYSVFTGVGERTREGNDLYHEMQETSVIQLDGESKVALVFGQMNEPPGARARVALTGLTVAEYFRDAEGQDVLLFIDNIFRFTQAGSEVSALLGRIPSAVGYQPTLAVDMGGMQERITTTQKGSITSVQAVYVPADDLTDPAPATTFAHLDATTVLSRGISELGIYPAVDPLDSKSRMLDPRVVGQEHYDTATRVQQILQEYKSLQDIIAILGMDELSEADKLTVERARKIQRFLSQPFTVAQVFTGIEGKLVDLKETINSFKAILSGEGDNLPEGAFYMVGDFASAKAKGEKILAELEGQ

SEQ ID NO: 6836 - DNA, 1524 bp, Candida glabrata CBS 138
  CDS (1)..(1524)
atggtattgcctagactatacgctgcgccatcctcccgtgctgctttgcaagctgctaggatggcctccaaattcaactccccagtgagattcgcctctactgctgctctagcctctggtaaagttagtgctgtcattggtgctatcgtcgatgtccaattcgaagagtccaacttgccagctatcctgaacgctctggagatcaagaccccacaggggaaactggtcctggaggtcgcccagcacttgggtgaaaacaccgtcagaaccattgccatggacggtaccgaaggtctggtcagaggcgagaaggtcgtcgacacaggtgccccaatctccgtccctgtcggcagagagaccctgggcagaatcatcaacgttatcggtgaacctatcgacgagcgtggcccaatcaactcaaagttgagaaagcctatccacgccgaccctccttccttcgcagaacagtccaccgccgccgaagtcctggaaacaggtatcaaggtcgtcgacttgctagccccttacgccagaggtggtaagatcggcctgttcggtggtgccggtgtcggtaagaccgtgttcatccaagaactgatcaacaacatcgcaaaggctcacggtggtttctccgtgttcacaggtgtcggtgaaagaaccagagaaggtaacgatttgtacagagaaatgaaggaaaccggtgtcatcaacttggaaggtgactctaaggtcgccttggtcttcggccaaatgaacgaaccaccaggagccagagccagagtcgccttgaccggtttgaccatcgcagaatacttcagagatgaagaaggtcaagatgtcctgctgttcgtcgacaacattttcagattcacccaagccggttcagaagtctccgctttgctaggtcgtatcccatccgccgtcggttatcaaccaaccttggccaccgatatgggtctgttgcaagaaagaattaccaccacaaagaagggttccgtcacttccgtccaagccgtctacgtgcctgcagatgatttaacagatcctgcccctgccactactttcgcgcacttggacgccaccaccgtcttgtccagaagtatctcagaattgggtatctacccagctgtcgacccattggactccaagtctagattgctagacgctgccgttgtcggtgaagagcattacaacgtcgccacaaaggtccaagaaactttacaaacttacaagtctctgcaagatatcatcgccattttgggtatggatgaattgtccgaacaagataagctaaccgtcgaaagagcaagaaagatccaaagattcttgtcccaaccattcgctgtcgctgaagttttcaccggtatcgaaggtaagctggtcagattgaaggacaccatctcctctttcaaggctgtcttggaaggtaagtacgatgatcttccagaaaatgcattctatatggtcggtggtattgaagatgtcgttgctaaggctgaaaagttggctgctgaagcttcataa

SEQ ID NO: 6837 - protein, 507 aa, Candida glabrata CBS 138
MVLPRLYAAPSSRAALQAARMASKFNSPVRFASTAALASGKVSAVIGAIVDVQFEESNLPAILNALEIKTPQGKLVLEVAQHLGENTVRTIAMDGTEGLVRGEKVVDTGAPISVPVGRETLGRIINVIGEPIDERGPINSKLRKPIHADPPSFAEQSTAAEVLETGIKVVDLLAPYARGGKIGLFGGAGVGKTVFIQELINNIAKAHGGFSVFTGVGERTREGNDLYREMKETGVINLEGDSKVALVFGQMNEPPGARARVALTGLTIAEYFRDEEGQDVLLFVDNIFRFTQAGSEVSALLGRIPSAVGYQPTLATDMGLLQERITTTKKGSVTSVQAVYVPADDLTDPAPATTFAHLDATTVLSRSISELGIYPAVDPLDSKSRLLDAAVVGEEHYNVATKVQETLQTYKSLQDIIAILGMDELSEQDKLTVERARKIQRFLSQPFAVAEVFTGIEGKLVRLKDTISSFKAVLEGKYDDLPENAFYMVGGIEDVVAKAEKLAAEAS

SEQ ID NO: 6838 - DNA, 1512 bp, Debaryomyces hansenii CBS767
  CDS (1)..(1512)
atggtttttccaagattgtttaactctgcttcacgcaatgctttcactgctgctaagcgtaactttgttttcaacagaggtttagcttcagcagctccagtcgccggtaaggttagagctgttattggtgctgttgttgatatccaattcgacgaaggtaacttaccagctattcttaatgctttaacccttaagaacggtgaccaagacttagtcttagaagtcgcccaacatttaggtgaaaacaccgtcagagctattgctatggatggtaccgatggtttagttagaggtgctccagttaacgataccggtgctccaatttctgttcctgttggtcgtgaaaccttaggtcgtattatcaacgttattggtgaaccaattgacgaaagaggcccaatcaagaccaaacaaaagaacccaattcacgctgatccaccttcgttcgtcgaacaatccacttcttccgaagttttagaaaccggtattaaggttgtcgatttattagccccatacgccagaggtggtaagattggtttattcggtggtgccggtgtcggtaaaaccgttttcattcaagaattgattaacaacattgctaaggcccatggtggtttctctgttttcgccggtgtcggtgaacgtaccagagaaggtaacgatttataccgtgaaatgcaagaaactggtgttattaaccttgaaggtgattctaaggtctccttagttttcggtcaaatgaacgaaccaccaggagctagagctagagttgctttaaccggtttaaccattgccgaatacttcagagatgaagaaggtcaagatgtcttgttattcgttgataacatttacagattcacccaagctggttccgaagtctctgctttgttaggtcgtattccatctgctgtcggttatcaaccaaccttagccactgatatgggtttattacaagaacgtattaccaccaccaagaagggttccgttacttctgtccaagccgtctatgtcccagctgatgatttaaccgatccagctccagctaccaccttcgcgcatttagatgccaccactgtcttgtctagaggtatttccgaattaggtatttacccagctgtcgatccattagattccaagtctagattgttagatattgctgttgtcggtaaggaacattatgacgtcgcttccggtgtccaacaaaccttacaagcttacaagtctttacaagatatcattgctattttaggtatggatgaattatctgaacaagataagttaaccgtcgaaagagcacgtaagatccaaagattcttgtctcaaccattcgctgttgctgaagttttcactggtatcccaggtaaattagttagattacaagaaaccgtcaaatctttcaaggaagtcttagatggtaagcacgatcacttaccagaaaatgctttctatatggttggtggtattgaagatgccactgctaaagccgaaaaattagcttctgaatctaaataa

SEQ ID NO: 6839 - protein, 503 aa, Debaryomyces hansenii CBS767
MVFPRLFNSASRNAFTAAKRNFVFNRGLASAAPVAGKVRAVIGAVVDIQFDEGNLPAILNALTLKNGDQDLVLEVAQHLGENTVRAIAMDGTDGLVRGAPVNDTGAPISVPVGRETLGRIINVIGEPIDERGPIKTKQKNPIHADPPSFVEQSTSSEVLETGIKVVDLLAPYARGGKIGLFGGAGVGKTVFIQELINNIAKAHGGFSVFAGVGERTREGNDLYREMQETGVINLEGDSKVSLVFGQMNEPPGARARVALTGLTIAEYFRDEEGQDVLLFVDNIYRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDIAVVGKEHYDVASGVQQTLQAYKSLQDIIAILGMDELSEQDKLTVERARKIQRFLSQPFAVAEVFTGIPGKLVRLQETVKSFKEVLDGKHDHLPENAFYMVGGIEDATAKAEKLASESK

SEQ ID NO: 6840 - DNA, 1671 bp, Yarrowia lipolytica CLIB122
  CDS (1)..(1671)
atggctccaacgagctcggaaatacattcagcgagggcgattacgccggcgtgtgtttgcggattcgctctgcgaccgaaaccaccccttctgttggctacgttggggttgctgtacctcttgcgtacagctggcacttttttcgctcgggggctaataagctctagagttgggaacaaccgaccaatgacagcgcagcacagctcacacctaaccacacacacacacacgcacacaaacaaaaggatacacaaactagttactaaccccagaaccgttattggtgccgttgtcgatgtccagttcgagcaggataacctccccgctattcttaacgctctgaccattgatcgtggtgagggtaacaagctcgtcctcgaggttgcccagcatctcggtgagaacaccgtccgaaccattgccatggacggtactgagggtcttgtccgaggcacctctgtcgctgacactggtgctcccatcactatccccgtcggccgaggtacccttggtcgaatcatcaacgtttgtggtgagcccattgacgagcgaggacctatcgaggctactaagttcctccccatccacgccgacccccctaccttcgctgagcagtctaccactgctgaggttcttgagaccggtattaaggtcgtcgacctcctcgccccttacgctcgaggtggtaagattggtctcttcggtggtgccggtgtcggtaagaccgttttcatccaggagctgattaacaacattgctaaggcccatggtggtttctccgttttctgcggtgtcggtgagcgaacccgagagggtaacgatctttaccgagagatgaaggagactggtgtcatcaacctcgagggtgagtccaaggtcaccctcgtcttcggtcagatgaacgagcctcccggagcccgagcccgagtcgcccttactggtctgaccattgccgagtacttccgagacgaggagggtcaggatgtgttgctcttcgttgacaacattttccgattcacccaggccggttccgaggtgtccgctctgcttggtcgaattccctccgctgtcggttaccagcccactctggccaccgatatgggtgccctccaggagcgaattaccaccacccagaagggttccgtcacttccgtccaggccgtctacgtgcccgccgatgatctgactgatcctgctcccgccaccaccttcgcccatcttgacgccaccaccgtcctgtcccgaggtatttccgagctgggtatctaccccgctgtcgaccctcttgattccaagtctcgacttctggatatcgatgttgtcggccaggagcactacgacgttgcttccaacgtccagcagaccctccaggcttacaagtctctccaggatatcattgccattcttggtatggatgagctttccgagcaggacaagctgaccgtcgagcgagctcgaaagatccagcgattcctgtctcagcccttcaccgtcgccgaggttttcaccggtattgagggacgacttgtctctcttaaggacactgtccgatctttcaaggagattcttgacggtaagcacgatgctctccctgaggccgctttctacatggtcggcggtatcgaggaggttgtcgccaaggccgagaagcttgctgctgagtccaagtaa

SEQ ID NO: 6841 - protein, 556 aa, Yarrowia lipolytica CLIB122
MAPTSSEIHSARAITPACVCGFALRPKPPLLLATLGLLYLLRTAGTFFARGLISSRVGNNRPMTAQHSSHLTTHTHTHTNKRIHKLVTNPRTVIGAVVDVQFEQDNLPAILNALTIDRGEGNKLVLEVAQHLGENTVRTIAMDGTEGLVRGTSVADTGAPITIPVGRGTLGRIINVCGEPIDERGPIEATKFLPIHADPPTFAEQSTTAEVLETGIKVVDLLAPYARGGKIGLFGGAGVGKTVFIQELINNIAKAHGGFSVFCGVGERTREGNDLYREMKETGVINLEGESKVTLVFGQMNEPPGARARVALTGLTIAEYFRDEEGQDVLLFVDNIFRFTQAGSEVSALLGRIPSAVGYQPTLATDMGALQERITTTQKGSVTSVQAVYVPADDLTDPAPATTFAHLDATTVLSRGISELGIYPAVDPLDSKSRLLDIDVVGQEHYDVASNVQQTLQAYKSLQDIIAILGMDELSEQDKLTVERARKIQRFLSQPFTVAEVFTGIEGRLVSLKDTVRSFKEILDGKHDALPEAAFYMVGGIEEVVAKAEKLAAESK

SEQ ID NO: 6842 - DNA, 1542 bp, Aspergillus nidulans FGSC A4
  CDS (1)..(1542)
ctggcccggaccttcgggagggctgcttttgctcgaccttcccccgtcgcacgccgcgccctccagccctccaagctcaatggcttcccttcattcgctcgcctcgccagcactgagaccgctgccggtggaaagattcaccaggtcatcggtgccgtcgtcgacgtgaagtttgagggtgagaagcttcccgccattctcaacgccattgagaccgagaacaacggccagaagctcgttctcgaggtttctcaacacttgggtgagaatgtcgtccgtaccattgctatggatggtaccgagggtcttactcgtggtgctcccgcccgtgacactggcgctcccatcaccatccctgtcggccctggcacccttggtcgtatcgtcaacgtcactggtgaccccattgacgagcgtggccccatcaaggccaccaagtatgcccccattcacgctgaggctcccgagttcaccgagcagtccaccactgctgagattctcgtcactggtatcaaggttgttgaccttcttgccccctacgctcgtggtggtaagattggtctcttcggtggtgccggtgtcggtaagaccgtgttcattcaggagctgattaacaacatcgccaaggctcacggtggttactctgttttcaccggtgtcggtgagcgtactcgtgagggtaacgatctgtaccacgaaatgcaggagaccggtgtcattcagctcgatggtgaatccaaggtgtctctggtgttcggtcagatgaacgagccccccggtgctcgtgcccgtgtcgcccttactggtctgaccattgctgaatacttccgtgacgaggagggtcaggacgtgctgctcttcattgacaacattttccgtttcacccaggccggttctgaggtgtctgcccttctcggtcgtatcccctctgccgtcggttaccagcccactctggccgtcgacatgggtggtatgcaggaacgtattaccactaccaccaagggttccattacctccgtccaggccgtctacgtgcccgctgacgatctgactgaccctgcccccgccaccaccttcgctcacttggatgccaccactgtcttgtctcgtggtatttctgagttgggtatctaccctgctgtcgaccctcttgactctaagtctcgtatgctggacccccgtattgtcggtgaggaacactacaacaccgccactcgtgtccagcagatgcttcaggagtacaagtcccttcaggatatcattgccattcttggtatggacgaactttctgaggctgacaagcttactgtcgagcgtgctcgtaagcttgagcgtttcctctctcagcctttcaccgtcgcccaggtcttcactggtatcgagggtaagctcgtcgaccttaaggacaccatcgcctctttcaaggctatcatgaacggtgagggtgatgaccttcctgaggctgccttctacatggttggtgacttggcctccgcccgtgctaagggtgagaagatcttggccgatctcgccaagaactaa

SEQ ID NO: 6843 - protein, 513 aa, Aspergillus nidulans FGSC A4
MARTFGRAAFARPSPVARRALQPSKLNGFPSFARLASTETAAGGKIHQVIGAVVDVKFEGEKLPAILNAIETENNGQKLVLEVSQHLGENVVRTIAMDGTEGLTRGAPARDTGAPITIPVGPGTLGRIVNVTGDPIDERGPIKATKYAPIHAEAPEFTEQSTTAEILVTGIKVVDLLAPYARGGKIGLFGGAGVGKTVFIQELINNIAKAHGGYSVFTGVGERTREGNDLYHEMQETGVIQLDGESKVSLVFGQMNEPPGARARVALTGLTIAEYFRDEEGQDVLLFIDNIFRFTQAGSEVSALLGRIPSAVGYQPTLAVDMGGMQERITTTTKGSITSVQAVYVPADDLTDPAPATTFAHLDATTVLSRGISELGIYPAVDPLDSKSRMLDPRIVGEEHYNTATRVQQMLQEYKSLQDIIAILGMDELSEADKLTVERARKLERFLSQPFTVAQVFTGIEGKLVDLKDTIASFKAIMNGEGDDLPEAAFYMVGDLASARAKGEKILADLAKN

SEQ ID NO: 6844 - DNA, 1539 bp, Candida albicans SC5314
  CDS (1)..(1539): transl_table=12
atgtccaatcagattttcaagaaaattttcgttttttttttccaacatttttttttctgtgcgagggacttccaaccaatagaattccatgattcagtacgatttataaaatatactaacattaatttcttttttttgtttagagccgttattggtgccgttgttgatgtccaattcgacgaaggaaacttgccagctattttgaatgctttgactttgaagaacggtgaccaagacttggtcttggaagttgctcaacatttgggtgaaaacaccgtcagagctattgctatggatggtactgaaggtttagtcagaggtaccgaagtcaacgataccggtgccccaatctccgtcccagtcggtagaggtaccttaggtagaatcatcaatgttgttggtgaaccaattgatgacagaggtccaattgaatgtaaggaaaagaaaccaattcacgctgaaccaccatcattcgttgaacaatccactgctgccgagattttggaaaccggtatcaaggttgtcgacttgttggccccatacgccagaggtggtaagattggtttattcggtggtgctggtgtcggtaagaccgtctttatccaagaattgattaacaacattgccaaagcccatggtggtttctctgtctttaccggtgtcggtgaaagaaccagagaaggtaacgatttgtaccgtgaaatgaaagaaaccggtgtcatcaacttggaaggtgactccaaggtcgctttggtcttcggtcaaatgaacgaaccaccaggtgctagagctagagttgctttgactggtttgaccattgctgaatacttcagagatgaagaaggtcaagatgtcttgttgttcattgataacattttcagattcacccaagctggttccgaagtgtctgctttgttaggtcgtattccatctgctgtcggttatcaaccaaccttagccactgatatgggtcttttgcaagaacgtattaccaccaccaagaaaggttccgtcacctctgtccaagctgtctatgtcccagctgatgatttgaccgatcctgctccagccactacattcgcccatttggatgccactactgtcttgtctagaggtatttctgaattgggtatctacccagctgtcgatccattggattccaaatccagattattggacgcttctgttgttggtcaagaacattacgatgtcgctactggtgttcaacaaactttacaagcttacaaatccttacaagatatcattgctattttgggtatggatgaattgtctgaagctgataaattgactgtcgaaagagcccgtaagatccaaagattcttgtctcaaccattcgctgttgctgaagttttcactggtatcccaggtagattagtcagattgcaagacactgtcaaatcattcaaggatgttttggaaggtaaatacgataacttgccagaaaacgctttctatatggttggtggtatcgaagatgtcgttgctaaagctgaaaaattagctgctgaatccaactaa

SEQ ID NO: 6845 - protein, 512 aa, Candida albicans SC5314
MSNQIFKKIFVFFFQHFFFCARDFQPIEFHDSVRFIKYTNINFFFLFRAVIGAVVDVQFDEGNLPAILNALTLKNGDQDLVLEVAQHLGENTVRAIAMDGTEGLVRGTEVNDTGAPISVPVGRGTLGRIINVVGEPIDDRGPIECKEKKPIHAEPPSFVEQSTAAEILETGIKVVDLLAPYARGGKIGLFGGAGVGKTVFIQELINNIAKAHGGFSVFTGVGERTREGNDLYREMKETGVINLEGDSKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDASVVGQEHYDVATGVQQTLQAYKSLQDIIAILGMDELSEADKLTVERARKIQRFLSQPFAVAEVFTGIPGRLVRLQDTVKSFKDVLEGKYDNLPENAFYMVGGIEDVVAKAEKLAAESN

SEQ ID NO: 6846 - DNA, 1572 bp, Ustilago maydis 521
  CDS (1)..(1572)
atgcctgtcatccagcgcaccgccgtgcgcgctgccagccgctccgctcttcgagcccgacaaaatgctgccgctttctcctccgtcgctcgcgccgctgtgaccgcttcgtccagcgcccctcgcggtctcgccaccgaggcctcccccaagggccagaccggtgctgtcaaggccgtcattggtcccgttgtcgacgttcagtttgacaccgaggatctaccctccatcttcaacgctctcgaggttcagaatgtcaccggtggtggtcgtctcgttctcgaggtcgcccagcacctgggtgagaacactgtccgagctattgccatggagggtaccgagggtctcgttcgtggtcagaaggtcgtcgacactggtcttcccattcagatccccgtcggtcccggtaccctcggccgtatcatgaacgtcattggtgagcccatggacgagcgtggtcccatcaagggcaacaagcttgctcccatccacgttgagccccctgcgttcgtcgaccagtccaccaaggccgaggtgctcgagaccggtatcaaggtcgtcgacctcctcgccccctacgcccgtggtggtaagattggtctcttcggtggcgccggtgtcggcaagactgtgcttatccaggagctcatcaacaacgtcgctaaagcccacggtggttactctgtcttcaccggtgtcggtgagcgaacccgtgagggtaacgatctttaccacgaaatgatcgagactggtgtcatcaacctggagggtgactccaaggtcgctctcgtcttcggtcagatgaacgagccccctggtgcccgtgcccgtgtcgccctgaccggtctcaccatcgccgagtacttccgtgacgaagagggccaggatgtgcttctcttcatcgacaacattttccgtttcacccaggccggttccgagacctcggctcttctcggtcgtattccctcagccgtaggttaccagcccacccttgccaccgacatgggtgtcatgcaggagcgaattaccaccaccaagaagggctccattacctcggtgcaggccgtctacgtgcccgccgatgacttgactgaccctgcccccgccaccacctttgcccacttggacgccaccaccgtgctgtcccgtggtattgccgagcttggtatctaccctgccgtggaccccctcgactccaagtcacgtatgcttgaccccgccgtcgtcggtcgcgagcactacgacattgccactggtgtccagaagcttctccaggactacaagtcgcttcaggacatcatcgccattctcggtatggacgagctttccgaggaggacaagctcaccgtcgagcgtgcccgtaagatccagcgtttcatgagccagcccttcgctgtcgctcaggtcttcactggtatcgagggcaagctcgtctcgctcaaggacaccatctcggcctgcaaggagatccttcgtggtgaccacgatgctcttcctgagtccgctttctacatgtgcggtggtatcgacgacgtcaagaagaaggccgaggagatcgctcgcagcacctaa

SEQ ID NO: 6847 - protein, 523 aa, Ustilago maydis 521
MPVIQRTAVRAASRSALRARQNAAAFSSVARAAVTASSSAPRGLATEASPKGQTGAVKAVIGPVVDVQFDTEDLPSIFNALEVQNVTGGGRLVLEVAQHLGENTVRAIAMEGTEGLVRGQKVVDTGLPIQIPVGPGTLGRIMNVIGEPMDERGPIKGNKLAPIHVEPPAFVDQSTKAEVLETGIKVVDLLAPYARGGKIGLFGGAGVGKTVLIQELINNVAKAHGGYSVFTGVGERTREGNDLYHEMIETGVINLEGDSKVALVFGQMNEPPGARARVALTGLTIAEYFRDEEGQDVLLFIDNIFRFTQAGSETSALLGRIPSAVGYQPTLATDMGVMQERITTTKKGSITSVQAVYVPADDLTDPAPATTFAHLDATTVLSRGIAELGIYPAVDPLDSKSRMLDPAVVGREHYDIATGVQKLLQDYKSLQDIIAILGMDELSEEDKLTVERARKIQRFMSQPFAVAQVFTGIEGKLVSLKDTISACKEILRGDHDALPESAFYMCGGIDDVKKKAEEIARST

SEQ ID NO: 6848 - DNA, 1644 bp, Cryptococcus neoformans var. neoformans B-3501A
  CDS (1)..(1644)
atgaccctcgtcacccgctccgctatccgtctctccaggcgaggcggccagcagttgaagaacgcccgtgccaacgccgccttgttcaacaccgcggccaaccaggccaagaacattgtccccaagctcgccgcctcttcctctagggtcactcttcctgccaaggctgccaacgctgcccgcacctacgccactcccgctggcctccagactggttctatcaagaccgtcattggtgccgtcgttgacgtccacttcgactctgacaacctcccccctatccttaacgccctcgatgttcagtttggtgagggtcagaccgcccccgaaggtggccgactcgttcttgaggtcgctcagcacttgggtgagaacactgtccgatgcattgccatggacggtaccgatggtcttgtccgaggccagaaggttgtcgacactggtgctcccatcaagatccccgttggtcctgctgccctcggtcgtatcatgaacgtcatcggtcagcccattgaccagcgtggtcctatcaagggtgtcagggaggcccctatccacgccgacgccccccccttcgttgaccagtctacccaggctgaggttctcgagactggtatcaaggtcgttgacctccttgctccctacgcccgaggtggaaagattggtcttttcggcggtgccggtgtcggcaagactgtgctcattcaggagctcattaacaacattgccaaggcccacggtggttactccgtcttcaccggtgtcggtgagcgaactcgtgagggtaacgacttgtaccacgaaatgagggagactggtgttatcaaccttgagggtgactccaaggtcgctcttgtcttcggtcagatgaacgagccccctggagcccgtgcccgagttgctcttactggtttgaccattgccgagtacttccgtgacgaggaaggccaggatgtgttgcttttcattgacaacattttccgattcacccaggccggttccgaggtgtctgccttgctcggtcgtatcccctctgccgtcggttaccagcccactctttccaccgatatgggtggtatgcaagagcgaatcaccaccaccaagaagggttccattacctccgtccaggccgtctacgtccctgccgatgacttgactgaccctgcccccgccaccaccttcgcgcacttggacgccaccactgtgttgtctcgatccatcgccgagttgggtatctaccctgccgtcgaccctcttgactccaagtcccgaatgctcgacccccgagttgtcggccagcggcactacgatattgccaccaagactcagcagatcctccagtcttacaagtctctccaggatatcattgccattctcggtatggacgagttgtccgaagaggacaagttgaccgtcgagcgtgcccgaaagatccagcgattcatgtctcaacctttcgctgtcgctcaggtcttcaccggtattgagggtcgacttgtccccctcaaggagaccgtcaacgctttcgaggagattctcgacggtaagcacgaccacatctctgagaactctttctacatggtcggtggtatcgaggacgtcaaggccaagcacgagaagtctctcaaggagcagggtgcttaa

SEQ ID NO: 6849 - protein, 547 aa, Cryptococcus neoformans var. neoformans B-3501A
MTLVTRSAIRLSRRGGQQLKNARANAALFNTAANQAKNIVPKLAASSSRVTLPAKAANAARTYATPAGLQTGSIKTVIGAVVDVHFDSDNLPPILNALDVQFGEGQTAPEGGRLVLEVAQHLGENTVRCIAMDGTDGLVRGQKVVDTGAPIKIPVGPAALGRIMNVIGQPIDQRGPIKGVREAPIHADAPPFVDQSTQAEVLETGIKVVDLLAPYARGGKIGLFGGAGVGKTVLIQELINNIAKAHGGYSVFTGVGERTREGNDLYHEMRETGVINLEGDSKVALVFGQMNEPPGARARVALTGLTIAEYFRDEEGQDVLLFIDNIFRFTQAGSEVSALLGRIPSAVGYQPTLSTDMGGMQERITTTKKGSITSVQAVYVPADDLTDPAPATTFAHLDATTVLSRSIAELGIYPAVDPLDSKSRMLDPRVVGQRHYDIATKTQQILQSYKSLQDIIAILGMDELSEEDKLTVERARKIQRFMSQPFAVAQVFTGIEGRLVPLKETVNAFEEILDGKHDHISENSFYMVGGIEDVKAKHEKSLKEQGA

SEQ ID NO: 6850 - DNA, 1467 bp, Prochlorococcus marinus str. NATL1A
  CDS (1)..(1467): transl_table=11
atggccgcttctgctaccgctactgttggaactaagggtattgttcgccaagtaattggtcctgttttagatgttgaattcccagctggcaagctgccttcaattcttaatgcattaaggattgaaggcaaaaatcctgctgggcaagatgttgcactgactgctgaagttcaacaattattaggtgatcatcgggttagagccgtcgctatgagcggaactgatggattagttagaggtatggaagctttagacacaggagctccaatttctgtacctgttggtgaagccacccttggaagaattttcaacgtccttggggaacctgtagatgagcaaggcgaccttaagaatgtaactacctctccaatacaccgatcagccccaagccttacagatttagaaacaaaaccaaaagtatttgagactggtatcaaagttatcgatttgctggctccataccgtcagggtggaaaagttggattatttggtggggctggagtaggtaaaacagttctaattcaagagctcataaacaatattgcaaaagagcatggtggcgtatcagtttttggtggagtgggagaaagaactagagaaggtaacgatttatatgaagaatttaaagagtctggtgtgattaattctgaagatctaaccaagtcaaaagtagctttgtgctttggtcaaatgaatgagcccccaggcgcaagaatgagggtgggcctatctgccttgactatggctgagcatttccgtgatgtaaataagcaagatgttcttctgttcatcgataatatcttcagatttgttcaggctggatcagaagtatctgctttgctagggcgtatgccatctgctgttggatatcagccaaccttaggaactgacgtgggagagcttcaagaaaggattacctctacccttgaaggatctattacctcaattcaggctgtttatgtacctgctgacgacttaacggaccctgcacctgctactacttttgctcacttagatgcaactacagttttagcaagagctcttgcagccaagggaatttatcctgccgttgatccacttgactcaaccagcacaatgttacagccgtctgttgtaggagatgagcattaccgcacggccagagctgttcaatcaacacttcagagatataaggaattgcaggatattattgcgattttgggattggacgaactatcagaagaggataggaagacagttgatcgtgcccgcaaaattgagaaattcttatctcaaccattctttgttgctgaaatatttacaggtatgtcaggtaaatacgtcaaattagaagatacgattaaaggtttcaatatgattctttcaggtgaacttgaccaactccctgagcaagctttctatcttgttggaagcattgatgaagtgaaagctaaagcagaaaaattagcatctgaagcaaaagcttaa

SEQ ID NO: 6851 - protein, 488 aa, Prochlorococcus marinus str. NATL1A
MAASATATVGTKGIVRQVIGPVLDVEFPAGKLPSILNALRIEGKNPAGQDVALTAEVQQLLGDHRVRAVAMSGTDGLVRGMEALDTGAPISVPVGEATLGRIFNVLGEPVDEQGDLKNVTTSPIHRSAPSLTDLETKPKVFETGIKVIDLLAPYRQGGKVGLFGGAGVGKTVLIQELINNIAKEHGGVSVFGGVGERTREGNDLYEEFKESGVINSEDLTKSKVALCFGQMNEPPGARMRVGLSALTMAEHFRDVNKQDVLLFIDNIFRFVQAGSEVSALLGRMPSAVGYQPTLGTDVGELQERITSTLEGSITSIQAVYVPADDLTDPAPATTFAHLDATTVLARALAAKGIYPAVDPLDSTSTMLQPSVVGDEHYRTARAVQSTLQRYKELQDIIAILGLDELSEEDRKTVDRARKIEKFLSQPFFVAEIFTGMSGKYVKLEDTIKGFNMILSGELDQLPEQAFYLVGSIDEVKAKAEKLASEAKA

SEQ ID NO: 6852 - DNA, 1599 bp, Prochlorococcus marinus str. MIT 9303
  CDS (1)..(1599): transl_table=11
atgctgtgccgactagtcgatacctgtgcgggtcaccgaaccctgagaagatctcgccatgcagtggtaatgttgcgccgctctgtaagggcatgcgttcgacacgcaacccctgcaaaactctattttcttatggccgctgcagctaccgccaccgctggcaccaagggcgttgttcgccaggtgattggcccggttctggatgtggaattccctgccggcaagctgcccaaaatcctcaatgcccttcgtattgatggcaagaacccatccggtcagcacattgccatcactgccgaagtgcagcagctcctcggcgatcatcgagtaagggcagtggcaatgagcagcaccgatggtctggttcgtggcatggaagccctcgacaccggctctgcaatttccgtgcccgttggtgaagccactctgggcaggatcttcaacgtgctcggcgaaccagttgatgagcagggtcctgttacaaccgatgcaactgctccgattcaccggccagcgccaaaactcactgagctagagaccaaaccaacagtttttgaaactggcatcaaggtgattgatctcttggctccctaccgtcaaggcggcaaggttggcctcttcggtggtgccggtgtgggcaagaccgtgctgattcaggagctgatcaataacatcgccaaagagcacggtggtgtgtctgtctttggtggggtgggcgagcgtacccgtgaaggcaacgacctctacgaggaattcaaagaatccggagtgatcaactccgacgacctgtcgaagtcgaaggtagctctttgcttcgggcagatgaatgagccccctggcgcccggatgcgcgtgggtctttcagctctcaccatggctgagcacttccgcgacgtgaacaagcaagacgtgctgctgttcatcgacaacatcttccgttttgtgcaggccggatcagaagtctctgctctattgggtcgcatgccttccgccgtgggttaccagcccacccttggcaccgatgttggtgcacttcaagagcgcatcacatcaaccctagagggatcgattacctcgattcaggccgtctacgttcccgcagatgacctcaccgaccccgcaccagccacaacatttgcccacttagacgccacaactgtgctggctcgtgcattggccgccaagggcatttacccggctgtggatcctttggattccaccagcaccatgcttcagccatcagttgttggcgatgagcattaccgcacagcacgaagcgtgcaggccacactgcagcgctacaaggaactgcaagacatcattgccatccttggtctcgacgaactctcagaagatgatcgccgcacagtagatcgtgcccgcaagattgagaagttcctttcccagcccttctttgtcgccgagatttttaccggcatgtccggcaagtacgtcaagctggaagaaaccatcgccggcttcaatatgatcctggctggtgaactagaccatctacctgagcaagccttttacctggttggcaacatcgacgaggtcaaggctaaggccgagaagatagcttcagaagcaaagggttaa

SEQ ID NO: 6853 - protein, 532 aa, Prochlorococcus marinus str. MIT 9303
MLCRLVDTCAGHRTLRRSRHAVVMLRRSVRACVRHATPAKLYFLMAAAATATAGTKGVVRQVIGPVLDVEFPAGKLPKILNALRIDGKNPSGQHIAITAEVQQLLGDHRVRAVAMSSTDGLVRGMEALDTGSAISVPVGEATLGRIFNVLGEPVDEQGPVTTDATAPIHRPAPKLTELETKPTVFETGIKVIDLLAPYRQGGKVGLFGGAGVGKTVLIQELINNIAKEHGGVSVFGGVGERTREGNDLYEEFKESGVINSDDLSKSKVALCFGQMNEPPGARMRVGLSALTMAEHFRDVNKQDVLLFIDNIFRFVQAGSEVSALLGRMPSAVGYQPTLGTDVGALQERITSTLEGSITSIQAVYVPADDLTDPAPATTFAHLDATTVLARALAAKGIYPAVDPLDSTSTMLQPSVVGDEHYRTARSVQATLQRYKELQDIIAILGLDELSEDDRRTVDRARKIEKFLSQPFFVAEIFTGMSGKYVKLEETIAGFNMILAGELDHLPEQAFYLVGNIDEVKAKAEKIASEAKG

SEQ ID NO: 6854 - DNA, 1395 bp, Rhodobacter sphaeroides 2.4.1
  CDS (1)..(1395): transl_table=11
atgactggacgggtgacatcggttcgagggccggtcctcgacatccgtgtcgagggacctctgcccgcgatcggcgacgtggtggaggtgggctccctccccgtcgtggcggagatccaggcccatctcggcgccgccgatgtccgggccatcgcgctgcactcgacgcagggcatcgcccgcggcgagacggtccgcacgacgggcgggccgctccgggtgcccacggggccggccgtgctcgggcggcttctcgatgtggcgggccgccccgccgatctgggcccgccgatccccgccggggcgccccgcgcgccgatcctgcaccccgccccgccgctcgccgcgcaggacgcgcgctttcaggtcttctccaccggcatcaaggtgctcgacctgctggccccgctggcccagggcggcaagaccgcgatgttcggcggcgcgggcgtgggcaagaccgtgctggtgatggagctgatccgcgccatggtttcgggctatgacgggatctcggtcttcgcgggcgtgggcgaacgctcgcgcgaggggcacgagatgctgggcgagatgaaggcctcgggcgtgctcgaccgcaccgtgctggtctacggccagatgaacgagccgcccggcgcgcgctggcgcgtgccgctgaccgcgctcaccatcgccgagggcttccgcgacggcgaggggcgcaacgtgcttctgctcatcgacaatgtgttccgcttcgtgcaggcgggggccgaggtctcggggcttctgggccggatgccctcgcgcgtgggctatcaaccgacgctcgagaccgaggtcgcggcgctgcaggagcgcatcgcctcggtcgggcgcgcctcggtcacggcgatcgaggcggtctatgtcccggccgacgatttcaccgaccccgccgtgaccgcgatcagcgcccatgtcgacagcacggtggtcctgtcgcggcagctggcggccgaggggatctatcccgcgatcgatccgctggccaccacctccgtcctgctcgatccggcggtggtgggcgaggagcatgcccgcgtggcggggcggctgaaggaagcgatcgaacattaccacgagctgcgcgacgtgatcgcgcttctgggtatcgaggagctcggccgcgaggagcagctgatggtgggccgcgcccgcaagctgcagcgcttcctgacccagcccttcttcgtcgccgccgcctataccggcatggagggccgctcggttccggtggccgagacggtgcagggctgcgcggcgatcctcgggggggagtgcgacgactgggacgagggctcgctctacatgatcggcacgcttgcggaggcgcgcgcacgggaagaggcgcgccgccggaagggggccgcatga

SEQ ID NO: 6855 - protein, 464 aa, Rhodobacter sphaeroides 2.4.1
MTGRVTSVRGPVLDIRVEGPLPAIGDVVEVGSLPVVAEIQAHLGAADVRAIALHSTQGIARGETVRTTGGPLRVPTGPAVLGRLLDVAGRPADLGPPIPAGAPRAPILHPAPPLAAQDARFQVFSTGIKVLDLLAPLAQGGKTAMFGGAGVGKTVLVMELIRAMVSGYDGISVFAGVGERSREGHEMLGEMKASGVLDRTVLVYGQMNEPPGARWRVPLTALTIAEGFRDGEGRNVLLLIDNVFRFVQAGAEVSGLLGRMPSRVGYQPTLETEVAALQERIASVGRASVTAIEAVYVPADDFTDPAVTAISAHVDSTVVLSRQLAAEGIYPAIDPLATTSVLLDPAVVGEEHARVAGRLKEAIEHYHELRDVIALLGIEELGREEQLMVGRARKLQRFLTQPFFVAAAYTGMEGRSVPVAETVQGCAAILGGECDDWDEGSLYMIGTLAEARAREEARRRKGAA

SEQ ID NO: 6856 - DNA, 1395 bp, Clostridium thermocellum ATCC 27405
  CDS (1)..(1395): transl_table=11
atggccacggaaaatgtaggtacagtggtgcagataattggacctgttatagatataaggtttgagagaggaaagcttccttcgatatacaatgcaataaaaatcaattcagaaggcatcgatatagttgccgaagtgatgcagtatacaggaaatgacactgtaagatgtgtgtcaatgaattcaacggacggactgaaaaggggcatgaaggccgttgacaccggtgaacctataaaggtcccggtgggcaaagaggttttgggaagagtgtttaatgtgctgggagaacccattgacggcaaaggtgatgtgaaagcaacaacatatcttcccattcacagagaagctcccggacttgacgagcagaagccggtaacggagattttggagacgggaataaaggtaatcgaccttctggctccttacgccaagggagggaaaataggtctgtttggcggagcgggagtcggtaaaactgtgcttataatggagcttataagaaacattgcaacagagcatggcggatattccgtattcaccggagtaggtgaaagatcaagggaaggaaacgatctttggaatgaaatgaatgaatccggtgtaatagaaaaaaccgccctggtgttcgggcaaatgaatgaacctccgggttcaagaatgagagtggggcttacgggccttaccatggcagagtatttcagggacgaactgggccaggatgtacttcttttcattgacaatatattcaggttcatccaggcgggttccgaagtgtcggctcttttagggagaattccgtcagcagttgggtaccagcctactttggctacggaaatgggagccctgcaggaaagaataacttctaccaaaaaagggtcaattacttcggtacaggcggtttatgtgcctgcggatgacctgacggaccctgcaccggcaacaacctttacccaccttgatgccactaccgtactgtcaaggcatattgttgaacagggaatttaccctgccgttgaccccttagattccacttcaagggtgctggaccgcagaattgtcggtgatgaacactataccgttgcaagaaaggtgcaggagattttgcaaagatacaaggaacttcaggatataattgcaatacttggacttgatgaattgtcggaggaagacaagctcatagtatttagagcaaggaagatacagagatttctttcccagccgttctttgtggcggaggcctatacgggatacaaagggaagtttgtccgcataaaggacacgataaggggatttaaggaaattattgaaggaaaaatggatgacattcccgaagccgcattctatatggctggaactattgatgaagtttatgaaagagcaaagaaaatgtag

SEQ ID NO: 6857 - protein, 464 aa, Clostridium thermocellum ATCC 27405
MATENVGTVVQIIGPVIDIRFERGKLPSIYNAIKINSEGIDIVAEVMQYTGNDTVRCVSMNSTDGLKRGMKAVDTGEPIKVPVGKEVLGRVFNVLGEPIDGKGDVKATTYLPIHREAPGLDEQKPVTEILETGIKVIDLLAPYAKGGKIGLFGGAGVGKTVLIMELIRNIATEHGGYSVFTGVGERSREGNDLWNEMNESGVIEKTALVFGQMNEPPGSRMRVGLTGLTMAEYFRDELGQDVLLFIDNIFRFIQAGSEVSALLGRIPSAVGYQPTLATEMGALQERITSTKKGSITSVQAVYVPADDLTDPAPATTFTHLDATTVLSRHIVEQGIYPAVDPLDSTSRVLDRRIVGDEHYTVARKVQEILQRYKELQDIIAILGLDELSEEDKLIVFRARKIQRFLSQPFFVAEAYTGYKGKFVRIKDTIRGFKEIIEGKMDDIPEAAFYMAGTIDEVYERAKKM

SEQ ID NO: 6858 - DNA, 1395 bp, Clostridium difficile 630
  CDS (1)..(1395): transl_table=11
atggcaaatgtaggtaaagtagtacagattgtaggagctgtactagatgttaagtttgatagtgaacaaagcctacctaacttattaaatgcgttagtaataaagttaggagataaagaaatagttgcagaagttgctcaacatataggtgatgatactgtaagatgtatagctatgagtgcaacagacggacttgtaagaggtatggaagttgtagatacaggagggccaataagtgttcctgttggagatgaaactttaggtagaatattcaatgttcttggaaaaccagttgatgggaaaccagctccaaaatctgcacctaaattacctatacatagaccagcaccagcatatgatgaactagaaactacagcagagatactagaaactggtattaaggtagttgacttactagctccatatctaaaaggtggaaaaataggtctatttggaggagcaggagtaggaaagacagttctaatacaagagcttataaacaatattgctaagcaacatggtggtatttctgtgttttcaggagtaggagaaagaacaagagaaggtaacgacctttatggcgaaatgagtgagtctggagttataaataaaacagctctagtatttggtcaaatgaatgaaccacctggagcgagaatgagagttgctttaactggacttacaatggcagaacattttagagatgagcaaggacaagacgttttacttttcgttgataatatattccgtttcacacaagctggttcagaagtttcagcacttctaggacgtatgccatcagctgttggttatcagccaacattagctactgaaatgggtgcacttcaagagagaataacatcaactaagaaaggttcaataacatctgttcaagcagtatatgtaccagcagatgacttaactgacccagcaccagctacaacattctctcacttagatgcaaaaacagttttatcaagacaaatatcatcactgggtatatatccagcagttgaccctcttgaatctacatcaaggattcttgaccctagtatagtaggaaaagaacattatgaagtagctagaggtgtacaatcaatacttcaaagatataaagaacttcaagatataattgctatacttggtatggatgaattatctgatgaagataagttaatagttgcacgtgctagaaagatacaaagattcttatctcaatcattcacagttgctgagcaatttacaggaaatccaggtcaatatgttcctgttaaagagactgtaagaggatttaaagaaattcttgaagggaaacatgatgacttaccagagtcagcattcttatttgtaggaacaatagaagacgctgttagaaaagcgaagggaagtatgtag

SEQ ID NO: 6859 - protein, 464 aa, Clostridium difficile 630
MANVGKVVQIVGAVLDVKFDSEQSLPNLLNALVIKLGDKEIVAEVAQHIGDDTVRCIAMSATDGLVRGMEVVDTGGPISVPVGDETLGRIFNVLGKPVDGKPAPKSAPKLPIHRPAPAYDELETTAEILETGIKVVDLLAPYLKGGKIGLFGGAGVGKTVLIQELINNIAKQHGGISVFSGVGERTREGNDLYGEMSESGVINKTALVFGQMNEPPGARMRVALTGLTMAEHFRDEQGQDVLLFVDNIFRFTQAGSEVSALLGRMPSAVGYQPTLATEMGALQERITSTKKGSITSVQAVYVPADDLTDPAPATTFSHLDAKTVLSRQISSLGIYPAVDPLESTSRILDPSIVGKEHYEVARGVQSILQRYKELQDIIAILGMDELSDEDKLIVARARKIQRFLSQSFTVAEQFTGNPGQYVPVKETVRGFKEILEGKHDDLPESAFLFVGTIEDAVRKAKGSM

SEQ ID NO: 6860 - DNA, 1407 bp, Streptococcus pyogenes str. Manfredo
  CDS (1)..(1407): transl_table=11
atgagctcaggcaaaattgctcaggttgttggtccagtagtagacgtcatgtttgctagtggggacaaacttccagagattaataatgcattgattgtttataaagatagtgataaaaagcaaaaaatcgtccttgaagttgctctggaacttggtgacggtatggtgcgaacaatcgctatggaatcaactgatgggcttacacgtgggttagaagttcttgacactggtcgtgcgattagcgtaccagtaggtaaagaaactttgggacgcgtctttaatgtacttggagaaaccattgacttggaagaaccatttgcagaagacgttgaccgtcagccgatccataaaaaagcaccatcgtttgatgaattatcaacatcatcagaaattcttgaaactggtatcaaggtaattgaccttcttgccccttaccttaaaggtggtaaagttggacttttcggtggtgccggagttggtaagactgttcttatccaagaattaatccacaatatcgcccaagaacacggaggtatttcagtatttaccggtgttggtgagcgaacacgtgaaggaaatgacctttactgggaaatgaaagaatcaggcgttattgagaaaactgccatggtttttggtcagatgaatgagccgcctggggcacgtatgcgtgtagcccttactggtttaaccattgctgagtatttccgtgatgtagaaggccaagatgttttgctctttattgataatatcttccgtttcactcaggcaggttcagaagtatcagccctcttaggccgcatgccttctgctgttggttaccaaccgacacttgctactgaaatgggacaattgcaagaacgtattacgtcaactcaaaaaggatctgttacttctatccaagcgatttatgtgccagccgatgactatactgacccagcgccagcaactgcatttgctcacttggattcaacaactaaccttgagcgtaaattgactcaaatgggtatttaccctgcggttgacccattggcttcaagttcacgggccttatcacctgaaattgttggtgaagagcactatgctgtggcaacagaagttcaacgtgtgcttcaacgctaccgtgaattacaagacatcatcgctattttggggatggatgaattatcagatgaagaaaaaacattggttggacgtgcgcgtcgtatccagttcttcttatcacaaaactttaatgttgctgaacaatttacaggtcttcctggttcttacgtgccagttgctgatacagttcgcggctttaaagaaattcttgaaggaaaatacgatgatcttccagaagacgccttccgttcagttggtccaatcgaggatgtgattaaaaaagccgaaaaaatgggcttttaa

SEQ ID NO: 6861 - protein, 468 aa, Streptococcus pyogenes str. Manfredo
MSSGKIAQVVGPVVDVMFASGDKLPEINNALIVYKDSDKKQKIVLEVALELGDGMVRTIAMESTDGLTRGLEVLDTGRAISVPVGKETLGRVFNVLGETIDLEEPFAEDVDRQPIHKKAPSFDELSTSSEILETGIKVIDLLAPYLKGGKVGLFGGAGVGKTVLIQELIHNIAQEHGGISVFTGVGERTREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTQKGSVTSIQAIYVPADDYTDPAPATAFAHLDSTTNLERKLTQMGIYPAVDPLASSSRALSPEIVGEEHYAVATEVQRVLQRYRELQDIIAILGMDELSDEEKTLVGRARRIQFFLSQNFNVAEQFTGLPGSYVPVADTVRGFKEILEGKYDDLPEDAFRSVGPIEDVIKKAEKMGF

SEQ ID NO: 6862 - DNA, 1461 bp, Candidatus Protochlamydia amoebophila UWE25
  CDS (1)..(1461): transl_table=11
gtgaatttttcgaatcatttgaagaaactcaatagaaaaggctcaaataaaaataaaaggcaaatgatggcggtaggaaaagtcaaacagattgtaggtcccacattagatatcgagtttcctcctgggcagcttccaaacattttaaatgcgattaaaatcattgatcccaaagatcaacgagaattaattgctgaagttgcgatgcacttaggagataaccaagttcgttgtattgccctatcatctacagatggtttggtgagagaagcccaagccgttgatactgaagctcctatttctattcctgtgggaagtccaacacttggccggctccttaatgtcctaggtcaaccgatcgacgaaatgggagctatcgaaaacgctgaaatttctcctattcacaaagcttcccccactttcgaagagcaagatacgcagggagtcatttttgaaacagggattaaggttattgaccttctttgcccctatacaaaaggagggaaagttggattgtttggaggggcaggagttggtaaatcagtcattgtaatggaattaattcataacattgccacccatcatggaggctattctgttttttgcggaatcggggaaagaacaagagaaggaaatgatttatggttagaaatgaaagagtccggtattctctctaagactagtctcgtatttggccagatgaacgaacctcctggggcaagaatgcgagtaggtttaacaggattaacgatggcagagcattttagagaccaagagcatcaaaatgtccttttattcattgataatattttccgttttgttcaagcaggatcagaagtttctgcgttgctaggtagaatgccgtccgctgtcggttatcagccaactttagcaagtgaaattggaagtttacaagaaagaatcacttcgacaaagcatggttctattacctcagtccaagcgatttatgttccagcagatgattatacagatccggcaccagctagtatttttccccatttagatgctgcaacaactctctcgcgtcaaattgcggaactgggcatttatccagctgtagatcctttaaattcaagttcgcggattttagacccccacgttttaggtgaagagcattatcaggttgctagacaagtgcaaaaagttttgcagcgttataaagatttgcaagacatcattgcaattttgggaattgatgaattatctgaagaagatcagttaacagtttctcgtgctcgtcgcattcaaaaatttttatcgcaaccattttttgttgccgaaacgtttacaggaaaaaaaggacgttttgttaaattgcctgatactatcaaaggattcaaaatgatagtagaaggcgaaatggataatattcctgagcaagctttttatatggtgggaacaattgaagaagttttcgaaaaagctgagcaaatgaaataa

SEQ ID NO: 6863 - protein, 486 aa, Candidatus Protochlamydia amoebophila UWE25
MNFSNHLKKLNRKGSNKNKRQMMAVGKVKQIVGPTLDIEFPPGQLPNILNAIKIIDPKDQRELIAEVAMHLGDNQVRCIALSSTDGLVREAQAVDTEAPISIPVGSPTLGRLLNVLGQPIDEMGAIENAEISPIHKASPTFEEQDTQGVIFETGIKVIDLLCPYTKGGKVGLFGGAGVGKSVIVMELIHNIATHHGGYSVFCGIGERTREGNDLWLEMKESGILSKTSLVFGQMNEPPGARMRVGLTGLTMAEHFRDQEHQNVLLFIDNIFRFVQAGSEVSALLGRMPSAVGYQPTLASEIGSLQERITSTKHGSITSVQAIYVPADDYTDPAPASIFPHLDAATTLSRQIAELGIYPAVDPLNSSSRILDPHVLGEEHYQVARQVQKVLQRYKDLQDIIAILGIDELSEEDQLTVSRARRIQKFLSQPFFVAETFTGKKGRFVKLPDTIKGFKMIVEGEMDNIPEQAFYMVGTIEEVFEKAEQMK

SEQ ID NO: 6864 - DNA, 1425 bp, Legionella pneumophila subsp. pneumophila str. Philadelphia 1
  CDS (1)..(1425): transl_table=11
atgggtcatgaatacaattggaaaatgatggataaaaacacggctgttgctcaaactcatggaactcccatcggcaggataatcgaaatcaatggccctgttgtcaggatacattgtgatgtactacctcctttgcatcaatctcttaaaacttacacggacagtgatgaatacattttggaagtgtgtcagcatcttgatgagcatcatgtgagagccatcacgctccaccgtgcctcaggattgcaaagaggtttaatagtttatgaccaaggcacttcgttacgaattcccgtttcaaaagaatgcttgggccgccttttaaatatttttggtgagccattagacggagccccgccattagaaacccatgaatatcgtgatgttctggcaaacttagcgccacttgaaatgacgagcactcaagaaaccattcttgagactggaattaaagtcattgatttactttgtcctttcgtcagagggtgtaaaacgggattgtttggtggtgcaggagttgggaaaaccgtactcctgatggaattgatgcatgccattattcaattgcatcaagggacctctgtctttgctggtgttggggagcgcattcgggaaggacatgaattgtggcatgagatgaaatccgcaggcgtaatggataaaaccctcatggtgtttggtcaaatggacgaatcaccgggagtgcgttttcgcacagggttatcggcattaacttatgcggaatatttgcgtgatacgttgggccatgaggttctttttcttgtggataatatttatcgttttgtgcaagccggcagtgaaatttcggggttacttggccgaatgccggctagtgtcggttatcaacccaccttaatgactgagatagcggaacttgaagagcgcatgacatcgactgcaaaaggagcagtgacctcggtacaagcggtttatgttccggctgatgatatgagcgatccggcggtgaccgggattattactcatttggattccatcatagtactctctcgcgcacaagcaggcaaaggcatttatcccgccgtggatcccttagcttccaagagtcaatttatggataaaatcctattgggcgagcgacattattccattgcacaagccgtacgagaacacctggaacgttatcaagaattagaagacatgatttctatgatggggattgaagagctttctcctaaagaccgtgctattgtgttaagagcacgtaaactgcagcgctatcttagccaacccttccatgtcaccaaacttcaaacaggaatggaagggaaatcggtttcattagaacacacattaaccgattgcgaatcatttctaagaggcgattacgatgaattttcagaagaagcgtgttacatgaggggtgccatggataaagggagataa

SEQ ID NO: 6865 - protein, 474 aa, Legionella pneumophila subsp. pneumophila str. Philadelphia 1
MGHEYNWKMMDKNTAVAQTHGTPIGRIIEINGPVVRIHCDVLPPLHQSLKTYTDSDEYILEVCQHLDEHHVRAITLHRASGLQRGLIVYDQGTSLRIPVSKECLGRLLNIFGEPLDGAPPLETHEYRDVLANLAPLEMTSTQETILETGIKVIDLLCPFVRGCKTGLFGGAGVGKTVLLMELMHAIIQLHQGTSVFAGVGERIREGHELWHEMKSAGVMDKTLMVFGQMDESPGVRFRTGLSALTYAEYLRDTLGHEVLFLVDNIYRFVQAGSEISGLLGRMPASVGYQPTLMTEIAELEERMTSTAKGAVTSVQAVYVPADDMSDPAVTGIITHLDSIIVLSRAQAGKGIYPAVDPLASKSQFMDKILLGERHYSIAQAVREHLERYQELEDMISMMGIEELSPKDRAIVLRARKLQRYLSQPFHVTKLQTGMEGKSVSLEHTLTDCESFLRGDYDEFSEEACYMRGAMDKGR

SEQ ID NO: 6866 - DNA, 1377 bp, Methylococcus capsulatus str. Bath
  CDS (1)..(1377): transl_table=11
atgcaggagcgagcccccgtcatcggcagcatcgccgaggtccacggaccggtggtggtgattgcctgccagacgctgccgccgctccggcaggccctgtacagccggatcgatcatgaaacctatctattcgaagttcaccagcatctcgatgaaagccatgttcgggccgtgacgctacaccgtactacgggtctcaaacgcggcatggtggttcacgatcttggagcgccgctgcaggtcccggtgtccacagcctgcctgggccgcctggtgaaccttttcggcgaaccgctggacaacggcccgccgctacccgactccgagtaccgcgacgcccaccgtccgccggcaccgctggccgaatcgcgcgctgccggtgaaacgctggaaaccggcatcaaggtcatcgacctgctctgccctttcgcccgcggcggcaagaccggcctgtttggcggtgcgggcgtggggaaaacggtgttgatcatggaattcatgcacgccgtcagcgccctgcaccggggagtctcggtcttcgccggcgtgggtgagcgcatccgcgagggccacgaactgtggcgcgaactggccgaggccggcgtcctcgacaagtcgctgctggtgtatggccagatggacgagtcgcccggcgtccgcttccgggtcggattgacggccctcacttatgccgaatacctccgcgacacgctgcacaccgaagtgctgttcctcatcgacaacgtgttccgcttcgttcaggccggcagcgagatttccagcctgctgggccggatgcctgcgaccgtgggttaccagccgaccctggccaccgaggtagcggaaatcgaggaacgcatcacttcgaccgccgccggtgcgatcacctccgtacaggccgtgtacgtacccgctgacgacatgaccgacccggccgtggccgccattctcagccacctcgacaccaccgtagtgctgtcgcgcgtccaggcaggcaagggcatctatccggcgatcgacccgctggcctcgaccagccggctgatggaccgccatgtgatcggtgaccgtcactacgggatcgcccagggggtgcgggaacatctggcccgctatcgggagctggaagacatcatcaccatgttgggaatcgaggaactctccccccaggaccggctcctcgtgctgcgggcacgcaagcttcagcgctacctgacccagcctttcttcgtcaccgcgcagcacactgggctggccggcgtcagtgtcccactcgacgccacgctcggcgattgtgaaggatttctgaccgggcgctacgacgacctggcggaagaagactgctacatgcgcggcacactcggccgcggttcatga

SEQ ID NO: 6867 - protein, 458 aa, Methylococcus capsulatus str. Bath
MQERAPVIGSIAEVHGPVVVIACQTLPPLRQALYSRIDHETYLFEVHQHLDESHVRAVTLHRTTGLKRGMVVHDLGAPLQVPVSTACLGRLVNLFGEPLDNGPPLPDSEYRDAHRPPAPLAESRAAGETLETGIKVIDLLCPFARGGKTGLFGGAGVGKTVLIMEFMHAVSALHRGVSVFAGVGERIREGHELWRELAEAGVLDKSLLVYGQMDESPGVRFRVGLTALTYAEYLRDTLHTEVLFLIDNVFRFVQAGSEISSLLGRMPATVGYQPTLATEVAEIEERITSTAAGAITSVQAVYVPADDMTDPAVAAILSHLDTTVVLSRVQAGKGIYPAIDPLASTSRLMDRHVIGDRHYGIAQGVREHLARYRELEDIITMLGIEELSPQDRLLVLRARKLQRYLTQPFFVTAQHTGLAGVSVPLDATLGDCEGFLTGRYDDLAEEDCYMRGTLGRGS

SEQ ID NO: 6868 - DNA, 1548 bp, Ehrlichia ruminantium str. Welgevonden
  CDS (1)..(1548): transl_table=11
ttgctacgtttttattgtaatgtaaggtacaggatgtcaagtttaactggtaaagtaaaaggtagagctaggaaaattaaaggtgatgcagatattcgtattaatgagtccactgagaatgttggattagtaatccgtgtgatgactgcagttgtagatattaagtttcctagtgggaaggtacctaagatactaaatgcattagaaagtaaagaaatttataatggtaaaaaattagttcttgaggtatctcagcatattagtgatagtattgtaaggtgtatagcacttgatagtactgatggtttatctagaaatgatgaatttattgatactggtgctcctatctctgttcctgttggtagagcaactttgggtagggtttttgatgtattaggaaatccaatagataattgtggcccattaactaaatcagattactctattaagccaatatattcagaagttcctaaattaacggatcaaaaggttactacagaaatattggtaactggtattaaggtaatagatttactggcaccgtaccttaaaggtggaaaagttggtttgtttggaggtgctggtgtaggtaaaactgtacttattatggagttaatacataatattgcaaaagctcataagggggtttcagtatttgctggggtaggagaacgtacacgtgaaggaaatgatttatatcatgagatgatagaatctggtgtaatcaatttagaggaaaaagataagtcacaagcagttttagtatatggtcagatgaatgaacctcctggggcaaggttacgtgttgcattatctgctttaactatggcagaatattttagggatgttgaaaatcaggatgtattgttttttgtagataacatatttagatttactcagtctggttctgaaatttcagctttattaggtagaatcccatctgctgtaggttatcagcctactcttgctgcagaaatgggtgctatgcaagagagaattacttctacaaatcgtggttctattacttcagtacaagcaatatatgtgccagcagatgatttaacagatccagctccagcaacttcttttgctcatcttgattcgacaactgtcttgtcaagacaaatagctgagttgggtatatatcctgctgttgatcctttagattcggcttctcaggcgttgtctattgatattgttggggaaaaacattatgaggtatctaaggaagtgcagcgtatattacaaacgtataagtctttacaagatattattgcaattcttggtatggaggagttgtcagaagaagataagcttatagtggcaagagcgaggaaaattcagaggtttttatcgcaaccttttcatgttgcagaggtgtttactggtacaccaggtgtatttgtttctcttgaagacacagtctctagttttaaggatatagtggaaggtaagtatgatcatttacctgaagctgcattctatatggttagtaacataaatgaagctgttaaaaaagcagagctattgcaaaaagaaggtaaataa

SEQ ID NO: 6869 - protein, 515 aa, Ehrlichia ruminantium str. Welgevonden
MLRFYCNVRYRMSSLTGKVKGRARKIKGDADIRINESTENVGLVIRVMTAVVDIKFPSGKVPKILNALESKEIYNGKKLVLEVSQHISDSIVRCIALDSTDGLSRNDEFIDTGAPISVPVGRATLGRVFDVLGNPIDNCGPLTKSDYSIKPIYSEVPKLTDQKVTTEILVTGIKVIDLLAPYLKGGKVGLFGGAGVGKTVLIMELIHNIAKAHKGVSVFAGVGERTREGNDLYHEMIESGVINLEEKDKSQAVLVYGQMNEPPGARLRVALSALTMAEYFRDVENQDVLFFVDNIFRFTQSGSEISALLGRIPSAVGYQPTLAAEMGAMQERITSTNRGSITSVQAIYVPADDLTDPAPATSFAHLDSTTVLSRQIAELGIYPAVDPLDSASQALSIDIVGEKHYEVSKEVQRILQTYKSLQDIIAILGMEELSEEDKLIVARARKIQRFLSQPFHVAEVFTGTPGVFVSLEDTVSSFKDIVEGKYDHLPEAAFYMVSNINEAVKKAELLQKEGK

SEQ ID NO: 6870 - DNA, 1542 bp, Rubrobacter xylanophilus DSM 9941
  CDS (1)..(1542): transl_table=11
atggcggagaacggcggagccgagagggctgtgagccaggacggccgcagggacggccagccccgcgagggcggggtcggacgtgtcgtagaggtcaaggggccggtggtcgacgtccggtttccgccggaccagatcccggagatctacaacgccctgacctgcaagatagagaccgaggagggggagcacaccctcaccctcgaggtccagcagctgctcggggacgacatggtgcgcaccgtggccatgtcctccaccgacggcctcaggcggggcgtcgaggtgcaggacaccggcaggccgatagccgtcccggtgggcgaggcggtcctcgggcgggtgctcgacgtgctcggggagccggtggacgagcaggggccggtcgagggcgaggccgaccgctggccgatccaccgccccgcccccaagttcgaggacctctccaccaaggccgagcagttcgtctccggcatcaaggtcatagacctgctgtgcccggtgaggaggggcggcaaggtcggcctgttcgggggcgcgggcgtgggcaagaccgtgctcatcaccgagctgatcaacaacatcgccctgcagtacgagggcacctcggtcttcaccggcgtgggggagcggacccgcgaggggacggccctctacggcgagatggaggaggccggggttctcaagaacacggcgctgatcttcggccagatgaacgagccgcccggggcccgcttccgggtggggctgaccggcgtgaccatcgccgagtacttcagggacgtgctcgggcaggacgtgctgttcttcctggacaacatcttccggttcgcccaggcgggcaacgaggtctcggcgctgatgggccggatgccctcggaggtcggctaccagcccacgctggggaccgagatgggggcgctgcaggagaggatcacctccaccaagaagggttcgatcaccagcttccaggcggtctacgtcccggcggacgacccgacggaccccgcgccgttcacggtcttcgcccacctggactccaccgtcgagctctcccggagcctcttcgagcaggccatcttcccggcggtggacccgctggcctcctcctcgaccatcctcgaccccgacgtggtcgggcaggagcactacgaggtcgcccaggaggtcaagggcatcctgcagcgctacaaggagctgcaggacatcatcgccatcctcggcatcgacgagctctccgaggaggacaaggtgatcgtggcccgcgcccggcggctgcagcgcttcctcagccagccgttcttcgtggccgagcagttcaccagcctccccggcaagttcgtggagctcgaggagaccgtccagagcttccgggaggtcgtcgagggcaagcacgacgacctgcccgagcaggccttctacctggtcggcggcatcgacgacgttctggagaaggcgcgccagctctccggcgaggaggaggaaggcgaggaggccgccaaggaggaggccggcgtgggggccggcggcgagggcagctga

SEQ ID NO: 6871 - protein, 513 aa, Rubrobacter xylanophilus DSM 9941
MAENGGAERAVSQDGRRDGQPREGGVGRVVEVKGPVVDVRFPPDQIPEIYNALTCKIETEEGEHTLTLEVQQLLGDDMVRTVAMSSTDGLRRGVEVQDTGRPIAVPVGEAVLGRVLDVLGEPVDEQGPVEGEADRWPIHRPAPKFEDLSTKAEQFVSGIKVIDLLCPVRRGGKVGLFGGAGVGKTVLITELINNIALQYEGTSVFTGVGERTREGTALYGEMEEAGVLKNTALIFGQMNEPPGARFRVGLTGVTIAEYFRDVLGQDVLFFLDNIFRFAQAGNEVSALMGRMPSEVGYQPTLGTEMGALQERITSTKKGSITSFQAVYVPADDPTDPAPFTVFAHLDSTVELSRSLFEQAIFPAVDPLASSSTILDPDVVGQEHYEVAQEVKGILQRYKELQDIIAILGIDELSEEDKVIVARARRLQRFLSQPFFVAEQFTSLPGKFVELEETVQSFREVVEGKHDDLPEQAFYLVGGIDDVLEKARQLSGEEEEGEEAAKEEAGVGAGGEGS

SEQ ID NO: 6872 - DNA, 1506 bp, Cytophaga hutchinsonii ATCC 33406
  CDS (1)..(1506): transl_table=11
atggcaaatattggtaaaatcactcagattattggtccggttgtagacgttggatttgaaggagagtacgctcttccgcaaattttagatgcattggaagtaactcgtccggatggacaaaaagtaatccttgaatgtcagcagcatttaggagaagatcgtgtacgtacaatcgcgatggactctacagatggtttgacaagaggaatggaagttaaaacatacggtatgccgatttctatgcctgtaggcgaagatatccgtggccgtttatataatgtggttggcgatgcaatcgatggtattccatcgggagtagctgctaaccgtatgtcaattcaccgtcaggctcctaaatttgaagatttatctacaaatacagaagtattgtttacgggtatcaaagtaattgatttgcttgagccatatgtaaaaggtggtaaaatcggtcttttcggtggtgccggtgtaggtaaaacagtgttgatcatggaattgatcaacaacattgcaaaagcatatgcaggtctttctgtatttgccggtgttggtgagcgtacacgtgaaggaaacgatttgcttcgtgaaatgattgaatcaaacgtaatccgttacggggatgaattcaaacattctatggaaaaaggagagtgggatttatctaaagtagatgctactgaattattaaagtctcaggcaacattggtgttcggtcagatgaacgaacctcctggagcaagagcaagagttgcgttggctggtcttacagttgcggaatatttccgtgatggagatggccagggccagggccgtgatatcttattctttattgataacatattcagatttacacaagcaggttcagaagtatctgccttgttaggtcgtatgccatctgccgtaggttaccaaccgacattggcaacagaaatgggtgcgatgcaggaacgtattacttcaacaaaaagaggttctattacatctgtacaagccgtttatgtaccagctgatgatttaaccgatccggctccggcaactacatttgcgcacttggatgctacaacggtattgaaccgtaaaatttctgaattaggtatctatcctgctgtggatccattggattctacatcacgtatccttagccctgaaattttaggtagcgaacattacgattgcgcacaacgtgtaaaagaaattttacagcgttacaaagaacttcaggatatcatcgccattcttggtatggatgaactttctgaagaagataagcaggcggttcaccgcgcgcgtcgtgtgcaacgtttcttatctcagcctttccacgtagcggaacagtttacaggtctaaaaggtgagttagtaaatattaaagatactatcaaaggatttaacatgatcatggacggtgcattagaccacttgcctgaagcagcgtttaaccttgtaggtagcattgagcaggcaattgctaaaggcgagaagcttgttgctgattctaaaaaataa

SEQ ID NO: 6873 - protein, 501 aa, Cytophaga hutchinsonii ATCC 33406
MANIGKITQIIGPVVDVGFEGEYALPQILDALEVTRPDGQKVILECQQHLGEDRVRTIAMDSTDGLTRGMEVKTYGMPISMPVGEDIRGRLYNVVGDAIDGIPSGVAANRMSIHRQAPKFEDLSTNTEVLFTGIKVIDLLEPYVKGGKIGLFGGAGVGKTVLIMELINNIAKAYAGLSVFAGVGERTREGNDLLREMIESNVIRYGDEFKHSMEKGEWDLSKVDATELLKSQATLVFGQMNEPPGARARVALAGLTVAEYFRDGDGQGQGRDILFFIDNIFRFTQAGSEVSALLGRMPSAVGYQPTLATEMGAMQERITSTKRGSITSVQAVYVPADDLTDPAPATTFAHLDATTVLNRKISELGIYPAVDPLDSTSRILSPEILGSEHYDCAQRVKEILQRYKELQDIIAILGMDELSEEDKQAVHRARRVQRFLSQPFHVAEQFTGLKGELVNIKDTIKGFNMIMDGALDHLPEAAFNLVGSIEQAIAKGEKLVADSKK

SEQ ID NO: 6874 - DNA, 1455 bp, Trichodesmium erythraeum IMS101
  CDS (1)..(1455): transl_table=11
atggtaagcaccttagaaaaaacaaacgtaggatctattactcaaattattggtccagtagtagatgttaagtttcctagtggaaatcttccagaaatctacaacgccttaacaattacagctaaaaatgaagctggacaagatgtatccgtgacctgtgaagtacaacaacttctaggggataaccaagtccgagctgtggccatgagtgctacagatggcctagtgcgtggcatggaagtagtagatacccgtgcagcaattagtgtaccagtaggaaatgccacccttggtagaatatttaatgttgtcggtgaaccagtagatgaattaggtccagttggtactgaagacaaatctcctattcaccgtgaagctcctaaactagtagatctagaaactcagccttcggtatttgaaacaggtattaaagttgtagacctacttgccccttatcgtcgtggtggaaaaattgggctatttggtggtgctggtgtaggtaaaaccgttatcatcatggaattaattaacaacatcgctaaagctcacggtggagtatccgtttttggtggtgtgggagagcggactcgtgaaggtaatgacctttacaatgagatgattgagtccaaagtaattaacccagaaaaccttagtgaatctaaagtggctctggtttatggtcagatgaatgaaccaccaggagctaggatgcgtgttggtctttcagctttgacaatggcagaatatttccgggatgttagtaagcaagacgtactactatttattgataatatcttcagatttgtacaagccggttctgaagtatctgctcttttaggaagaatgccttctgcggtgggatatcaacctacccttggtacagagatgggtgaattgcaagaacgaattacttctacaaaagaaggttctattacttctattcaagctgtgtatgtacctgcggatgacttgacagatcccgcacctgctactacttttgctcatctagatgctacaacagtattatcaaggggtcttgcttctaagggaatctatccagcagttgaccccttagattctacatctactatgttacaaccaagtgtagttggtaaagaacactatgatgttgctcgtgcagtacaatctactctacaaagatacaaagaacttcaagatattatcgctattcttggtttagatgaattatcagaagatgaccgtctggttgtagctcgtgctcgtaaaattgagcgctttttatcacaaccattctttgtagctgaagtatttaccggttctcctggtcaatatgtgaagttagaagatactatgaaaggtttcaaaatgattttatctggtgaacttgacgatttaccagagcaagctttctacatggtaggtggtattgaccaggtaattgccaaagctgaaaaacttaaagcagaagcatag

SEQ ID NO: 6875 - protein, 484 aa, Trichodesmium erythraeum IMS101
MVSTLEKTNVGSITQIIGPVVDVKFPSGNLPEIYNALTITAKNEAGQDVSVTCEVQQLLGDNQVRAVAMSATDGLVRGMEVVDTRAAISVPVGNATLGRIFNVVGEPVDELGPVGTEDKSPIHREAPKLVDLETQPSVFETGIKVVDLLAPYRRGGKIGLFGGAGVGKTVIIMELINNIAKAHGGVSVFGGVGERTREGNDLYNEMIESKVINPENLSESKVALVYGQMNEPPGARMRVGLSALTMAEYFRDVSKQDVLLFIDNIFRFVQAGSEVSALLGRMPSAVGYQPTLGTEMGELQERITSTKEGSITSIQAVYVPADDLTDPAPATTFAHLDATTVLSRGLASKGIYPAVDPLDSTSTMLQPSVVGKEHYDVARAVQSTLQRYKELQDIIAILGLDELSEDDRLVVARARKIERFLSQPFFVAEVFTGSPGQYVKLEDTMKGFKMILSGELDDLPEQAFYMVGGIDQVIAKAEKLKAEA

SEQ ID NO: 6876 - DNA, 1392 bp, Shewanella sp. MR-4
  CDS (1)..(1392): transl_table=11
atgagcacaggtactgttgtccaagtgattggcgcggttgtggacgtagagtttccacaagatgccgtacctcaggtatatgacgctctgaagatcgtaggtgaaggctcctgtaatggtttggtgctggaagttcagcaacaactaggtggtggtgtagttcgtaccatcgctatgggtacttctgatggtctgcgtcgtggtcttgaggtagtaaactcaggttcacctatttctgttcctgttggtaccgccactcttggccgtatcatgaacgttttaggcgagcctattgatgaagctggcgcaattggcgaagaagaacgttatgttattcaccgcagcgctccttcatacgaagatcaatcaaacacgactgaactgttagagactggtatcaaggttatcgaccttgtatgtccattcgctaagggtggtaaagtaggtctgttcggtggtgcgggtgttggtaagacagttaacatgatggaactgatcaacaacatcgctaaagctcactcaggtctttctgtattcgccggtgtaggtgagcgtactcgtgagggtaacgacttctactacgagatgaaggattctggcgttctcgacaaagtagccatggtatatggtcaaatgaacgagccaccaggaaaccgtctgcgtgtagcactgaccggtctgactatggctgaaaaattccgtgacgaaggtcgtgacgttctgttgttcgttgacaacatctaccgttacaccctagccggtactgaagtatcagcactgttaggtcgtatgccttctgcggtaggttaccaaccaactctggctgaagaaatgggcgttctgcaagagcgtattacttcaactaagactggttctattacctctgtacaagcggtatacgtacctgcggacgacttgactgacccgtcaccagcaacaaccttcgctcacttagatgcgactgttgtattgtcacgtcaaatcgcttctctgggtatttacccagcggttgacccactggattctacttctcgtcaattagatccattagtggttggtcaagagcactatgacgtagctaacggtgtacaaactgttctgcaacgctacaaagagctgaaagacatcattgcgattctcggtatggacgaactgtcagacgacgataagatgaccgtttcccgtgcacgtaagattgagcgtttcttgtctcagcctttccacgtagcagaagtctttactggttctcctggtaagtacgtttctctgaaagacactatccgtggcttcaagggaattctgagtggtgagttcgatcacattccagaacaagcgttctacatggttggttctatcgacgaagctgtcgagaaagctaacaaaaagaaataa

SEQ ID NO: 6877 - protein, 463 aa, Shewanella sp. MR-4
MSTGTVVQVIGAVVDVEFPQDAVPQVYDALKIVGEGSCNGLVLEVQQQLGGGVVRTIAMGTSDGLRRGLEVVNSGSPISVPVGTATLGRIMNVLGEPIDEAGAIGEEERYVIHRSAPSYEDQSNTTELLETGIKVIDLVCPFAKGGKVGLFGGAGVGKTVNMMELINNIAKAHSGLSVFAGVGERTREGNDFYYEMKDSGVLDKVAMVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVANGVQTVLQRYKELKDIIAILGMDELSDDDKMTVSRARKIERFLSQPFHVAEVFTGSPGKYVSLKDTIRGFKGILSGEFDHIPEQAFYMVGSIDEAVEKANKKK

SEQ ID NO: 6878 - DNA, 1392 bp, Shewanella sp. MR-7
  CDS (1)..(1392): transl_table=11
atgagcacaggtactgttgtccaagtgattggcgcggttgtggacgtagagtttccacaagatgccgtacctcaggtatatgacgctctgaagatcacaggtgaaggctcctgtaatggtttggtgctggaagttcagcaacaactaggtggtggtgtagttcgtaccatcgctatgggtacttctgatggtctgcgtcgtggtcttgaggtagtaaactcaggttcacctatttctgttcctgttggtaccgccactcttggccgtatcatgaacgttttaggcgagcctattgatgaagctggcgcaattggcgaagaagaacgttatgttattcaccgcagcgctccttcatacgaagatcaatcaaacacgactgaactgttagagactggtatcaaggttatcgaccttgtatgtccattcgctaagggtggtaaagtaggtctgttcggtggtgcgggtgttggtaagacagttaacatgatggaactgatcaacaacatcgctaaagctcactcaggtctttctgtattcgccggtgtaggtgagcgtactcgtgagggtaacgacttctactacgagatgaaggattctggcgttctcgacaaagtagccatggtatatggtcaaatgaacgagccaccaggaaaccgtctgcgtgtagcactgaccggtctgactatggctgaaaaattccgtgacgaaggtcgtgacgttctgttgttcgttgacaacatctaccgttacaccctagccggtactgaagtatcagcactgttaggtcgtatgccttctgcggtaggttaccaaccaactctggctgaagaaatgggcgttctgcaagagcgtattacttcaactaagactggttctattacctctgtacaagcggtatacgtacctgcggacgacttgactgacccgtcaccagcaacaaccttcgctcacttagatgcgactgttgtattgtcacgtcaaatcgcttctctgggtatttacccagcggttgacccactggattctacttctcgtcaattagatccattagtggttggtcaagagcactatgacgtagctaacggtgtacaaactgttctgcaacgctacaaagagctgaaagacatcattgcgattctcggtatggacgaactgtcagacgacgataagatgaccgtttcccgtgcacgtaagattgagcgtttcttgtctcagcctttccacgtagcagaagtctttactggttctcctggtaagtacgtttctctgaaagacactatccgtggcttcaagggaattctgagtggtgagttcgatcacattccagaacaagcgttctacatggttggttctatcgacgaagctgtcgagaaagctaacaaaaagaaataa

SEQ ID NO: 6879 - protein, 463 aa, Shewanella sp. MR-7
MSTGTVVQVIGAVVDVEFPQDAVPQVYDALKITGEGSCNGLVLEVQQQLGGGVVRTIAMGTSDGLRRGLEVVNSGSPISVPVGTATLGRIMNVLGEPIDEAGAIGEEERYVIHRSAPSYEDQSNTTELLETGIKVIDLVCPFAKGGKVGLFGGAGVGKTVNMMELINNIAKAHSGLSVFAGVGERTREGNDFYYEMKDSGVLDKVAMVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVANGVQTVLQRYKELKDIIAILGMDELSDDDKMTVSRARKIERFLSQPFHVAEVFTGSPGKYVSLKDTIRGFKGILSGEFDHIPEQAFYMVGSIDEAVEKANKKK

SEQ ID NO: 6880 - DNA, 1377 bp, Alkalilimnicola ehrlichei MLHE-1
  CDS (1)..(1377): transl_table=11
atgagctctggaaagattgttcaagtcatcggtgctgtggtggacgtggagttcccgcaggatcaggtgcccaagatctatgacgcgcttatcgtggacgagcgtggcctgaccctggaagtccagcagcagctgggcgacggggtggtgcgcaccatcgccatgggttccagtgacggcctgaagcgctccgaaaaggtcagcgccactggcaagccgatctccgtaccggtgggtaagggcaccctcggccggatcatggacgtcctgggcgagcccgtggatgagaagggcgcggtcgagaccgaggagcgctggggcattcatcggtcggcaccgagctttgccgagcaggccgggggcgccgagctgctcgagaccggtatcaaggtgatcgacctactctgccccttcgccaagggcggcaaggtcggcctcttcggcggcgccggcgtgggcaagaccgtcaacatgatggagctcatccgtaacatcgccaccgagcacgccggttactcggtgttcgccggggtgggggagcgtacccgtgagggcaacgacttctaccacgagatgaaagactccaacgtgctcgacaaggtcgccctggtctacggccagatgaacgagccgccgggcaaccgcctgcgtgtcgcgctgaccggcctgaccatggccgagtacttccgcgacgaggggcgtgacatcctgatgtttatcgacaacatctaccgttacaccctggcgggcaccgaggtgtcggcgctgctgggccgcatgccctccgcggtgggctatcagccgaccctggccgaggaaatgggtaagctccaggagcgcattacctccaccaagaccggatcgatcacctcggtgcaggcggtttacgtgccggcggatgacctcactgacccgtcgccggccaccaccttcgcccacctggacgccaccgtcgtgctggcccgcggtatcgccgagctgggcatctacccggccgtggatccgctcgactccacctcccgccagctcgatccgctggtggtcggcgaggagcactacaacgtggcgcgcggtgtccagggggtgcttcagcgctacaaggagctgcgcgacatcatcgcgatcctgggtatggacgagctgtcggaagacgacaaactgaccgtggcccgggcccgtaagatccagcggttcctgtcgcagcccttcttcgtggccgaggtcttcaccggtgccccgggcaagtacgtgcccctgaaggacaccatcgcctccttcaaggccatcctggacggcgagtacgaccacctgccggagcaggccttctacatggtcggcaccgtggacgaggcggccgagaaggcgaagaacctgtaa

SEQ ID NO: 6881 - protein, 458 aa, Alkalilimnicola ehrlichei MLHE-1
MSSGKIVQVIGAVVDVEFPQDQVPKIYDALIVDERGLTLEVQQQLGDGVVRTIAMGSSDGLKRSEKVSATGKPISVPVGKGTLGRIMDVLGEPVDEKGAVETEERWGIHRSAPSFAEQAGGAELLETGIKVIDLLCPFAKGGKVGLFGGAGVGKTVNMMELIRNIATEHAGYSVFAGVGERTREGNDFYHEMKDSNVLDKVALVYGQMNEPPGNRLRVALTGLTMAEYFRDEGRDILMFIDNIYRYTLAGTEVSALLGRMPSAVGYQPTLAEEMGKLQERITSTKTGSITSVQAVYVPADDLTDPSPATTFAHLDATVVLARGIAELGIYPAVDPLDSTSRQLDPLVVGEEHYNVARGVQGVLQRYKELRDIIAILGMDELSEDDKLTVARARKIQRFLSQPFFVAEVFTGAPGKYVPLKDTIASFKAILDGEYDHLPEQAFYMVGTVDEAAEKAKNL

SEQ ID NO: 6882 - DNA, 1428 bp, Hyphomonas neptunium ATCC 15444
  CDS (1)..(1428): transl_table=11
atgagcacccccgcaaacggcaaaggccgcatttcccaggttatcggcgccgttgtcgacgttgagttcgacggcgagctgccatcgatcctcaacgccctcgagaccttcaacaacggctcgcgccttgttctcgaagtcgcccagcacctcggcgagaatactgtccgcacgatcgccatggactcgaccgaaggtctggttcgcgggcagcccgtgtcggacatcggtacgccgatcacggttccagttggcccggccactcttggccgcatcatgaacgtcatcggcgagccgattgacgagcgcggcccggtcaatgccgacacctacatgccgatccacgctcaggcgcctgccttcgttgatcaggccacggaatccgaagtactcgtcaccggtatcaaggttatcgaccttctctgcccctacgcgaaaggcggcaagatcggcctcttcggcggcgccggcgtgggcaagacggttctgatcatggaactggtgaacaacattgcgaaactgttcggcggctactcggtgtttgccggcgtcggcgagcggacccgtgaaggtaacgacctctatcacgagatgatcgagtcgaacgttatcaacctcgaaggcgaaagccgcatgtcgctggtttatggccagatgaacgagcctccaggcgcccgtgcacgggttgctctgactggtctgacgcaagcggaatacttccgcgatgtggaaggcaaggacgtgctgttcttcgtcgacaacatcttccgcttcacccaggcaggttcggaagtgtccgctctgctcggccgtattccttcggccgtgggttaccagccgacgctggcgactgacatgggcgcgcttcaggagcgcatcacctcgaccaacaaagggtcgatcacgtcggtccaggccgtctacgttcctgcggacgaccttactgaccctgcgcctgccacatcgtttgctcaccttgacgcgacaacggttctcaaccgcgcgatctccgagaagggcatctaccctgctgtggacccgcttgactccacctcgcgtattctcgaccctatggttgtcggcgaagagcactacgaagtggctcgcggcgttcagcagatcctgcagaagtacaaagagcttcaggacatcatcgccatcctcggcatggacgagctttcggaagacgacaaagtcaccgttgcgcgcgctcgtaaagttgagcgtttcctgtcgcagccattcgacgttgcccaggtcttcaccggttcgccaggcgtccaggtgaaactcgaagatacgatcaaaggcttcaaaggcctgatcagcggcgagttcgaccacctgccagagcctgccttctacatggtcggcaacatcgaggaagccaaagccaaagctgcgaagctgatggcggacgctgcctga

SEQ ID NO: 6883 - protein, 475 aa, Hyphomonas neptunium ATCC 15444
MSTPANGKGRISQVIGAVVDVEFDGELPSILNALETFNNGSRLVLEVAQHLGENTVRTIAMDSTEGLVRGQPVSDIGTPITVPVGPATLGRIMNVIGEPIDERGPVNADTYMPIHAQAPAFVDQATESEVLVTGIKVIDLLCPYAKGGKIGLFGGAGVGKTVLIMELVNNIAKLFGGYSVFAGVGERTREGNDLYHEMIESNVINLEGESRMSLVYGQMNEPPGARARVALTGLTQAEYFRDVEGKDVLFFVDNIFRFTQAGSEVSALLGRIPSAVGYQPTLATDMGALQERITSTNKGSITSVQAVYVPADDLTDPAPATSFAHLDATTVLNRAISEKGIYPAVDPLDSTSRILDPMVVGEEHYEVARGVQQILQKYKELQDIIAILGMDELSEDDKVTVARARKVERFLSQPFDVAQVFTGSPGVQVKLEDTIKGFKGLISGEFDHLPEPAFYMVGNIEEAKAKAAKLMADAA

SEQ ID NO: 6884 - DNA, 1410 bp, Pediococcus pentosaceus ATCC 25745
  CDS (1)..(1410): transl_table=11
atgagtactggtaaagttgttcaagttatcggaccagttatcgacgttgaatttccccttgacgaagaattaccaactatcaataacgctttgaagattaaaaaggcggatggtactgtcctagtttctgaagtaacgcttgaattaggtgatggtgttgtaagaaccatcgctatggatggaacagatggactacaacgtggtcttgatgttgaagatactggagattctattaaagtacccgttggtaaagaaacacttggtcgtgttttcaacgtcttgggtgacactatcgatggcggcaaagaacttggccccgatataaaacgcgatccaatccatcgtgatccaccagattatgatgaattgaatccaagtacagaagttcttgaaacaggtatcaaggttattgacttacttgccccatatattcgtggtggtaagattggtcttttcggaggtgccggggttggtaaaaccgttttgattcaagaattaattcataatattgcacaagaacataatggtatctcagtttttactggtgttggtgaaagaacacgtgaaggtaatgacttatacttcgaaatgaagggatccggagttcttgaacgtacggccatggtatatggtcaaatgaacgagccgcctggggctcgtatgcgagttgctcttactggtttgacgattgcggaacatttccgtgatgttgaagggcaagatgtgttgttatttattgataacattttccgtttcacgcaagctggttcagaagtttcggccttacttggtcgtattccttcagccgttggttaccaaccaacacttgctacagaaatgggacaacttcaagaacgtattacatcaacaaagaagggttcagtaacatcaatccaagcagtttatgttcctgctgatgattatactgatcctgctcctgctacaacatttgctcatttggatgcaactactaacttggaacgtgcattgactcaacaaggtatttaccctgctgtggatcctcttgcatctacttcaactgcgcttgacccacaaattgttggtgaagaacattatgaagtagctacagaggtacaacatgttctccaacgttataaggaattgcaagatatcatctctatccttggtatggatgaattatctgatgaagaaaagaccgtcgttgctcgtgcacgtcgtatccaactcttcttatctcaagacttcagtgttgctgctcaatttactggccttccaggtcactatgtaaagattgaagacacaatttctggattcaagggtatccttgatggtaagtatgatgatcttcctgaagaagcattccgtttggttggatcaattgatgatgtagttgaaaaggctaaaaaaataagtgctacagaagattag

SEQ ID NO: 6885 - protein, 469 aa, Pediococcus pentosaceus ATCC 25745
MSTGKVVQVIGPVIDVEFPLDEELPTINNALKIKKADGTVLVSEVTLELGDGVVRTIAMDGTDGLQRGLDVEDTGDSIKVPVGKETLGRVFNVLGDTIDGGKELGPDIKRDPIHRDPPDYDELNPSTEVLETGIKVIDLLAPYIRGGKIGLFGGAGVGKTVLIQELIHNIAQEHNGISVFTGVGERTREGNDLYFEMKGSGVLERTAMVYGQMNEPPGARMRVALTGLTIAEHFRDVEGQDVLLFIDNIFRFTQAGSEVSALLGRIPSAVGYQPTLATEMGQLQERITSTKKGSVTSIQAVYVPADDYTDPAPATTFAHLDATTNLERALTQQGIYPAVDPLASTSTALDPQIVGEEHYEVATEVQHVLQRYKELQDIISILGMDELSDEEKTVVARARRIQLFLSQDFSVAAQFTGLPGHYVKIEDTISGFKGILDGKYDDLPEEAFRLVGSIDDVVEKAKKISATED

SEQ ID NO: 6886 - DNA, 1449 bp, Solibacter usitatus Ellin6076
  CDS (1)..(1449): transl_table=11
atggtaacgaccaacgtggtaaccggcaaagtagtcgtggtgtccggtccggccgtggattgcgaatttcccgagggacagattcccccggtgcatacggcgatccggatcatcagcgagggtttcgacattccgacgccgatcgatatcatctgcgaagtgcagcagcacatcggtgaagggcgcgtgcgtaccatcgcgctgcagcccaccgaagggctggttcgcggcatgcaggcaatcagcctgggccacccggtggaagtgccggtgggtccggaaacgttgggccgcgtgctcaacgttatcggcgagccggtggacgagatggggccggtcaacgccaagaagcattatccgattcaccgtccggcgccctcctttgaagaccagtcaacgcgcctcgaaatgttcgagaccggcatcaaggtcatcgatctgatcgagccttacttgcgcggcggcaaaatcggtctgttcggcggcgcgggcgtcggcaagaccgtcatcattcaggagctgatcaacaacctcgccatgaagcacggcggcgtctcggtgttcgccggcgtgggcgagcgcaccagggaaggcaacgatctctggctggaattccaggaatcgggcgttatcgacccgcacgattacaccaaatccaagtgcgccctgatctacgggcagatgaccgagccgcccggagcgcgtctgcgcgtcggcctcaccgggttgacggtcgccgagtacttccgcgatgaagaacaccaggacgtactgctcttcatcgacaatattttccgcttcacgcaggccggttcggaagtctccgcgctgctcggacgtatgcccagcgcggtcgggtaccagcccaacctggctaccgagatgggcgaattgcaggagcgcatcacctccaccaagaacggttccatcacctccgtgcaggccatctacgtgccggccgacgactacaccgaccccgctcccgcaacggccttcgcgcacctggacgccaccacgaatctctcgcgcgacatcgccgcgctgggcatttatccggcggtcgatccgctggcatccacctcgcgcattctggatccgcacatcgtcggcgaagatcactatgcaaccgcgcagatggtgaagggaacactgcagcgctacaaagacctgcaggacatcatcgccattctcggtatcgacgaactgtcggacgaagacaaactaactgtggcccgcgcgcgcaaggtgcagaaattcctttcgcagcccttccacgtggccgagcagttcaccggcttcaagggcaagtatgtgaagctggccgatagcatcaagggtttccgcgagatcgtggaaggcaagcacgatggcgtccccgaacaggcgttctacatgcaggggaccatcgaggacgtgctcgaaaaagcggaagccatgaagaaggcgtag

SEQ ID NO: 6887 - protein, 482 aa, Solibacter usitatus Ellin6076
MVTTNVVTGKVVVVSGPAVDCEFPEGQIPPVHTAIRIISEGFDIPTPIDIICEVQQHIGEGRVRTIALQPTEGLVRGMQAISLGHPVEVPVGPETLGRVLNVIGEPVDEMGPVNAKKHYPIHRPAPSFEDQSTRLEMFETGIKVIDLIEPYLRGGKIGLFGGAGVGKTVIIQELINNLAMKHGGVSVFAGVGERTREGNDLWLEFQESGVIDPHDYTKSKCALIYGQMTEPPGARLRVGLTGLTVAEYFRDEEHQDVLLFIDNIFRFTQAGSEVSALLGRMPSAVGYQPNLATEMGELQERITSTKNGSITSVQAIYVPADDYTDPAPATAFAHLDATTNLSRDIAALGIYPAVDPLASTSRILDPHIVGEDHYATAQMVKGTLQRYKDLQDIIAILGIDELSDEDKLTVARARKVQKFLSQPFHVAEQFTGFKGKYVKLADSIKGFREIVEGKHDGVPEQAFYMQGTIEDVLEKAEAMKKA

SEQ ID NO: 6888 - DNA, 1425 bp, Magnetococcus sp. MC-1
  CDS (1)..(1425): transl_table=11
atgagcgtagcacgcactggaaaagtggtacaggtagtcggaccggttgtggacgtccgcttcgagggcgaattgcccaacatcctcaatgcgttacacatggtgcgcaatggtgagcgtctggttttggaagtcgccacgcacatgggtgagggcaccgtgcgtgccatcgccatggacagcaccgacggtgtcgtccgcggcatggaagtaaccgacactggggacactatccgcgtgcctgtgggtcgtcaaaccctgggccgtattcttaacgtggtgggtgagcctcaagatgaaaaaggcccagtcgaaaccaccgagaccctgccgattcaccgtcctgctccggcctttgcccagcaagccaccagcgcagagatattggaaaccggcatcaaggtgatcgacttgctggccccctatgctaagggtggtaaagtgggtctgttcggcggtgcgggtgtgggtaagacggtgttgatcatggagctgatcaacaacgtagcccaggaacatggtggttattcggtgtttgccggtgtgggtgagcgtacccgcgaaggtaacgacctttaccacgagatggccgagtctggtgttattgatcccaatagctgggagaactctaaggccgctctgatctatggtcagatgaacgaaccccctggggcccgtgctcgggtggcgttgaccggtctgacggtggctgaatatttccgtgatttggggggccaggatgtgctcttcttcgtggataacatcttccgcttcacccaggctggtgctgaagtgtcggcgctgttgggtcgtatcccttctgcggtgggttatcagcctaccctaggtaccgacatgggtgctttgcaagagcgtatcaccaccaccaaaaccggttccatcacctctgtgcaagccgtctatgtgccggccgatgacttgaccgaccctgctccagccaccaccttctcccacttggatgccaccacggtgctaaaccgtgccatctctgagatgggtatctatcctgctgtggatcctctggactccacctcgcgggtgttggatcctaaggttgtgggtgaagagcattaccatacagcccgtgaagttcagcgcattctgcaaacctataaatccttgcaggatatcatcgccattctcggtatggatgagctttccgaagaagataagctggtggtgaaccgcgcgcgtaaaattcagcgtttcctctcccagcctttccatgtggctgaagtgtttaccggtaccaagggtgtctatgtacccgttaaaaagacggtacagggctttaaagagctgtgtgaaggcaagtatgacaatgtgccagaagcagccttctacatggtaagcgacattgatgctgctttggcaaaagctgagaagctgaaagcggcgagctaa

SEQ ID NO: 6889 - protein, 474 aa, Magnetococcus sp. MC-1
MSVARTGKVVQVVGPVVDVRFEGELPNILNALHMVRNGERLVLEVATHMGEGTVRAIAMDSTDGVVRGMEVTDTGDTIRVPVGRQTLGRILNVVGEPQDEKGPVETTETLPIHRPAPAFAQQATSAEILETGIKVIDLLAPYAKGGKVGLFGGAGVGKTVLIMELINNVAQEHGGYSVFAGVGERTREGNDLYHEMAESGVIDPNSWENSKAALIYGQMNEPPGARARVALTGLTVAEYFRDLGGQDVLFFVDNIFRFTQAGAEVSALLGRIPSAVGYQPTLGTDMGALQERITTTKTGSITSVQAVYVPADDLTDPAPATTFSHLDATTVLNRAISEMGIYPAVDPLDSTSRVLDPKVVGEEHYHTAREVQRILQTYKSLQDIIAILGMDELSEEDKLVVNRARKIQRFLSQPFHVAEVFTGTKGVYVPVKKTVQGFKELCEGKYDNVPEAAFYMVSDIDAALAKAEKLKAAS

SEQ ID NO: 6890 - DNA, 1392 bp, Shewanella sp. ANA-3
  CDS (1)..(1392): transl_table=11
atgagcacaggtactgttgtccaagtgattggcgcggttgtggacgtagagtttccacaagatgccgtacctcaggtatatgacgctctgaagatcacaggtgaaggctcctgtaatggtttggtgctggaagttcagcaacaactaggtggtggtgtagttcgtaccatcgctatgggtacttctgatggtctgcgtcgtggtcttgaggtagtaaactcaggttcacctatttctgttcctgttggtactgccactcttggccgtatcatgaacgtattaggcgaccctattgatgaagctggcgcaattggcgaagaagaacgttatgtgattcaccgcagcgctccttcatacgaagagcaatcaaacacgactgaactgttagagactggtatcaaggttatcgaccttgtatgtccattcgctaagggtggtaaagtaggtctgttcggtggtgcgggtgttggtaagacagttaacatgatggaactgattaacaacatcgctaaagctcactcaggtctttctgtattcgccggtgtaggtgagcgtactcgtgagggtaacgacttctactacgagatgaaggattctggcgttctcgacaaagtagccatggtttatggtcaaatgaacgagccaccaggaaaccgtctgcgtgtagcactgaccggtctgactatggctgaaaaattccgtgacgaaggtcgtgacgttctgttgttcgttgacaacatctaccgttacaccctagccggtactgaagtatcagcactgttaggtcgtatgccttctgcagtaggttaccaacccactctggctgaagaaatgggcgttctgcaagagcgtattacttcaactaagactggttctattacctctgtacaagcggtatacgtacctgcggacgacttgactgacccgtcaccagcaacaaccttcgctcacttagatgcgactgttgtattgtcacgtcaaatcgcttctctgggtatttacccagcggttgacccactggattcgacttctcgtcaattagatccattagtggttggtcaagagcactatgacgtagctaacggtgtacaaactgttctgcaacgctacaaagagctgaaagacatcattgcgattctcggtatggacgaactgtcagacgaagataagatgaccgtttcccgtgctcgtaagattgagcgtttcttgtctcagcctttccacgtagcagaagtctttactggttctcctggtaagtacgtatctctgaaagacactatccgtggcttcaagggaattctgagtggcgagttcgaccacattccagaacaagcgttctacatggttggttctatcgacgaagctgtcgagaaagctaacaaaaagaaataa

SEQ ID NO: 6891 - protein, 463 aa, Shewanella sp. ANA-3
MSTGTVVQVIGAVVDVEFPQDAVPQVYDALKITGEGSCNGLVLEVQQQLGGGVVRTIAMGTSDGLRRGLEVVNSGSPISVPVGTATLGRIMNVLGDPIDEAGAIGEEERYVIHRSAPSYEEQSNTTELLETGIKVIDLVCPFAKGGKVGLFGGAGVGKTVNMMELINNIAKAHSGLSVFAGVGERTREGNDFYYEMKDSGVLDKVAMVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVANGVQTVLQRYKELKDIIAILGMDELSDEDKMTVSRARKIERFLSQPFHVAEVFTGSPGKYVSLKDTIRGFKGILSGEFDHIPEQAFYMVGSIDEAVEKANKKK

SEQ ID NO: 6892 - DNA, 1458 bp, Mycobacterium avium 104
  CDS (1)..(1458): transl_table=11
atgcctgctactgaaaccgccgacaagaacacgaagtcggccaacagcgacaccagcggccgggtggtgcgggtcaccggaccggtcgtcgacgtcgagttcccgcggggttcggtgccggccctgttcaacgcactgcacgcggagatcacgttcgaggagctggccaagacgctgacgctcgaggtcgcccagcacctcggggacaacctggtgcgcaccatctcgctgcagcccaccgacggcctggtgcgcggcgtcgaggtgatcgacaccggtcgttccatctcggtgccggtcggccaggaggtcaagggccacgtgttcaacgccctggggcactgcctggacaagccgggttacggagaagacttcgaacactggtcgattcaccgcaagccgccgccgttcgaggagctggagccccgcacggagatgctcgagacgggtctgaaggtcgtcgacctgctcacaccgtacgtgcgtggcggcaagatcgccctgttcggcggcgccggcgtgggcaagacggtgctcatccaggagatgatcaaccgcatcgcccgcaacttcggtggtacctcggtgttcgccggggtgggggagcgcacccgtgagggcaacgacctgtgggtcgagttgcaggaagccaacgtgctcaaggacaccgcgctggtgttcggtcagatggacgagccgcccggcacccgtatgcgggtggcgctgtccgcgttgaccatggcggagtggttccgcgacgaggcgggccaggacgtgctgttgttcatcgacaacatcttccggttcacccaggccggctccgaggtctcgaccctgctcggccggatgccctcggcggtggggtatcagcccacgctggccgacgagatgggcgagctgcaggagcgcatcacctcgacccgtggccggtccatcacgtcgatgcaggcggtctacgtgcccgccgacgactacaccgacccggcgccggcgacgacgttcgcgcacctggacgccaccaccgagctgtcgcgttcggtgttctccaagggcatcttccccgcggtggacccgctggcgtccagctcgaccattctcgacccgggcgtggtcggcgaagagcactaccgggtggcgcaggaagtcatccgaatcctgcagcgctacaaggaccttcaggacatcatcgccatcctcggtatcgacgagctgtccgaggaggacaagcagttggtcaaccgggcgcggcggatcgagcggttcctgtcgcagaacatgatggcggccgagcagttcaccggccagccgggttcgacggtcccgctcaaggagaccatcgaggcattcgaccggctcaccaagggtgagttcgaccacgtgcccgagcaggccttcttcctgatcggtggcctggacgacctggccaagaaggcagagagccttggcgccaagctgtaa

SEQ ID NO: 6893 - protein, 485 aa, Mycobacterium avium 104
MPATETADKNTKSANSDTSGRVVRVTGPVVDVEFPRGSVPALFNALHAEITFEELAKTLTLEVAQHLGDNLVRTISLQPTDGLVRGVEVIDTGRSISVPVGQEVKGHVFNALGHCLDKPGYGEDFEHWSIHRKPPPFEELEPRTEMLETGLKVVDLLTPYVRGGKIALFGGAGVGKTVLIQEMINRIARNFGGTSVFAGVGERTREGNDLWVELQEANVLKDTALVFGQMDEPPGTRMRVALSALTMAEWFRDEAGQDVLLFIDNIFRFTQAGSEVSTLLGRMPSAVGYQPTLADEMGELQERITSTRGRSITSMQAVYVPADDYTDPAPATTFAHLDATTELSRSVFSKGIFPAVDPLASSSTILDPGVVGEEHYRVAQEVIRILQRYKDLQDIIAILGIDELSEEDKQLVNRARRIERFLSQNMMAAEQFTGQPGSTVPLKETIEAFDRLTKGEFDHVPEQAFFLIGGLDDLAKKAESLGAKL

SEQ ID NO: 6894 - DNA, 1428 bp, Mycobacterium smegmatis str. MC2 155
  CDS (1)..(1428): transl_table=11
atgactgctactgcagaaaagaccgcgggtcgcgtagtccgcatcaccggcccggtggtggacgtcgaattcccgcgtggctctgtgcccgagctgttcaacgcgctgcacgccgagatcacgttcggtgcgctcgccaagaccctgaccctcgaggtcgcccagcacctcggtgacagcctggtgcgctgcatctccatgcagcccaccgacggcctggtgcgtggcgtcgaggtcaccgacaccggcgcctcgatctccgtcccggtcggcgacggcgtcaagggccacgtgttcaacgcgctcggcgactgcctcgacgatccgggctacggcaaggacttcgagcactggtcgatccaccgcaagccgccggccttctctgacctggagccccgcaccgagatgctggagaccggtctgaaggtcgtcgacctgctcaccccgtacgtgcgtggcggcaagatcgccctgttcggcggcgcgggcgtgggcaagacggttctgatccaggagatgatcaaccgtatcgcccgcaacttcggtggtacctcggtgttcgccggcgtgggtgagcgcacccgtgagggcaacgacctgtgggtcgagctcgccgacgccaacgtgctcaaggacaccgcgttggtgttcggtcagatggacgagccgccgggcacccgtatgcgcgtcgccctgtcggccctgaccatggccgagttcttccgcgacgagcagggccaggacgtgctgctgttcatcgacaacatcttccggttcacccaggccggttccgaggtgtcgaccctgctgggtcgtatgccttcggccgtgggttaccagccgacgctggccgacgagatgggtgagctgcaggagcgcatcacctcgacccgtggtcgctccatcacctcgatgcaggccgtgtacgtgcccgccgacgactacaccgacccggccccggcgacgacgttcgcccacctggacgccaccaccgagctctcgcgtgcggtgttctcgaagggcatcttcccggcggtggatccgctggcgtcgtcctcgaccatcctggacccggcgatcgtcggtgacgagcactaccgcgtcgcccaggaagtcatccggatcctgcagcgctacaaggatctccaggacatcatcgcgatcctcggtatcgacgagctgtccgaagaggacaagcagctggtgaaccgggcgcgtcgtatcgagcgcttcctgagccagaacatgatggccgccgagcagttcaccggtcagccgggctcgaccgtgccgctcaaggagaccatcgaggcgttcgacaagctcaccaagggcgagttcgatcacctgcccgagcaggcgttcttcctgatcggtggtctggacgacctggcgaagaaggccgagagcctcggcgccaagctgtga

SEQ ID NO: 6895 - protein, 475 aa, Mycobacterium smegmatis str. MC2 155
MTATAEKTAGRVVRITGPVVDVEFPRGSVPELFNALHAEITFGALAKTLTLEVAQHLGDSLVRCISMQPTDGLVRGVEVTDTGASISVPVGDGVKGHVFNALGDCLDDPGYGKDFEHWSIHRKPPAFSDLEPRTEMLETGLKVVDLLTPYVRGGKIALFGGAGVGKTVLIQEMINRIARNFGGTSVFAGVGERTREGNDLWVELADANVLKDTALVFGQMDEPPGTRMRVALSALTMAEFFRDEQGQDVLLFIDNIFRFTQAGSEVSTLLGRMPSAVGYQPTLADEMGELQERITSTRGRSITSMQAVYVPADDYTDPAPATTFAHLDATTELSRAVFSKGIFPAVDPLASSSTILDPAIVGDEHYRVAQEVIRILQRYKDLQDIIAILGIDELSEEDKQLVNRARRIERFLSQNMMAAEQFTGQPGSTVPLKETIEAFDKLTKGEFDHLPEQAFFLIGGLDDLAKKAESLGAKL

SEQ ID NO: 6896 - DNA, 1455 bp, Nocardioides sp. JS614
  CDS (1)..(1455): transl_table=11
atgactgcaacgatcgaagagacccaggagaccggctccgctggcgtcggtcggatcgcccgggtgatcggcccggtcgtcgacgtcgagttcccggtggactcgatgccggagatctacaacaagctcgagtgcgagctcacgctcgaaggcgaggccaagatcctctcgctcgaggtcgcccagcacatcggtgacggcatggtccgcgcgatctcgctgcagccgaccgacggcctggtccgcggggcgcaggtgacggacacgggcggcccgatcacggtgcccgtcggcgacgcgaccctcggcaaggtgttcaacaccctcggcgaggtgctcaacctcgaggagggcgagaccttcgaggtcaaggagcgctggggcatccaccgcaaggcgcccgcgttcgaccagctggagtcgaagacccagatgttcgagaccggcatcaaggtcatcgacctgctcacgccgtacgtgcagggcggcaagatcggcctgttcggcggtgccggcgtcggcaagaccgtgctgatccaggagatgatcgcccgcgtcgccaaggaccacggtggcgtgtcggtgttcgccggcgtcggcgagcgcacccgtgagggcaacgacctgatcgtcgagatggaggaggccggcgtcatcggccagaccgccctcgtgttcggtcagatggacgagccgccgggcacccgtctgcgggtcgcgctgtccgcgctgacgatggcggagtacttccgcgacgtgcagggccaggacgtgctgctgttcatcgacaacatcttccggttcacccaggcgggttcggaggtgtcgaccctgctgggccggatgccctccgcggtgggctaccagccgaacctcgccgacgagatgggcacgctccaggagcggatcacctcgacgcgtggtcactcgatcacctcgatgcaggcgatctacgtgccggccgacgactacaccgacccggcaccggcgacgacgttcgcccacctggacgcgacgaccgagctctcccgtgagatcgcctcgctcggcatctacccggccgtggacccgctgacctcgacctcgcggatcctcgacccgcagtacatcgggcaggcgcactacgactgcgcgatccggatcaagcagatcctgcagcgcaacaaggagctccaggacatcatcgcgatcctgggtgtggacgagctctccgaagaggacaagatcatcgtgtcccgggctcgccggatccagcggttcctgtcccagaacacctacgtcgccaagcagttcaccggcatcgagggctcgaccgttcccgtgtcggagacgatcgaggggttcaacaagatcgccgacggcgagtacgaccacgtggccgagcaggccttcttcatgtgcggcggtctggacgacgtcgagcagaagtgggccgagatccagaagagcctctga

SEQ ID NO: 6897 - protein, 484 aa, Nocardioides sp. JS614
MTATIEETQETGSAGVGRIARVIGPVVDVEFPVDSMPEIYNKLECELTLEGEAKILSLEVAQHIGDGMVRAISLQPTDGLVRGAQVTDTGGPITVPVGDATLGKVFNTLGEVLNLEEGETFEVKERWGIHRKAPAFDQLESKTQMFETGIKVIDLLTPYVQGGKIGLFGGAGVGKTVLIQEMIARVAKDHGGVSVFAGVGERTREGNDLIVEMEEAGVIGQTALVFGQMDEPPGTRLRVALSALTMAEYFRDVQGQDVLLFIDNIFRFTQAGSEVSTLLGRMPSAVGYQPNLADEMGTLQERITSTRGHSITSMQAIYVPADDYTDPAPATTFAHLDATTELSREIASLGIYPAVDPLTSTSRILDPQYIGQAHYDCAIRIKQILQRNKELQDIIAILGVDELSEEDKIIVSRARRIQRFLSQNTYVAKQFTGIEGSTVPVSETIEGFNKIADGEYDHVAEQAFFMCGGLDDVEQKWAEIQKSL

SEQ ID NO: 6898 - DNA, 1401 bp, Azoarcus sp. BH72
  CDS (1)..(1401): transl_table=11
atgagtaacggtactatcgttcagtgcatcggcgcggtggtggacatccagttcccgcgcgattcgatgcccaaggtgtatgacgccctgaagcttgaggacgccgccgactccttcgccgaagctggcctgaccttcgaggtccagcagcaactcggcgacggcgtggtgcgtacgattgcgctgggttcctccgacggcctgcgccgcggcatgaaggtgtccaacaccggcaagccgatctcggtgcctgtcggccacggcacgctgggccgcatcatggacgtgctcggccgcccgatcgacgaagcgggtccggttgaaaccgacgagctgcgcgcgatccaccagaaggcgccgaagttcgacgagctgtccccgtccgtggaactgctcgaaaccggcatcaaggttattgacctgatctgcccgttcgcgaagggcggcaaggtgggcctgttcggcggcgccggtgtgggcaagaccgtgaacatgatggagctgatcaacaacatcgccaagcagcactcgggcttgtcggtgttcgctggcgtgggcgagcgtacccgtgagggcaacgacttctaccacgaaatgaaggactccaacgttctcgacaaggtcgcgatggtgttcggtcagatgaacgaacccccgggcaaccgtctgcgcgtcgcgctgaccggtctgaccatggcggagcgtttccgcgacgaaggccgcgacatcctgttcttcgtggataacatctaccgctacaccctggccggtaccgaagtgtccgcgctgctgggtcgtatgccttccgcggtgggttaccagccgacgctggccgaagaaatgggccgtctgcaggaacgcatcacctcgaccaaggtgggctcgatcacctcgatccaggccgtgtatgtgccggcggatgacttgaccgacccgtcgcctgccaccaccttcctgcacctcgactccaccgtcgtgctgtcgcgtgacatcgctgcgctgggtatctaccccgccgtcgatccgctcgactccaccagccgccagctcgatccgctggtcgtcggtgaagagcactactcggtcgctcgcgccgtgcagcagaccctgcagaagtacaaggaactgcgtgacatcatcgcgattctgggtatggacgaactgtcgccggacgacaagctcgccgtggcccgtgcgcgtaagatccagcgcttcctgtcgcagcccttccacgttgccgaagtgttcaccggttcgccgggcaagtacgtttcgctgaaggacaccatcgccggcttcaaggcgatcgtgaacggcgaatacgaccacctgccggaacaggccttctacatggtcggcggcatcgaggaagtgctcgagaaggcgaagaagctgcagtaa

SEQ ID NO: 6899 - protein, 466 aa, Azoarcus sp. BH72
MSNGTIVQCIGAVVDIQFPRDSMPKVYDALKLEDAADSFAEAGLTFEVQQQLGDGVVRTIALGSSDGLRRGMKVSNTGKPISVPVGHGTLGRIMDVLGRPIDEAGPVETDELRAIHQKAPKFDELSPSVELLETGIKVIDLICPFAKGGKVGLFGGAGVGKTVNMMELINNIAKQHSGLSVFAGVGERTREGNDFYHEMKDSNVLDKVAMVFGQMNEPPGNRLRVALTGLTMAERFRDEGRDILFFVDNIYRYTLAGTEVSALLGRMPSAVGYQPTLAEEMGRLQERITSTKVGSITSIQAVYVPADDLTDPSPATTFLHLDSTVVLSRDIAALGIYPAVDPLDSTSRQLDPLVVGEEHYSVARAVQQTLQKYKELRDIIAILGMDELSPDDKLAVARARKIQRFLSQPFHVAEVFTGSPGKYVSLKDTIAGFKAIVNGEYDHLPEQAFYMVGGIEEVLEKAKKLQ

SEQ ID NO: 6900 - DNA, 1530 bp, Mycobacterium sp. KMS
  CDS (1)..(1530): transl_table=11
atgactgctgccaccgaacaaaaagagaagaccggcaccgacaacgtcggccgcgtcgtgcgggtcaccgggcctgtcgtcgacgtcgagttcccgcgcgggtccgtgccggagctgttcaacgcactgcacgcggagatctcctacaaggacctcgccaagacgctgaccctcgaggtcgcccagcacctcggcgacagcctggtgcgctgcatctcgatgcagccgaccgacggcctggttcgcggcgtcgacgtcaccgacaccggcgcctcgatctcggtgcccgtcggcgagggcgtcaagggccacgtgttcaacgccctgggtgcctgcctcgacgaccccggctacggcaaggacttcgagaagtggtccatccaccgcaagccgccggccttcgacgagctcgagccgcgtaccgagatgctcgagaccggcctcaaggtcgtcgacctgctcaccccctacgtccgcggcggcaagatcgccctgttcggtggcgccggtgtgggcaagaccgtgctcatccaggagatgatcaaccgcatcgcccgcaacttcggcggcacctcggtgttcgccggtgtgggtgagcgcacccgtgagggcaacgacctgtgggtcgagctcgccgacgcgaacgtgctcaaggacaccgccctggtgttcggccagatggacgagccgcccggcacgcgtatgcgcgtcgccctgtcggcgctgaccatggcggagtacttccgcgacgagaagcagcaggacgtgctgctgttcatcgacaacatcttccggttcacccaggccggttcggaggtctccacgctgctcggccgtatgccgtcggcggtgggctaccagccgaccctggccgacgagatgggtgagctccaggaacgcatcacctcgacgcgtggtcgctccatcacctcgatgcaggccgtgtacgtgcccgccgacgactacaccgacccggccccggccaccacgttcgcgcacctcgacgcgacgacggagctgagccgttcggtgttctccaagggcatcttcccggcggtggacccgctggcctccagctcgaccatcctcgacccgtcggtcgtcggtgacgagcactaccgtgtcgcccaggaagtcatccggatcctgcagcgctacaaggaccttcaggacatcatcgccatcctcggtatcgacgaactcgccgaggaggacaagcagctcgtccagcgcgcgcgtcgtatcgagcgcttcctgagccagaacatgatggcggccgagcagttcaccggtcagcccggctcgacggtgccgctcaaggagaccatcgaggcgttcgacaagctcagcaagggcgatttcgaccacctgcccgagcaggcgttcttcctcatcggtggcctcgaggatctgcagcgcaaggccgagagcctcggcgccaagatggaggacacctccggcgacggcgccccggcccagagcgattccaagagcgactccaagggtgacgacgcagacaaggacgcctga

SEQ ID NO: 6901 - protein, 509 aa, Mycobacterium sp. KMS
MTAATEQKEKTGTDNVGRVVRVTGPVVDVEFPRGSVPELFNALHAEISYKDLAKTLTLEVAQHLGDSLVRCISMQPTDGLVRGVDVTDTGASISVPVGEGVKGHVFNALGACLDDPGYGKDFEKWSIHRKPPAFDELEPRTEMLETGLKVVDLLTPYVRGGKIALFGGAGVGKTVLIQEMINRIARNFGGTSVFAGVGERTREGNDLWVELADANVLKDTALVFGQMDEPPGTRMRVALSALTMAEYFRDEKQQDVLLFIDNIFRFTQAGSEVSTLLGRMPSAVGYQPTLADEMGELQERITSTRGRSITSMQAVYVPADDYTDPAPATTFAHLDATTELSRSVFSKGIFPAVDPLASSSTILDPSVVGDEHYRVAQEVIRILQRYKDLQDIIAILGIDELAEEDKQLVQRARRIERFLSQNMMAAEQFTGQPGSTVPLKETIEAFDKLSKGDFDHLPEQAFFLIGGLEDLQRKAESLGAKMEDTSGDGAPAQSDSKSDSKGDDADKDA

SEQ ID NO: 6902 - DNA, 1407 bp, Acidovorax sp. JS42
  CDS (1)..(1407): transl_table=11
atggctcaagtgcaaggcaagattgttcaatgtatcggcgccgtggtggacgtggagttcccgcgcgaccggatgcccaaggtgtatgacgccctgaagctcgagggctcgcccctgacgctggaagtgcagcagcagctgggcgacggcgtggtgcgtaccattgcgctcggttcttcggacggcctcaagcgtggcctgatggtcacgaacaccggcaaccccatcaccgtccccgtgggcaaggccacgctgggccgcatcatggacgtgctgggcaaccccatcgacgagcgcggccccgtggaccagagcctgacggcttccatccaccgcaaggcccccgcttatgacgagctcagcccttcgcaggaactgctcgagaccggcatcaaggtgatcgacctggtgtgcccgttcgccaagggcggcaaggtgggtctgttcggtggcgccggcgtgggcaagaccgtgaacatgatggaactcatcaacaacatcgccaaggcacactcgggtctgtccgtgttcgccggcgtgggtgagcgtacccgcgagggcaacgacttctatcacgaaatggccgactccggcgtcgtgaacctggagaacctgggcgaatccaaggtggccatggtctacggccagatgaacgagcccccgggcaaccgtctgcgcgtggccctgaccggcctgaccatcgccgagtccttccgcgacgaaggccgtgacgtgctgttcttcgtggacaacatctaccgctacacgctggccggtaccgaagtgtccgccctgctgggccgtatgccttccgccgtgggctaccagccgacgctggccgaggaaatgggccgtctgcaagagcgtattacctcgaccaaggtcgggtccatcacgtccattcaggccgtgtacgtgcctgccgacgacttgaccgacccctcgcccgccaccaccttcgcccacctggactccaccgtggtgctgtcgcgtgacatcgccgctctgggtatctaccctgccgtggacccgctggactccaccagccgccagttggacccgcaggtcgtgggtgaagagcactaccaagtggcccgccaagtgcagggtaccctgcagcgctacaaggaactgcgcgacatcatcgcaattctgggtatggacgagctggcccccgaggacaagctggtcgtggcccgtgcccgcaagatccagcgtttcctgtcgcagccgttccacgtggccgaggtgttcacgggctcgcctggcaagtacgtgccgctgtccgagaccatccgcggcttcaagatgatcgtggctggcgaatgcgaccacctgcccgagcaggccttctacatggtgggcaccatcgacgaagccttcgaaaaggcgaagaaggtggcctga

SEQ ID NO: 6903 - protein, 468 aa, Acidovorax sp. JS42
MAQVQGKIVQCIGAVVDVEFPRDRMPKVYDALKLEGSPLTLEVQQQLGDGVVRTIALGSSDGLKRGLMVTNTGNPITVPVGKATLGRIMDVLGNPIDERGPVDQSLTASIHRKAPAYDELSPSQELLETGIKVIDLVCPFAKGGKVGLFGGAGVGKTVNMMELINNIAKAHSGLSVFAGVGERTREGNDFYHEMADSGVVNLENLGESKVAMVYGQMNEPPGNRLRVALTGLTIAESFRDEGRDVLFFVDNIYRYTLAGTEVSALLGRMPSAVGYQPTLAEEMGRLQERITSTKVGSITSIQAVYVPADDLTDPSPATTFAHLDSTVVLSRDIAALGIYPAVDPLDSTSRQLDPQVVGEEHYQVARQVQGTLQRYKELRDIIAILGMDELAPEDKLVVARARKIQRFLSQPFHVAEVFTGSPGKYVPLSETIRGFKMIVAGECDHLPEQAFYMVGTIDEAFEKAKKVA

SEQ ID NO: 6904 - DNA, 1425 bp, Magnetospirillum magnetotacticum MS-1
  CDS (1)..(1425): transl_table=11
atggcaaacaagaacgtcggcacgattacccaggtcctgggcgccgtcgtggacgtgcgcttcgacggccagctgccggccatcctcagcgcgcttcacctggaacatcagggtaagaagctggttctcgaagtcgctcagcatctgggcgagtccaccgtgcgtaccatcgccatggactccacggacggcctgacgcggggcaccgaagtggtggacaccggcgccgccatccagatgcccgtcggccccgagaccctgggccgtatcatcaacgtgatcggcgagcccatcgacgagcgcggccccatcggcaacaagaccaccctgccgatccatgcggacgccccggacttcgtggaccagtccaccgagaccgagatcctggtcaccggcatcaaggtcatcgacctgctggctccctactgcaagggcggcaagatcggcctgttcggcggcgccggcgtgggcaagaccgtgctgatcatggagctgatcaacaacatcgccaaggcgcacggtggttactccgtgttcgccggtgtgggcgagcgtacccgcgaaggcaacgacctctatcacgaaatgatcgagtcgggcgttatcaagctggacggcccgggctccaaggtggccctggtctatggccagatgaacgagcccccgggcgcccgtgcccgcgtcgccctgtcgggtctgaccgtcgccgagtatttccgcgacgtggaaggccaggacgtgctgttcttcgtggacaacatcttccgcttcacccaggccggttccgaagtgtccgctctgctgggccgcatcccgtcggcggtgggctatcagcccactctcgccaccgacatgggcgctctgcaggaacgcatcacctcgaccaagaagggctcgatcacctcggtgcaggccatttacgtgcccgccgacgatctcaccgacccggctccggccacgtccttcgcccacttggacgccaccaccgtgctgaatcgtcagatcgccgagctgggcatctacccggccgtggatccgctcgactccacgtcgcgcgttctggacccccgcgtggtcggcaacgaccactaccagaccgcccgcgacgtgcagcgcatcctgcagacctacaagtcgctgcaggacatcatcgccattctgggcatggatgagctgtcggaagaggacaagctggtggtgacccgcgctcgtaagatccagcgcttcctgtcccagcccttccatgtggccgaaatcttcaccggctcgccgggcaagctggtggccatcgaagacaccatcaagggcttcaaggccatcgtggctggcgaatacgatcatctgcccgaggctgccttctacatggtcggcggcatcgacgaagtgatcgagaaggccaagaagatggccgccgaagcggcctaa

SEQ ID NO: 6905 - protein, 474 aa, Magnetospirillum magnetotacticum MS-1
MANKNVGTITQVLGAVVDVRFDGQLPAILSALHLEHQGKKLVLEVAQHLGESTVRTIAMDSTDGLTRGTEVVDTGAAIQMPVGPETLGRIINVIGEPIDERGPIGNKTTLPIHADAPDFVDQSTETEILVTGIKVIDLLAPYCKGGKIGLFGGAGVGKTVLIMELINNIAKAHGGYSVFAGVGERTREGNDLYHEMIESGVIKLDGPGSKVALVYGQMNEPPGARARVALSGLTVAEYFRDVEGQDVLFFVDNIFRFTQAGSEVSALLGRIPSAVGYQPTLATDMGALQERITSTKKGSITSVQAIYVPADDLTDPAPATSFAHLDATTVLNRQIAELGIYPAVDPLDSTSRVLDPRVVGNDHYQTARDVQRILQTYKSLQDIIAILGMDELSEEDKLVVTRARKIQRFLSQPFHVAEIFTGSPGKLVAIEDTIKGFKAIVAGEYDHLPEAAFYMVGGIDEVIEKAKKMAAEAA

SEQ ID NO: 6906 - DNA, 1449 bp, Nostoc punctiforme PCC 73102
  CDS (1)..(1449): transl_table=11
atggtcacaaccgcagaaaaaacaaacattggctacattacccaaatcattggcccagttgtagacgttaaatttcccggcgggaaattgccacaaatctacaacgctttgaaaatcgttggcaccaacgaaagtggacaggaaatcaacatcaccgttgaagtacagcaactgctgggcgacaaccaagtgcggactgttgcgatgagttccaccgaaggcttagtgcgcggttttgaagtcaccgatacaggcgctcccattaccgtgccagttggtaaagccactttgggccggattttcaacgtccttggcgaacctgtggacaacaggggacctgtaaatgctgaggcaagtttacccatccaccgctctgctcctaaattcactgacctggaaaccaaaccttcggtgtttgagactgggattaaagttgttgaccttctgactccctatcgacgcggcggtaagattggtctgttcggcggtgctggtgttggtaaaaccgtgatcatgatggagttgattaacaacatcgctacccagcatggtggagtatccgtatttgctggcgtgggtgagcgcacccgtgaaggcaatgacctctacaacgaaatgattgagtctggggttatcaataacgagaacctcaacgaatcaaaaattgctctagtttacggtcaaatgaacgaaccacccggagctagaatgcgggttggtctttcgggattgacagtagcagagtacttccgggatgtgaacaagcaggatgtgctgctgtttattgacaacatcttccgatttgtgcaagcaggttcggaagtatccgcgctattgggtcggatgccttctgcggtaggatatcagcccacattgggaaccgacgtaggtgaactgcaagagcggattacctcgactacagagggttccattacctccattcaagcagtatacgtacctgcggatgacctcacagaccccgcacctgctactaccttcgcccacttggacggaaccacagtactgtctcgcggtttggctgctaagggaatttatcccgcagttgacccccttggttcaacttccaccatgctccaaccaaatattgtaggtgacgaacactacaatactgcgcgggcggtgcaatcaactctgcaacgttacaaagaactccaagacattatcgccattctcggtttagatgaattgtctgaagaagaccgtctaatcgtggcacgggcgcggaaagttgagcgcttcttgtctcagccgttctttgttgcagaagtattcaccggttctcctggtaagtatgtgaagttggaagataccatcaaaggcttccaaaaaattctgtctggtgagttggatgctctgccagaacaggctttctacttggttggcgatatcaacgaagcgatcgctaaagctgaaaaaatcaaaggttag

SEQ ID NO: 6907 - protein, 482 aa, Nostoc punctiforme PCC 73102
MVTTAEKTNIGYITQIIGPVVDVKFPGGKLPQIYNALKIVGTNESGQEINITVEVQQLLGDNQVRTVAMSSTEGLVRGFEVTDTGAPITVPVGKATLGRIFNVLGEPVDNRGPVNAEASLPIHRSAPKFTDLETKPSVFETGIKVVDLLTPYRRGGKIGLFGGAGVGKTVIMMELINNIATQHGGVSVFAGVGERTREGNDLYNEMIESGVINNENLNESKIALVYGQMNEPPGARMRVGLSGLTVAEYFRDVNKQDVLLFIDNIFRFVQAGSEVSALLGRMPSAVGYQPTLGTDVGELQERITSTTEGSITSIQAVYVPADDLTDPAPATTFAHLDGTTVLSRGLAAKGIYPAVDPLGSTSTMLQPNIVGDEHYNTARAVQSTLQRYKELQDIIAILGLDELSEEDRLIVARARKVERFLSQPFFVAEVFTGSPGKYVKLEDTIKGFQKILSGELDALPEQAFYLVGDINEAIAKAEKIKG

SEQ ID NO: 6908 - DNA, 1419 bp, Haemophilus somnus 2336
  CDS (1)..(1419): transl_table=11
atgaaattgttgcgggtgcagcagcaatttaatggagataaggtaatgtcagcaggaaaaattatacagattatcggtgcggtaattgatgttgaattcccacaaaatgcagtaccaaaagtttatgatgcattaaaagttgaatcaggattaactcttgaagttcaacaacagttgggtggcggtgtagtacgttgtatcgcattgggttcatctgatggtctaaaacgtggtttaaaagtagaaaatacaggaaatccaatttctgttcctgtgggaacaaaaacactaggacgtattatgaacgttctgggagagcctattgatgaaaaaggagaaattggtgcggaagaatattgggctatacatcgtgctgcaccaagctatgaagaacaatcaaatagtacagaacttttagaaacaggtatcaaagttattgacctaatttgtccttttgctaaaggtggtaaagttggtttatttggtggtgccggtgtaggtaaaactgtaaatatgatggaattaatccgtaatattgcaatcgaacattcaggttattcagtatttgcaggtgtaggtgagcgtactcgagagggtaatgatttctaccatgaaatgacagaatctaatgtattagataaagtatcgctggtttatggtcaaatgaatgaaccgccgggtaaccgtttacgtgttgctttaacaggattgactatggcggaaaaattccgtgatgaaggtcgtgacgtattatttttcgtagataatatctatcgttataccttggcaggtacagaagtatccgctcttttaggtcgtatgccttctgcggtaggttatcaaccgacattagcagaagaaatgggtgttttacaagagcgtattacttcaacaaaaacgggttctattacttccgttcaggctgtttatgttccggcggatgacttgacagacccttctccggcaacaacctttgctcatttggattcaacagtggtgttaagtcgtaatatcgcttctttgggtatttatccagctgttgatcctttggattctacttcacgtcaattagatccattagtagtaggacaggaacattatgatgtagctcgaggtgtgcagggtattttgcaacgctataaagaattaaaggatattattgctatcctcggtatggatgagctttccgaagatgataagctagtggtagcacgagcacgtaaaatagaacgtttcttgtcacaaccgttctttgttgcagaagtatttactggttctcctggtaaatatgtatcactaaaagatactattcgtggtttcaaaggtattttagatggtgaatacgatcatataccggaacaagcgttctatatggttggctcaatcgaagaagtgctagaaaaagccaaaaaaatgtag

SEQ ID NO: 6909 - protein, 472 aa, Haemophilus somnus 2336
MKLLRVQQQFNGDKVMSAGKIIQIIGAVIDVEFPQNAVPKVYDALKVESGLTLEVQQQLGGGVVRCIALGSSDGLKRGLKVENTGNPISVPVGTKTLGRIMNVLGEPIDEKGEIGAEEYWAIHRAAPSYEEQSNSTELLETGIKVIDLICPFAKGGKVGLFGGAGVGKTVNMMELIRNIAIEHSGYSVFAGVGERTREGNDFYHEMTESNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPLVVGQEHYDVARGVQGILQRYKELKDIIAILGMDELSEDDKLVVARARKIERFLSQPFFVAEVFTGSPGKYVSLKDTIRGFKGILDGEYDHIPEQAFYMVGSIEEVLEKAKKM

SEQ ID NO: 6910 - DNA, 1422 bp, Rickettsia sibirica 246
  CDS (1)..(1422): transl_table=11
atgacaaaaaatattggaaaaattactcagattatttcagcggtggtggatgtaaaatttacgaataacggtaagttaccggaaattttaaatgctctagagtgctataacgataaacaaaggatagtcctggaagtagcacaacatataggtgatgatacagtgcgttgtattgctatggattctatggaagggttagtgcggggcgtagaagtaatagatacaggcagtcctattcgtattcctgtaggtactgagacgcttgggcgtattatgaatgttgtaggtgagccgattgacggtaaaggagacattaaaagctcaaatatttcttctatatataagcctgctcctgattttaccaatcagtcaaccgagcgtaatatattagtaactggtattaaagttattgatttacttgctccttatactaaaggcggtaaaataggactattcggtggtgcaggagtcggtaaaaccgtgcttataatggagcttattaataacgtggctaaagcacacggcggttatacggtatttgcaggagttggtgagagaactagagaaggtaatgatctttaccatgaaatgattgactcgggtgttattaaccttgcagagcctgaaaagtcaaaagtagctttagtttatggacaaatgaacgagccgccgggagcaagggcaagagttgcgttaagcggtctgaccattgcagagagttttagagatatgaatgaagggcaagatgttttgttttttgtagataatattttccgttttactcaagcaggttctgaagtatcggcgttactcggtaggattccgtcagcggtagggtatcagcctactcttgcaagcgatatgggtgagctacaagagcgtatcacctctactaagtacggctcaataacttccgtgcaggctatatatgtaccggcggatgatttaactgatcctgctcctgctacttcttttgcacatttagatgctacaacggtacttagccgtcagatagctgagtttgggatttatccggcagttgatccgttagatagtaattcgcaggtacttgatccgatgattgttggtgaagaacattatagtgtagcaagacaagtgcagcaggttttacaaacttataaatcgttgcaggatattatcactattttaggtatggatgagctatccgaagaagataaactaaccgtggcacgtgctagaaaaatacagcgtttcttatcgcagcctttccatgtcgctgaagtatttaccggagctgcaggcaaatttgttaatctagccgatactattgcaggctttaaaggacttgtagagggtaaatacgatgatttaccggaagctgctttttatatggtcggaactatagacgaggctatagagaaggcgcagacgttgaagtga

SEQ ID NO: 6911 - protein, 473 aa, Rickettsia sibirica 246
MTKNIGKITQIISAVVDVKFTNNGKLPEILNALECYNDKQRIVLEVAQHIGDDTVRCIAMDSMEGLVRGVEVIDTGSPIRIPVGTETLGRIMNVVGEPIDGKGDIKSSNISSIYKPAPDFTNQSTERNILVTGIKVIDLLAPYTKGGKIGLFGGAGVGKTVLIMELINNVAKAHGGYTVFAGVGERTREGNDLYHEMIDSGVINLAEPEKSKVALVYGQMNEPPGARARVALSGLTIAESFRDMNEGQDVLFFVDNIFRFTQAGSEVSALLGRIPSAVGYQPTLASDMGELQERITSTKYGSITSVQAIYVPADDLTDPAPATSFAHLDATTVLSRQIAEFGIYPAVDPLDSNSQVLDPMIVGEEHYSVARQVQQVLQTYKSLQDIITILGMDELSEEDKLTVARARKIQRFLSQPFHVAEVFTGAAGKFVNLADTIAGFKGLVEGKYDDLPEAAFYMVGTIDEAIEKAQTLK

SEQ ID NO: 6912 - DNA, 1389 bp, Fusobacterium nucleatum subsp. vincentii ATCC 49256
  CDS (1)..(1389): transl_table=11
gtgaacaaaggaactataacacaaattataagtgctgttgtagacgttgcttttaaagatgagttgcctgcaatatataatgctttaaaagtaaaattagaagataaagaacttgttctagaagttgaacaacaccttggtaacaacgttgtaagaactgttgctatggattcaactgatggattaaaaagaggaatggaagttatagacacaggaaaaccaattacaataccagttggaaaagctgttctaggtagaatattaaatgttttaggagagcctgttgataatcaaggaccaataaatgctgaaacatttttacctattcatagagaagctccagaatttgatgacttagaaactgaaactgaaatatttgaaacaggaataaaagttatagacttattagcaccatatattaaaggtggaaaaataggattatttggtggagcaggagtaggtaaaactgttctaataatggaacttatcaataacattgcaaaaggacatggaggaatttcagtttttgcaggggttggagaaagaacaagagaaggtagagatttatatggtgaaatgactgaatcaggagttatcacaaaaacagctcttgtttatggacaaatgaatgagccacctggagcaagacttagagttgcactaacaggacttactgttgcagaaaattttagagataaagatggacaagatgttcttctatttatagataatatatttagatttacacaagcaggttcagaagtttcagctttacttggaagaattccatctgctgttggatatcaaccaaacttagcaactgaaatgggtgctttacaagaaagaataacatctacaaaatctggttcaattacatcagtacaagctgtatatgtaccagcagatgacttgactgacccagcaccagctacaaccttctctcacttggatgcaacaacagttctttcaagaaatattgcatcactagggatatatccagctgttgatccattagattcaacatctaaggctctatcagaagatgtagttggaaaagaacattatgaagtagctagaaaagtgcaagaagttttacaaagatataaggaacttcaagatataatagctatcttaggtatggatgagctatctgatgaagataaacttactgtatcaagagctagaaaaattgaaagatttttctcacaaccattctctgttgcagaacaatttactggaatggaaggaaaatatgttcctgtaaaagaaacaataagaggatttagagaaattttagaaggaaaacatgatgatattcctgaacaagcattcctatatgttggtacaatagaagaagccgttgctaaatcaaaagatttagtaaaataa

SEQ ID NO: 6913 - protein, 462 aa, Fusobacterium nucleatum subsp. vincentii ATCC 49256
MNKGTITQIISAVVDVAFKDELPAIYNALKVKLEDKELVLEVEQHLGNNVVRTVAMDSTDGLKRGMEVIDTGKPITIPVGKAVLGRILNVLGEPVDNQGPINAETFLPIHREAPEFDDLETETEIFETGIKVIDLLAPYIKGGKIGLFGGAGVGKTVLIMELINNIAKGHGGISVFAGVGERTREGRDLYGEMTESGVITKTALVYGQMNEPPGARLRVALTGLTVAENFRDKDGQDVLLFIDNIFRFTQAGSEVSALLGRIPSAVGYQPNLATEMGALQERITSTKSGSITSVQAVYVPADDLTDPAPATTFSHLDATTVLSRNIASLGIYPAVDPLDSTSKALSEDVVGKEHYEVARKVQEVLQRYKELQDIIAILGMDELSDEDKLTVSRARKIERFFSQPFSVAEQFTGMEGKYVPVKETIRGFREILEGKHDDIPEQAFLYVGTIEEAVAKSKDLVK

SEQ ID NO: 6914 - DNA, 1422 bp, Rickettsia rickettsii
  CDS (1)..(1422): transl_table=11
atgacaaaaaatattggaaaaattactcagattatttcagcggtggtggatgtaaaatttacgaataacggtaagttaccggaaattttaaatgctctagagtgctataacgatacacgaagggtagtcctggaagtagcacaacatataggtgatgatacagtgcgttgtattgctatggattctatggaagggttagtgcggggcgtagaagtaatagatacaggcagtcctattcgtattcctgtaggtactgagacgcttgggcgtattatgaatgttgtaggtgagccgattgacggtaaaggagacattaaaagctcaaatatttcttctatatataagcctgctcctgattttaccaatcagtcaaccgagcgtaatatattagtaaccggtattaaagttattgatttacttgctccttatactaaaggcggtaaaataggactattcggtggtgcaggagtcggtaaaaccgtgcttataatggagcttattaataacgtagctaaagcacacggcggttatacggtatttgcaggagttggtgagagaactagagaaggtaatgatctttatcatgaaatgattgactcgggtgttattaaccttgcagagcctgaaaaatcaaaagtagctttagtttatggacaaatgaacgagccgccgggagcaagggcaagagttgcgttaagcggtctgaccattgccgagagttttagagatatgaatgaagggcaagatgttttgttttttgtagataatattttccgttttactcaagcaggttctgaagtatcggcgttactcggtaggattccgtcagcggtagggtatcagcctactcttgcaaccgatatgggcgaactacaagagcgtatcacctctactaagcacggctcaataacttccgtgcaggctatatatgtaccggcggatgatttaactgatcctgctcctgctacttcttttgcacatttagatgctacaacggtacttagtcgtcagatagctgagtttgggatttatccggcagttgatccgttagatagtaattcgcaggtacttgatccgatgattgttggtgaagaacattatagtgtagcaagacaagtgcagcaggttttacaaacttataaatcgttgcaggatattatcactattttaggtatggatgagctatccgaagaagataaactaaccgtggcacgtgctagaaaaatacagcgtttcttatcgcagcctttccatgtcgctgaagtatttaccggagctgcaggcaagtttgttaatctagctgatactatagcaggctttaaaggacttgtagagggtaaatacgatgatttaccggaagctgctttttatatggtcggaactatagacgaggctataaagaaggcgcaaacgttgaagtga

SEQ ID NO: 6915 - protein, 473 aa, Rickettsia rickettsii
MTKNIGKITQIISAVVDVKFTNNGKLPEILNALECYNDTRRVVLEVAQHIGDDTVRCIAMDSMEGLVRGVEVIDTGSPIRIPVGTETLGRIMNVVGEPIDGKGDIKSSNISSIYKPAPDFTNQSTERNILVTGIKVIDLLAPYTKGGKIGLFGGAGVGKTVLIMELINNVAKAHGGYTVFAGVGERTREGNDLYHEMIDSGVINLAEPEKSKVALVYGQMNEPPGARARVALSGLTIAESFRDMNEGQDVLFFVDNIFRFTQAGSEVSALLGRIPSAVGYQPTLATDMGELQERITSTKHGSITSVQAIYVPADDLTDPAPATSFAHLDATTVLSRQIAEFGIYPAVDPLDSNSQVLDPMIVGEEHYSVARQVQQVLQTYKSLQDIITILGMDELSEEDKLTVARARKIQRFLSQPFHVAEVFTGAAGKFVNLADTIAGFKGLVEGKYDDLPEAAFYMVGTIDEAIKKAQTLK

SEQ ID NO: 6916 - DNA, 1422 bp, Rickettsia akari str. Hartford
  CDS (1)..(1422): transl_table=11
atgacaaaaaatatcggtaaaattactcagattatttcagcggtggtggatgtaaaatttacgaataacggtgagttaccggaaattttaaatgctctagagtgctataacgataaacaaaggatagtgctggaagtagcccaacatataggtgatgatacggtgcgttgtattgctatggattctactgaaggattagtgcggggtgtagaagtaatggataccggtagtcctatttgtattcctgtaggtactgagacgcttgggcgtattatgaatgttgtaggtgagccgattgatggtaaaggagacattaaaagctcaaatatttctgctatatataagtctgctcctgattttaccaatcagtcaaccgagcgtaatatattagtaaccggtattaaagttgttgatttacttgctccttacattaaaggcggtaagataggattattcggcggtgcaggtgtaggtaaaaccgtgttaattatggagcttattaataacgtagctaaggcacatggaggttatacggtatttgcaggagtcggtgagagaactagagagggtaatgatctttaccatgaaatgattgactcgggtgtgattgaccttgagaaaccggaaaattcaaaagtagctcttgtttatggacaaatgaacgcgccgcctggagcaagggcaagagttgcgttaagcggtctgaccattgcggaaagttttagagatatgaatggggggcaagatgttttgtttttcgtggataatattttccgtttcactcaagcaggttctgaagtatcggcgctgcttggtaggattccgtcagcggtagggtatcagcctactcttgctaccgatatgggagaactacaagagcgtatcacctctactaagcacggctcaataacttcagtgcaggctatatatgtaccggcggatgatttaactgatcctgctcctgctacttctttcgcgcatctcgatgctacaacggtacttagccgtcagatagccgagtttggaatttatccagcagttgacccgttagatagtaattctcaggtacttgacccgatgattgtcggtgaggagcattatagcgtagcaagacaagtacagcaggttttacaaacttataaatcgttgcaggatatcattgctattttaggtatggatgagttgtccgaagaagataaactaaccgtgtcgcgtgctagaaaaatacagcgtttcttatcacagccttttcatgtcgccgaagtatttaccggatctgaaggcaaatttgttaatctagctgatactatcgcaggttttaaaggattggtagagggtaaatatgatgatttaccggaagctgctttttatatggtcggaactatagacgaggctattgagaaagcaaagattttgaagtaa

SEQ ID NO: 6917 - protein, 473 aa, Rickettsia akari str. Hartford
MTKNIGKITQIISAVVDVKFTNNGELPEILNALECYNDKQRIVLEVAQHIGDDTVRCIAMDSTEGLVRGVEVMDTGSPICIPVGTETLGRIMNVVGEPIDGKGDIKSSNISAIYKSAPDFTNQSTERNILVTGIKVVDLLAPYIKGGKIGLFGGAGVGKTVLIMELINNVAKAHGGYTVFAGVGERTREGNDLYHEMIDSGVIDLEKPENSKVALVYGQMNAPPGARARVALSGLTIAESFRDMNGGQDVLFFVDNIFRFTQAGSEVSALLGRIPSAVGYQPTLATDMGELQERITSTKHGSITSVQAIYVPADDLTDPAPATSFAHLDATTVLSRQIAEFGIYPAVDPLDSNSQVLDPMIVGEEHYSVARQVQQVLQTYKSLQDIIAILGMDELSEEDKLTVSRARKIQRFLSQPFHVAEVFTGSEGKFVNLADTIAGFKGLVEGKYDDLPEAAFYMVGTIDEAIEKAKILK

SEQ ID NO: 6918 - DNA, 1419 bp, Exiguobacterium sibiricum 255-15
  CDS (1)..(1419): transl_table=11
atgaacgaactcggtttaaaaggccgcgtcgtcgcggtcatgggacctgtcatcgacgttaagttcgacggacacttgccgaacatctacaacgcgcttcgtattcaatatacgccgcaaacagtagaagaagtggctatcgacttgacgcttgaggtcgccttgcaccttggtgacgacgtcgtccgtaccattgcgatggattctacggatggtgtacgccgcggagtggaagtactggacactggtgctccaatctcggtacctgtcggagaagcaacgcttggtcgcgtcttcaacgtactcggtaacccaattgatgaaaaagaactcgatgcaagcgtggaacgtcttccgatccacaaaaaagcaccgacgtttgataacctttcaacaaaagttgaaatcctcgaaacaggaattaaagtcgttgacttactcgctccttacatcaagggtggtaagattggtctcttcggtggtgctggtgtaggtaagaccgtcctcatccaggaattgatcaacaacatcgcccaagagcacagcggtatctcggtattcgcaggtgttggtgagcggacgcgtgaaggtaatgacttgtaccacgagatgacggattcaggcgttatcaaacaaacagcgatggtcttcggtcagatgaacgagccgccgggcgcacgtcttcgtgttgccttgactggtttgacaatggcagaatacttccgtgatgagcagggacaagacgttcttctcttcgttgataacatcttccgttacacacaagcaggttcagaggtatcggcccttctcggtcgtatgccgtctgccgttggttaccagccgacacttgcgacagagatgggtatgcttcaagagcgtatcacgtcaacaaacaaaggttcggttacatcgatccaagcggtttatgtaccggccgatgactatactgacccggctcctgcaacgacgtttgcccacttggatgcaacgacgaaccttgagcgccgtctctctgagatgggtatctatcctgccgtggatccacttgcttctacatcacgtgccctttcaccggaaatcgtcggcgaagagcattacggcgtagcacgtcaagttcaggaaacacttcagcgttacaaagaacttcaagatatcatcgcgatcctcggtatggacgagttgtctgaagaagacaaattgactgtacaccgtgcgcgtcgtatccagttcttcttgtcgcagaacttccacgtagctgagcagttcacaggacaaaaaggatcgtacgtcccggttaaggacacgatccgcggcttcaaagaaatcctcggtgggaaacacgatgatctgacggaagaagcattccgtctcgtcggtccgatcgaagatgcgattgaaaaagcgaagacgcttgtctaa

SEQ ID NO: 6919 - protein, 472 aa, Exiguobacterium sibiricum 255-15
MNELGLKGRVVAVMGPVIDVKFDGHLPNIYNALRIQYTPQTVEEVAIDLTLEVALHLGDDVVRTIAMDSTDGVRRGVEVLDTGAPISVPVGEATLGRVFNVLGNPIDEKELDASVERLPIHKKAPTFDNLSTKVEILETGIKVVDLLAPYIKGGKIGLFGGAGVGKTVLIQELINNIAQEHSGISVFAGVGERTREGNDLYHEMTDSGVIKQTAMVFGQMNEPPGARLRVALTGLTMAEYFRDEQGQDVLLFVDNIFRYTQAGSEVSALLGRMPSAVGYQPTLATEMGMLQERITSTNKGSVTSIQAVYVPADDYTDPAPATTFAHLDATTNLERRLSEMGIYPAVDPLASTSRALSPEIVGEEHYGVARQVQETLQRYKELQDIIAILGMDELSEEDKLTVHRARRIQFFLSQNFHVAEQFTGQKGSYVPVKDTIRGFKEILGGKHDDLTEEAFRLVGPIEDAIEKAKTLV

SEQ ID NO: 6920 - DNA, 1389 bp, Prosthecochloris aestuarii DSM 271
  CDS (1)..(1389): transl_table=11
atgcaagaaggtaagatatctcaaatcatcggccctgtcgttgatgttgatttcccggaaggacagcttccgtcaattctggacgcacttacagttgctcgtcctgacggatcaaaactggttcttgaaacccagcagcaccttggcgacgaaagggtccgcgcgatcgccatggaaggtaccgaaggcctcgtaagaggaatcccggttatcaacacaggaaaaccgatccaggttcctgtcggccagaacgtactcggccgcatgctcaacgtcgtcggagaaccgatcgacggcatgggcgacatcgacagcgataccacccgctcgatccacaggagcgccccgaaatttgacgaactctccacaaaatcagagatgttcgagacaggcatcaaagtcatcgatcttcttgagccatattcaagaggcggtaaaacaggtttgttcggtggtgccggtgtcggtaaaaccgttcttatcatggagctcatcaacaacatcgccaaacagcagtccggatactccgtctttgccggtgtcggtgagcgtacccgtgaaggcaacgacctctgggaagagatgaaggagtccggcgttatcgacaaaaccgcgctcgtgttcggtcagatgaacgagcctcccggcgcacgtgcccgcgttgcattgaccggtctttctatcgcggagtacttccgtgatgtagaacaccgcgacgttctgctcttcgttgacaatatcttccgctttacccaggcaggttcagaggtttccgcacttctcggccgtatgccgagcgctgtagggtaccagccgaccctcggtaccgagatgggtgaactccaggacagaattgtctccaccaaagacggttcggttacctctgtacaggctatctatgtccctgcagatgacctgaccgatccggccccggccacgacatttactcaccttgacgcgacgaccgtactttcccgttcgatcgccgagcttggtatctaccctgctgttgatcccctggattcaacctcgcgaattctcgacccgaacattgtcggcgatgaccattacgataccgcacaggcggtcaaagagatcctgcagcgctataaagatcttcaggatatcatcgccattctcggtatggatgaactgagcgatgaggacaaacttgtcgtttcgcgtgccagaaaaattcagcgattcctttcacagccgttcttcgttgccgaagcctttaccggcctttccggcaaatacgtcaaactcgaagacaccattaaaggcttcaaggaaatcatcgcaggccgccacgataatcttcctgaaaatgccttctacctggtcggcaccattgaggaagcgatcgaaaaagcgaaaaaactgtaa

SEQ ID NO: 6921 - protein, 462 aa, Prosthecochloris aestuarii DSM 271
MQEGKISQIIGPVVDVDFPEGQLPSILDALTVARPDGSKLVLETQQHLGDERVRAIAMEGTEGLVRGIPVINTGKPIQVPVGQNVLGRMLNVVGEPIDGMGDIDSDTTRSIHRSAPKFDELSTKSEMFETGIKVIDLLEPYSRGGKTGLFGGAGVGKTVLIMELINNIAKQQSGYSVFAGVGERTREGNDLWEEMKESGVIDKTALVFGQMNEPPGARARVALTGLSIAEYFRDVEHRDVLLFVDNIFRFTQAGSEVSALLGRMPSAVGYQPTLGTEMGELQDRIVSTKDGSVTSVQAIYVPADDLTDPAPATTFTHLDATTVLSRSIAELGIYPAVDPLDSTSRILDPNIVGDDHYDTAQAVKEILQRYKDLQDIIAILGMDELSDEDKLVVSRARKIQRFLSQPFFVAEAFTGLSGKYVKLEDTIKGFKEIIAGRHDNLPENAFYLVGTIEEAIEKAKKL

SEQ ID NO: 6922 - DNA, 1461 bp, Kineococcus radiotolerans SRS30216
  CDS (1)..(1461): transl_table=11
atgaccgccaccgtcaacgaagcgccggccagcaccagcaagggtgcgacaggccgcatcgcccgagtcatcggccccgtcgtcgacgtcgagttctcggccgacacgatgccggaccagaacaacgccctcaccacccaggtgaccatgggtggcaccacccagaccgtgaccctcgaggtggcctcccacctcggcgacaacatggtccgtgccatctccctgaagccgaccgacggcatggtccgcggcgcggccgtcgtcgacaccggcgccccgatctcggtgcccgtcggcaacgcgaccctgggtcacgtcttcaacgccatcggcgagtgcctcaacctcgaggagggtgagcagctcgaggtccacgagcgctggcccatccaccgcaaggccccgaacttcgaccagctcgagtcgcggaccacgatgttcgagaccggcatcaaggtcatcgacctgctgaccccgtacgtccagggcgggaagatcggcctcttcggcggtgcgggcgtcggcaagaccgtcctcatccaggagatgatccagcgcgtcgcccagaaccacggcggtgtgtcggtgttcgccggggtcggcgagcgcacccgtgagggcaacgacctcatcggcgagatggccgaggccggcgtcttcgacaagacggccctcgtcttcggccagatggacgagccgccgggcacccgcctgcgcgtggccctgtccgcgctgaccatggcggagtacttccgcgacgtgcagaaccaggacgtgctgctcttcatcgacaacatcttccggttcacccaggccggttcggaggtgtcgaccctgctgggccgcatgccctccgccgtggggtaccagccgacgctggccgacgagatgggcgtcctccaggagcgcatcacctcgacccgcggtcactcgatcacctcgctgcaggcgatctacgtccccgccgacgactacaccgacccggcgccggccacgacgttcgcgcacctcgacgcgacgacggagctctcccgcgagatcgcctcgcgcggtctgtacccggctgtggacccgctgacctcgacgtcgcgcatcctggacccgctgtacatcgcgcaggaccactacgacaccgcggtccgcgtcaagcagatcctgcagcgcaacaaggagctgcaggacatcatcgccatcctcggtgtcgacgagctgtcggaggaggacaagctgacggtgagccgtgctcgccgcatccagcagttcctctcgcagaacacctacatggcggagaagttcaccggcgtcgagggctcgacggtcccgctcaaggagaccatcgagggcttctccaagatcgccgacggcgagctcgaccacgtcgccgagcaggccttcttcaacgtcggtggcctcgaggacgtcgagcgcaactgggctcgcatccagaaggaaaccgcctga

SEQ ID NO: 6923 - protein, 486 aa, Kineococcus radiotolerans SRS30216
MTATVNEAPASTSKGATGRIARVIGPVVDVEFSADTMPDQNNALTTQVTMGGTTQTVTLEVASHLGDNMVRAISLKPTDGMVRGAAVVDTGAPISVPVGNATLGHVFNAIGECLNLEEGEQLEVHERWPIHRKAPNFDQLESRTTMFETGIKVIDLLTPYVQGGKIGLFGGAGVGKTVLIQEMIQRVAQNHGGVSVFAGVGERTREGNDLIGEMAEAGVFDKTALVFGQMDEPPGTRLRVALSALTMAEYFRDVQNQDVLLFIDNIFRFTQAGSEVSTLLGRMPSAVGYQPTLADEMGVLQERITSTRGHSITSLQAIYVPADDYTDPAPATTFAHLDATTELSREIASRGLYPAVDPLTSTSRILDPLYIAQDHYDTAVRVKQILQRNKELQDIIAILGVDELSEEDKLTVSRARRIQQFLSQNTYMAEKFTGVEGSTVPLKETIEGFSKIADGELDHVAEQAFFNVGGLEDVERNWARIQKETA

SEQ ID NO: 6924 - DNA, 1401 bp, Xylella fastidiosa Dixon
  CDS (1)..(1401): transl_table=11
atgaatcagggtaagatcgttcagatcatcggcgcaattgtcgacgtcgaattcccacgaaacaatgtccccaaagtatataacgcgctgaagatcgacggcacagccatcatcttggaagtgcagcaacagcttggcgacggcattgtacgcaccatagcacttggctccacagacggcttaaaacgcaacctcattgccaccgacaccggccatgcaatcacagttcccgtaggcactggcacattaggtcgcatcatggatgtactaggcaacccaatcgacgaagcaggtccgatcacttatacagatcaatgggaaatccatcgaaacgctccttcctatgaagatcaagcctcaaccaccgaactgctggagaccggaatcaaggtcatcgaccttatgtgtccatttgctaaaggcggcaaagtcggattattcggtggtgccggtgtcggcaaaactgtcaacatgatggaattgatcaataacatcgccaaggcacatagtgggctgtccgtattcgcgggtgttggcgagcgaacccgcgaaggtaacgacttctatcacgagatgaaagactccaacgttctcgacaaggtagcaatggtgtatggccagatgaacgaaccaccgggtaaccgtctgcgcgttgcgctcaccggtctcaccatagccgagtacttccgcgatgagaaagacagtagcggcaaaggcaaagatgtacttctattcatcgacaatatctaccgctacaccttagctggcacggaagtatccgccctactcggtcgcatgccctcagcagtaggctaccaaccaacccttgccgaggaaatgggcgtactacaagagcgtatcacctcaaccgcaaatggctcgatcacctcgatccaagcagtgtacgtacccgccgatgatctgactgacccatcacctgcgacgacctttggacatctggactccacagtgacactatcccgctcgatcgccgcattaggcatttacccagcagtggatccactggattcgagcagtcgccagatggatccgctgatcatcggcgaagaacactacaataccactcaacgtgtccaacaaactctgcaaaaatataaagatctgaaggacatcattgcaatcttaggcatggatgaactttccgaggacgacaaactagccgtgtcacgtgcacgcaaaattgaacgatttttcagtcaaccattccatgtcgcagaagtattcaccggtgccccaggtaaatacgtcccattaaaagagacaatccgtggtttcaaagcaatcgtagacggcgaatatgaccatcttcccgaacaagccttctatatggtcggtaacattgaagaagtcatcgaaaaagccaacaaaatgacagcatga

SEQ ID NO: 6925 - protein, 466 aa, Xylella fastidiosa Dixon
MNQGKIVQIIGAIVDVEFPRNNVPKVYNALKIDGTAIILEVQQQLGDGIVRTIALGSTDGLKRNLIATDTGHAITVPVGTGTLGRIMDVLGNPIDEAGPITYTDQWEIHRNAPSYEDQASTTELLETGIKVIDLMCPFAKGGKVGLFGGAGVGKTVNMMELINNIAKAHSGLSVFAGVGERTREGNDFYHEMKDSNVLDKVAMVYGQMNEPPGNRLRVALTGLTIAEYFRDEKDSSGKGKDVLLFIDNIYRYTLAGTEVSALLGRMPSAVGYQPTLAEEMGVLQERITSTANGSITSIQAVYVPADDLTDPSPATTFGHLDSTVTLSRSIAALGIYPAVDPLDSSSRQMDPLIIGEEHYNTTQRVQQTLQKYKDLKDIIAILGMDELSEDDKLAVSRARKIERFFSQPFHVAEVFTGAPGKYVPLKETIRGFKAIVDGEYDHLPEQAFYMVGNIEEVIEKANKMTA

SEQ ID NO: 6926 - DNA, 1506 bp, Croceibacter atlanticus HTCC2559
  CDS (1)..(1506): transl_table=11
atgtctaaagtcacaggaaaagttgctcaaattattggccctgttgttgacgttgcgtttgacacagaaggcgaacttccaaaaatttacgattctcttgaaataaaaagagaagacggatctatcttagttctagaagtacaatcacacattggtgaaaacaccgtgcgtactatctctatggactctacagatggattgtcaagaggtactgctgttgaagcgacaaacgctccaatacaaatgcctattggtgatgtttacgggagactatttaatgttgtaggagatcctattgatggtatggaagacatgcctaagactggagacaacggtctaccaattcaccgtaatgcacctaagtttgaagatctatctgtatctacagaagttctttttactggtattaaagtaattgaccttattgaaccttatgctaaaggtggtaagattggtttatttggtggtgcaggtgtaggtaaaactgtacttattcaagaattaattaacaacattgcaaaaggacacggtggtttgtctgtatttgcaggtgttggagagcgtactcgtgagggtaacgatttacttcgtgagatgttagagtctggtattattaaatacggagatgactttatgcactctatggaagaaggtggatgggatctttctaaagtagataaaactgctatgaaagactctaaagcaacgttcgtattcggacaaatgaatgagccaccaggagcacgtgctcgtgtagcactttcaggattaactattgcagaatacttccgtgatggagcaggagatggtcaaggaaaagatgtattatttttcgtagataatatattccgttttacacaagcaggatcagaggtgtcagcacttcttggtcgtatgccttctgcggtaggttaccaacctaccttagcaaccgaaatgggagctatgcaagagcgtattacatcaactaaaaaaggatctattacatctgtacaagcggtatacgtacctgcagatgaccttaccgatccagcaccagcaacaacgtttgctcacttagatgcaactactgtattgtctcgtaagattgcagagcttggtatttatccagcggtagatccgttagattctacatctcgtatccttactgcagatattttaggtaatgagcattatgactgtgcacaacgtgtaaaagagcttttgcagagatataaagaactacaagatattattgctattcttggtatggaagaattatctgaagaagataaaatggctgtagggcgcgctcgtcgtgtacagcgtttcctttctcagccgttccacgtagcagagcagtttacaggtattcctggtgtcttagtagatattaaggaaactattaaaggcttcaacatgattatggacggtgagttagatcacctgccagaagcagctttcaaccttaaaggaactatagaggaagcaattgaagctggtgagaaaatgttagcagagtcttaa

SEQ ID NO: 6927 - protein, 501 aa, Croceibacter atlanticus HTCC2559
MSKVTGKVAQIIGPVVDVAFDTEGELPKIYDSLEIKREDGSILVLEVQSHIGENTVRTISMDSTDGLSRGTAVEATNAPIQMPIGDVYGRLFNVVGDPIDGMEDMPKTGDNGLPIHRNAPKFEDLSVSTEVLFTGIKVIDLIEPYAKGGKIGLFGGAGVGKTVLIQELINNIAKGHGGLSVFAGVGERTREGNDLLREMLESGIIKYGDDFMHSMEEGGWDLSKVDKTAMKDSKATFVFGQMNEPPGARARVALSGLTIAEYFRDGAGDGQGKDVLFFVDNIFRFTQAGSEVSALLGRMPSAVGYQPTLATEMGAMQERITSTKKGSITSVQAVYVPADDLTDPAPATTFAHLDATTVLSRKIAELGIYPAVDPLDSTSRILTADILGNEHYDCAQRVKELLQRYKELQDIIAILGMEELSEEDKMAVGRARRVQRFLSQPFHVAEQFTGIPGVLVDIKETIKGFNMIMDGELDHLPEAAFNLKGTIEEAIEAGEKMLAES

SEQ ID NO: 6928 - DNA, 1425 bp, Sulfitobacter sp. EE-36
  CDS (1)..(1425): transl_table=11
atggcaaatgcagtcggcaaaatcacacaagtcatcggcgccgtcgtcgatgtgcagttcgaggatcacctgccagagatcctcaacgctgttgtaactgaaaaccacggcaagaaactgatcctcgaagtggctcagcaccttggcgaaaacaccgtgcgtaccatcgcgatggacgcgaccgaaggtctggttcgcggccagcgcgtcgaagacacaggcgcgcccatctcgatcccagtgggtaacgccacattgggccgcatcatgaacgttgttggcgaagccatcgacgaaaaaggcgacatccaatcggccgagcgtcgctcgatccacgctgacgcgcccgaattcgcggaacagtcgaccacatccgaagtgctggaaacgggcatcaaggttatcgaccttctggcaccttacgccaagggtggtaaaattggtctgttcggtggtgccggtgttggcaaaaccgttctgatcatggaactgatcaacaacatcgccaaagtgcactccggttattcggttttcgcgggcgttggtgaacgtacccgtgaagggaacgacctgtaccacgagatgatcgaatccaacgttatcaaccctgatgatctggaaaaatcgcaggttgcgctggtgtacggccagatgaacgagcctcccggagcgcgtatgcgcgttgctctgaccggtctgacactggccgaacagttccgcgaccaatccggtaccgacgttctgttcttcgtcgacaacatcttccgctttacccaagccggttccgaggtttcggctctgctgggtcgtatcccttcggccgtgggctaccagccaacactggcgaccgacatgggtgcgatgcaagaacgtattacatcgaccaaatccggttcgattacatcggttcaggccgtttacgttcctgcggatgaccttaccgaccctgcgcccgcgacatcctttgcgcaccttgacgcgacaaccgttctggaccgttcgatctcggaaaagggtatctaccctgctgttgatccgcttggctccacatcgcgtctgatggacccatccatcgttggcgaagagcactacaacgtggcacgtgacgttcagggtatcctgcaacgctacaagtcgctgcaggacatcatcgcgattctcggcatggacgaactgtcggaagacgacaaactgaccgttgcccgtgcgcgtaagatcgaacgcttcctgagccagcctttcgacgttgcgaaagtgttcaccggctccgacggtaagcaggttccactggaagagacaatcacctccttcaaggcggttgttgccggtgaatacgatcacctgcccgaaggtgccttctacatggttggcggcatcgaagaagtgaaagcgaaagctgaaaaaatggcggcagacgccgcttaa

SEQ ID NO: 6929 - protein, 474 aa, Sulfitobacter sp. EE-36
MANAVGKITQVIGAVVDVQFEDHLPEILNAVVTENHGKKLILEVAQHLGENTVRTIAMDATEGLVRGQRVEDTGAPISIPVGNATLGRIMNVVGEAIDEKGDIQSAERRSIHADAPEFAEQSTTSEVLETGIKVIDLLAPYAKGGKIGLFGGAGVGKTVLIMELINNIAKVHSGYSVFAGVGERTREGNDLYHEMIESNVINPDDLEKSQVALVYGQMNEPPGARMRVALTGLTLAEQFRDQSGTDVLFFVDNIFRFTQAGSEVSALLGRIPSAVGYQPTLATDMGAMQERITSTKSGSITSVQAVYVPADDLTDPAPATSFAHLDATTVLDRSISEKGIYPAVDPLGSTSRLMDPSIVGEEHYNVARDVQGILQRYKSLQDIIAILGMDELSEDDKLTVARARKIERFLSQPFDVAKVFTGSDGKQVPLEETITSFKAVVAGEYDHLPEGAFYMVGGIEEVKAKAEKMAADAA

SEQ ID NO: 6930 - DNA, 1425 bp, Roseovarius nubinhibens ISM
  CDS (1)..(1425): transl_table=11
atggcaaatgcaaaaggcacaatcactcaggtgatcggcgccgtggtggacgttcagttcggcgaccacctgcccgaaattctgaacgccctgaccaccgacaacaacggcaagaaactggtcctcgaagtggcccagcaccttggtgagaacaccgtgcggaccatcgcgatggacagcaccgagggtctcgtgcgcggtcaggaagtgaccgacaccgacggcccgatcaccgtgcccgtcggcaacgccaccctgggccgtatcctcaacgtcgtgggcgagcccgtggacgagggtgccccgatcaaggcaaccgaaacccgcgccatccaccaagaagcgcccgagttccaagaacagtcgaccgagtcggaagttctggtcaccgggatcaaggtggttgacctgctggccccctacgcaaaaggcggcaagatcggcctcttcggcggtgccggcgtgggcaagaccgttctcatcatggaactgatcaacaacatcgccaaagtgcactcgggtttctcggtgttcgccggtgtgggtgagcggacccgtgagggcaacgacctctatcacgagatgatcgaatccaacgttatcaaccccgataacctggaagagagccaagtggccctcgtctacggtcagatgaacgaacctccgggagcgcgtatgcgtgtggccctgaccggtctgaccctggccgagcagttccgcgaccagtccgggaccgacgttctgttcttcgtcgacaacatcttccgctttacccaagccggttcggaagtgtcggcccttcttggtcgtattccttcggctgtgggctatcagccgacgctggcgaccgacatgggcgcgatgcaggaacgcatcacctcgaccaaatcgggttcgatcacctcggtgcaggccgtctacgttcccgcggacgaccttaccgaccccgcgcctgcgacctcgttcgcgcacctcgacgccaccaccgttctgtcgcgtgccatctccgagctgggcatctacccggcggtggacccgctcgacagtacgtcgcgcctgatggacccggcgatcgttggtgaagagcactaccaagtggcccgtgacgtgcagggtatcctgcaacgctacaagtcgctgcaggacatcatcgccatcctcggcatggacgaactgtcggaagaggacaagctgaccgtggcccgtgcccggaagatccagcgtttcctcagccagcccttcgacgtggcaaaggtcttcaccggttcggacggtgtgcaggtgcctctcgaagacacgatccggtcgttcaaggccgtggttgccggcgaatatgaccacctgcccgaaggtgccttctacatggttggcggcatcgacgacgtggtggccaaagccgagaagatggctgccgacgcggcctaa

SEQ ID NO: 6931 - protein, 474 aa, Roseovarius nubinhibens ISM
MANAKGTITQVIGAVVDVQFGDHLPEILNALTTDNNGKKLVLEVAQHLGENTVRTIAMDSTEGLVRGQEVTDTDGPITVPVGNATLGRILNVVGEPVDEGAPIKATETRAIHQEAPEFQEQSTESEVLVTGIKVVDLLAPYAKGGKIGLFGGAGVGKTVLIMELINNIAKVHSGFSVFAGVGERTREGNDLYHEMIESNVINPDNLEESQVALVYGQMNEPPGARMRVALTGLTLAEQFRDQSGTDVLFFVDNIFRFTQAGSEVSALLGRIPSAVGYQPTLATDMGAMQERITSTKSGSITSVQAVYVPADDLTDPAPATSFAHLDATTVLSRAISELGIYPAVDPLDSTSRLMDPAIVGEEHYQVARDVQGILQRYKSLQDIIAILGMDELSEEDKLTVARARKIQRFLSQPFDVAKVFTGSDGVQVPLEDTIRSFKAVVAGEYDHLPEGAFYMVGGIDDVVAKAEKMAADAA

SEQ ID NO: 6932 - DNA, 1404 bp, Oceanicola batsensis HTCC2597
  CDS (1)..(1404): transl_table=11
gtgacccaggtcatcggcgccgttgtggacgtgcagttcgacgatcacctgccggagatcctcaacgcactgaccaccgacaacaacggcaccaagctggttctggaagtggcgcagcaccttggtgagaacaccgtgcgcaccatcgcgatggacgcgaccgaaggtctggtccgcggccaggaagtgaccgacaccgacggcccgatctcggtgccggtcggcacggcgacgctgggccgcatcctgaacgtgatcggcgagccggtcgacgagaagggcccggtcgaggcggacgaattccggccgatccacgcgccggcccccgacttcgccgaccaggcgaccgaagccgaggtcctcgtgaccggcatcaaggtgatcgacctgctggccccctacgccaagggcggcaagatcggtctcttcggcggtgccggtgtgggcaagacggttctcatccaggaactgatcaacaacatcgccaaggtgcactcgggtctgtccgtgttcgccggtgtgggcgaacggacccgcgagggcaacgacctctaccacgagatgatcgagtcgggcgttctgaccccggacaacctgccggattccaagatcgccctggtctacggccagatgaacgaaccgccgggtgcgcgcgcgcggatcgcccttaccggcctgacgctggcggaacagttccgcgacgcgaccgggacggacgttctgttcttcgtcgacaacatcttccgcttcactcaggcgggctcggagatgtcggcgcttctgggtcgtattccctcggccgtgggctaccagccgacgctggccaccgacatgggcgcgatgcaggaacggatcacctcgaccaagaacgggtcgatcacctcgatccaggccgtctacgttcccgcggacgacctgaccgacccggcgccggccacgaccttcgcccacctcgacgcgacgacggttctcaaccgtgcgatctcggagcttggcatctacccggccgtggacccgctcgactcgacctcgcgtctcatggacccgcagatcgtcggcgaggaacactaccaggtggcccgtgacgtgcagggtatccttcagcgctacaagtcgctgcaggacatcatcgcgatcctcgggatggacgaactgtcggaagaggacaagctgaccgtggcccgcgcccggaagatccagcgcttcctgtcgcagccgttcgacgtggcgaaggtcttcaccggctcggatggtgtgcaggttcccctggaagacacgatcgcgtcgttcaaggccgtggtcgccggcgagtacgaccacctgcccgaagcggccttctacatggtcggcggcatcgacgaagtgaaagccaaggccgagaagctggccgcggaagcggcgtaa

SEQ ID NO: 6933 - protein, 467 aa, Oceanicola batsensis HTCC2597
MTQVIGAVVDVQFDDHLPEILNALTTDNNGTKLVLEVAQHLGENTVRTIAMDATEGLVRGQEVTDTDGPISVPVGTATLGRILNVIGEPVDEKGPVEADEFRPIHAPAPDFADQATEAEVLVTGIKVIDLLAPYAKGGKIGLFGGAGVGKTVLIQELINNIAKVHSGLSVFAGVGERTREGNDLYHEMIESGVLTPDNLPDSKIALVYGQMNEPPGARARIALTGLTLAEQFRDATGTDVLFFVDNIFRFTQAGSEMSALLGRIPSAVGYQPTLATDMGAMQERITSTKNGSITSIQAVYVPADDLTDPAPATTFAHLDATTVLNRAISELGIYPAVDPLDSTSRLMDPQIVGEEHYQVARDVQGILQRYKSLQDIIAILGMDELSEEDKLTVARARKIQRFLSQPFDVAKVFTGSDGVQVPLEDTIASFKAVVAGEYDHLPEAAFYMVGGIDEVKAKAEKLAAEAA

SEQ ID NO: 6934 - DNA, 1467 bp, Prochlorococcus marinus str. MIT 9211
  CDS (1)..(1467): transl_table=11
atggcccctgcagcaactgcctcaaccggtacaaagggaattgtccgtcaagttattggaccagttttagatgttgaatttcccgctgggaagctgcccaaaatcttgaatgcacttcgaatagaaggcaaaaatccagcaggtcaagacattggactaacagcagaggtccaacaattgttaggagatcaccgtgttcgtgctgttgctatgagcgggacagatggtctcgtaagaggcatggaggctgttgatactggagccccaatatctgttcctgttggagaagcgactctaggaagaatttttaatgttttaggcgaacctgttgatgagcaaggacctattaaaagttcaacgacttcaccaatccatagatcagctccaaaattaactgatctcgaaacaaagccaaaagtatttgaaacagggatcaaagttattgatctactcgctccatataggcaaggcggcaaagtaggtctttttggtggagctggtgttggtaaaactgttttaattcaagaattaattaacaatatcgccaaagagcatgggggtgtttcagtttttgggggtgttggagagcgtacacgcgagggaaatgatttatatgaagaatttaaagaatctggagttataaatgccgacaatctaactgagtcaaaggtagccctttgtttcggccaaatgaatgagccaccaggcgcaagaatgagagttggcctttcagctttaacgatggctgaacactttagagatgttaataagcaagatgttctgttattcattgataatattttccgctttgtgcaggctggttcagaagtatctgctctcttaggcagaatgccgtctgctgtgggttatcaaccaacattgggaacagacgttggtgaacttcaagagcgaataacttcaacacttgaaggatcaataacttctattcaggcagtttatgttcctgcagatgacttaacagacccagctccagcaacaacttttgcacaccttgatgcaacaacggttcttgcaagagctttagcggcaaaaggtatatatcctgctgttgatccactcgattcaacaagtaccatgctccagccagcagttgttggcgacgagcattaccgtactgcaagagccgtacaatcaaccctacaaagatataaagaacttcaggacatcattgcaattcttggattagatgagctctctgaagaagatagaaaaacttttgatagagctagaaaaatagaaaagtttttatctcagccattctttgttgcagagatctttacaggcatgtcaggtaaatacgtgaagctagaagaaacaattgcaggttttaacatgattctatctggagaacttgataatcttcctgagcaagctttttatctagtaggaaatatcgaggaagtaaaagcaaaagctcaaaaaatcaactcagaaaataaaggataa

SEQ ID NO: 6935 - protein, 488 aa, Prochlorococcus marinus str. MIT 9211
MAPAATASTGTKGIVRQVIGPVLDVEFPAGKLPKILNALRIEGKNPAGQDIGLTAEVQQLLGDHRVRAVAMSGTDGLVRGMEAVDTGAPISVPVGEATLGRIFNVLGEPVDEQGPIKSSTTSPIHRSAPKLTDLETKPKVFETGIKVIDLLAPYRQGGKVGLFGGAGVGKTVLIQELINNIAKEHGGVSVFGGVGERTREGNDLYEEFKESGVINADNLTESKVALCFGQMNEPPGARMRVGLSALTMAEHFRDVNKQDVLLFIDNIFRFVQAGSEVSALLGRMPSAVGYQPTLGTDVGELQERITSTLEGSITSIQAVYVPADDLTDPAPATTFAHLDATTVLARALAAKGIYPAVDPLDSTSTMLQPAVVGDEHYRTARAVQSTLQRYKELQDIIAILGLDELSEEDRKTFDRARKIEKFLSQPFFVAEIFTGMSGKYVKLEETIAGFNMILSGELDNLPEQAFYLVGNIEEVKAKAQKINSENKG

SEQ ID NO: 6936 - DNA, 1458 bp, Erythrobacter sp. NAP1
  CDS (1)..(1458): transl_table=11
atggcaaccgcaccagtcctcaaccagaccaccaacggcacgatcagccaggtcatcggcgctgtcgtcgacgtgcagttccccggtgaactgcccgcaattctgaccgcgctcgaaaccaaaaacgacggcaagacgctcgtcctcgaagtcgcgcagcaccttggcgaaaacaccgtccgcaccatcgcgatggatgcgaccgaaggccttgttcgtggtcaggaagtcatcaacaccggcgcgcagatcagcgttccggttggccccaagacgctcggccgcatcatgaacgtcgtcggcgaagccatcgacgagcgtggcccggttggcgctgacatgaccagcccgatccacgcagaggctcctgcctttgtcgaccagtcgaccgaagccgacattctcgtcaccggcatcaaggtgatcgaccttctcgctccttacgcgaagggcggcaagatcggcctgtttggcggcgctggcgttggcaagaccgttctcattcaggaactcatcaacaacatcgcaaagggccacggcggcgtgtccgtgttcgcaggcgttggtgagcgcacccgtgaaggtaacgacctctaccacgaattcctcgacgctggcgttatcgccaaggacgaagacggcaacgctatctcggaaggctccaaggttgcgctcgtcttcggtcagatgaacgagcctccgggcgcacgtgcacgcgttgctctgtcgggtctgaccatggccgaatatttccgcgaccaagaaggccaggacgtcctgttcttcgtcgacaacatcttccgctttacgcaggcgggttcggaagtgtccgcgcttctcggccgtattccttcggcagtgggctatcagccgaccctgtcgaccgacatgggtaacctgcaggaacgcatcacctcgaccaccaagggctcgatcacctcggtgcaggccatctacgttcctgcagatgacttgaccgacccggcgcctgcaacctcgtttgctcaccttgacgcaacgaccactctgtcgcgcgccatctcggagctcggcatctacccggcggtggacccgctggactcgaccagccgcgttctcgagccgcgcgttgtcggtcaggaacactacgaaaccgctcgccgcgttcaggaaacgctgcagaagtacaagagccttcaggacatcatcgccattctcggcatggacgagctttcggaagaagataagctcaccgttgcccgtgcgcgcaagatccagaagttcctttcgcagccgttccacgtggctgaggtcttcaccaacatcccgggcctgttcgtgcagctcgaagatacgatcaagtcgttcaaggctgtggtcgatggtgaatacgaccaccttcccgaagcggccttctacatggttggcggcatcgacatggttgtcgaaaaggcagccaagctcgccgaggaaagctaa

SEQ ID NO: 6937 - protein, 485 aa, Erythrobacter sp. NAP1
MATAPVLNQTTNGTISQVIGAVVDVQFPGELPAILTALETKNDGKTLVLEVAQHLGENTVRTIAMDATEGLVRGQEVINTGAQISVPVGPKTLGRIMNVVGEAIDERGPVGADMTSPIHAEAPAFVDQSTEADILVTGIKVIDLLAPYAKGGKIGLFGGAGVGKTVLIQELINNIAKGHGGVSVFAGVGERTREGNDLYHEFLDAGVIAKDEDGNAISEGSKVALVFGQMNEPPGARARVALSGLTMAEYFRDQEGQDVLFFVDNIFRFTQAGSEVSALLGRIPSAVGYQPTLSTDMGNLQERITSTTKGSITSVQAIYVPADDLTDPAPATSFAHLDATTTLSRAISELGIYPAVDPLDSTSRVLEPRVVGQEHYETARRVQETLQKYKSLQDIIAILGMDELSEEDKLTVARARKIQKFLSQPFHVAEVFTNIPGLFVQLEDTIKSFKAVVDGEYDHLPEAAFYMVGGIDMVVEKAAKLAEES

SEQ ID NO: 6938 - DNA, 1386 bp, Pseudoalteromonas tunicata D2
  CDS (1)..(1386): transl_table=11
atgagtttaggtaaggtcgtccaaattatcggcgccgttgtggatattgaattcccacaaaatagcgtgcctgccgtatatgacgcagtcaacattacagatggcgatttagctggtttaactctagaagttcaacagcagctaggtggcggtgtggtacgtggtatcgcacttggtactacagacggtttacgtcgtggtgctacagtacaaaacactggtaaagcaattcaagtgccagtaggtaaagcaacactaggtcgtatcatgaacgtacttggtgagccaatcgatgaagcaggtccaatcggtgaagaagagcgtatgtctattcaccgtgcagcaccaagctacgaagagcaatcaagctcaatcgaacttttagaaacgggtatcaaggttatcgaccttgtatgtccattcgctaaaggtggtaaagttggtttattcggtggtgccggtgtaggtaaaaccgtaaacatgatggaacttatccgtaacatcgcaatcgagcacagcggttattcagtattcgctggtgttggtgagcgtacacgtgaaggtaacgatttctatcacgaaatgaacgaatctaacgtacttgataaagtatcgctagtttacggtcagatgaatgagccaccaggcaaccgtttacgtgttgctttaacgggtctaactatggctgagaagttccgtgacgaaggtcgcgatgtacttttcttcgtagataatatctaccgttacacactagctggtacagaagtatctgcacttttaggtcgtatgccatcagccgtaggttaccaaccaacgcttgctgaagaaatgggtgtactacaggagcgtatcgcttctactaaaacaggttcaattacttcaatccaagcggtatacgtacctgcggatgacttaacagatccatcaccagcaacaacgtttgctcacttagatgcaacagttgtactttctcgtgatatcgcatctttaggtatctatccagcggttgacccactagattcatcatctcgtcaacttgatccattagtaatcggtcaagagcattatgatgcagcacgtggtgttcaaacagttcttcaacgttataaagaactaaaagacatcattgcgattctaggtatggatgaattatcagatgaagataagcaattagtatctcgtgctcgtaaaatccaacgtttcctatctcagccgttcttcgttgctgaggtatttacaggtgcgtcaggtaaatacgtttcattaaaagatactattgcaggctttaaaggcatcttaaacggtgactatgatgcgcttcctgagcaagcattctacatggttggctctatcgatgaagcgatcgaaaaagctaaaaacatgtaa

SEQ ID NO: 6939 - protein, 461 aa, Pseudoalteromonas tunicata D2
MSLGKVVQIIGAVVDIEFPQNSVPAVYDAVNITDGDLAGLTLEVQQQLGGGVVRGIALGTTDGLRRGATVQNTGKAIQVPVGKATLGRIMNVLGEPIDEAGPIGEEERMSIHRAAPSYEEQSSSIELLETGIKVIDLVCPFAKGGKVGLFGGAGVGKTVNMMELIRNIAIEHSGYSVFAGVGERTREGNDFYHEMNESNVLDKVSLVYGQMNEPPGNRLRVALTGLTMAEKFRDEGRDVLFFVDNIYRYTLAGTEVSALLGRMPSAVGYQPTLAEEMGVLQERIASTKTGSITSIQAVYVPADDLTDPSPATTFAHLDATVVLSRDIASLGIYPAVDPLDSSSRQLDPLVIGQEHYDAARGVQTVLQRYKELKDIIAILGMDELSDEDKQLVSRARKIQRFLSQPFFVAEVFTGASGKYVSLKDTIAGFKGILNGDYDALPEQAFYMVGSIDEAIEKAKNM

SEQ ID NO: 6940 - DNA, 1377 bp, Oceanospirillum sp. MED92
  CDS (1)..(1377): transl_table=11
atgagtagcggaactattgttcagattatcggtgcggtagttgacgtggaatttccacgtgattctgtaccgaaggtttacgacgcgctgaccgtaactaaaaacggtttgacgctggaagttcagcagcagctgggcgacggtgttgttcgtgcgatcgcaatgggtcagactgaaggcgtaagccgtggtcaggacgttgcgaacactggtgcgccagtttctgtacctgttggtacagcaacactgggtcgtatcatggacgtactgggtaacccaattgatgaatgtggcgaaatcggtgaagaagagcgtatgcctatccaccgtaaagcgccatcttacgacgagcaggcagcatcaaacgaactgctggaaactggtatcaaggtaatcgacctggtatgcccgtttgctaaaggtggtaaagttggtctgttcggtggtgcgggtgtaggtaaaaccgtaaacatgatggagctgatccgtaacatcgcgatcgagcactcaggtttctccgtattcgccggcgtaggtgagcgtactcgtgagggtaacgacttctactacgagatgaaagaatccaacgtactggataaagtatctctggtttacggtcagatgaatgagcctccaggtaaccgtctgcgtgtagcgctgactggcctgacaatggctgaaaaattccgtgacgaaggtcgtgacgtactgttgttcgtagacaacatctaccgttacacactggcaggtactgaagtatcagcactgctgggtcgtatgccttctgcggtaggttaccagccaactctggcagaagagatgggcgttcttcaggagcgtatcacttctactaagactggttccatcacgtctatccaggcggtatacgtacctgccgatgacttgactgacccatctccagcaacaaccttctctcaccttgacgcaacagtagtactgtctcgtcagatcgcagagctgggtatctaccctgcggttgacccactggattcaacgtctcgtcagctagacccactggttatcggtactgagcactatgaaattgctcgtaacgtacagggtgtacttcagcgctataaagagctgaaagacatcatcgctatcctgggtatggacgaactgtctgaagaagataaatctctggtagcacgtgcacgtaagatccagcgattcctttctcagccattcttcgtagctgaagtattcaccggtgctcctggtaaatacgtgccactgaaagaaactatcagcggctttaaaggcatcctggaaggccagtacgacgatctgccagagcaggcgttctacatggttggcggtatcgacgaagcgatcgagaaagctaaaggcatgtaa

SEQ ID NO: 6941 - protein, 458 aa, Oceanospirillum sp. MED92
MSSGTIVQIIGAVVDVEFPRDSVPKVYDALTVTKNGLTLEVQQQLGDGVVRAIAMGQTEGVSRGQDVANTGAPVSVPVGTATLGRIMDVLGNPIDECGEIGEEERMPIHRKAPSYDEQAASNELLETGIKVIDLVCPFAKGGKVGLFGGAGVGKTVNMMELIRNIAIEHSGFSVFAGVGERTREGNDFYYEMKESNVLDKVSLVYGQMNEPPGNRLRVALTGLTMAEKFRDEGRDVLLFVDNIYRYTLAGTEVSALLGRMPSAVGYQPTLAEEMGVLQERITSTKTGSITSIQAVYVPADDLTDPSPATTFSHLDATVVLSRQIAELGIYPAVDPLDSTSRQLDPLVIGTEHYEIARNVQGVLQRYKELKDIIAILGMDELSEEDKSLVARARKIQRFLSQPFFVAEVFTGAPGKYVPLKETISGFKGILEGQYDDLPEQAFYMVGGIDEAIEKAKGM

SEQ ID NO: 6942 - DNA, 1437 bp, Xanthobacter autotrophicus Py2
  CDS (1)..(1437): transl_table=11
atggcgaacaaggtcggacgcatcacccaggtcatcggcgccgtcgtggacgtgcagttcgacggccatctgccggaaatcctcaacgcgctggagaccaccaaccagggcaaccggctggtgctcgaagtggcgcagcacctcggtgagagcaccgtgcgctgtatcgccatggacgctaccgaaggtctggtgcgtggcctcgaggtcaccgataccggcgcgccgatccaggtgccggtgggtgccggcaccctcggccgcatcatgaacgtcatcggcgagccggtggacgagcttggcccgatcgaggcggaagccacccgcggcatccaccagccggccccctcctatgcggagcaggccacggaagccgagatcctcgtcaccggcatcaaggtggtggacctcctcgccccctacgccaagggcggcaaggtgggcctgttcggcggcgcaggcgtgggcaagaccgtgctcatcatggagctgatcaacaacgtggcgaaggcgcacggcggctattccgtgttcgccggcgtgggtgagcgcacccgcgagggcaacgacctctaccacgagatgatcgagtccaacgtgaacaaggacccgcacgagaacggtggttccgccgccggttccaagtgcgccctggtgtacggccagatgaacgagcctccgggcgcccgcgcccgcgtggcgctgaccggcctcaccgtcgccgagcacttccgcgaccagggccaggacgtgctgttcttcgtggacaacatcttccgcttcacccaggccggctcggaagtgtcggctctgctcggccgcattccctcggcggtgggctaccagccgacgctggccaccgacatgggcgcgctccaggagcgcatcaccaccaccaccaagggctcgatcacctcggtgcaggccatctacgtgccggccgacgacctgaccgacccggcgcctgccgcctccttcgcccatctggacgccaccaccgtgctgtcgcgctccatcgcggaaaagggcatctacccggcggtggatccgctggactccacctcgcgcatgctctcccccgccatcctcggcgacgagcactacaacaccgcgcgtcaggtccagcagaccctgcagcgctacaaggctctccaggacatcatcgccatcctgggcatggacgagctcagcgaagaggacaagatcacggtcgcccgcgcccgcaagatcgagcgcttcctctcgcagcccttccacgtggcggaagtgttcaccggctccccgggcaagctcgtggacctgaaggacaccatcgccggcttcaagggcctggtggaaggcaagtacgactacctgcccgagcaggccttctacatggtcggctccatggaagaagccatcgagaagggcaagaagctcgcggccgaggcggcctga

SEQ ID NO: 6943 - protein, 478 aa, Xanthobacter autotrophicus Py2
MANKVGRITQVIGAVVDVQFDGHLPEILNALETTNQGNRLVLEVAQHLGESTVRCIAMDATEGLVRGLEVTDTGAPIQVPVGAGTLGRIMNVIGEPVDELGPIEAEATRGIHQPAPSYAEQATEAEILVTGIKVVDLLAPYAKGGKVGLFGGAGVGKTVLIMELINNVAKAHGGYSVFAGVGERTREGNDLYHEMIESNVNKDPHENGGSAAGSKCALVYGQMNEPPGARARVALTGLTVAEHFRDQGQDVLFFVDNIFRFTQAGSEVSALLGRIPSAVGYQPTLATDMGALQERITTTTKGSITSVQAIYVPADDLTDPAPAASFAHLDATTVLSRSIAEKGIYPAVDPLDSTSRMLSPAILGDEHYNTARQVQQTLQRYKALQDIIAILGMDELSEEDKITVARARKIERFLSQPFHVAEVFTGSPGKLVDLKDTIAGFKGLVEGKYDYLPEQAFYMVGSMEEAIEKGKKLAAEAA

SEQ ID NO: 6944 - DNA, 1512 bp, Flavobacteria bacterium BBFL7
  CDS (1)..(1512): transl_table=11
atgtctcaaattacaggtagcgtttcacaaatcatcggtccggtggttgacgtaacatttgatagtgcacaaggcgcacttcctaaaatttatgattctcttgaagtagaacttaatggtaatcttctcgttttagaagtacagtctcacattggtgagaacactgtaagaaccatttctatggattcaacagatggtctttctcgtggaaccgctgtaaaatcaacagggaaccctattaaaatgcctatcggagatgacgtatatggtcgtctttttaatgttatcggtgatgcgattgatggattaggtaaccttcctaaaacaggagataatggtttatctattcacagatctgcgccagcatttgaggatctttctacatctacagaagtgcttttcacaggtattaaagtaatcgatctaattgaaccttatgcaaaaggtggtaagattggacttttcggtggtgctggagtaggtaaaacagtattgattcaagaattgattaataacattgcaaaaggtcacggtggactttcagtatttgctggagttggtgagcgtacgcgtgaaggtaatgaccttttacgtgagatgttagaatcaggtattataaaatacggagatgcatttatgcactctatggaagaaggcggatgggatctacaaaaggtagataaggaaatcatgaaagattcaaaagcgactttcgtttttggtcagatgaatgagccaccaggagcacgtgcacgtgttgcactttctggacttactattgctgagtatttccgtgatggagctggagatggacaagggaaagacgtacttttcttcgttgataatattttccgttttactcaagcaggttctgaggtatctgcacttctaggtcgtatgccatctgcggtaggatatcagcctacactagcaactgagatgggagcgatgcaagaacgtattacttcaacaaagaaaggatctattacatctgtacaagcggtatacgtacctgcagatgaccttaccgatcctgcaccagcaacaacatttgctcacttagatgcaacgacggtactttcacgtaagattgcagagctaggtatctacccagcggtggatcctttagattctacttcacgtattctaaccgcagagatcttaggaaaagagcactatgagtgtgctcaaaacgtaaaagaattattacaacgttataaagagcttcaagatattattgccattctaggaatggaagaattatctgaagaagataaacttgcagtaagccgtgcacgtcgtgtacaacgtttcttatctcaaccattccacgtagcagagcagtttactggtcttaaaggtgtgttagttgacattaaagatactatcaaaggatttaatatgattatggacggtgagttagatcacttaccagaaagtgcatttaaccttaaaggtactattgaagaagcaattgaggcaggagaaaaaatgcttgctgaggtatcataa

SEQ ID NO: 6945 - protein, 503 aa, Flavobacteria bacterium BBFL7
MSQITGSVSQIIGPVVDVTFDSAQGALPKIYDSLEVELNGNLLVLEVQSHIGENTVRTISMDSTDGLSRGTAVKSTGNPIKMPIGDDVYGRLFNVIGDAIDGLGNLPKTGDNGLSIHRSAPAFEDLSTSTEVLFTGIKVIDLIEPYAKGGKIGLFGGAGVGKTVLIQELINNIAKGHGGLSVFAGVGERTREGNDLLREMLESGIIKYGDAFMHSMEEGGWDLQKVDKEIMKDSKATFVFGQMNEPPGARARVALSGLTIAEYFRDGAGDGQGKDVLFFVDNIFRFTQAGSEVSALLGRMPSAVGYQPTLATEMGAMQERITSTKKGSITSVQAVYVPADDLTDPAPATTFAHLDATTVLSRKIAELGIYPAVDPLDSTSRILTAEILGKEHYECAQNVKELLQRYKELQDIIAILGMEELSEEDKLAVSRARRVQRFLSQPFHVAEQFTGLKGVLVDIKDTIKGFNMIMDGELDHLPESAFNLKGTIEEAIEAGEKMLAEVS

SEQ ID NO: 6946 - DNA, 1398 bp, marine gamma proteobacterium HTCC2207
  CDS (1)..(1398): transl_table=11
atgagtagcggaagaatcgtacaaattattggtgctgtgatcgatgtggaatttgcacgtgatcaggtgcccagcgtatatgacgcactagtcgtcgacggcaagggtttgaccctcgaagttcagcagcagttgggtgacggtgttgtccgtactattgctatgggtgcatctgaaggcgttagccgtgggttgggcgtggttaataccaaagcgccaatttcagtaccagttggtgttgaaacgctcggacgcatcatggatgttctgggtaacccaatcgatgagaaaggccctatcggtgaaaaagagcgcatggcgattcaccgcaagccaccagcctatgacgagctggcggcttctgacgatttgctcgagactggtatcaaggtaatcgacttggtttgtcctttcgctaaaggcggtaaggttggattgttcggtggtgctggtgttggtaaaaccgtaaatatgatggagctaatcaacaacattgcaacagagcacagtggtctgtctgtatttgctggtgttggtgagcgtactcgtgaaggtaatgacttttactacgagatgcaggaatccggtgttgtaaacatcgagactccaagtgaatctaaagtagcgatggtctacggtcagatgaatgagcctccaggaaaccgtctgcgtgttgctctgactggtttgaccatggcagagaaattccgtgacgaaggtaaagacgtactgttgttcgttgataatatctaccgttacacattggcaggtactgaagtatcagcactgttgggccgtatgccttcagctgtaggctaccagcctactttggcagaagagatgggtgttcttcaggagcgtatcacctcgactaagaccggttctattacatcggttcaggcggtatacgtaccggcggatgatttgaccgatccctctcctgctactacatttgctcaccttgactccaccgttgtactgagccgtgatattgcttctaaaggtatttacccagcggtagatccactggattcaacctcacgtcagctcgatccattgattattggcaccgagcactatgcggttgctcgtggtgtacagtcagtgctgcagcgctacaaagagttgaaagatattattgcgatcctgggtatggacgagctgtctgaagaagacaaaatggccgtagcccgagcgcgtaagatcgagcgtttcttgtcacagccattccatgtagctgaaatctttaccggctctccaggtaagtacgtttctcttaaagacactattgctggcttccagggtattttggacggacagtatgatgatcttcctgagcaggcgttctatatggttggctctatcgatgaggcagtagaaaaagctaaaaagctataa

SEQ ID NO: 6947 - protein, 465 aa, marine gamma proteobacterium HTCC2207
MSSGRIVQIIGAVIDVEFARDQVPSVYDALVVDGKGLTLEVQQQLGDGVVRTIAMGASEGVSRGLGVVNTKAPISVPVGVETLGRIMDVLGNPIDEKGPIGEKERMAIHRKPPAYDELAASDDLLETGIKVIDLVCPFAKGGKVGLFGGAGVGKTVNMMELINNIATEHSGLSVFAGVGERTREGNDFYYEMQESGVVNIETPSESKVAMVYGQMNEPPGNRLRVALTGLTMAEKFRDEGKDVLLFVDNIYRYTLAGTEVSALLGRMPSAVGYQPTLAEEMGVLQERITSTKTGSITSVQAVYVPADDLTDPSPATTFAHLDSTVVLSRDIASKGIYPAVDPLDSTSRQLDPLIIGTEHYAVARGVQSVLQRYKELKDIIAILGMDELSEEDKMAVARARKIERFLSQPFHVAEIFTGSPGKYVSLKDTIAGFQGILDGQYDDLPEQAFYMVGSIDEAVEKAKKL

SEQ ID NO: 6948 - DNA, 1422 bp, delta proteobacterium MLMS-1
  CDS (1)..(1422): transl_table=11
atgagcgaggttaacacgggaaaggttattcaggtcgtcggaccggtggttgacgttgaatttgagccgggcaagcttccggagatcatgaacgctctgctgatcagcaacaagggcttgagcgacgaggccgacaacctggtggttgaggtggcccagcatctgggtgataacgtggtgcggtgcgtgtccatggacggcaccgacggtctggtgcggggtcaggaagccaaggataccggtaagcccattgagattccctgcggccagaacgccctgggtcggatcatgaacgtggttggccgctcggtggacggtatgggcaagatcgagtccgacaaaatgcggcccattcacaagccagcgccgctgtttacagagcaggataccgaggtccacgtcctggaaaccgggatcaaagttatcgacctgctggtacccttcccccggggcggtaaaatggggctgttcggcggggccggttgcggtaagaccgttattatgatggaaatggtcaacaacattgccatgcaccatggcggtatttcggtattctgcggggtcggtgagcggacccgggaaggaaacgacctttatcacgaaatgaaggaatccggagttttgcccaaggcggccctggtatacggccagatgaccgagcctccgggagcccgcagccgagtggccctgaccgggctgtcggcggccgagtacttccgtgacgaggaaggccaggacgtgctgttgtttgttgataacatcttccgttttacccaggccggccaggaagtatcggccctgttgggtcggattccgtcggcggttggttatcaacccaccctgggaaccgacttaggtggcctgcaggagcggattacttccaccaacaaagggtcgatcaccgccgtccagtgtgtttacgtccctgccgacgacctcaccgacccggctccggccaccacctttgcccaccttgacggtaccgtggtcctttcccggcagatcgccgagctgggtatttaccccgccgttgatcccctggactccacctcccggattctcgatcccaacgtactgggtgaagaccactacctggtggcgcgcggggtgcagatgaccctgcagaagtacaaggatctgcaggacatcatcgccattctggggatggatgagctttccgaagaagatcagctcaccgtctcccgggcccggaagatgcagcgcttcctttcccagcccttcacggtggccgagaccttcaccgggatggccggcaagtacgtaaaagttgaagataccgtccgcggcttcaaggagatcctggaaggcaaacacgacgagttgcctgaaagcgctttctacatggtgggcagcatcgacgaggcggtggagaaggccggtaaggaaaaggctgaagcctaa

SEQ ID NO: 6949 - protein, 473 aa, delta proteobacterium MLMS-1
MSEVNTGKVIQVVGPVVDVEFEPGKLPEIMNALLISNKGLSDEADNLVVEVAQHLGDNVVRCVSMDGTDGLVRGQEAKDTGKPIEIPCGQNALGRIMNVVGRSVDGMGKIESDKMRPIHKPAPLFTEQDTEVHVLETGIKVIDLLVPFPRGGKMGLFGGAGCGKTVIMMEMVNNIAMHHGGISVFCGVGERTREGNDLYHEMKESGVLPKAALVYGQMTEPPGARSRVALTGLSAAEYFRDEEGQDVLLFVDNIFRFTQAGQEVSALLGRIPSAVGYQPTLGTDLGGLQERITSTNKGSITAVQCVYVPADDLTDPAPATTFAHLDGTVVLSRQIAELGIYPAVDPLDSTSRILDPNVLGEDHYLVARGVQMTLQKYKDLQDIIAILGMDELSEEDQLTVSRARKMQRFLSQPFTVAETFTGMAGKYVKVEDTVRGFKEILEGKHDELPESAFYMVGSIDEAVEKAGKEKAEA

SEQ ID NO: 6950 - DNA, 1407 bp, Rickettsiella grylli
  CDS (1)..(1407): transl_table=11
atgaagagtaatcttatgatgaagtcaatcaaacccattgggtctatcgtcgaaattattggtgccgttatcgatgtcgaatttccaagaggcgagattcccaaagtttttgatgcgttaaccgttgatggccatgatttagtgttagaggtccaacaacagctaggtgacggtattgtacgaactatcgcgatgggtacgagcgatggtttaaagcgtggaacaaaagtcatgaataccaaagcaccgattagtgtgcctgtcgggaagcagactttaggtcgaatcatggatgtattaggtaagcctatcgacgaagcaggtcctatccatgaagaaattcgtttaccgattcatcgcaagccccccactttttctgaacaagccgtgaatgagcaattacttgaaacagggattaaagtcattgatttactttgtccctttgctaaaggtggaaaggttggtttgtttggcggcgcaggtgttggtaaaaccgttaacatgatggaattgatacgtaatattgcgattgaacatagtggatattctgtatttgcaggtgttggagaacgaacacgggaaggtaatgatttctaccatgagatgaaagaatccaacgtgttagataaagtatcattagtttatggtcaaatgaatgaaccgccaggtaatcgtttacgcgtcgcattaacaggtttgacagtagccgaatatttccgtgatgaaggtcgcgatatcttattatttatagataatatttatcgctataccttggctggcgtcgaagtctctgcattattaggacgtatgccttctgctgtggggtatcaaccaaccttagccgcagaaatgggtgctttacaagagcgtattacgtcaacaaaaacaggttctattacttctattcaagcggtttatgttccagcggacgatctgaccgatccttcacccgcaacgacttttgcacacctcgacgcaacggtcgtattatcacgccaaattgctgaactgggtatttatccagcaatagatccgttagattcgaatagccgtcaattggatccgttgattgttgggcaagaacattatgacgttgcgcgggcggtacaaaaaacattgcagcggtttaaagagttaaaggatattattgctattttaggtatggatgaattatcagagcacgataaattgacggttatgcgggctagaaagatacaacgttttttatctcagcctttttttgttgctgaaatattcaccggatctccaggaaaatatgtcagccttagagagacaattcgtggttttaaagcgattttaaatggtgagtttgatgattatcccgaactcgcgttttacatggttggaagtatcgatgaagtggaaattaaagcaaaagccttgtag

SEQ ID NO: 6951 - protein, 468 aa, Rickettsiella grylli
MKSNLMMKSIKPIGSIVEIIGAVIDVEFPRGEIPKVFDALTVDGHDLVLEVQQQLGDGIVRTIAMGTSDGLKRGTKVMNTKAPISVPVGKQTLGRIMDVLGKPIDEAGPIHEEIRLPIHRKPPTFSEQAVNEQLLETGIKVIDLLCPFAKGGKVGLFGGAGVGKTVNMMELIRNIAIEHSGYSVFAGVGERTREGNDFYHEMKESNVLDKVSLVYGQMNEPPGNRLRVALTGLTVAEYFRDEGRDILLFIDNIYRYTLAGVEVSALLGRMPSAVGYQPTLAAEMGALQERITSTKTGSITSIQAVYVPADDLTDPSPATTFAHLDATVVLSRQIAELGIYPAIDPLDSNSRQLDPLIVGQEHYDVARAVQKTLQRFKELKDIIAILGMDELSEHDKLTVMRARKIQRFLSQPFFVAEIFTGSPGKYVSLRETIRGFKAILNGEFDDYPELAFYMVGSIDEVEIKAKAL

SEQ ID NO: 6952 - DNA, 1377 bp, Oceanobacter sp. RED65
  CDS (1)..(1377): transl_table=11
atgagtagcggaaagatcgttcagatcatcggtgctgtaatcgacgtggaattcccacgtgattctgtaccaaaagtatatgacgcgcttaaagttgaaggcggaaagattacgctagaagttcaacaacaattaggcgacggtatggttcgtaccatcgctatgggttctactgaaggtcttaagcgcggcctagtagcagaaaacaccaatcaaccgatccaagtaccagtgggtaaagaaaccctaggtcgtatcatggacgtgttgggtgacccaatcgacgaaaaaggcccaatcggcgaacaagagcgtgcctctattcaccgtaaagccccatcttacgacgaacaagctggtggccaagagctactagaaaccggcgtaaaagtaatcgaccttgtttgcccattcgctaagggtggtaaagttggtctattcggtggtgcgggtgttggtaaaaccgtaaacatgatggagcttatccgtaacatcgcaatcgagcacagtggttactctgtattcgccggtgttggtgagcgtactcgtgaaggtaacgacttctaccacgagatgtctgagtctaacgtattggacaaagtatctctggtttacggtcagatgaatgagccaccaggtaaccgtctacgtgttgcactaactggcttgaccatggctgaaaaattccgtgacgaaggtcgtgacgtactattgttcgtcgacaacatctatcgttacacactagcgggtactgaggtatcagcactgctaggtcgtatgccatctgcggtaggttatcagcctactctagcagaagagatgggtgtacttcaggagcgtatcacgtcaactaagaaaggttcgatcacatctgtacaagcggtatacgtacctgcggatgacttgactgacccgtctcctgctacaacgttcgcccacttggacgcaaccgttgtattgagccgtgacatcgcttctaaaggtatctacccagcgatcgatccattggattcaacgtctcgtcagcttgacccactagtaattggtcaagagcactacgacatcgctcgtggcgtacagactgtacttcagcgcttcaaagagctgaaagacatcatcgccatcttaggtatggacgaactatctgaagaagacaagctaactgtagctcgtgctcgtaagatcgagcgtttcttgtctcagccgttcttcgttgcagaagtattcacaggcgcacctggtaagtacgtatctttgaaagaaaccattcgtggcttcaaaggtatcttagaaggtgagttcgatgatcttcctgagcaagctttctacatggttggtaccatggacgaagccatcgagaaggcgaaaaacctttaa

SEQ ID NO: 6953 - protein, 458 aa, Oceanobacter sp. RED65
MSSGKIVQIIGAVIDVEFPRDSVPKVYDALKVEGGKITLEVQQQLGDGMVRTIAMGSTEGLKRGLVAENTNQPIQVPVGKETLGRIMDVLGDPIDEKGPIGEQERASIHRKAPSYDEQAGGQELLETGVKVIDLVCPFAKGGKVGLFGGAGVGKTVNMMELIRNIAIEHSGYSVFAGVGERTREGNDFYHEMSESNVLDKVSLVYGQMNEPPGNRLRVALTGLTMAEKFRDEGRDVLLFVDNIYRYTLAGTEVSALLGRMPSAVGYQPTLAEEMGVLQERITSTKKGSITSVQAVYVPADDLTDPSPATTFAHLDATVVLSRDIASKGIYPAIDPLDSTSRQLDPLVIGQEHYDIARGVQTVLQRFKELKDIIAILGMDELSEEDKLTVARARKIERFLSQPFFVAEVFTGAPGKYVSLKETIRGFKGILEGEFDDLPEQAFYMVGTMDEAIEKAKNL

SEQ ID NO: 6954 - DNA, 1398 bp, marine gamma proteobacterium HTCC2143
  CDS (1)..(1398): transl_table=11
atgagtagcggacaaatcgttcaaatcattggcgcggtaatcgatgtggaatttccacgggattcagtaccgcaggtttatgatgcactaacagtcactgaaaaagcactaaccctagaagtacagcaacaactgggtgatggcgtcgtgcgcacaattgctatgggttcttctgaaggcgttagccgcgggctggtcgtagagtccacaggcgcgcctatttcggtaccggttggtattgagacattaggacgcataatggatgttcttggaaatccaattgacgagtgcggtccaattggcgaaaaggaacgggcttctattcatcggaaggcacccgcatacgatgaactttcagcctctgaagacttgctggagacaggcatcaaagtaattgatttgatttgcccgtttgccaagggtggtaaagttggtctgttcggtggagctggtgttggtaaaaccgtaaacatgatggaactgatcaataacatagctctggagcactctggcttgtcagtttttgccggtgttggagaacgtacccgagaaggtaacgatttctactatgagatgcaggaatcaggcgttgtaaatattgaagagccaagtaaatcgaaagttgcgatggtttatggtcagatgaatgagccaccaggaaataggttgcgcgttgctttgaccggcttgacgatggcagaaaaatttcgtgacgaaggtaaagatgttctactatttgttgataacatttaccgctatacattggccggaacagaagtgtcggcgctgttaggccgcatgccttcagcggttggttaccagccaacactggcgcaggaaatgggcgaattgcaggagcggattacgtctactaaaactggttccatcacgtcgattcaagcggtttacgtaccagcggacgatttgactgacccatcacctgctactacgtttgctcaccttgattctacggttgtattgtcgcgtgatatcgctgctaaaggtatttaccctgcggttgatccgctagactctacgtcacgtcagttagatccgctaattatcggtactgagcattacgacacggctcgcggtgtacaatctgttttgcagcgttataaagagctgaaagacatcattgcaatattgggcatggacgagctgtctgaagaagataagcaaacggtaaaccgcgcgcggaagatcgaacggtttttgtcacagccatttcacgtcgctgaggtatttactgggtcacctggcaaatatgtatcgctgaaagataccattgccggctttaccgggattctggcgggcgaatatgatcacataccagagcaagcgtttctgatgtgcggtggtattgatgacgtgttggaaaacgcgaaaaaattataa

SEQ ID NO: 6955 - protein, 465 aa, marine gamma proteobacterium HTCC2143
MSSGQIVQIIGAVIDVEFPRDSVPQVYDALTVTEKALTLEVQQQLGDGVVRTIAMGSSEGVSRGLVVESTGAPISVPVGIETLGRIMDVLGNPIDECGPIGEKERASIHRKAPAYDELSASEDLLETGIKVIDLICPFAKGGKVGLFGGAGVGKTVNMMELINNIALEHSGLSVFAGVGERTREGNDFYYEMQESGVVNIEEPSKSKVAMVYGQMNEPPGNRLRVALTGLTMAEKFRDEGKDVLLFVDNIYRYTLAGTEVSALLGRMPSAVGYQPTLAQEMGELQERITSTKTGSITSIQAVYVPADDLTDPSPATTFAHLDSTVVLSRDIAAKGIYPAVDPLDSTSRQLDPLIIGTEHYDTARGVQSVLQRYKELKDIIAILGMDELSEEDKQTVNRARKIERFLSQPFHVAEVFTGSPGKYVSLKDTIAGFTGILAGEYDHIPEQAFLMCGGIDDVLENAKKL

SEQ ID NO: 6956 - DNA, 1398 bp, marine gamma proteobacterium HTCC2080
  CDS (1)..(1398): transl_table=11
atgagtagtggaaaagtcgtacaggtgattggcgcggttattgatgtagagtttccccgcgacaacgtaccccaggtttacgatgcgctgtctgtcagtgagaagggtttgacactcgaagtgcaacagcaactcggtgatggcgtcgttcgcgcaattgctatgggatcttccgaaggcattagccggggattgtcggttgagaatacgggagcaccgatttcagttcctgttggtattgaaaccttaggccgcattatggacgttcttgggaaccccatcgatgagaaggggcctattggtgagcagcagcgcagtgcgattcaccgagctgcgccggcatatgatgagctcgctgcttctgaagaggttttggaaaccggcattaaagtcatcgatttagtttgtccctttgctaaaggcggtaaggtcggtttgtttggtggtgctggtgttggcaagaccgtcaacatgatggaactgattaacaacattgctaccgagcactcggggttatccgtttttgctggtgttggtgagcgaacacgagaaggcaacgacttctattacgaaatgcaggaatcaggagttgttaacatcgagaacatggaccagtcgaaagtggcgatggtctacggccaaatgaatgagccgcctggaaaccgactgcgtgttgctttgacaggcttaacgatggcggagaaatttcgtgatgaaggtcgcgatgttctgttgttcgttgataatatttatcgttataccttggcgggaaccgaagtttcggcgttgttaggtcgtatgccgtctgcagtgggttatcagccgacactcgcggaggaaatgggcgttttgcaagagcgcattacctcaacaaaaacaggatcaatcacctcaattcaagcggtttacgttcccgccgatgacttgactgacccctcaccggcaacgacttttgcacacttggactctacagtggtgctaagtcgagatatcgcggccaagggcatttatccagcggttgatcccttagattcgacctctcgccaactggatccactggttattggaaccgagcattacgacgtggctcgaggcgtgcaatcggtcttacagcgttataaggaactgaaagatattattgctattctgggcatggacgagctatctgaagaagataagctcacagtgtcgcgagcgcgaaaaattgagcgatttttgtctcagcctttccacgtcgcagagattttcacaggatccccaggcatctacgtatcattaaaagatacgattgccgggttcaaaggcattttggcgggtgaatatgaccaccttccagagcaggccttctacatggtgggctctattgagcaagccgtagaacgagctgagaagctttaa

SEQ ID NO: 6957 - protein, 465 aa, marine gamma proteobacterium HTCC2080
MSSGKVVQVIGAVIDVEFPRDNVPQVYDALSVSEKGLTLEVQQQLGDGVVRAIAMGSSEGISRGLSVENTGAPISVPVGIETLGRIMDVLGNPIDEKGPIGEQQRSAIHRAAPAYDELAASEEVLETGIKVIDLVCPFAKGGKVGLFGGAGVGKTVNMMELINNIATEHSGLSVFAGVGERTREGNDFYYEMQESGVVNIENMDQSKVAMVYGQMNEPPGNRLRVALTGLTMAEKFRDEGRDVLLFVDNIYRYTLAGTEVSALLGRMPSAVGYQPTLAEEMGVLQERITSTKTGSITSIQAVYVPADDLTDPSPATTFAHLDSTVVLSRDIAAKGIYPAVDPLDSTSRQLDPLVIGTEHYDVARGVQSVLQRYKELKDIIAILGMDELSEEDKLTVSRARKIERFLSQPFHVAEIFTGSPGIYVSLKDTIAGFKGILAGEYDHLPEQAFYMVGSIEQAVERAEKL

SEQ ID NO: 6958 - DNA, 1404 bp, Candidatus Desulfococcus oleovorans Hxd3
  CDS (1)..(1404): transl_table=11
atgagtgacaatatcggaaaggtcgtacaggtcatggggcctgtggtggacgtcgagtttgaacccggcaagttgcccgcgattctgacagcgctgttgattaccaataccgtcattaatgatgaggcggacaacctggtggttgaggttgcccagcaccttggcgacaacgtggtgcgcaccattgccatggacgttaccgacggtctggtgaggggcatgccggtaaaggacaccggtgctcccattaccatgcctgttggcgcggcctctcttggtcgtgtgctcaacgtggtgggaaaacccgtggacggcctgggccctgtcagccgtgaaaagaccatgccgattcaccgtcccgcgcctctgttcactgagcaggacaccagcgtgaacgttctggaaaccggcatcaaggttattgacctgctggtgccctttcccagaggcggcaagatgggtctgttcggcggcgctggcgtgggcaagaccgttatcatgatggaaatggtcaacaacatcgccatgcagcacggcggtatttccgtgtttgccggtgtgggcgagcggacccgtgaaggcaacgacctttaccatgaaatgaaggattccggggttcttcccaaggcggccctgatttacggtcagatgaccgagccccccggggcccgtgcccgtgtggccctttccgcgctgacctgcgccgaatatttccgtgatgtggaaggccaggacgtgctgatcttcatcgacaacatcttccggtttacccaggccggcgccgaagtctccgcccttctgggccgcattccctcggcggtgggttatcagccgacactggcggtggaccttggcggccttcaggagcggatcacctcaaccgacaagggctccattaccgcggttcagtgcgtgtacgtgcccgcggacgaccttaccgacccggcccctgccaccacctttgcccatctggacggtacagtggtgctttcccgtcagatcgccgagctgggcatttacccctcggtggacccgctggactccacctcccgtattctggacgcggcctatatcggtgaggagcattaccgggtggcccgggaggttcagcagacccttcagaaatacaaggaactccaggacattatcgccatcctcggtatggatgagctttccgatgaggacaaggtcacggttgagcgggccagaaagcttcagcgcttcctgtctcagcccttccatgtggccgaggtcttcaccggcaagcccggctcctatgtcaagattgaagacacggttcgaagcttcaaggagatctgtgacggcaagcatgacgaccttccggagtcggccttttacatggtgggcagcattgaagaagccgttgcaaaagccaaaggctaa

SEQ ID NO: 6959 - protein, 467 aa, Candidatus Desulfococcus oleovorans Hxd3
MSDNIGKVVQVMGPVVDVEFEPGKLPAILTALLITNTVINDEADNLVVEVAQHLGDNVVRTIAMDVTDGLVRGMPVKDTGAPITMPVGAASLGRVLNVVGKPVDGLGPVSREKTMPIHRPAPLFTEQDTSVNVLETGIKVIDLLVPFPRGGKMGLFGGAGVGKTVIMMEMVNNIAMQHGGISVFAGVGERTREGNDLYHEMKDSGVLPKAALIYGQMTEPPGARARVALSALTCAEYFRDVEGQDVLIFIDNIFRFTQAGAEVSALLGRIPSAVGYQPTLAVDLGGLQERITSTDKGSITAVQCVYVPADDLTDPAPATTFAHLDGTVVLSRQIAELGIYPSVDPLDSTSRILDAAYIGEEHYRVAREVQQTLQKYKELQDIIAILGMDELSDEDKVTVERARKLQRFLSQPFHVAEVFTGKPGSYVKIEDTVRSFKEICDGKHDDLPESAFYMVGSIEEAVAKAKG

SEQ ID NO: 6960 - DNA, 1377 bp, Pseudomonas putida GB-1
  CDS (1)..(1377): transl_table=11
atgagtagcggacgtatcgttcaaatcatcggcgccgtcatcgacgtggaattcccacgtgacgtcgtgccgagtgtatacaacgcgctgaaagtacaaggcgcggaaaccaccctggaagttcagcagcagctgggcgacggcgtggttcgtaccattgcgatgggctcgaccgaaggcctgaagcgtggtctggatgtcgtcgacaccggcgctgccatttccgtccctgttggtaaggccactctgggccgtatcatggacgtactgggcaacccgatcgacgaagccggcccgatcggcgaagaagagcgtcgcggtatccaccagccagcgccttcgttcgctgaccaggcaggcggcaacgacctgctggaaactggcatcaaggttatcgacctggtttgcccgttcgccaagggtggtaaagttggtctgttcggtggtgccggtgtcggcaagaccgtaaacatgatggaactgatccgtaacatcgccatggaacacagcggttactccgtgttcgctggtgtgggtgagcgtactcgtgagggtaacgacttctaccacgagatgaaggactccaacgttctcgacaaagtagcgctggtctacggtcagatgaacgagccaccaggaaaccgtctgcgcgtagcgctgaccggcctgaccatggctgagaagttccgtgacgaaggtaacgacgttctgctgttcgtcgacaacatctatcgttacaccctggccggtactgaagtatccgcactgctgggccgtatgccttcggcagtaggttaccagccgaccctggctgaagagatgggcgttctgcaagagcgtatcacctccaccaaggaaggttcgatcacctccgtacaggccgtatacgtacctgcggacgacttgaccgacccgtcgccagcgaccaccttcgcccacttggacgccaccgtcgttctgtcccgtgacatcgcctccctgggtatctacccagcagtcgacccactggactcgacttcgcgccagctggacccgaacgtgatcggcaacgagcactacgacaccgctcgtggcgttcagtatgttctgcagcgttacaaagagctgaaggacatcatcgcgatcctgggtatggacgaactgtccgaagacgacaagcaactggtagcccgcgctcgtaagatccagcgcttcctgtcgcagccgttcttcgtggccgaagtcttcaccggttcgccaggcaagtacgtttccctgaaagacaccatcgctggcttcagcggcatcctcaaaggtgactacgaccacctgccagaacaagcgttctacatggtcggcagcatcgacgaagcgatcgagaaagccaagaaactgtaa

SEQ ID NO: 6961 - protein, 458 aa, Pseudomonas putida GB-1
MSSGRIVQIIGAVIDVEFPRDVVPSVYNALKVQGAETTLEVQQQLGDGVVRTIAMGSTEGLKRGLDVVDTGAAISVPVGKATLGRIMDVLGNPIDEAGPIGEEERRGIHQPAPSFADQAGGNDLLETGIKVIDLVCPFAKGGKVGLFGGAGVGKTVNMMELIRNIAMEHSGYSVFAGVGERTREGNDFYHEMKDSNVLDKVALVYGQMNEPPGNRLRVALTGLTMAEKFRDEGNDVLLFVDNIYRYTLAGTEVSALLGRMPSAVGYQPTLAEEMGVLQERITSTKEGSITSVQAVYVPADDLTDPSPATTFAHLDATVVLSRDIASLGIYPAVDPLDSTSRQLDPNVIGNEHYDTARGVQYVLQRYKELKDIIAILGMDELSEDDKQLVARARKIQRFLSQPFFVAEVFTGSPGKYVSLKDTIAGFSGILKGDYDHLPEQAFYMVGSIDEAIEKAKKL

SEQ ID NO: 6962 - DNA, 1440 bp, Marinobacter sp. ELB17
  CDS (1)..(1440): transl_table=11
atgttgaatcaagctattccaggctcagatcagggtagcccggagcctacttctgttactgagcacctcgcaaatggcgaatttgatggagaggtagtcggcattcgcggtggcgttgtcgacgttctttttccgcaagactctccgcgtattcacgatttgctctacgccggcaatctggcgctggaagtcacgtcccttctggaaagcggcgccgtgcgctgtatggcgctggcaccggtacgcgggttgggcctgggtgtttctgtgcgtgctaccggcgcacccattcaggtcccggttggaaacgctgttctgggccgcatgctgaacgttttcggcgagcctattgataacaaacccgcccccgctaccgacattcgccgctctattcaccagccgccaccggcgctggaagaccgagtggtgcacagcgatattctggaaaccggcatcaaagccattgatctgctgtcgcctatcgagcgcggcggcaaaaccgggttgtttggcggcgccggtgtgggcaaaaccgtgctgattaccgagctgattaacaacaccgtgcaggaatacgagggcgtcagcctgttttgcggtattggcgaacgctcccgtgaagccgaagaactctaccgggaaatgggcgacgccggcgtgcgcgacaaaaccgtgatggtgttcgggcagatgaatgaggctcccggtgtgcgctttctggtgggcaaaacagcgcttaccatggccgaatatttccgtgacgataaaaagcaggacgttctgctgctgatcgacaacatttttcgctttgttcaggcaggctcggaagtgtccggtttgatgggccgtatgccgtcacgggtgggctaccaacccacactggccaccgaactggccaccttggaggagcgcatcacctccacccgcaacggttccatcacctctattcaggcggtatacgtgccggcggatgacttcaccgaccctgccgctgcgcatattttttcgcacttgtccgcttcggtggtgctgtcgcgcaagcgcgccagcgaaggcttgtacccggccgtcgaccctcttgcctcggcttctgtgatgctgacgccggcggttgtcggccagcgccactacgacatcgcccgcgcggtgcggcgtaccctggccgattatgaggacttgcgagacattatttccatgctgggtatggaagaactgtcggccgccgatcgcgccgtcgtggcgcgggcgcgacgtttggagcgctatctgacccagccgtttttcactattggttcggtcgacggcgacaacggcaggcgagtgcccatcaaagacacgctgaacgactgcgaaaccatactcaaccagactgaattcaacgataacgaaagcgactattacatgattggctcgctgaaagatttggcgtcatcgtcatga

SEQ ID NO: 6963 - protein, 479 aa, Marinobacter sp. ELB17
MLNQAIPGSDQGSPEPTSVTEHLANGEFDGEVVGIRGGVVDVLFPQDSPRIHDLLYAGNLALEVTSLLESGAVRCMALAPVRGLGLGVSVRATGAPIQVPVGNAVLGRMLNVFGEPIDNKPAPATDIRRSIHQPPPALEDRVVHSDILETGIKAIDLLSPIERGGKTGLFGGAGVGKTVLITELINNTVQEYEGVSLFCGIGERSREAEELYREMGDAGVRDKTVMVFGQMNEAPGVRFLVGKTALTMAEYFRDDKKQDVLLLIDNIFRFVQAGSEVSGLMGRMPSRVGYQPTLATELATLEERITSTRNGSITSIQAVYVPADDFTDPAAAHIFSHLSASVVLSRKRASEGLYPAVDPLASASVMLTPAVVGQRHYDIARAVRRTLADYEDLRDIISMLGMEELSAADRAVVARARRLERYLTQPFFTIGSVDGDNGRRVPIKDTLNDCETILNQTEFNDNESDYYMIGSLKDLASSS

SEQ ID NO: 6964 - DNA, 1395 bp, Marinobacter sp. ELB17
  CDS (1)..(1395): transl_table=11
atgagtagcggacacatcgttcagatcattggcgcggttatcgacgtggaatttccacgtgatgccgtacccggcatttacgacgcactgctgcttgaaggtggcgaaacaactctggaagttcagcaacagctgggcgacggcgttgtacgtaccatcgcgatgggcagcaccgagggcctgaagcgcggcctgaaagcagaaaatacacacaagccgatttcagtacctgtgggcaccaagactcttggccgcatcatggacgttctgggtcgtcctatcgacgaacagggcccaattggcgaagaagagctttgggcgatccaccgcaaagcacccggttatgctgatcaggctgcatctgcagacctgctggaaaccggcatcaaggttatcgatctgatctgcccgtttgccaagggcggcaaagtgggtctgttcggcggcgccggtgtaggcaagaccgttaacatgatggaactgatcaacaacattgcgaaagagcactccggtctctccgtatttgccggtgttggtgagcggactcgtgaaggtaacgacttctactacgagatgaaggactccaacgttcttgataaagtagcgatggtctatggccagatgaacgagcccccgggaaaccgtctgcgtgttgccctgaccggtctgaccatcgccgagaagttccgtgacgaaggccgtgacgttctgtttttcgtggacaacatctaccgttacaccttggccggtaccgaagtatccgcactgctgggccgtatgccttccgcagtaggctatcagcccacgctggcccaagaaatgggtgagttgcaggagcgtattacctccactaaaagcggttccatcacgtccatccaggcggtatacgtaccggcggatgacttgaccgacccgtcaccagccaccaccttctcccaccttgacgccaccgtggtattgagccgtgacatcgcttccaagggtatttacccggcgatcgacccgcttgactccacctcgcgccagctagacccgctggtgattggcgagcagcactacgcggttgcccgtggtgtgcagaatgttctgcaacgctataaggaactaaaagacattatcgccattctgggtatggacgagctgtcggaagatgacaagcagatcgtatcccgtgcccgtaagattgagcgatttctgtctcagccattccacgttgctgaagtatttactggttcaccgggcaagtacgtgtctttgaaagagactatcagcagcttcgaaggcatcctcaatggcgactatgacgatatgcctgaacaggcgttctacatggtcggcaccatggatgaagccgtcgaaaaagcgaaggctatgaaattgaaagaaagtaagtaa

SEQ ID NO: 6965 - protein, 464 aa, Marinobacter sp. ELB17
MSSGHIVQIIGAVIDVEFPRDAVPGIYDALLLEGGETTLEVQQQLGDGVVRTIAMGSTEGLKRGLKAENTHKPISVPVGTKTLGRIMDVLGRPIDEQGPIGEEELWAIHRKAPGYADQAASADLLETGIKVIDLICPFAKGGKVGLFGGAGVGKTVNMMELINNIAKEHSGLSVFAGVGERTREGNDFYYEMKDSNVLDKVAMVYGQMNEPPGNRLRVALTGLTIAEKFRDEGRDVLFFVDNIYRYTLAGTEVSALLGRMPSAVGYQPTLAQEMGELQERITSTKSGSITSIQAVYVPADDLTDPSPATTFSHLDATVVLSRDIASKGIYPAIDPLDSTSRQLDPLVIGEQHYAVARGVQNVLQRYKELKDIIAILGMDELSEDDKQIVSRARKIERFLSQPFHVAEVFTGSPGKYVSLKETISSFEGILNGDYDDMPEQAFYMVGTMDEAVEKAKAMKLKESK

SEQ ID NO: 6966 - DNA, 1401 bp, Herbaspirillum seropedicae
  CDS (1)..(1401): transl_table=11
atggctgatggcaaaatcgttcagtgtatcggcgctgtggtggacgtggagtttccgcgcgatgcgatgcccaaggtttacgatgccttgaaattggaaggttcggatctgaccctggaagtccagcagcagctgggcgacggcgtggtccgtaccattgcgctcggttcgtcggacggtctgcgccgcggcctgaccatctcgaacaccggcaagcccatcacggtgcctgtcggtaccgcgaccctgggtcgcatcatggacgtgctgggcaacccgatcgacgaatgcggtccggtctcgcacgagcaaaccgcgtcgatccaccgcaaggctcccgcctacgacgaactgtcgccctcgcaggagctgctggaaaccggcatcaaggtgattgacctggtctgcccgttcgccaagggtggtaaggtcggtctgttcggtggcgccggtgtgggcaagaccgtgaacatgatggagctgatcaacaacatcgccaaggcgcacagcggtctgtccgtgttcgccggtgtgggtgagcgtacccgtgaaggtaacgacttctaccacgaaatggcagaagccaaggtggtggacctggaaaacccgaccaattccaaggtcgccatggtctacggccagatgaacgaaccgccgggcaaccgtctgcgcgtggcgctgaccggcctgaccatcgcggaaggcttccgtgatgaaggcaaggacgtgctgttcttcgtcgacaacatctaccgttacaccctggccggtaccgaagtgtccgcgctgctgggtcgtatgccttcggccgtgggctaccagccgacgctggccgaagaaatgggccgcctgcaagagcgtatcacctcgaccaagactggctcgatcacctcgatccaggccgtgtacgtccctgcggatgacttgaccgacccgtcgccggcaaccaccttcgcccacttggactcgaccgtcgttctgtcgcgtgacatcgcctcgctgggtatctaccccgccgtcgatccgctggactcgacctcgcgccagctggacccgcaagtggtcggccaggaacactacgagaccgcacgcgctgtccagggcaccctgcagcgctacaaggaactgcgtgacatcatcgccattctgggcatggacgaactggctccggaagacaagctgatcgtcgcacgtgctcgtaagatgcagcgtttcctgtcgcagcccttccacgtcgccgaagtgttcaccggttccccgggcaagtacgtttcgctgaaggacacgatcaagggcttcaagatgatcgccagcggcgaactggaccacctgccggaacaagcgttctacatggtcggtaccatcgacgaagcaatcgaaaaggccaagaagatcaactaa

SEQ ID NO: 6967 - protein, 466 aa, Herbaspirillum seropedicae
MADGKIVQCIGAVVDVEFPRDAMPKVYDALKLEGSDLTLEVQQQLGDGVVRTIALGSSDGLRRGLTISNTGKPITVPVGTATLGRIMDVLGNPIDECGPVSHEQTASIHRKAPAYDELSPSQELLETGIKVIDLVCPFAKGGKVGLFGGAGVGKTVNMMELINNIAKAHSGLSVFAGVGERTREGNDFYHEMAEAKVVDLENPTNSKVAMVYGQMNEPPGNRLRVALTGLTIAEGFRDEGKDVLFFVDNIYRYTLAGTEVSALLGRMPSAVGYQPTLAEEMGRLQERITSTKTGSITSIQAVYVPADDLTDPSPATTFAHLDSTVVLSRDIASLGIYPAVDPLDSTSRQLDPQVVGQEHYETARAVQGTLQRYKELRDIIAILGMDELAPEDKLIVARARKMQRFLSQPFHVAEVFTGSPGKYVSLKDTIKGFKMIASGELDHLPEQAFYMVGTIDEAIEKAKKIN

SEQ ID NO: 6968 - DNA, 1978 bp, Pisum sativum
  CDS (20)..(1705)
ctcctttctctctctgaagatggcttcacgcagactcgtatcgtctctgattcgatcttctcttcgtcgatcctcatcgaaaccctcaatttccgcctcaacttcgaggctcacttctcaatcccgtgcctctccttgcggctatcttcttaaccgcgtagcgcattacgctacttcggccgcagctgctgctcttcctccatctccgcctccagcgaaaaaggagggtcccggtggtggtaaaatcaccgatgagttcaccggtaagggtgcgatcgggcatgtttgtcaggttattggtgccgtcgtcgatgtcagattcgaagagggtttgcctccgatcttgacttctcttgggcttttgggctcacatgaaacgcggttttggacgttggaagttgcgcaatttgggcgagggcgtgtcagaactattgctatggatgctactgaaggtgttgttagagggtggcgtgtgctcaacactggatcccctatcagtgttcctgtcggtagggccaacccctgggcctatcatgaagttattggagagcctattgacgagaagggtgaattgaaaactgagcattttttgcccatccatagagaaggcccttcttttgttgagcaagcaactgaacaggaaattcttgttactggtatcaaggttgttgacctgcttgcaccataccaaagaggaggaaagattgggttgtttggtggtgctggtgttggaaagactgtgcttattatggaacttatcaacaatgttgctaaggcgcatggtggtttctctgtgtttgctggtgttggagaacgaactcgagagggtaatgacctgtacagagaaatgattgagagtggtgtcattaagctgggtgataagcagagtgaaagcaaatgtgctcttgtgtatggccaaatgaacggaccccctggtgcccgtgcgcgtgttggtcttactggacttactgttgctgagcacttccgtgatgctgaagggcaagatgtgcttctttttgttgacaacattttccgtttcactcaagctaactcagaggtgtctcgtttacttggccgtatcccatctgctgttggttaccaaccaacattggctactgacctgggaggtctccaagaacgtattacaacccccaaaaaagggtcaattacccctggccaagctatctacgtgcctgctgacgatttgacagatctggcccccgccactacctttgcacacttggatgccacaacagtgttgtcacgaacgatctctgagcttggtatctatcctgttgtcgacccattggattctacatctcgtatgctttccccacttattttgggtgaggcccactatgaaaccgctcgtggtgtacagaaagtacttcaaaactacaagaatcttcaaggtatcattgcaattttgggaatggatgagctcagtgaagacgataaattgactgttgcccgtgcccgtaagattcagcgattcttgagccagcctttccatgttgcagaagtcttcactggtggccctggcaaatatgttgacttgaaggagaacattactagtttccagggtgtgttggatggcaagtacgatgacctttcagagcagtcattttacatggttggtggtattgaagaggtcattgcgaaggcagagaagattgccaaggaatcagctgcatcttcatcttaatctcacaaatccctcccatcattttgtcttttctttataattgcgaaaatttaataatttaggaactctttcttgcaatgccaaacaacaaaaattttccattttataatttttataatttgaatggtcattcctttcattttgagtgttgttgctgacggtgagatcaaccaaattatgtggccgctttttttccgttgtgttatttaataagtggatgatgcaacagattgtacatttttatttgttaagaacttggatgcatccattgtt

SEQ ID NO: 6969 - protein, 561 aa, Pisum sativum
MASRRLVSSLIRSSLRRSSSKPSISASTSRLTSQSRASPCGYLLNRVAHYATSAAAAALPPSPPPAKKEGPGGGKITDEFTGKGAIGHVCQVIGAVVDVRFEEGLPPILTSLGLLGSHETRFWTLEVAQFGRGRVRTIAMDATEGVVRGWRVLNTGSPISVPVGRANPWAYHEVIGEPIDEKGELKTEHFLPIHREGPSFVEQATEQEILVTGIKVVDLLAPYQRGGKIGLFGGAGVGKTVLIMELINNVAKAHGGFSVFAGVGERTREGNDLYREMIESGVIKLGDKQSESKCALVYGQMNGPPGARARVGLTGLTVAEHFRDAEGQDVLLFVDNIFRFTQANSEVSRLLGRIPSAVGYQPTLATDLGGLQERITTPKKGSITPGQAIYVPADDLTDLAPATTFAHLDATTVLSRTISELGIYPVVDPLDSTSRMLSPLILGEAHYETARGVQKVLQNYKNLQGIIAILGMDELSEDDKLTVARARKIQRFLSQPFHVAEVFTGGPGKYVDLKENITSFQGVLDGKYDDLSEQSFYMVGGIEEVIAKAEKIAKESAASSS

SEQ ID NO: 6970 - DNA, 1389 bp, Moorella thermoacetica
  CDS (1)..(1389): transl_table=11
ttgaacgaaggacaggtggtccaggttattggcccggtggttgacgtcgaattcgccagcgaccgtctgcccgacctgtataacgccatcaccattaaaaccgataagattaatataaccatggaggccatgcagcacctgggcaacaacaccgtccgctgtgtggccctctcctcgaccgacggcctgcagcgagggatgaaggccgttgacaccggccagccaatcaccgtaccggtaggccgggctaccctgggacggctctttaacgtcctgggagaacccattgacaaccagggaccggtagaaaccaccgagaggctgcccattcaccggccggcgccctcctttgaagagcaacagccttctaccgaggtcctggagactggcatcaaggtggtcgacctcctggcgccctacgccaagggcggcaagatcggcctcttcggcggcgccggggtcggcaagacggtcctcatcatggaactcatccgcaacatcgcctatgaacacggcggcttttccgtcttcagcggcgtgggcgagcgtacccgcgagggtaacgacctctacctggagatgaaggaatccggggttctcgaaaagacggccctggtctttggccagatgaacgaacccccgggtgcccgcctgcgggtgggtcttacaggcctgactatgcccgagtacttccgggaccccgaggcccaggacgttctcctcttcatcgacaatatctttcgcttcgtgcagcccggttccgaggtttccgccctcctggcccggatgccctcggcggtgggttatcagcccaccctgcccacagagatggggcccctgcaggaacggattacctccacgaaaaagggttccatcacctccgtgcaagctatctatgtgccggccgacgacctgaccgacccggccccggcgacgaccttcgcccatctggacgccaccacggttctgtcccggcagatcgctgagctgggcatctacccggccgtcgaccccctggactccacctcccgtatcctggacccgcgcgtcctgggagaagagcactaccaggtggtccggggagtccagcaggtactgcagcgttataaagaactccaggacattatcgccatcctgggaatggatgagctgtccgaagatgataaactcatagtagcccgggcacgcaagatccagcgtttcctctcccagcccttccacgtagccgaggcttttaccggccagcccggggtttatgtgcccctgaaggaaaccattcgcggtttcaaagagatcctggagggccgccacgacaacctccccgagcaggccttctatatggtcgggaccatcgacgaagccgtcaagaagggccaggagttgatgtag

SEQ ID NO: 6971 - protein, 462 aa, Moorella thermoacetica
MNEGQVVQVIGPVVDVEFASDRLPDLYNAITIKTDKINITMEAMQHLGNNTVRCVALSSTDGLQRGMKAVDTGQPITVPVGRATLGRLFNVLGEPIDNQGPVETTERLPIHRPAPSFEEQQPSTEVLETGIKVVDLLAPYAKGGKIGLFGGAGVGKTVLIMELIRNIAYEHGGFSVFSGVGERTREGNDLYLEMKESGVLEKTALVFGQMNEPPGARLRVGLTGLTMPEYFRDPEAQDVLLFIDNIFRFVQPGSEVSALLARMPSAVGYQPTLPTEMGPLQERITSTKKGSITSVQAIYVPADDLTDPAPATTFAHLDATTVLSRQIAELGIYPAVDPLDSTSRILDPRVLGEEHYQVVRGVQQVLQRYKELQDIIAILGMDELSEDDKLIVARARKIQRFLSQPFHVAEAFTGQPGVYVPLKETIRGFKEILEGRHDNLPEQAFYMVGTIDEAVKKGQELM

SEQ ID NO: 6972 - DNA, 1410 bp, Methanosarcina barkeri
  CDS (1)..(1410): transl_table=11
atggtagatcgaagtcggctcttgaatctcggtaaggtcatctcggtgcgcggcagcattgtagatgtattgttcgagaagcacttgccacctgtatatacactgctacgtgcaggaagagaaagccaaattgccatagaagttttgacgcaacttgacgcacatcatgtccgcggaattgctctgacccccactgaaggtcttgctcgaggtatggcagtggaagatacaggtggacctttgaaagcgcctgttggtagggaaatcctttctcgaatgttcgatgtgtttggaaataccatagaccgcaggaagcctccatctgatatccagtggcgctcaatacatcaaaccccgccaccgctaatgcgtcgatccactacgtctgaaatattcgagaccggtatcaaagctatagatgtactggtaccgcttgagcgcggaggtaaagcaggtctattcggaggagcgggcgttggcaagacagtgttgctaaccgaaatgattcataacgtagtcaaacaacaccagggagtgagcatcttttgcggaataggcgagcgttgtcgagaaggggaagaactttatcgtgatatgaaagacgctggtgtgcttccgaatacggttatggtattcggccagatgaacgagccaccaggtgcccgttttcgtgtaggtcatacggcgctgacaatggcagagtacttcagagacgatgaacgccgagatgtgctactgcttatagataacattttcaggtttattcaggctggttccgaagtatctggtttgatgggacagatgccttcacgcctgggatatcaaccgacattgggcactgaattatccgagttagaagagcgcatatctaccaccgatgccggagccataatgtctattcaagcggtgtatgtgcctgctgacgatttcactgacccttcggctgtgcatacattctcacatctatcggcatcaattgtcctctctcgcaagagggcaagcgaggggctttatccggctattgaccctttgcagtcaaactccaaaatggccacacctggcattgttggcgaaaggcattatctccttgcccaagaaatcaggcagacgcttgcgcaatactcagaactcaaggatattatctcaatgcttggcctggagcagctatcgcctgaggaccgaaatgtggtagcccgcgctcgacggctggaacgtttcctgacgcagccgtttttcaccactgagcaattcacaggtattaaaggcaaatccatcagtctttcagatgcgctcgacggctgcgagcgtatcttgaatgacgaattcaaagactactctgaaggtgacctctacatgatcggaacaattgacgaagcaatggccaaaaaatcaagccgggaaaaatcatga

SEQ ID NO: 6973 - protein, 469 aa, Methanosarcina barkeri
MVDRSRLLNLGKVISVRGSIVDVLFEKHLPPVYTLLRAGRESQIAIEVLTQLDAHHVRGIALTPTEGLARGMAVEDTGGPLKAPVGREILSRMFDVFGNTIDRRKPPSDIQWRSIHQTPPPLMRRSTTSEIFETGIKAIDVLVPLERGGKAGLFGGAGVGKTVLLTEMIHNVVKQHQGVSIFCGIGERCREGEELYRDMKDAGVLPNTVMVFGQMNEPPGARFRVGHTALTMAEYFRDDERRDVLLLIDNIFRFIQAGSEVSGLMGQMPSRLGYQPTLGTELSELEERISTTDAGAIMSIQAVYVPADDFTDPSAVHTFSHLSASIVLSRKRASEGLYPAIDPLQSNSKMATPGIVGERHYLLAQEIRQTLAQYSELKDIISMLGLEQLSPEDRNVVARARRLERFLTQPFFTTEQFTGIKGKSISLSDALDGCERILNDEFKDYSEGDLYMIGTIDEAMAKKSSREKS

SEQ ID NO: 6974 - DNA, 1410 bp, Streptococcus bovis
  CDS (1)..(1410): transl_table=11
atgagctcaggcaaaattgctcaggttgtaggtccagttgtcgacgttgcgtttgctgctggtgacaaactacctgagattaataatgcattgattgtttataaagatggcgataagtctcaaaaaatcgtgctcgaagttgctcttgaacttggagacggtcttgtacgtactatcgctatggaatcaactgatgggcttacacgtggattagaagttttcgatactggtcgtccaatcagtgtaccagttggtaaagaaactttgggtcgtgtgtttaatgttcttggggatacaattgatcttgatgaaccatttgcagaagatgcaccacgcgaaccaattcacaaaaaagcaccagcatttgatgaattatcaacatcatcagaaatccttgaaacaggtatcaaagttattgaccttcttgccccttacctaaaaggtggtaaagtcggacttttcggtggtgccggtgttggtaaaaccgttcttatccaagaattgattcacaacattgcccaagaacacggtggtatctcagtatttaccggtgttggggaacgtacacgtgaaggtaatgacctttactgggaaatgaaagaatctggcgttatcgaaaaaacagccatggtcttcggtcaaaggaatgaacccaccctgggagcacgtatgcgtgttgcccttactggtttgactatcgcggaatacttccgtgatgttgaaggacaagacgtacttctctttatcgataacatcttccgtttcactcaagcaggttctgaagtatcagcccttcttggtcgtatgccatcagccgttggttaccaaccaacattggctactgaaatgggtcaattgcaagaacgtatcacatcaactaaaaaggttctgttacatcaatccaagccatctacggtgccagccgatgactacactgacccagcgccagcaacagcattcgctcacttggattcaacaactaaccttgaacgtaagttgactcaaatgggtatctacccagccgttgacccacttgcttcaagttcacgtgcccttgcaccagaaattgttggtcaagaacactatgaagtagcaacagaagttcaacgtgttcttcaacgttaccgtgaattgcaagatatcatcgcaatcctaggtatggatgaattgtcagacgaagaaaaaacattggttggacgtgctcgtcgtatccaattcttcttgtcacaaaacttcaacgttgctgaacaatttacaggtatgcctggttcatacgtaccagttgctgaaactgttcgtggcttcaaggaaatcttggaaggtaaatacgatgatcttccagaagatgctttccgtaacgtaggtccaatcgaggatgtagttgaaaaagctaagaaaatgaattactaa

SEQ ID NO: 6975 - protein, 469 aa, Streptococcus bovis
MSSGKIAQVVGPVVDVAFAAGDKLPEINNALIVYKDGDKSQKIVLEVALELGDGLVRTIAMESTDGLTRGLEVFDTGRPISVPVGKETLGRVFNVLGDTIDLDEPFAEDAPREPIHKKAPAFDELSTSSEILETGIKVIDLLAPYLKGGKVGLFGGAGVGKTVLIQELIHNIAQEHGGISVFTGVGERTREGNDLYWEMKESGVIEKTAMVFGQRNEPTLGARMRVALTGLTIAEYFRDVEGQDVLLFIDNIFRFTQAGSEVSALLGRMPSAVGYQPTLATEMGQLQERITSTKKVLLHQSKPSTVPADDYTDPAPATAFAHLDSTTNLERKLTQMGIYPAVDPLASSSRALAPEIVGQEHYEVATEVQRVLQRYRELQDIIAILGMDELSDEEKTLVGRARRIQFFLSQNFNVAEQFTGMPGSYVPVAETVRGFKEILEGKYDDLPEDAFRNVGPIEDVVEKAKKMNY

SEQ ID NO: 6976 - DNA, 1987 bp, Nicotiana sylvestris
  CDS (3)..(1688)
ccatggcgacgcggcggcttctcacctctctcctccgtcaatcggctcaacgtggcggcggtccaatttcccgatccttgggaaactccatccctaaatccgctgcacgcgcctcttcacgcgcgtcccctaagggattcctcttaaaccgcgcgcccgtacagtacgctacctctgcagcagcacccgcatctcagccatcaacaccaccgaagtccggcagtgaaccgtcggggaaaatcaccgatgagttcaccggcgctggttcgatcgggaaggtgtgccaggtcatcggtgccgtcgtggatgtgagattcgatgaaggtttgccaccaattttaaccgctctcgaagtgttggataatcagatccggcttgttcttgaagtggctcagcatttgggtgagaatatggttaggactattgctatggatggtactgaagggcttgttcgtggtcaacgcgtcctcaatacaggttctcctatcaccgttcctgttggtagagccacacttgccagtataatcaatgtcattggagaggcaattgatgagagaggcccaattactaccgatcactttttaccaattcatcgtgaagctcctgcctttgtcgagcaagccactgaacaacaaattattgtcactggtattaaggttgttgatcttcttgctgcataccaaagaggaggaaaaattgggctttttggtggtgctggtgtggggaaaactatgcttattatggaactaattaacaatgttgcaaaagcacatggcggtttctctgtctttgctggtgttggtgaacgcactcgagagggtaatgatttgtaccgagaaatgattgaaagtggtgtcatcaagctaggcgagaagcaaagtgaaagcaagtgtgctcttgtatatggtcaaatgaatgagccccctggtgctcgtgcatgtgttggacttacaggtttgaccgtggctgagcacttccgagatgccgaggggcagtatgtgcttctctttattgacaatattttcaggtttactcaggctaactcagaagtgtctgctttgcttggtcgtatcccatctgctgtcggttatcaaccaactttggctacggatcttggaggtcttcaagaacgtatcaccaccaccaagaaaggttctattacatccgtgcaagctatttatgtgcctgctgatgacttgacagatccagcccctgctacaacctttgctcacttggatgccacaactgtcttgtcccgtcagatctctgagcttggtatctatcctgctgtcgatccacttgattctacatcccgtatgctctcacctcacattttgggagaggatcactacaatactgctcgtggggtacagaaagttcttcaaaactacaagaatcttcaagatattattgctattttgggtatggatgagcttagtgaagacgataagatgactgttgcccgtgcacgtaaaatccaaaggttccttagccagcctttccatgttgctgaagttttcacgggtgcccctggaaagtatgtcgacttgaaggagagcattaacagtttccagggagtgttggatggcaaatatgatgacctttcagagcaatcgttttatatggttggtggaatcgacgaggtcattgccaaagcagagaagattgccaaggaatctgcagcctagatagattataaacttctgtgactttcttttcttctctttgccaaaataatttagtttgtgacatcccggatttttttggagaccaagaggtccagaattctggttttgttttacatccaatgcgagattatagagacatgcagccaagcctttgttggcaagagacccccttttctgttatgtcacataataaagggggtaaatgggatcttgtatatcgtattttcaagtctttttcgagaattttggattccctgattatcaaatgcctttctgaaacgctttctttctaaaaaaaa

SEQ ID NO: 6977 - protein, 561 aa, Nicotiana sylvestris
MATRRLLTSLLRQSAQRGGGPISRSLGNSIPKSAARASSRASPKGFLLNRAPVQYATSAAAPASQPSTPPKSGSEPSGKITDEFTGAGSIGKVCQVIGAVVDVRFDEGLPPILTALEVLDNQIRLVLEVAQHLGENMVRTIAMDGTEGLVRGQRVLNTGSPITVPVGRATLASIINVIGEAIDERGPITTDHFLPIHREAPAFVEQATEQQIIVTGIKVVDLLAAYQRGGKIGLFGGAGVGKTMLIMELINNVAKAHGGFSVFAGVGERTREGNDLYREMIESGVIKLGEKQSESKCALVYGQMNEPPGARACVGLTGLTVAEHFRDAEGQYVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHILGEDHYNTARGVQKVLQNYKNLQDIIAILGMDELSEDDKMTVARARKIQRFLSQPFHVAEVFTGAPGKYVDLKESINSFQGVLDGKYDDLSEQSFYMVGGIDEVIAKAEKIAKESAA

SEQ ID NO: 6978 - DNA, 1983 bp, Nicotiana sylvestris
  CDS (3)..(1673)
ccatggcgacgcggcggcttctagcctctctcctccgatcaaccgcccaacgcggcggcgctatttccagatctccattagcaaattccattcccagaactacttcacgggcctcaccgaaaggattcctcttaaaccgtgccgttaagtacgctacctcagctgctgctgagaagccgaaggcgactcctcctaaaccttccggtaatgaacctactgggaaaatcaccgatgaattcaccggcgctggttcgatcgggaaagtgtgtcaggttattggtgccgtcgtagatgtgagattcgatgaaggtttgcctccgatccttacggcgcttgaggttttggataaccagatccggcttgtgcttgaggttgctcagcatttgggtgagaatatggttaggactattgctatggatggtactgaaggtcttgttcgtggtcaacgtgtcctcaatactggctctcctatcactgtccctgttggtagagccacccttggtcgtattattaatgtcattggagagcctattgatgagagaggcgacattaacaccgatcactttttgccaattcatcgtgaagctcctgcctttgttgagcaggcaactgaacaacaaattctcgttactggtatcaaggttgttgatcttcttgccccttaccaaaggggaggaaagattgggctttttggtggtgctggtgttgggaagactgtgcttattatggaactgattaacaacgttgcaaaagcgcacggaggtttctctgtctttcctggtgttggtgaacccagtgctgagggcaatgatttgtacagggaaatgattgaaagtggtgttattaagcttggtgacaagcaaagtgaaagcaagtgcgctcttgtgtacggtcaaatgaatgagccccctggtgctcgtgcccgtgttggtcttacaggcttgactgtggctgagcacttcagagatgctgaggggcaggatgtgcttctcttcattgacaacattttcagatttacccaggctaactcagaggtgtctgctttgcttggtcgtatcccatccgctgtcggttatcaaccaactttggctacagatcttggaggtcttcaagagcgtatcactacaaccaagaaaggttctattacatcagtccaagctatttatgtgcctgctgatgacttgacagatccagcccctgctacaacctttgctcacttggatgccacaactgtcttgtcccgtcaaatttctgagctaggtatttaccctgctgtcgatcctcttgattctacatctcgtatgctctcacctcacattttgggagaagaccactacaatactgctcgtggggtacagaaagttcttcagaactacaagaatcttcaagatattattgccattttgggtatggatgagcttagtgaagatgataagatgactgttgcccgtgcacgtaaaatccaaagattccttagtcagcctttccatgttgctgaagttttcacgggtgcccctggaaagtatgttgacttgaaggagagcattaacagtttccagggagtcttggatggaaaatacgatgatctttcagaacagtccttctatatggttggtggaatcgatgaggtcattgccaaggcagaaaaaattgccaaggaatctgcagcttagattatggactccagtgactttctttcattatctttcatcgataactacagagataatttaagtttctgtgacactttggattctttttgagagccaagggtccaagattttctggtttttgtttttatatgcaatccggaattgtgatagggaagacatggagctaaggcctacttgccaaacacccacccttgacgctctgttatgtcgcaaaataaagggggtaaaacggcgaacttgtatattttactttgaattaatcttgagaatgttggttgcccagtttatgaaaaaaaaaaaaaaaaaaaaa

SEQ ID NO: 6979 - protein, 556 aa, Nicotiana sylvestris
MATRRLLASLLRSTAQRGGAISRSPLANSIPRTTSRASPKGFLLNRAVKYATSAAAEKPKATPPKPSGNEPTGKITDEFTGAGSIGKVCQVIGAVVDVRFDEGLPPILTALEVLDNQIRLVLEVAQHLGENMVRTIAMDGTEGLVRGQRVLNTGSPITVPVGRATLGRIINVIGEPIDERGDINTDHFLPIHREAPAFVEQATEQQILVTGIKVVDLLAPYQRGGKIGLFGGAGVGKTVLIMELINNVAKAHGGFSVFPGVGEPSAEGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHILGEDHYNTARGVQKVLQNYKNLQDIIAILGMDELSEDDKMTVARARKIQRFLSQPFHVAEVFTGAPGKYVDLKESINSFQGVLDGKYDDLSEQSFYMVGGIDEVIAKAEKIAKESAA

SEQ ID NO: 6980 - DNA, 1377 bp, Pseudomonas veronii
  CDS (1)..(1377): transl_table=11
atgacgcaacgacagatagtgcccgagaacgctgccacgaacatcggcgtagtggttgctgtgcgcggcagtgttgtggacatgcgtttcgatacggtgctgccgcccatccataccctgctgcgcgcgggtgacgccggccaggtgactatcgaggttttggcccagcgcgacgaacaccatgtgcgtggcatcgcactgacgcccacccaagggctggcgcgagggatgggggtgcaagacaccggcggtccgttaaaagcaccggtgggcaatcagatcctttcgcgcatgttcgatgtctttggcaacaccatcgatcgccagccgccactggacgccgtccagtggcgctccgtgcaccaggcaccaccgccattggtgcgccgctccacccaatccgaggtgttcgagaccggtatcaaagccattgatgtgctcgccccgctggagcgcggcggcaaagccggcctgttcggtggcgcgggtgtcggcaagacggtgctgctgaccgagatgatccataacatgatcgggccaccagggaagggcgtgagtatcttttgcggcatcggcgagcgttcgcgagaaggcgaagagctgtaccgcgatatgaaggccgccggcgtgctgcccaacatggtgatgatttttgcccagatgaatgagccgcctggggcgcgcttccgcatcgggcacgcggcattgaccatggcggagtactttcgtgacgatcaacatcgcgatgtgctgctgctcgtcgacaatatctttcgttttatccaggccggttccgaggtttccggcttgatggggcaaatgccgtctcgcttgggctatcagccgacgatgggcactgaactctcggcgctggaagaacgtatcgccaatactgacagcggcgctatcacctctattcaagcggtttacgtgcccgccgacgacttcaccgacccggcggcggtgcataccttttcgcacctctcggcatcgatcgtgttgtcgcgcaaacgcgcgagcgaaggcctgtttccggccattgatccactgcagtccagctcgaagatgctcacaccgggcattgtcggcgagcgtcactaccggctcgcgcaggccatacgccgcacgcttgcccagtacgcagaactcaaggacatcattgccatgctcgggcttgagcagttgtcgccggatgaccgcaaggtggtcgctcgtgcacggcgcctggagcgtttcctgacccagccgtttttcaccaccgaacaattcaccaacatgcccggcaagctcgtcagcctgcaggatgcactggacggttgtgagcgcatcctggctgacgagttcaaggacttcccggcaaagcgccgctctacatga

SEQ ID NO: 6981 - protein, 458 aa, Pseudomonas veronii
MTQRQIVPENAATNIGVVVAVRGSVVDMRFDTVLPPIHTLLRAGDAGQVTIEVLAQRDEHHVRGIALTPTQGLARGMGVQDTGGPLKAPVGNQILSRMFDVFGNTIDRQPPLDAVQWRSVHQAPPPLVRRSTQSEVFETGIKAIDVLAPLERGGKAGLFGGAGVGKTVLLTEMIHNMIGPPGKGVSIFCGIGERSREGEELYRDMKAAGVLPNMVMIFAQMNEPPGARFRIGHAALTMAEYFRDDQHRDVLLLVDNIFRFIQAGSEVSGLMGQMPSRLGYQPTMGTELSALEERIANTDSGAITSIQAVYVPADDFTDPAAVHTFSHLSASIVLSRKRASEGLFPAIDPLQSSSKMLTPGIVGERHYRLAQAIRRTLAQYAELKDIIAMLGLEQLSPDDRKVVARARRLERFLTQPFFTTEQFTNMPGKLVSLQDALDGCERILADEFKDFPAKRRST

SEQ ID NO: 6982 - DNA, 1398 bp, Clostridium paradoxum
  CDS (1)..(1398): transl_table=11
atgccagataaaaatgttggtaaagtggttcagataattgggccagtactagacattaaatttagttcagataatttacctaatctacttaatgcaatagagatatatcacgaaggaagaaaaatagttgcagaggtagctcagcatataggtgatgatacagtaagatgtatagctatgagttcaactgatggacttgtaagaggtatagatgctatagatacaggaaatgctatatctgttccagttggaagaaaaacacttggaagaatattcaatgtattaggagatcctgttgataacaagcctgaagttgaagatgctccgaaacttccaatacatagaccagcaccttcatttgaagaccaagaaacagctacagaaattcttgaaacaggaataaaggtagtagaccttatagctccttatgcaaagggaggaaagataggtctatttggaggagcaggtgttggaaaaacagttcttataatggagcttataaacaacatagctaaagagcatggaggtctttcagtattctcaggagttggagaaagaacaagagaaggaaatgacctttatcacgagatgatagattcgggagttatagacaaaacaactcttgtttatggacaaatgaatgagccaccaggagctagaatgagagttgcgttaactggtcttacaatggcagaatattttagagatcaagaagggcaagacgtattattattcatagataatatattcagatttactcaagcaggttctgaagtttcagcacttcttggacgtatgccatcagcggttggttatcagcctacattagctacagaaatgggtgctttacaagagagaattacatctactaaaaagggatctataacttcagttcaagcagtatacgttccagctgacgacttaactgacccagcgccagctacaactttcgctcaccttgatgcaacaacagttttatcaagacaaatagcagcgcttggtatatatccagcagttgatccgctagattctacatcaagaatactagatccaaatatagttggaagagaacattatgaagttgcccgtggagttcagtcggttcttcaaagatataaagaacttcaagatataatagctatacttggtatggatgaactttcagatgaagataaattaatagttgctagagctagaaaaatccaaagattcttatctcaaccatttagcgttgcagaacagtttacaggaatggcaggaaaatatgtaccattaaaagaaactataagaggatttagagaaattcttgaaggaaaacatgatgatttaccagagtctgcattcttatatgttggaactattgatgaggcagtagaaaaggcgaagaagggagagtag

SEQ ID NO: 6983 - protein, 465 aa, Clostridium paradoxum
MPDKNVGKVVQIIGPVLDIKFSSDNLPNLLNAIEIYHEGRKIVAEVAQHIGDDTVRCIAMSSTDGLVRGIDAIDTGNAISVPVGRKTLGRIFNVLGDPVDNKPEVEDAPKLPIHRPAPSFEDQETATEILETGIKVVDLIAPYAKGGKIGLFGGAGVGKTVLIMELINNIAKEHGGLSVFSGVGERTREGNDLYHEMIDSGVIDKTTLVYGQMNEPPGARMRVALTGLTMAEYFRDQEGQDVLLFIDNIFRFTQAGSEVSALLGRMPSAVGYQPTLATEMGALQERITSTKKGSITSVQAVYVPADDLTDPAPATTFAHLDATTVLSRQIAALGIYPAVDPLDSTSRILDPNIVGREHYEVARGVQSVLQRYKELQDIIAILGMDELSDEDKLIVARARKIQRFLSQPFSVAEQFTGMAGKYVPLKETIRGFREILEGKHDDLPESAFLYVGTIDEAVEKAKKGE

SEQ ID NO: 6984 - DNA, 1398 bp, Spiroplasma citri
  CDS (1)..(1398): transl_table=4
atggagaaaaatggaaaagtagtacaagtgttagggcctgttgttgatgtacggtttaccgaagagtatttgcctgaattatataatgctattacggttaataataatggaacaaagttagttttagaagttgttcaacatattggtgatgacaccgtacgggcaattgccctagggccaacagagggaatggttcgggggatggatgttattgatacgaaagctccaattacagtccctgttggtgaagaggttttaggacgaatgtttaatgttcttggagaagcaattgatgaaaaaccacaaccaaaaacaaagttaatgcgtccaattcaccgcgaagcaccatcatatgaagaacaacaaacaacagcggcgattttagaaacaggaattaaagttgttgatttattagttccctttgcaaaaggagggaaaattggtttgtttggtggtgctggagttggaaaaacagtactagtgcaagaactaattaataatgtggcaaaagcacacggaggaatttctgtttttgctggtgtcggtgaacgaacacgagaaggtaatgatttatattatgaaatgattgaagctggcgttattgataaaacagccttagtttttggccaaatgaatgaaacaccaggagctcgtatgcgagttgccttaactggattaacaattgctgaatatttccgtgatgataagaaccaagatgttttattgtttattgataacattttccgttttacccaagctggttctgaagtatcagccttattaggacgaatgccatcagcagttggttatcaaccaactttagcaactgaaatgggagctttgcaagaacgaattacatcaactaaaaaaggaagtattacttctatacaagcagtatatgtaccatcggatgatttaaccgacccagcgccagcaacaacatttgctcatttagatgctaaggttgttttagaccgggaaattgcagcattaggaatttatccggcggtagatccactaggaagttcatcacggttattagaccccttagtggttggtgaagaacattatgaagtagcgcgaggagtacaagaaattttacaaaaatttaaagaattgcaatcaattattgcaattttaggaatggatgaattatcagatgaagataaattagctgttgcaagagcacgaaaaattcgtaactttttatcacaatcattttttgtagctgaaaagttttctggaaaaacaggaaaatatgtccctgtggtagaaacaattcgtgcttttaaagaaatcttaacaggaaagtatgatgatttaccagaacaagcattcttatatgttggaacaattgatgaggttgttaaagtggctgaagctttaaaacataattaa

SEQ ID NO: 6985 - protein, 465 aa, Spiroplasma citri
MEKNGKVVQVLGPVVDVRFTEEYLPELYNAITVNNNGTKLVLEVVQHIGDDTVRAIALGPTEGMVRGMDVIDTKAPITVPVGEEVLGRMFNVLGEAIDEKPQPKTKLMRPIHREAPSYEEQQTTAAILETGIKVVDLLVPFAKGGKIGLFGGAGVGKTVLVQELINNVAKAHGGISVFAGVGERTREGNDLYYEMIEAGVIDKTALVFGQMNETPGARMRVALTGLTIAEYFRDDKNQDVLLFIDNIFRFTQAGSEVSALLGRMPSAVGYQPTLATEMGALQERITSTKKGSITSIQAVYVPSDDLTDPAPATTFAHLDAKVVLDREIAALGIYPAVDPLGSSSRLLDPLVVGEEHYEVARGVQEILQKFKELQSIIAILGMDELSDEDKLAVARARKIRNFLSQSFFVAEKFSGKTGKYVPVVETIRAFKEILTGKYDDLPEQAFLYVGTIDEVVKVAEALKHN

SEQ ID NO: 6986 - DNA, 1891 bp, Triticum aestivum
  CDS (15)..(1676)
ggcgatccgcggccatggcgacgcgccgggccctctcctcgctcctccggtcggcctcccgcgcgcgcgcggcctcgcccgtcgccgttcccccgcgcgacccgctccaccgcccgtccccggacggctacctcttcaaccgcgccgccaactacgcctccgccgccgccgccgccgaggcccccgccgagaagctgccccccacctccgacaagtacgtcggtgccaagatcaccgacgagttcaccggcgccggctccatcggccaggtctgccaggtcatcggcgccgtcgtcgacgtgcgcttcgacgagggcctcccgcccatcctcaccgcgctcgaggtgctcgacaacagcatccgcctcgtgctcgaggtggcgcagcatctcggcgagaacgtcgtgcgcaccatcgccatggacgggaccgaggggctcgtgcgcggccagaaagtcctcaacaccggatcccccatcactgtgcctgttgggagggccacccttggacgtatcattaacgttattggtgagccaattgaccacaagggtgacataaagacacacgacttccttcctattcatcgtgaggcccctgcttttgttgagcaagccacagagcagcaaattcttgttactggaattaaggtcgtggatttgcttgcaccttaccaaaggggtggcaaaattggtctcttcggtggtgcaggagtgggtaaaactgttcttattatggagttgatcaacaatgttgccaaggcccatggtggtttctctgttttcgctggtgtcggagaacgtacccgtgaaggtaatgacttgtacagggaaatgattgaaagtggtgtcattaagctcgatgagaagcaggctgaaagcaagtgtgctcttgtctacgggcaaatgaacgagcccccgggtgcccgtgctcgtgttggtcttactggtttgactgttgctgaacatttccgtgacgctgaaggacaagatgtgctcctgtttattgacaacattttccgtttcacccaggcaaactctgaggtgtctgctctccttggacgtattccatctgctgtgggataccaaccaactcttgccaccgatcttggaggactgcaagagcggattacgacgacaaagaagggttctattacatccgtccaggctatttatgtgcctgctgatgatttgacggatcctgctcctgctaccacctttgcccatcttgacgctactactgtgttgtcacgacagatttctgagctgggcatttaccctgctgttgatcccttggactcgacatcaagaatgctttctccccacgttctgggtgtggatcactacaacactgcccgtggtgtccagaaggttcttcagaactacaagaatcttcaggatatcattgccattttgggtatggatgagctcagtgaagatgataagatgacggttgctcgtgcaaggaagatccagaagttcctgagccagcctttccatgttgccgaagttttcactggtgctccagggaagtatgtggacctaaaggagggtgtccaaagtttccagggtgttttggacggcaagtacgacgacatctcggagcacgcgttctacatggttggaggcatcgacgaagtcatcgccaaggcagagaagatcgccagcgagaatgcctgatgacgaggtgttaccaccgctctgtacaagttaaattttttgggtttcagctgttcgcccgagacttgctcacgagcaggagtgtgccagctcctgctgagggatccttgtttttgttcgtttttactccaatttacccgtaataagcaactgcagtgacattggtttagtctgcacaacagcaacactactcttggcttggaaaaaaaaaaaaa

SEQ ID NO: 6987 - protein, 553 aa, Triticum aestivum
MATRRALSSLLRSASRARAASPVAVPPRDPLHRPSPDGYLFNRAANYASAAAAAEAPAEKLPPTSDKYVGAKITDEFTGAGSIGQVCQVIGAVVDVRFDEGLPPILTALEVLDNSIRLVLEVAQHLGENVVRTIAMDGTEGLVRGQKVLNTGSPITVPVGRATLGRIINVIGEPIDHKGDIKTHDFLPIHREAPAFVEQATEQQILVTGIKVVDLLAPYQRGGKIGLFGGAGVGKTVLIMELINNVAKAHGGFSVFAGVGERTREGNDLYREMIESGVIKLDEKQAESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGVDHYNTARGVQKVLQNYKNLQDIIAILGMDELSEDDKMTVARARKIQKFLSQPFHVAEVFTGAPGKYVDLKEGVQSFQGVLDGKYDDISEHAFYMVGGIDEVIAKAEKIASENA

SEQ ID NO: 6988 - DNA, 1665 bp, Desulfovibrio vulgaris
  CDS (174)..(1589): transl_table=11
gagcatgcggcgcgcatggccgccatggataacgccacgcgcacgtgcgacgacatgatcggttccctgacgctgctcttcaacaagacgcggcaggcttcgatcacgcgcgacctcatggacatcgtcggtggcgccgaggcgctgaaaggctaataagggagcgtacacacatgagtgctaacattggcaagatcgttcaggtcatcggcgccgtcgtggacgtcgagttcccgagcggcaacctgccgaacatcttgagcgcgttggacatcaagaaccccaacaacagcgacgcgccccagttggtctgcgaagttgcccagcacctcggcgacaacgtcgtccgcaccatcgccatggacgcgaccgaaggtctcgtgcgcggcatggaagcggtggacaccggcaagcccatcatggtgcctgtcggcaaggcgtcgcttggccgtatcatgaacgtggtgggccgtcccgttgacgaaatgggccccatcaagaccgacaaatacctgcccattcaccgtccggcgccggagttcaccgagcagaacaccaaggtggaactgctcgaaaccggcatcaaggtcgttgacctgctcatcccgttggggaagggcggcaagatgggcctgttcggcggcgcgggcgtgggcaagaccgttatcctcatggaaatgatcaacaacatcgcgaagcagcacggcgctatctccgtgttcgcaggtgttggcgagcgtacccgtgaagggaacgacttgtaccacgaaatgaaggacgccggcgttctggagaaggccgcgcttatctacggccagatgaacgaaccgccaggagcccgtgcccgcgtcgccctgaccgccctcgcctgcgcggaatacttccgtgacatcgagaaccaggacgtgctactgttcgtcgacaacatcttccgcttcacccaggcgggttcggaagtgtcggcactgctcggccgcatgccttcggcggtgggttaccagcccaccctgggtaccgaccttggtggcctgcaggaacgcatcacctccacggtcaagggctcgatcacctcggtccaggccgtgtacgtgcccgcggacgaccttaccgaccccgcgcctgccaccaccttctcgcaccttgacggtacgctggtgctttcgcgtcagatcgctgaactcggcatctaccctgcggtggacccgctcgactccacgtcgcgcatcctcgaccccaacgtggtcggtcccgagcactactcggtggcccgcgcggtgcagcaggttctgcagaagtacaaggatctgcaggacatcatcgccattctcggcatggacgaactgtccgacgaagacaagctgaccgtcgcccgcgcgcgccgcatccagcgcttcctgtcgcagccgttccacgtggccgaaaccttcaccggcacgcccggcgtgtacgtgaagctggaagacaccatcaaggcgttccggggcatcctgaacggtgacttcgaccaccttgcggaaggcgacttctacatggtgggcggcatcgagacggcccttgaaaagtacaagaagcgccaggagcagcaataaggagtgacccatggaaaagtcgctccatctcgaaatcgtcacgcctgacaggctcgtgctcagcgagaaggtcgac

SEQ ID NO: 6989 - protein, 471 aa, Desulfovibrio vulgaris
MSANIGKIVQVIGAVVDVEFPSGNLPNILSALDIKNPNNSDAPQLVCEVAQHLGDNVVRTIAMDATEGLVRGMEAVDTGKPIMVPVGKASLGRIMNVVGRPVDEMGPIKTDKYLPIHRPAPEFTEQNTKVELLETGIKVVDLLIPLGKGGKMGLFGGAGVGKTVILMEMINNIAKQHGAISVFAGVGERTREGNDLYHEMKDAGVLEKAALIYGQMNEPPGARARVALTALACAEYFRDIENQDVLLFVDNIFRFTQAGSEVSALLGRMPSAVGYQPTLGTDLGGLQERITSTVKGSITSVQAVYVPADDLTDPAPATTFSHLDGTLVLSRQIAELGIYPAVDPLDSTSRILDPNVVGPEHYSVARAVQQVLQKYKDLQDIIAILGMDELSDEDKLTVARARRIQRFLSQPFHVAETFTGTPGVYVKLEDTIKAFRGILNGDFDHLAEGDFYMVGGIETALEKYKKRQEQQ

SEQ ID NO: 6990 - DNA, 1407 bp, Thiobacillus ferrooxidans
  CDS (1)..(1407): transl_table=11
atgagcgaacggtgcaaagaaaacgccgtcggccatatcgtccaggtgatcgggccggggatcgatatcgccttttctcgcgggcaggtccccgagattatggaagctattgtggtcgacgcaaacaatctgaccatcgaggtgcaggcccagttgggtgacggcgtggcgcgcggtatcgccatggggctcagcgaaggcctcaaacgcgggctggccgtcactcgtaccggtgcgccgatcagtgtgccggtagggcatgctaccctgggccggatcatgaacgtcctgggtgaaccggtagatggcaaaggacccgtgcagacgcaagatcgccaggccatccatcgcccggcgccggcctttgatgaacttgcggcaagcaccgaggtgctggagaccggcatcaaggtcatcgatctggtctgtcctttcgccaaaggcggtaaggtcggtctcttcggcggcgccggcgtgggcaagacggtgttcatgatggagatgatccgcaacatcgctatcgagcataccggatattcggtgtgtgcaggcgtcggcgagcggactcgtgaagggaacgacttttaccatgaaatgaccgactccggcgttttggacaaggtcgccctggtaaacgggcagatgaacgagccgccccgcaaccgtttgcgcgccgggttgaccggcctgaccatggcggcgagcttccgtgatgaaggtcgcgacattttgatgttcatcgataacattttccgctatacgctggcaggcaccgaagtctcggcgctgctggggcgtatgccttctgcggtgggctatcagccaacgctggctgaagaaatgggccagttgcaggagcgtatcacttccaccaaggtgggttccatcacctcggtgcaggctgtttacgtgcccgcggattatctcaccgatccttctccggcgacgacctttgcccacttggacgccacggtagtgttgtcgcggcagattgcggaactgggcatctaccccgcgctcgatccgctcgattctttcagccgtcagctcgatccgcagatcgttggccaagagcactatgatgtggctcgttcctgccagaagacgttgcagccgtacaaggaattgcaggatatcattgccattctgggcatggatgaattgtctgaggacgacaaactgctggtgtcgcgggcacgcaagattcagcgctatctgtcccagcctttctttgtcgctgaagtgttcaccggcagccccggtacctatgtctccctgaaggaaacgatccgtgcattcaaggcgatcgtggcaggagagtatgaccacctgcccgagcaggccttctacatggtcggcaccatagatgaagcccttgccaaggcccaaaagctgcagcaaggctaa

SEQ ID NO: 6991 - protein, 468 aa, Thiobacillus ferrooxidans
MSERCKENAVGHIVQVIGPGIDIAFSRGQVPEIMEAIVVDANNLTIEVQAQLGDGVARGIAMGLSEGLKRGLAVTRTGAPISVPVGHATLGRIMNVLGEPVDGKGPVQTQDRQAIHRPAPAFDELAASTEVLETGIKVIDLVCPFAKGGKVGLFGGAGVGKTVFMMEMIRNIAIEHTGYSVCAGVGERTREGNDFYHEMTDSGVLDKVALVNGQMNEPPRNRLRAGLTGLTMAASFRDEGRDILMFIDNIFRYTLAGTEVSALLGRMPSAVGYQPTLAEEMGQLQERITSTKVGSITSVQAVYVPADYLTDPSPATTFAHLDATVVLSRQIAELGIYPALDPLDSFSRQLDPQIVGQEHYDVARSCQKTLQPYKELQDIIAILGMDELSEDDKLLVSRARKIQRYLSQPFFVAEVFTGSPGTYVSLKETIRAFKAIVAGEYDHLPEQAFYMVGTIDEALAKAQKLQQG

SEQ ID NO: 6992 - DNA, 1449 bp, Nonomuraea sp
  CDS (1)..(1449)
atgactgcagaggctgttgaaactgtagaagcccccgcggccggcactggccgcgtggcacgtgtcaccggcgccgtcgtcgacgtggagttccccgtcgaggcgatgcccgagatctacaacgcgctcaaggtcgaggtgaccctcggcggcgagaccaagaccctgacgctcgaggtcgcccagcacctgggcgacaacctcgtccgcgccatctccatgcagcccaccgacggcctggtccgcggccaggcggtcgccgacaccggcgcgccgatctcggtgcccgtcggcgacgtcgtcaagggtcacgtgtggaacgcgctcggcgagacgctcgacgtcccgacctcctcgctgaagatcgaggagcggtggggcatccaccgtccgtcgccggccttcgaccagctcgagtcccgcaccgagctgctcgtcaccggtatcaaggtcatcgacctgctcaccccgtacgttcagggtgggaagatcggcctgttcggcggcgccggcgtgggcaagacggtgctcatccaggagatgatccgccgagtcgcccgtaacttcggtggcacctcctgcttcgccggtgtgggcgagcgcacccgtgagggcaacgacctctggctggagatggaggaggcggacgtcctcaaggacaccgcgctcgtcttcggccagatggacgagccgccgggcacccgtctgcgggtcgccctgtcggcgctgacgatggcggagtacttccgcgatgtgcagaagcaggacgtgctgctgttcatcgacaacatcttccgcttcacgcaggccggttccgaggtctccacgctgctcggccgcatgccgtccgccgtgggttaccagcccacgctggccgacgagatgggcgtgctccaggagcgcatcacctcgacgcgcggtcactcgatcacctccatgcaagcgatctacgtgcccgcggacgacatcaccgacccggccccgcacaacgcgttcgcgcacctcgacgcgcagaccgtgctctcgcggccgatctcggagaagggcatctacccggcggtggacccgctcgactcctcctcccggatcctcgacccgcagatcgtgggcgaggagcactaccgggtggcccaggagaccaagcggatcctgcagaagtaccgcgagctccaggacatcatcgcgatcctcggtatcgacgagctgtccgaagaggacaaggtcaccgtccagcgggcccgccgcatcgagcgcttcctgtcgcacccgatgtacgcggccgaggccttcaccggccagccgggcgagaccgtgccgctcgacgagaccatcgcctccttcaagggcctctgcgcgggtgagtacgaccacctgcccgagcaggcgttcttcatggtcggtggcatcgaccaggccatcgcgaaggccaaggaactcgagcgtcgctaa

SEQ ID NO: 6993 - protein, 482 aa, Nonomuraea sp
MTAEAVETVEAPAAGTGRVARVTGAVVDVEFPVEAMPEIYNALKVEVTLGGETKTLTLEVAQHLGDNLVRAISMQPTDGLVRGQAVADTGAPISVPVGDVVKGHVWNALGETLDVPTSSLKIEERWGIHRPSPAFDQLESRTELLVTGIKVIDLLTPYVQGGKIGLFGGAGVGKTVLIQEMIRRVARNFGGTSCFAGVGERTREGNDLWLEMEEADVLKDTALVFGQMDEPPGTRLRVALSALTMAEYFRDVQKQDVLLFIDNIFRFTQAGSEVSTLLGRMPSAVGYQPTLADEMGVLQERITSTRGHSITSMQAIYVPADDITDPAPHNAFAHLDAQTVLSRPISEKGIYPAVDPLDSSSRILDPQIVGEEHYRVAQETKRILQKYRELQDIIAILGIDELSEEDKVTVQRARRIERFLSHPMYAAEAFTGQPGETVPLDETIASFKGLCAGEYDHLPEQAFFMVGGIDQAIAKAKELERR

SEQ ID NO: 6994 - DNA, 1950 bp, Zygosaccharomyces rouxii
  CDS (342)..(1862)
gcacgtgactcacgatacccctttttcgctagccgccgaggtagttaccctccttcgtatccgccaatcagatctcacaaactagaaatgcccaacaccacagccaatagcagcagagaaaaacctttttctatattttttttcagaaaaggcaccaaccgccgcgttctgagctcgacggtgtatggcatagggaaagtcttacacttacttataacatattacaatctcctttaacacaagtaactttaaaaacacaattctcgattgctgttagttgagttttggaaaactagagagttgcattaaattcctctagatcataagattctcagtaaaagatggtcttacccaagcttttccccgcttcctctcgtgcagcattgcaagctgcccgtcgttcggttccattcaccggtttcagaggtttagcctctgctgctgctgcttctaccggtaaggtcagagctgttattggtgccgtcgtggatgttcaattcgaccaagaaaacttgccagaaattttgaatgccctagagattgagagacctcaaggaaaattggttttggaagttgctcaacatttgggtgaaaacactgttagagcaattgccatggatggtaccagtggtctagtccgtggtgctgctgttaccgataccggtgccccaatttctgtcccagtcgataaggagactctgggtagaattatcaacgttatcggtgagccaatcgatgaagctggtccaattaacactaaggaaagaagaccaattcacgctgagccaccttccttcgttgaccaatccactaactccgaagttttggaaaccggtatcaaggtcgtcgacttgttggctccttacgctagaggtggtaagattggtcttttcggtggtgctggtgtcggtaaaaccgtgttcatccaagaattgattaacaacattgccaaggcacacggtggtttctcagttttcaccggtgtcggtgaaagaaccagagaaggtaacgatttgtaccgtgaaatgatggaaactggtgtcattgacttgaagggtgactccaaggtggccttggttttcggtcaaatgaacgaaccaccaggagccagagctagagttgctctaactggtttgaccgttgccgaatatttcagagatgaagaaggtcaagatgtcttgcttttcatcgataacattttcagatttactcaagctggttccgaagtgtctgcccttttgggtcgtattccatctgctgtcgcttaccaaccaactttgtccactgatatgggtgccttgcaagaaagaattgcaaccactcaaaagggttccgttacctctgtgcaagccgtttacgtgccagcagatgatttgactgatcctgcccctgctaccacttttgcccacttggacgccaccaccgtgttgtccagaggtatctctgaattgggtatctacccagccgtggatccattggattccaaatcccgtttgttggatgcctccatcgtcggtgaagaacactacaacattgcatctgacgttcaaatgactctacaagcctacaaatctttgcaagatatcattgccattttgggtatggacgaattgtctgaacaagacaagctaactgtggaaagagccagaaagattcaaagattcttgtctcaaccatttgctactgctcaagttttcaccggtatcgaaggtaagttggttagattgaaggacactattagatctttcaaggaagttttggacggtaaatacgaccacttgccagaaaatgccttctacatggttggtggtatcgaagatgttatcgcaaaggctgaaaaattggctgccggtggtaactaaagttaagattcattgaacaacaaacgatctggtggtctttaatgtgacttgttaaaagatacgtactttttatattcgattacagggc

SEQ ID NO: 6995 - protein, 506 aa, Zygosaccharomyces rouxii
MVLPKLFPASSRAALQAARRSVPFTGFRGLASAAAASTGKVRAVIGAVVDVQFDQENLPEILNALEIERPQGKLVLEVAQHLGENTVRAIAMDGTSGLVRGAAVTDTGAPISVPVDKETLGRIINVIGEPIDEAGPINTKERRPIHAEPPSFVDQSTNSEVLETGIKVVDLLAPYARGGKIGLFGGAGVGKTVFIQELINNIAKAHGGFSVFTGVGERTREGNDLYREMMETGVIDLKGDSKVALVFGQMNEPPGARARVALTGLTVAEYFRDEEGQDVLLFIDNIFRFTQAGSEVSALLGRIPSAVAYQPTLSTDMGALQERIATTQKGSVTSVQAVYVPADDLTDPAPATTFAHLDATTVLSRGISELGIYPAVDPLDSKSRLLDASIVGEEHYNIASDVQMTLQAYKSLQDIIAILGMDELSEQDKLTVERARKIQRFLSQPFATAQVFTGIEGKLVRLKDTIRSFKEVLDGKYDHLPENAFYMVGGIEDVIAKAEKLAAGGN

SEQ ID NO: 6996 - DNA, 1413 bp, Pediococcus parvulus
  CDS (1)..(1413): transl_table=11
atgagtactggtaaagttgtccaagttatcggacctgttgttgatgttgaatttcctctggatggtaatttacctgatattaataatgctttaaacgtcaagaaaccagacggcagtattttggttgctgaagtcgctcttgaacttggagacggcgttgtgcgaacaattgctatggatggtactgatggtttacaacgtggattggaagttgaagatactggttcttcaatcacagttccagttggtgataaaacattaggtcgggttttcaacgtccttggagaaacaattgataatggtgaaaaatttggacccgaagtaaaacgtaatcctattcatcgggatccacctaagtatgatgacctaaaccctagtatggaaattttggaaacaggaatcaaagttattgatttgctggctccgtatatccgtggtggtaaggttggactattcggtggtgccggtgttggtaaaactgttttaattcaggaattaattcataatattgcacaagaacacaatggtatttctgtatttacgggtgttggtgaacgaactcgtgaaggaaatgacttgtattttgaaatgaaggcatcgggtgttcttgaaaagaccgccatggtgtatggtcagatgaacgagccgcctggtgcgcgtatgcgggttgctttgactggtttaacattggcggaatatttccgtgatgttgaaggacaagatgtgttattatttatcgataacattttccggttcacacaagccggttctgaagtatccgcattgcttggtcgtattccttctgccgttggttatcaaccaacactggctactgaaatgggtcagttgcaggaacgaattacttcaaccaagaagggatcaattacttcgattcaggccgtttatgtgcctgccgatgattatactgatcccgcccctgccacaaccttcgcccatttggatgccacaactaacttggaacgtagcttaacgcaacaaggaatttatcccgctgttgatccgttggcttctacttcaagtgcgttggatccatctgtcgttggtgaggaacattacaaagtggcaacagatgttcagcatgtgttgcaacgctatcgtgagttgcaagatatcatttctattttaggaatggatgaattatctgacgaagaaaaaacgattgtcgctcgtgctcgtcgaatccaattcttcctatcacaaaacttctcagttgcggaacagtttactggtcaaccaggttcttatgttcctgttgaagaaacagtaaaaggtttcaaagaaattcttgaaggtaagtacgatgatttacctgaggatgctttccgtcaggtcggaaatattgatgaagttgttgaaaaggcgaagaagttaactagtgctgcaagtaaataa

SEQ ID NO: 6997 - protein, 470 aa, Pediococcus parvulus
MSTGKVVQVIGPVVDVEFPLDGNLPDINNALNVKKPDGSILVAEVALELGDGVVRTIAMDGTDGLQRGLEVEDTGSSITVPVGDKTLGRVFNVLGETIDNGEKFGPEVKRNPIHRDPPKYDDLNPSMEILETGIKVIDLLAPYIRGGKVGLFGGAGVGKTVLIQELIHNIAQEHNGISVFTGVGERTREGNDLYFEMKASGVLEKTAMVYGQMNEPPGARMRVALTGLTLAEYFRDVEGQDVLLFIDNIFRFTQAGSEVSALLGRIPSAVGYQPTLATEMGQLQERITSTKKGSITSIQAVYVPADDYTDPAPATTFAHLDATTNLERSLTQQGIYPAVDPLASTSSALDPSVVGEEHYKVATDVQHVLQRYRELQDIISILGMDELSDEEKTIVARARRIQFFLSQNFSVAEQFTGQPGSYVPVEETVKGFKEILEGKYDDLPEDAFRQVGNIDEVVEKAKKLTSAASK

SEQ ID NO: 6998 - DNA, 1413 bp, Pediococcus damnosus
  CDS (1)..(1413): transl_table=11
atgagtactggtaaagttgttcaggttatcggacctgttattgacgttgaatttcctctggatggtaatttacctgatattaataatgctttaaacatcaaaaaacttgatggtagtatcttagttgccgaagttgcgcttgaacttggtgatggcgttgttcgaacaatcgctatggatggtactgatggtttacaacgaggggcagaagttgaggacactggttcttcaattacagttcctgttggtgataaaacattaggtcgggttttcaacgtccttggagatacaattgataatggtgaagaatttggaccagaagcaaaacggaaccctattcatcgagatccaccaaagtatgacgaactaaatcccagcatggagattttggaaacaggaatcaaagttattgatttactggctccttacattcgtggtggtaaagtcggattattcggtggtgccggtgttgggaaaaccgttctaattcaagaattaattcataatattgcacaggaacacaatggtatttctgtatttacgggtgttggtgaacgaactcgtgaaggaaatgatttgtactttgaaatgaaggcatcgggtgttcttgaaaagaccgccatggtgtatggtcagatgaatgagccgcctggtgctcgtatgcgggttgctttaaccggtttaacaattgcggaatacttccgtgatgttgagggtcaagacgtgttattgtttatcgataacattttccgatttacacaagctggttctgaagtatccgcattacttggccgaattccatcagccgttggttatcaaccaactttggctactgaaatgggtcaacttcaggaacggattacatcaacgaagaaggggtcaattacctctattcaggctgtgtatgttcctgctgatgattatactgatcctgctcctgcaacaacattcgcgcatttggatgcaacaactaacttggaacgaagcttaactcaacaaggaatttatcctgctgttgatcctttggcttcaacttcgagtgctttggatcctgccgttgttggtgaggaacattataaagtagctactgatgttcagcatgttttgcaacgttaccgtgagttgcaagatatcatttctattttaggaatggatgaattgtctgatgaagagaagacaatcgttggacgtgctcgtagaattcagttcttcttgtcacagaatttctctgttgctgaacagtttactggtaaacctggatcttatgttccggttgaagaaacagtaaagggcttcgagggaattcttgaaggtaaatatgatgatttacctgaagatgcctttaatggtgttggtaatattgatgaagtcgttgagaaggctaagcaattaactagtgccactagtaaataa

SEQ ID NO: 6999 - protein, 470 aa, Pediococcus damnosus
MSTGKVVQVIGPVIDVEFPLDGNLPDINNALNIKKLDGSILVAEVALELGDGVVRTIAMDGTDGLQRGAEVEDTGSSITVPVGDKTLGRVFNVLGDTIDNGEEFGPEAKRNPIHRDPPKYDELNPSMEILETGIKVIDLLAPYIRGGKVGLFGGAGVGKTVLIQELIHNIAQEHNGISVFTGVGERTREGNDLYFEMKASGVLEKTAMVYGQMNEPPGARMRVALTGLTIAEYFRDVEGQDVLLFIDNIFRFTQAGSEVSALLGRIPSAVGYQPTLATEMGQLQERITSTKKGSITSIQAVYVPADDYTDPAPATTFAHLDATTNLERSLTQQGIYPAVDPLASTSSALDPAVVGEEHYKVATDVQHVLQRYRELQDIISILGMDELSDEEKTIVGRARRIQFFLSQNFSVAEQFTGKPGSYVPVEETVKGFEGILEGKYDDLPEDAFNGVGNIDEVVEKAKQLTSATSK

SEQ ID NO: 7000 - DNA, 1407 bp, Thermotoga neapolitana
  CDS (1)..(1407): transl_table=11
atggcaaagggttcaaaaggatacatagtgggagtgatggggcccgtcgtggatgtgaagttccccgaagaagaacttccagacatattcaacgcccttgaggtcgtgaatcctcaaacggggcagaagattgttcttgaagtagaacaactcataggagacggtgtcgtgagaacggtggcgatggactccaccgatgggctcatgaagggtctggaagtggttgatacgggtgaaccaattaccgctcccgtgggaaaagaagtactcggaagaatactgaacgttataggagagcccgtggacgaagccggcgagataaagtcgaaggaaaggtggccgatccacaggcctgctcctgaacttatagaacagtccaccgagatcgaaatcctcgagacggggataaaagttatcgatctgcttgcaccgtttccaaagggtggaaaaataggtttcttcggtggtgcaggtgttggtaaaaccgtgctcgttatggaattgatcagaaacatcgctatagagcataagggattttccgtgttcgcgggtgttggtgagaggacaagagagggaaacgaactctggcttgaaatgcaggaaagcggcgttcttggtaacactatcctcgtcttcggacagatgaacgaaccaccgggggcaaggttcagggttgccttgaccgcgctcacaatagccgaatacttcagggacgttgaaggaagagacgttcttctcttcatagacaacatattcaggttcgttcaggcgggaagtgaggtttctgctttgcttggaagaatgccgtccgcagttggttatcagcccacccttgcaaccgacatgggagagctccaggagagaatcacctcgaccaggagaggatccatcacttccgttcaggccatttacgtacccgcagacgacataactgatcctgcccccgcaaccaccttcgctcacctggatgcgaccgtcgttctgtcaagaagaatagcagagctcgggctttaccctgctgttgacccgctcgattcttcttcgaagatactcgatcccgctgtcgttggaagagaacactacgaagtggcaagaggtgttcaggaagtactccagaggtacaaggacctgcaggatatcatagccatcctcggtgtaaaggagttgtctccggaggacaaactcgttgttcaccgcgcaaggagaattcagaggttcttgagtcagcctttccacgttgctgaaaggttcacaggaagacccggtaaatacgttcctcttgaggagacgatcagaggtttcaaagagatcctcgatggaaagcttgacgatgtccctgaacaggcgtttctcatggccggaaccatcgacgaagtcaaagagcgcgctaaagagatgaggagttga

SEQ ID NO: 7001 - protein, 468 aa, Thermotoga neapolitana
MAKGSKGYIVGVMGPVVDVKFPEEELPDIFNALEVVNPQTGQKIVLEVEQLIGDGVVRTVAMDSTDGLMKGLEVVDTGEPITAPVGKEVLGRILNVIGEPVDEAGEIKSKERWPIHRPAPELIEQSTEIEILETGIKVIDLLAPFPKGGKIGFFGGAGVGKTVLVMELIRNIAIEHKGFSVFAGVGERTREGNELWLEMQESGVLGNTILVFGQMNEPPGARFRVALTALTIAEYFRDVEGRDVLLFIDNIFRFVQAGSEVSALLGRMPSAVGYQPTLATDMGELQERITSTRRGSITSVQAIYVPADDITDPAPATTFAHLDATVVLSRRIAELGLYPAVDPLDSSSKILDPAVVGREHYEVARGVQEVLQRYKDLQDIIAILGVKELSPEDKLVVHRARRIQRFLSQPFHVAERFTGRPGKYVPLEETIRGFKEILDGKLDDVPEQAFLMAGTIDEVKERAKEMRS

SEQ ID NO: 7002 - DNA, 1452 bp, Synechococcus sp
  CDS (1)..(1452)
atggtagctacacaagaaaaaactttaggtaaaatcactcagatcattggccctgtcattgacgcagagttccccagtggcaaaatgcctcggatttataacgctttaaaaatccaaggaaaaaacccctacggtcaagaaatcaacctcacctgtgaagttcaacagttgctcggcgacaaccaagtccgggccgttgccatgagctccaccgacggtctcgttcgcggcatggatatcctcgacactggtgctcccatcagcgttcccgtagggaagaaaaccctcggtcggattttcaacgttctcggtgaacccgtagacgaaaaaggcgaagttggcgcagaagaaacttctccgatccaccgccctgctcctaagctgaccgaacttgacacagctccttctgtgtttgaaacgggcattaaagttgttgaccttcttactccctaccgtcgtggtgggaaaattggtctctttggtggtgctggtgttggtaaaaccgtcatcatgatggagctgatcaacaacatcgccaccaaccacggtggtgtgtctgtattcgctggtgtaggggaacggacccgtgaagggaatgacctttacaacgaaatgatcgaatctggcgttatcaaccccgataacctcaacgattccaagatcgccctcgtgtacggtcagatgaacgagccccccggagcccggatgcgggttggtctgtctggtttgaccatggcggaatatttccgtgatgtaaacaagcaggacgtactgcttttcgttgacaacattttccgctttgtccaggctggttctgaggtatcggcactgctcggtcggatgccttctgcggtaggttatcagcccaccctcggtactgacgttggggatctccaagagcgcattacctccaccaaggaaggttctatcacctcgatccaagcagtttatgttctagcggatgacttgacagaccctgctccggcaaccaccttcgctcacctcgacggtactactgtactttcccgtgctttggcttccaaagggatttatcctgctgtggatccccttgattccaccagtacaatgcttcagcccagcatcgtgggtgaagaccactacaacacggcgcgtgcggtacagtctaccctccagcgctataaggaactccaggacatcatcgcgattcttggtttggacgaactttctgaagaagaccgtctgaccgtagaccgggcccggaagattgagcgtttcttgtctcagcctttcttcgtggcagaggtatttaccggttctcctggtaagtatgtgacccttgaagaaaccattgaaggcttcaagcgcatcctctctggtgaattagatgatctacctgagcaggcgttctacctcgttggcaacatcgaagaggcgatcgccaaaggcaagaagctcaaagagcaaggctaa

SEQ ID NO: 7003 - protein, 483 aa, Synechococcus sp
MVATQEKTLGKITQIIGPVIDAEFPSGKMPRIYNALKIQGKNPYGQEINLTCEVQQLLGDNQVRAVAMSSTDGLVRGMDILDTGAPISVPVGKKTLGRIFNVLGEPVDEKGEVGAEETSPIHRPAPKLTELDTAPSVFETGIKVVDLLTPYRRGGKIGLFGGAGVGKTVIMMELINNIATNHGGVSVFAGVGERTREGNDLYNEMIESGVINPDNLNDSKIALVYGQMNEPPGARMRVGLSGLTMAEYFRDVNKQDVLLFVDNIFRFVQAGSEVSALLGRMPSAVGYQPTLGTDVGDLQERITSTKEGSITSIQAVYVLADDLTDPAPATTFAHLDGTTVLSRALASKGIYPAVDPLDSTSTMLQPSIVGEDHYNTARAVQSTLQRYKELQDIIAILGLDELSEEDRLTVDRARKIERFLSQPFFVAEVFTGSPGKYVTLEETIEGFKRILSGELDDLPEQAFYLVGNIEEAIAKGKKLKEQG

SEQ ID NO: 7004 - DNA, 1515 bp, Oenococcus oeni
  CDS (1)..(1515): transl_table=11
atggcagaaaagaaaacaacaaaagctactgcttcaagtacgagcaaagttgctaaaagaacccgtggttcaaagtctactcaaactaaggcctctgtttcgaatgaaaaggatttggctgaaggaactgttcttcaggttatcggaccgattgtagatgtccagtttcctgataataagaaacttcctgatatcaacaatgctttaaaggttcaacgaattgatggttctgaattgactatcgaagtttcaattgatcttggcgacagtgtagttcggacgattgcgatggattcgacagatggattgactcgtggcatgaaggttcttgataccggtgctcctattgaagttccggttggagaagcgacgttgggacgtgtctttaatgttcttggtgagcctgttgatggaggagatccaattcctaatagcgttgaccgccatccgattcatcgttcggcgccaaagtatgatgaattggcaacttcagccgaagtacttgaaacaggtatcaaagttattgatttacttgagccctatttgcgtggtggaaaaactggactatttggtggcgccggcgttggtaagactgttttaattcaggaattaattcataatatcgctcagggccataatggaatttctgtctttaccggagttggtgaacgtactcgtgaaggcaatgatatgtattacgaaatgaaggcaagcggtgttcttaaaaataccgccatggtctatggacaaatgaacgagccgcctggagcgcgtatgcgtgtcggtttgactggactgacgatggccgaagattttcgtgatcaagaaggtaaggatgttctcttatttattgataacatctttaggttcacacaagccggttcggaagtttctgctttacttggccgtattccttcagccgttggttaccagccgacattagctacggaaatgggtcaactgcaggaacggattacttcaactaagaagggatcagttacttcaattcaagcggtttacgttccggctgatgattatactgatccggctccggcaacaacttttgctcatttggatgctacaaccaatttggagcggtctctaacacaacaaggtatttatcccgctgttgatccattggaatctacttctagtgctttaacacctgatattgttggtgaagatcactatgaggttgctacacaggttcaacatttcttgcagcgttataaggagttgcaggatatcatttcgattctaggaatggatgaattgtctgatgaagagaaaacgatcgttaatcgtgctcgtcgtatccaattcttcttaagtcagcctttttctgttgctgaacagtttaccggcgttcctggacagtatgttccggttgaggacacagttcgtggatttaaggaaattcttgatggcaagcatgacgatcttcctgaagaagcatttagaaatgttggtacgatagaacaagcagttgaaaaggctaaaaagctggaaagctag

SEQ ID NO: 7005 - protein, 504 aa, Oenococcus oeni
MAEKKTTKATASSTSKVAKRTRGSKSTQTKASVSNEKDLAEGTVLQVIGPIVDVQFPDNKKLPDINNALKVQRIDGSELTIEVSIDLGDSVVRTIAMDSTDGLTRGMKVLDTGAPIEVPVGEATLGRVFNVLGEPVDGGDPIPNSVDRHPIHRSAPKYDELATSAEVLETGIKVIDLLEPYLRGGKTGLFGGAGVGKTVLIQELIHNIAQGHNGISVFTGVGERTREGNDMYYEMKASGVLKNTAMVYGQMNEPPGARMRVGLTGLTMAEDFRDQEGKDVLLFIDNIFRFTQAGSEVSALLGRIPSAVGYQPTLATEMGQLQERITSTKKGSVTSIQAVYVPADDYTDPAPATTFAHLDATTNLERSLTQQGIYPAVDPLESTSSALTPDIVGEDHYEVATQVQHFLQRYKELQDIISILGMDELSDEEKTIVNRARRIQFFLSQPFSVAEQFTGVPGQYVPVEDTVRGFKEILDGKHDDLPEEAFRNVGTIEQAVEKAKKLES

SEQ ID NO: 7006 - DNA, 1473 bp, Ipomoea tiliacea
  CDS (1)..(1473)
atgagaatcaatcctactacttctggttctgaagtttccacggttgaaaaaaaaaacctggggcgtatcgtcaaaatcattggtccggtattagatgtagcttttcctcccgggaagatgcctaatatttataatgctctggtagttcaagggcgaggcaatgaacaaacgaacgtgacttgcgaggtacagcaattattgggaaataatcgagttagagctgtagctatgagtgatacagatggtctaatgagagggatggaagtgattgacacgggagctcctataagtgttccggtcggtggatcgactctgggacgaattttcaacgtgctcggacaacctgttgataatttaggtcctgtagagactaatacaacgtctcctattcatagatctgcgcccgcctttatacagttagatacaaaattatctatttttgaaacaggaattaaagtagtagatcttttagccccctatcgccgtgggggaaaaatcggactatttgggggagctggagtggggaaaacagtactcattatggaattgattaacaatattgccaaagctcacgggggagtatccgtatttggcggagtgggtgaacgtactcgtgaaggaaatgatctttacttggaaatgaaagaatccggagtgattaatgaagaaaatattcccgaatcaaaagtggccctagtttacggtcagatgaatgaaccgccgggagctcgtatgagagttggtttgactgccctaactatggcagaatatttccgagatgttaatgagcaagacgtacttctatttatcgacaatatctttcgtttcgtccaagcgggatcggaagtatcggccttactgggtagaatgccttctgctgtgggttatcaaccgaccctgagtaccgaaatgggttctttacaagaaagaattacttccaccaaagaaggttccataacctcgattcaagcagtttatgtacctgcagatgatttgaccgatcctgctcctgctacgacatttgcacatttagatgcgactaccgtactatcaagaggtttagctgccaagggtatctatccagcagtagatcctttagattcaacgtcaacgatgcttcaacctcggatcgttggtgaggaacattatgaaactgcgcaaagagttaagcaaactttacaacgttacaaagaacttcaggacattatagctatccttgggttggacgaattatccgaagaggatcgtttaaccgtagcaagagcgcgaaaaattgagcgtttcttatcacaaccctttttcgtagcagaagtatttactggttctccaggaaaatatgttggtctagcagaaacaattagaggatttcaattgatcctttccggcgaattagatggtcttcctgaacaggccttttatttggtaggtaatatcgatgaagctaccgcgaaggcgatgaacttaaaaacttag

SEQ ID NO: 7007 - protein, 490 aa, Ipomoea tiliacea
MRINPTTSGSEVSTVEKKNLGRIVKIIGPVLDVAFPPGKMPNIYNALVVQGRGNEQTNVTCEVQQLLGNNRVRAVAMSDTDGLMRGMEVIDTGAPISVPVGGSTLGRIFNVLGQPVDNLGPVETNTTSPIHRSAPAFIQLDTKLSIFETGIKVVDLLAPYRRGGKIGLFGGAGVGKTVLIMELINNIAKAHGGVSVFGGVGERTREGNDLYLEMKESGVINEENIPESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLKT

SEQ ID NO: 7008 - DNA, 1497 bp, Oryza sativa subsp
  CDS (1)..(1497)
atgagaaccaatcctactacttctcgtcctggggtttctacaattgaagaaaaaagtacagggcgtatcgatcaaattattggacccgtgctggatgttacttttcccccgggcaagttaccttatatttataatgctttggtagtcaagagtcgagacactgacggtaagcaaattaatgtaacttgtgaggtacaacaattattaggaaataatcgagttagagctgtagctatgagtgctacagatgggttgatgagaggaatggaagtgattgacacgggagctcctctcagtgttcctgtcggtggagctactcttggacgaattttcaacgttcttggggagcctgttgacaatttgggtcctgtagatactagtgcaacattccctattcatagatccgcgcccgcctttatcgagttagatacgaaattatccatctttgaaactggtattaaggtggtcgatcttttagctccttatcggcgtggaggaaaaatcggactatttgggggagctggagtaggtaaaacagtactcatcatggaattaatcaacaatattgctaaagctcacgggggcgtatccgtatttggcggagtaggggaacggactcgtgaaggaaatgatctttatatggaaatgaaggaatctggagtaattaatgaaaaaaatcttgaggaatcaaaggtagctctagtctatggccaaatgaatgaaccgccaggagctcgtatgagagttggtttgactgccctaactatggcagaatatttccgagatgttaataagcaagacgtgcttctattcatcgataatatctttcgttttgttcaagcaggatcggaggtatctgccttattagggagaatgccctctgcagtgggttatcaacctactcttagtacagaaatgggttctttgcaagaaagaattacttctactaaaaagggatctataacttcgatccaagcggtttatgtacctgcggacgatttgaccgaccctgctcctgctacaacatttgcacatttggatgctactaccgtactttccagaggattagcttccaaagggatttatcctacagtagatcctttagattcaacctcaactatgttacaacctcggatcgttggcaacgaacattatgaaactgcgcaaagagttaagcaaactttacaacgttacaaagaacttcaggacattatcgcaattcttgggttggatgaattatcggaggaggatcgtttaactgtagcaagagcacgaaaaattgagcgcttcttatcacaaccgttttttgtggcagaagtttttaccggttctccgggaaagtatgttggtcttgcagaaactattaggggatttcaactaatcctttccggagaattagatggcctacccgaacaggctttttatttggtgggtaacatcgatgaagctagcacgaaagctataaacttagaagaggagaacaaattgaagaaatga

SEQ ID NO: 7009 - protein, 498 aa, Oryza sativa subsp
MRTNPTTSRPGVSTIEEKSTGRIDQIIGPVLDVTFPPGKLPYIYNALVVKSRDTDGKQINVTCEVQQLLGNNRVRAVAMSATDGLMRGMEVIDTGAPLSVPVGGATLGRIFNVLGEPVDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNLEESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPTVDPLDSTSTMLQPRIVGNEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEASTKAINLEEENKLKK

SEQ ID NO: 7010 - DNA, 1407 bp, Streptococcus pneumoniae
  CDS (1)..(1407): transl_table=11
atgagttcaggtaaaattgctcaggttatcggtcccgttgtagacgttttgtttgcagcaggggaaaaacttcctgagattaacaatgcacttgtcgtctacaaaaatgacgaaagaaaaacaaaaatcgtccttgaagtagccttggagttaggagatggtatggttcgtactatcgccatggaatcaacagatgggttgactcgtggaatggaagtattggacacaggtcgtccaatctctgtaccagtaggtaaagaaactttgggacgtgtcttcaacgttttgggagataccattgacttggaagctccttttacagaagacgcagagcgtcagccaattcataaaaaagctccaacttttgatgagttgtctacctcttctgaaatccttgaaacagggatcaaggttattgaccttcttgccccttaccttaaaggtggtaaagttggacttttcggtggtgccggagttggtaaaactgtcttaatccaagaattgattcacaacattgcccaagagcacggtggtatttcagtatttgctggtgttggggaacgtactcgtgaggggaatgacctttactgggaaatgaaagaatcaggcgttatcgagaaaacagccatggtctttggtcagatgaatgagccaccaggagcacgtatgcgtgttgcccttactggtttgacaatcgctgaatacttccgtgatgtggaaggccaagacgtgcttctctttatcgataatatcttccgtttcactcaggctggttcagaagtatctgcccttttgggtcgtatgccatcagccgttggttaccaaccaacacttgctacggaaatgggtcaattgcaagaacgtatcacatcaaccaagaagggttctgtaacctctatccaggctatctatgtgccagcggatgactatactgacccagcgccagcaacagccttcgctcacttgaattcaacaacaaacttggaacgtaagttggtacaattgggtatctacccagccgttgacccacttgcttcaagctcacgtgccttggcacctgaaatcgttggagaagagcactatgcagttgctgctgaagtaaaacgtgtccttcaacgttaccatgaattgcaagatatcattgctatccttggtatggatgagctttctgatgaagaaaagaccttggttgctcgcgcccgtcgtatccagttcttcttgtcacaaaacttcaacgttgcggaacaatttactggtcagccaggttcttatgttccagttgctgaaactgtacgtggctttaaggaaatccttgatggtaaatacgaccacttgccagaagatgccttccgtggtgtaggttctatcgaagatgtgattgcaaaagctgaaaaaatgggattttaa

SEQ ID NO: 7011 - protein, 468 aa, Streptococcus pneumoniae
MSSGKIAQVIGPVVDVLFAAGEKLPEINNALVVYKNDERKTKIVLEVALELGDGMVRTIAMESTDGLTRGMEVLDTGRPISVPVGKETLGRVFNVLGDTIDLEAPFTEDAERQPIHKKAPTFDELSTSSEILETGIKVIDLLAPYLKGGKVGLFGGAGVGKTVLIQELIHNIAQEHGGISVFAGVGERTREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTKKGSVTSIQAIYVPADDYTDPAPATAFAHLNSTTNLERKLVQLGIYPAVDPLASSSRALAPEIVGEEHYAVAAEVKRVLQRYHELQDIIAILGMDELSDEEKTLVARARRIQFFLSQNFNVAEQFTGQPGSYVPVAETVRGFKEILDGKYDHLPEDAFRGVGSIEDVIAKAEKMGF

SEQ ID NO: 7012 - DNA, 1398 bp, Clostridium pasteurianum
  CDS (1)..(1398): transl_table=11
atgccagaacatataggtaaagttgttcaggtaataggacctgttatagatataaaatttgcaagcgaaaaccttcctaatatatataatgcattagaaataggcatgggagataaaatacttatagcagaagttgaacagcatataggtgatgatgtagtaagagctatatctatggaaccaactgatggcttaagaagaggagcaaaggcagttgatacagaaaagccaatttcagttcctgtaggaaagccagttttaggacgtctctttaatgtattaggaaagacaatcgatgaagcaggagatttgaaggatgatgaatattatcctatacacagattaccaccaagctttgaggaacaatcagtagtacctgaaatgtttgaaactggtataaaagtaatagatttacttgcgccatatcaaaagggtggtaagattggattattcggaggtgctggtgttggtaaaacagttcttatacaagagcttatcaacaatatagcaaaagagcatggtggattgtcagtatttactggtgttggtgagcgtactcgtgagggtaatgacctttattatgaaatgaaggagtctggagttatagacaagactgccttagtgtttggacaaatgaatgaaccacctggtgctagaatgagagttgcacttacagggcttacaatggcagaaaagtttagagatgaaggacaggatgtacttttatttatagataacatatttagatttacccaagctggttcagaggtttctgcactgcttggaagaatacctagtgccgttggttatcagccaacacttgctactgaaatgggtgctcttcaagagagaataacttctacaaagcatggttcaataacgtctgttcaagctgtatatgttccagcagatgatttaacagacccggcaccagctacaacttttactcatcttgatgctacaacagttttatcaagatctatatcagagctcggtatttatccggctgttagtcctcttgaatctagttcaagaatacttgatcctaatatagttggggaagaacattatcaggttgcaagtaaagtaaaacttattcttgaaaggtataatgaacttcaagatataatagctatacttggtgtagatgaattatcggaagaagatagggctatcgttaatagagcaagaaggattcaaagatttttatctcaacctttctctgtagcagagcagtttactggtatgcagggtaagtttgttagcgtatcagatacaataaagggctttaaagaaatacttgaaggtaaatgcgatgacttacctgaagcagcatttttatttgttggtactatagaagaagcaagagaaaaagctaaatctatgatggaaagctaa

SEQ ID NO: 7013 - protein, 465 aa, Clostridium pasteurianum
MPEHIGKVVQVIGPVIDIKFASENLPNIYNALEIGMGDKILIAEVEQHIGDDVVRAISMEPTDGLRRGAKAVDTEKPISVPVGKPVLGRLFNVLGKTIDEAGDLKDDEYYPIHRLPPSFEEQSVVPEMFETGIKVIDLLAPYQKGGKIGLFGGAGVGKTVLIQELINNIAKEHGGLSVFTGVGERTREGNDLYYEMKESGVIDKTALVFGQMNEPPGARMRVALTGLTMAEKFRDEGQDVLLFIDNIFRFTQAGSEVSALLGRIPSAVGYQPTLATEMGALQERITSTKHGSITSVQAVYVPADDLTDPAPATTFTHLDATTVLSRSISELGIYPAVSPLESSSRILDPNIVGEEHYQVASKVKLILERYNELQDIIAILGVDELSEEDRAIVNRARRIQRFLSQPFSVAEQFTGMQGKFVSVSDTIKGFKEILEGKCDDLPEAAFLFVGTIEEAREKAKSMMES

SEQ ID NO: 7014 - DNA, 1344 bp, Carsonella ruddii
  CDS (1)..(1344): transl_table=11
atgataggaagaattgtacaaattttaggttctatagtagacgttgaatttaaaaaaaacaatattccatatatatataatgccttatttattaaagaatttaatttatatttagaagttcaacaacaaattggaaataatattgtaagaactatagctttaggtagtacctatggattaaaaagatatcttttagtaatagatactaaaaaaccaattttaactcctgttggaaattgtactttaggacgtatattgaatgttttaggtaatcctattgataataatggtgaaattatttcaaacaaaaaaaaaccaatacattgttcaccgccaaaattttcagatcaagtattttcaaataatatattagaaactggaataaaagtaatagatttattgtgtccatttttaagaggaggaaaaattggtttatttggtggagcaggtgttggtaaaactataaatatgatggaattaataagaaatattgcaattgaacataaaggatgttctgtatttataggagttggtgaaagaactcgtgaaggaaatgatttttattatgaaatgaaagaatcaaatgtattagacaaagtttctttaatatatggtcaaatgaatgaaccttcaggtaatagattaagagttgcattaactggattaagtatagcagaagaatttagagaaatgggtaaagatgtacttttatttatagataatatttacagatttacgttagcaggtactgaaatttcagcattattgggaagaatgccttcagctgttggatatcagcctactttagcagaagaaatgggaaaattacaagaaagaatttcttcaacaaaaaatggaagtattacttcagtacaagctatatacgtacctgctgatgatttaacagatccatctccaagtactacttttactcatttagattctactattgttttgtctagacaaatagcggaattaggaatttatcctgctattgatccattagaatcttattctaaacaattagatccttatatagtaggaattgaacattatgaaattgctaattctgtaaaattttatttacaaaaatataaagaattaaaagatacaatagctattttaggaatggacgaattatcagaaaatgatcaaattattgttaaaagagcaagaaagttgcaaagatttttttctcaacctttttttgttggtgaaataattacaggaataaaaggagaatatgtaaatataaaagatacaattcaatgttttaaaaatattttaaatggtgaatttgataatattaatgaaaaaaatttttatatgataggaaaaatatga

SEQ ID NO: 7015 - protein, 447 aa, Carsonella ruddii
MIGRIVQILGSIVDVEFKKNNIPYIYNALFIKEFNLYLEVQQQIGNNIVRTIALGSTYGLKRYLLVIDTKKPILTPVGNCTLGRILNVLGNPIDNNGEIISNKKKPIHCSPPKFSDQVFSNNILETGIKVIDLLCPFLRGGKIGLFGGAGVGKTINMMELIRNIAIEHKGCSVFIGVGERTREGNDFYYEMKESNVLDKVSLIYGQMNEPSGNRLRVALTGLSIAEEFREMGKDVLLFIDNIYRFTLAGTEISALLGRMPSAVGYQPTLAEEMGKLQERISSTKNGSITSVQAIYVPADDLTDPSPSTTFTHLDSTIVLSRQIAELGIYPAIDPLESYSKQLDPYIVGIEHYEIANSVKFYLQKYKELKDTIAILGMDELSENDQIIVKRARKLQRFFSQPFFVGEIITGIKGEYVNIKDTIQCFKNILNGEFDNINEKNFYMIGKI

SEQ ID NO: 7016 - DNA, 1383 bp, Salmonella typhimurium
  CDS (1)..(1383): transl_table=11
atggctactggaaagattgtccaggtaatcggcgccgtagttgacgtcgaattccctcaggatgccgtaccgcgcgtgtacgatgctcttgaggtgcaaaatggtaatgagcgtctggtgctggaagttcagcagcagctcggcggcggtatcgtgcgtaccatcgcaatgggttcctccgacggtctgcgtcgcggtctggatgtaaaagacctcgaacacccgatcgaagtcccggtaggtaaagcgactctgggccgtatcatgaacgtactgggtgaaccggtcgacatgaaaggcgagatcggtgaagaagagcgttgggcgattcaccgcgcagcaccttcctacgaagagctgtcaaactctcaggaactgctggaaaccggtatcaaagttatcgacctgatgtgtccgttcgctaagggcggtaaagttggtctgttcggtggtgcgggtgtaggtaaaaccgtaaacatgatggagctcattcgtaacatcgcgatcgagcactccggttactctgtgtttgcgggcgtaggtgaacgtactcgtgagggtaacgacttctaccacgaaatgaccgactccaacgttatcgacaaagtatccctggtgtatggccagatgaacgagccgccgggaaaccgtctgcgcgttgctctgaccggtctgaccatggctgagaaattccgtgacgaaggtcgtgacgttctgctgttcgttgacaacatctatcgttacaccctggcaggtacggaagtatccgcactgctgggccgtatgccttcagcggtaggttatcagccgaccctggcggaagagatgggcgttctgcaggaacgtatcacctccaccaaaactggttctatcacctccgtacaggcagtatacgtacctgcggatgacttgactgacccgtctccggcaaccacctttgcgcaccttgacgcaaccgtggtactgagccgtcagatcgcgtctctgggtatctacccggccgttgacccgctggactccaccagccgtcagctggacccgctggtggttggtcaggaacactacgacaccgcgcgtggcgttcagtccatcctgcaacgttatcaggaactgaaagacgtcatcgccatcctgggtatggatgaactgtctgaagaagacaaactggtggtagcgcgtgctcgtaagatccagcgcttcctgtcccagccgttcttcgtggcagaagtattcaccggttctccgggtaaatacgtctccctgaaagacaccatccgtggctttaaaggcatcatggaaggcgaatacgatcacctgccggagcaggcgttctacatggtcggttccatcgaagaagctgtggaaaaagccaaaaaactttaa

SEQ ID NO: 7017 - protein, 460 aa, Salmonella typhimurium
MATGKIVQVIGAVVDVEFPQDAVPRVYDALEVQNGNERLVLEVQQQLGGGIVRTIAMGSSDGLRRGLDVKDLEHPIEVPVGKATLGRIMNVLGEPVDMKGEIGEEERWAIHRAAPSYEELSNSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDTARGVQSILQRYQELKDVIAILGMDELSEEDKLVVARARKIQRFLSQPFFVAEVFTGSPGKYVSLKDTIRGFKGIMEGEYDHLPEQAFYMVGSIEEAVEKAKKL

SEQ ID NO: 7018 - DNA, 1437 bp, Lactobacillus acidophilus
  CDS (1)..(1437): transl_table=11
ttgagtgaaggtgaaatcgttcaagtaatcggccctgttgtcgatgtaaaattcccaatcgataagaatttacctgatattaacaacgccttacgtgtaatcaagtccgaagatgaaagcatcgttcttgaagttacacttgaactcggtgatggtgttttaagaacaatcgccatggaatctaccgatggtcttcgtcgtggtatgaaagtcgaagatactggcgctccaatttcagttccagttggagaagacactttaggtcgtgtgtttaacgtattaggacagcctattgatggtggtccagccttaccaaaggatcacccacgtgagggtatccacaaggaagcaccaaaatatgaaaatttaactactagtcgtaaaaatcttgaaactggtatcaaggttatcgaccttcttgaaccatatgttcgtggtggtaaagttggtttgtttggtggtgccggtgttggtaaaactactattattcaaaaaataattcacaacatcgctcaagaacacggtggtatttccgtatttactggtgttggtgaaagaactcgtgaaggtaatgacctttactttgaaatgaaagcttcaggcgttttaagtaagactgccatggtatttggtcagatgaacgagccgcctggtgccagaatgcgtgttgcattaaccggtttgacacttgctgaatactttagagatgttgaaggtcaagacgtattgctctttattgacaatatctttagatttactcaggctggttcagaggtatctgctttgcttggtcgtatgccaagtgccgtagggtaccaaccaacaatcaccagaatgggtcaattgcaggaaagaattacttctactaagaagggttcaattacttcaattcaagccgtttatgttcctgccgatgactatactgacccagctccatcaaccacattcgcatacttggatgctactactaacttggaacgtagtttagtagaacaaggtatttatccagctgttgatccacttgaatcatcttcaagtgcccttgatcctgaagaagttgggcaggaacactatgaagttgctactcgtgttcaacatgttttgcaacgttaccatgaattacaagatattatttctgttttaggtatggatgaattgtcagatgaagaaaaattgatcgttgctcgtgcacgtaaagttcaattcttcttgtcacaaaacttctttgttgcagaacaatttactggtgtaccaggttcatatgttccaattaaagaaaccattaagggctttaagcttatcttagatggtcaccttgatgatttaccagaagatgccttccgtggtgtcggcccaattgaagatgttttgaagaaagcacaagaaatgggtgtaactccaagtgatccagaagctaaagcattactagaaaagtag

SEQ ID NO: 7019 - protein, 478 aa, Lactobacillus acidophilus
MSEGEIVQVIGPVVDVKFPIDKNLPDINNALRVIKSEDESIVLEVTLELGDGVLRTIAMESTDGLRRGMKVEDTGAPISVPVGEDTLGRVFNVLGQPIDGGPALPKDHPREGIHKEAPKYENLTTSRKNLETGIKVIDLLEPYVRGGKVGLFGGAGVGKTTIIQKIIHNIAQEHGGISVFTGVGERTREGNDLYFEMKASGVLSKTAMVFGQMNEPPGARMRVALTGLTLAEYFRDVEGQDVLLFIDNIFRFTQAGSEVSALLGRMPSAVGYQPTITRMGQLQERITSTKKGSITSIQAVYVPADDYTDPAPSTTFAYLDATTNLERSLVEQGIYPAVDPLESSSSALDPEEVGQEHYEVATRVQHVLQRYHELQDIISVLGMDELSDEEKLIVARARKVQFFLSQNFFVAEQFTGVPGSYVPIKETIKGFKLILDGHLDDLPEDAFRGVGPIEDVLKKAQEMGVTPSDPEAKALLEK

SEQ ID NO: 7020 - DNA, 1668 bp, Nicotiana sylvestris
  CDS (1)..(1668)
atgtcttctcggaggcttctagcctctctcctccgatcaaccgcccaacgcggcggcgctatttccagatctccattagcaaattccattcccagaactacttcacgggcctcaccgaaaggattcctcttaaaccgagccgttaagtacgctacctcagctgctgctgagaagccgaaggcgactcctcctaaaccttccggtaatgaacctactgggaaaatcacagatgaattcaccggcgctggttcgatcgggaaagtgtgtcaggttattggtgccgtactagatgtgagattcgatgaaggtttgcctccgatccttacggcgcttgaggttttggataaccagatccggcttgtgcttgaggttgctcagcatttgggtgagaatatggttaggactattgctatggatggtactgaaggtcttgttcgtggtcaacgtgtcctcaatactggctctcctatcactgtccctgttggtagagccacccttggtcgtattattaatgtcattggagagcctattgatgagagaggcgacattaacaccgatcactttttgccaattcatcgtgaagctcctgcctttgttgagcaggcaactgaacaacaaattctcgttactggtatcaaggttgttgatcttcttgccccttaccaaaggggaggaaagattgggctttttggtggtgctggtgttgggaagactgtgcttattatggaactgattaacaacgttgcaaaagcgcacggtttctctgtctttcctggtgttggtgaacccagtgctgagggcaatgatttgtacagggaaatgattgaaagtggtgttattaagcttggtgacaagcaaagtgaaagcaagtgcgctcttgtgtacggtcaaatgaatgagccccctggtgctcgtgcccgtgttggtcttacaggcttgactgtggctgagcacttcagagatgctgaggggcaggatgtgcttctcttcattgacaacattttcagatttacccaggctaactcagaggtgtctgctttgcttggtcgtatcccatccgctgtcggttatcaaccaactttggctacagatcttggaggtcttcaagagcgtatcactacaaccaagaaaggttctattacatcagtccaagctatttatgtgcctgctgatgacttgacagatcctgcccctgcaactacctttgctcatttggatgccacaactgtcttgtcccgtcaaatttctgagctaggtatttaccctgctgtcgatcctcttgattctacatctcgtatgctctcacctcacattttgggagaagaccactacaatactgctcgtggggtacagaaagttcttcagaactacaagaatcttcaagatattattgccattttgggtatggatgagcttagtgaagatgataagatgactgttgcccgtgcacgtaaaatccaaagattccttagtcagcctttccatgttgctgaagttttcacgggtgcccctggaaagtatgttgacttgaaggagagcattaacagtttccagggagtcttggatggaaaatacgatgatctttcagaacagtccttctatatggttggtggaatcgatgaggtcattgccaaggcagaaaaaattgccaaggaatctgcagcttag

SEQ ID NO: 7021 - protein, 555 aa, Nicotiana sylvestris
MSSRRLLASLLRSTAQRGGAISRSPLANSIPRTTSRASPKGFLLNRAVKYATSAAAEKPKATPPKPSGNEPTGKITDEFTGAGSIGKVCQVIGAVLDVRFDEGLPPILTALEVLDNQIRLVLEVAQHLGENMVRTIAMDGTEGLVRGQRVLNTGSPITVPVGRATLGRIINVIGEPIDERGDINTDHFLPIHREAPAFVEQATEQQILVTGIKVVDLLAPYQRGGKIGLFGGAGVGKTVLIMELINNVAKAHGFSVFPGVGEPSAEGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHILGEDHYNTARGVQKVLQNYKNLQDIIAILGMDELSEDDKMTVARARKIQRFLSQPFHVAEVFTGAPGKYVDLKESINSFQGVLDGKYDDLSEQSFYMVGGIDEVIAKAEKIAKESAA

SEQ ID NO: 7022 - DNA, 1407 bp, Streptococcus sanguis
  CDS (1)..(1407): transl_table=11
atgagctcaggcaaaattgctcaggttatcgggccggtcgtagacgttgcgtttgcttccggagacaaactacctgagataaataatgcacttgtagtctataaaaatgatgagaaaaaatcaaaaatcgtccttgaagtagctcttgagcttggtgacggtgtggtgcggaccattgccatggagtcgaccgatggtttgacgcgtggtttggaggttttagatactggtcgtccgatttctgtgccggtcggaaaggaaactctaggccgggtgttcaatgttttaggggataccattgatttggatgcgccttttgcagatgatgcagagcgccagcctattcataagaaagcaccgacctttgatgaactatcgacttcatcagaaatcctggaaacaggaatcaaggttatcgacctgctagcaccttatctgaaaggtgggaaagtcggactctttggcggtgccggagtagggaaaacagtcctgattcaggaattgattcacaatattgcccaagagcacggtgggatttctgtcttcacaggtgttggtgaacggacgcgtgaagggaatgacctctactgggaaatgaaagaatctggcgttatcgaaaagaccgccatggtctttggtcagatgaatgaaccgccaggagctcggatgcgggttgctcttaccggactgaccatcgcggaatatttccgtgatgtggaaggtcaggacgtgttgctctttattgacaacatcttccgctttacgcaggctggttcggaagtgtctgccctcttggggcgtatgccgtcagccgttggttaccagccaacacttgcgacagagatgggacagttacaagagcggattacctcaaccaagaaaggttccgttacttcaatccaggctatctatgtgccagcggatgactatactgacccagcgccagcgacagcttttgctcacttggattctactaccaacctagaacggaaattggttcaacttgggatttatcctgccgtggatccactcgcttccagctcgcgtgccctttctcctgagattgtcggagaggagcactatgcagtggcagcagaggttaagcgggttctgcaacgttatcatgaattgcaggatatcatagctatccttggtatggacgaactgtctgacgacgagaagactttggttgcacgtgctcgtcgaatccagttcttcctatcacagaacttcaatgtggcagagcagtttaccggccagccaggttcttatgtaccagtagctgaaacggttcgtggcttcaaggaaatccttgaaggtaagcacgataagctaccggaagatgccttccgtggtgtaggctccatcgaggatgtattggccaaggctgagaaaatgggattctaa

SEQ ID NO: 7023 - protein, 468 aa, Streptococcus sanguis
MSSGKIAQVIGPVVDVAFASGDKLPEINNALVVYKNDEKKSKIVLEVALELGDGVVRTIAMESTDGLTRGLEVLDTGRPISVPVGKETLGRVFNVLGDTIDLDAPFADDAERQPIHKKAPTFDELSTSSEILETGIKVIDLLAPYLKGGKVGLFGGAGVGKTVLIQELIHNIAQEHGGISVFTGVGERTREGNDLYWEMKESGVIEKTAMVFGQMNEPPGARMRVALTGLTIAEYFRDVEGQDVLLFIDNIFRFTQAGSEVSALLGRMPSAVGYQPTLATEMGQLQERITSTKKGSVTSIQAIYVPADDYTDPAPATAFAHLDSTTNLERKLVQLGIYPAVDPLASSSRALSPEIVGEEHYAVAAEVKRVLQRYHELQDIIAILGMDELSDDEKTLVARARRIQFFLSQNFNVAEQFTGQPGSYVPVAETVRGFKEILEGKHDKLPEDAFRGVGSIEDVLAKAEKMGF

SEQ ID NO: 7024 - DNA, 1662 bp, Nicotiana sylvestris
  CDS (1)..(1662)
atggcttctcgaaggttcctttcctccatgctccgctcatccatacgtcactcttcctcaaaaccctcactcacaacccatatccaccgcccctctccggccggccaccttctccaccgcgccgtcaactacgccacctctgccgccgcaaaggcgacgcctgcacctcagaaaaaaactcctcctccgaagattaaggaaacaggcggtaagatcaccgatgagtacaccggcgctggtgccattgggagcgtatgtcaggtgatcggagctgttgtggatgtccggttcgatgaaggtctgccgccaattttgacggcgttagaagtgatggataatgatataaggttggtgctagaggtagctcaacatttgggagaaaatatggttaggactattgctatggatgggactgaagggcttgtgcgtggtcaaagagtcctcaatactggctcccctattactgtgcctgttggcagggctacacttggtcgaattataaatgtcattggagaggccattgatgaaaggggtgatataaaaacggatcattatctcccgattcaccgtgaagctccatcttttgttgaacaagcaactgagcaacagatccttgtgactggaattaaggtggtggatctacttgctccttatcaaaaaggtggaaagattggactttttggtggtgcaggtgttggaaagacggtgcttattatggagcttattaacaacgttgccaaggcccatggtggtttctcagtgtttgctggtgtcggtgaacgtactccggagggtaatgatttgtacagacaaatgattgagagtggtgttattaaccttggtgataaccagggtgaaagcaaatgtgctttggtatatggtcaaatgaatgaacctcctggtgctcgtgctcgtgttgggctcactgggctgacagttgctgaacacttccgagatgctgaagggcaagatgtgctccttttcatcgataatatttttcgcttcactcaagccaactctgaggtgtctgctttgcttggtcgtattccctctgctgtcggttaccagccaactttacctacacatcttggggggcttcaacagaggattactacaactaagaaggggtccatcacctcagtccaagctatctatgtgcctgctgatgacttgactgatcctgcccctgctaccacctttgctcaccttgatgctacaaccgtgttatctcggcagatttctgagcttggtatttatcctgcagtggatcccttagattctacgtcccgtatgctttctcctcatatcctaggtgaagatcattataatactgcgcgaggtgtacaaaaggttctccagaactacaagaatctccaggatattatcgccattctgggaatggatgaactgagtgaagatgacaaactaactgttgctcgtgctcgtaaaattcagaggttcttgagccagcctttccatgttgcagaagtatttactggtgcccctggaaagtatgtggatttgaaagagagcatccaaagttttcagggtgtcctggacgggaaatatgatgacctatcagagcaatcgttttacatggttgggggtatagaagaagtcattgctaaggctgagaagattgcgaaggagtcagctagttga

SEQ ID NO: 7025 - protein, 553 aa, Nicotiana sylvestris
MASRRFLSSMLRSSIRHSSSKPSLTTHIHRPSPAGHLLHRAVNYATSAAAKATPAPQKKTPPPKIKETGGKITDEYTGAGAIGSVCQVIGAVVDVRFDEGLPPILTALEVMDNDIRLVLEVAQHLGENMVRTIAMDGTEGLVRGQRVLNTGSPITVPVGRATLGRIINVIGEAIDERGDIKTDHYLPIHREAPSFVEQATEQQILVTGIKVVDLLAPYQKGGKIGLFGGAGVGKTVLIMELINNVAKAHGGFSVFAGVGERTPEGNDLYRQMIESGVINLGDNQGESKCALVYGQMNEPPGARARVGLTGLTVAEHFRDAEGQDVLLFIDNIFRFTQANSEVSALLGRIPSAVGYQPTLPTHLGGLQQRITTTKKGSITSVQAIYVPADDLTDPAPATTFAHLDATTVLSRQISELGIYPAVDPLDSTSRMLSPHILGEDHYNTARGVQKVLQNYKNLQDIIAILGMDELSEDDKLTVARARKIQRFLSQPFHVAEVFTGAPGKYVDLKESIQSFQGVLDGKYDDLSEQSFYMVGGIEEVIAKAEKIAKESAS

SEQ ID NO: 7026 - DNA, 1428 bp, Mycoplasma pulmonis
  CDS (1)..(1428): transl_table=4
atgagtcaaaaaaacgttggtaaaatagtacaaatattaggtcctgttgttgatatttcttttgctggacaaaaaattccagccatttacaataacttagaactagtttttgaaaacaataaatataactttgaagttgctcagcacataggtgatgaagttgttagaaccatttcaatggtctcaacaaatggactttctagaggtcttgaagtaattgacacaggagctccaataatggttcctgtaggaaaagaagtgctttcaagaatgtttaatgttttaggtcaaacaattgacaacaaaggtgaaattgaagccaaagaatttcgttcaattcacgctagtgctccttcatatgaagagcaaaatgattcaagtgaaattcttgaaacaggaattaaagtcattgacctactagttccttattcaaaaggtggaaaaattggactttttggaggagctggagttggaaaaactgttctagttcaagagttaattaacaacatagcaactcaacacggaggtctatcagtttttgctggtgtaggagagagaactcgtgaaggaaatgatctctatcatgaaatgattgcctcaggagttttagataaaaccactctagtttttggtcaaatgaatgaacctcctggagctagaatgagagttgctttaactgggctaactatggctgagtattttagagataaatttaaacaagatgtgcttttatttattgacaacatctttagatttactcaagcaggtagtgaagtttcagctcttttaggtcgtatgccctcagctgttggttatcaacctactttagcaactgaaatgggacaacttcaagagcgtattacctcaactaaaaatggttcaattacttctgttcaagctgtctatgttccagctgatgatctaacagatccagctcctgctacaacctttactcacttagatgccaaaactgttttagagcgtaacatagcagctttaggaatttatccagccattgatccacttgcctcttcttcaagaatgcttgatcctttaattattggtaatgagcactacttagtagcccttgaagttcaaaatatcttacaaagatttaaagaacttcaagacatcatcgctattctaggaataggagagctctctgaagaggataaaaaattagtctttagagctagaaaaattagaaactttttatctcaaccttttactgtagctgaaaaattctcaggtaaaaaaggtaagtttgttcctttaaaagaaactattagatcttttaaagaaattcttgaaggtaaacatgataatttacctgaagatgcttttttatatgtaggttcaattgatgaggcaatagaaaaagctaaaggacaaagcaatgcaactacagctaataataacaacgcctaa

SEQ ID NO: 7027 - protein, 475 aa, Mycoplasma pulmonis
MSQKNVGKIVQILGPVVDISFAGQKIPAIYNNLELVFENNKYNFEVAQHIGDEVVRTISMVSTNGLSRGLEVIDTGAPIMVPVGKEVLSRMFNVLGQTIDNKGEIEAKEFRSIHASAPSYEEQNDSSEILETGIKVIDLLVPYSKGGKIGLFGGAGVGKTVLVQELINNIATQHGGLSVFAGVGERTREGNDLYHEMIASGVLDKTTLVFGQMNEPPGARMRVALTGLTMAEYFRDKFKQDVLLFIDNIFRFTQAGSEVSALLGRMPSAVGYQPTLATEMGQLQERITSTKNGSITSVQAVYVPADDLTDPAPATTFTHLDAKTVLERNIAALGIYPAIDPLASSSRMLDPLIIGNEHYLVALEVQNILQRFKELQDIIAILGIGELSEEDKKLVFRARKIRNFLSQPFTVAEKFSGKKGKFVPLKETIRSFKEILEGKHDNLPEDAFLYVGSIDEAIEKAKGQSNATTANNNNA

SEQ ID NO: 7028 - DNA, 1407 bp, Photobacterium profundum
  CDS (1)..(1407): transl_table=11
atggctacaggtaagatcgtacagatcatcggtgcagtagtcgacgtagagtttccgcaggactctgtgccaaaagtatacgatgccctaaaggttgatgcgaaagagaaaggtacgttagtactggaagttcagcagcaattaggtggtggtgttgttcgttgtatcgctatgggtacttctgatggcttacgtcgtggtttgtctgttgaaaatacagaccgcccaattgaagtaccagtgggtattgcaacgctaggacgtatcatgaacgttctaggtgagccgattgatgagtgtggtgagatcggtgaagaacagcgttatgctattcaccgcgaagcgccaagctatgaagaacagtctaacgagacttccctacttgaaactggggtaaaggttatcgacctgatttgtccattcgctaagggtggtaaaattggtttgtttggtggtgcgggtgtcggtaagactgtcaatatgatggaacttatcaataacattgcacttcaacactctggtttgtctgtatttgcaggtgtgggtgagcgtactcgtgagggtaacgacttctacttcgaaatgcaggaagcgggtgttgttaaccttgaaaatccatcggaatcaaaagttgcgatggtttatggtcagatgaacgagcctcctggtaaccgtttacgagttgctttgacgggtctaaccatggcagagcgtttccgtgacgaaggtcgtgacgtactactattcatcgataacatctatcgttatacccttgcgggtactgaggtgtcggctctactgggccgtatgccatcagcggtaggttaccagccaacattggctgaagagatgggcgtacttcaggaacgtatcacgtcaacgaagagtggctctatcacgtcggttcaagcggtatacgtaccagcggatgacttgacggatccatcaccagcaacaacgtttgcacacttggatgcaacggttgtactttcgcgtcaaattgcttctttgggtctatacccagcgatcgatccattggattctacatctcgtatgctagacccgttggttgttggtcaagagcactatgacattgctcgtggtgttcaaagccttctacagcgttataaagagctgaaagacatcattgcaattctaggtatggacgagctgtcagaaaatgataagcaagctgtatctcgtgcgcgtaagattgagcgtttcctaactcagccttaccacgttgctgaagtctttactggtgaccctggtatctacgtagcgcttaaagatacgttacgtagcttcaaaggtcttcttgctggcgaatacgacgacatcccagaacaggcatttatgtactgtggcgcgatcgaagacgtattggaaaaagcgaagaagctttaa

SEQ ID NO: 7029 - protein, 468 aa, Photobacterium profundum
MATGKIVQIIGAVVDVEFPQDSVPKVYDALKVDAKEKGTLVLEVQQQLGGGVVRCIAMGTSDGLRRGLSVENTDRPIEVPVGIATLGRIMNVLGEPIDECGEIGEEQRYAIHREAPSYEEQSNETSLLETGVKVIDLICPFAKGGKIGLFGGAGVGKTVNMMELINNIALQHSGLSVFAGVGERTREGNDFYFEMQEAGVVNLENPSESKVAMVYGQMNEPPGNRLRVALTGLTMAERFRDEGRDVLLFIDNIYRYTLAGTEVSALLGRMPSAVGYQPTLAEEMGVLQERITSTKSGSITSVQAVYVPADDLTDPSPATTFAHLDATVVLSRQIASLGLYPAIDPLDSTSRMLDPLVVGQEHYDIARGVQSLLQRYKELKDIIAILGMDELSENDKQAVSRARKIERFLTQPYHVAEVFTGDPGIYVALKDTLRSFKGLLAGEYDDIPEQAFMYCGAIEDVLEKAKKL

SEQ ID NO: 7030 - DNA, 1386 bp, Photobacterium profundum
  CDS (1)..(1386): transl_table=11
atgagtactggtaaaattgtcaaagtcatcggcgctgtcgttgatgtggaatttgaccaagatagtgtgccacgtgtttatgatgctttgaacatcattgatggcaacaatagctctcttgtacttgaagtacagcaacaaattggtagcggaatcgttcgttgtatcgcaatgggttcgtcagatggtatgcgtcgtggtttagttgcggtgaatacgggtgaacccattaccgtgccagtgggtgaagaaacccttggccgtatcatgaacgtattaggccaaccgattgatgaatgtggtgaaattggtcagaaaacctcttacccaattcaccgcgagccaccatcatatgaagatcaagcgaacagtactgaactattagaaaccggtgtaaaagttatcgacttgatttgtccgtttgctaaaggcggtaaaattggtctgttcggtggtgcgggtgtgggtaaaaccgtcaacatgatggagttaatcaacaacatcgccaaagcacactcagggttatcggtatttacgggtgtgggtgagcgaacacgagaaggcaacgacttctactacgaaatgaaagaagccggtgtactcgataaagttgccatggtgtatggccagatgaacgagcccccaggtaaccgcttacgtgtagcacttacaggcttaaccatcgcagaacgcttccgtgatgaaggccgtgacgtgctgttattcatcgataatatctaccgttataccctagcgggaacagaagtatcagctctattgggtcgtatgccttctgcggtaggttaccaaccaacattggctgaagagatgggtgtgctgcaagaacgtatcacatctacgcacaaaggttcgatcacctcgattcaagcggtttatgtgccagcggatgacttaacggatccatcaccagccacaacgtttgctcaccttgatgcaacggttgtactgtcgcgaaatattgccgccttaggtctttacccagcgattgacccattagattcaacgtcgcgtcagcttgatcctttagttgttggcgtcgagcactatgatgttgctcgtggcgtacaaactgtactgcaacgttataaagaactgaaagatattattgcgatcttaggtatggatgaattgtctgaagatgacaaattgaccgtagcccgagcacgtaaagtcgagcgtttcctgactcaaccttaccatgttgctgaagtattcacgggtcaaccgggtatttttgtatcattaaaagatacattgaatggctttaaaggcttattaagtggcgaatacgatgacgttccagaacaagcattcttgtactgtggcgctatcgaagacgttatcgaaaaagcgaaaactatgtaa

SEQ ID NO: 7031 - protein, 461 aa, Photobacterium profundum
MSTGKIVKVIGAVVDVEFDQDSVPRVYDALNIIDGNNSSLVLEVQQQIGSGIVRCIAMGSSDGMRRGLVAVNTGEPITVPVGEETLGRIMNVLGQPIDECGEIGQKTSYPIHREPPSYEDQANSTELLETGVKVIDLICPFAKGGKIGLFGGAGVGKTVNMMELINNIAKAHSGLSVFTGVGERTREGNDFYYEMKEAGVLDKVAMVYGQMNEPPGNRLRVALTGLTIAERFRDEGRDVLLFIDNIYRYTLAGTEVSALLGRMPSAVGYQPTLAEEMGVLQERITSTHKGSITSIQAVYVPADDLTDPSPATTFAHLDATVVLSRNIAALGLYPAIDPLDSTSRQLDPLVVGVEHYDVARGVQTVLQRYKELKDIIAILGMDELSEDDKLTVARARKVERFLTQPYHVAEVFTGQPGIFVSLKDTLNGFKGLLSGEYDDVPEQAFLYCGAIEDVIEKAKTM

SEQ ID NO: 7032 - DNA, 1671 bp, Arabidopsis thaliana
  CDS (1)..(1671)
atggcgtctcggagagtcttatcatctcttctccgttcatcttccggtagatctgccgccaaattaggcaaccgtaaccccaggcttccttctccttcacccgcgcgtcacgccgctccatgtagctacctcctcggccgcgtcgccgagtacgcgacctcttcacctgcaagctcagctgcgccatcttctgctcctgctaaggatgaggggaagaagacctatgattacggtggcaaaggtgcgatcgggcgtgtttgccaggtcattggtgccattgtcgatgtgagatttgaggatcaggaaggattgccaccaatcatgacatctctcgaggtgcaggatcaccccacaaggctagtgcttgaggtgtctcatcacttgggtcagaatgtcgtcaggaccattgctatggatggtactgagggtctcgttcgtggaaggaaagtcctcaacactggcgctccaatcactgtacctgtcggaagggctactcttggacgtatcatgaatgttcttggagaacctattgacgaaagaggcgaaattaagaccgaacattacttacctattcacagagatgcaccggctttggttgatctagctactgggcaagagatcctggccactggtattaaggttgttgatcttcttgctccttaccaaagaggaggaaagattggtctctttggcggtgctggtgttgggaaaactgtgcttattatggagctgatcaacaatgttgccaaagctcatggtggtttctctgtgtttgctggtgtgggagaacgaacccgtgaaggcaatgacttgtacagagaaatgattgagagtggtgtcatcaagctaggcgaaaagcagtctgagagcaagtgtgctctagtgtacggacaaatgaatgagcccccgggtgcccgtgcccgtgttggactgactggtttgactgttgccgagtatttccgtgatgctgaaggccaagacgttttgcttttcattgacaacattttccgtttcactcaggccaactctgaagtgtctgctttactcggtcgtatcccgtctgctgtgggataccagccaactctggcttctgatcttggtgctcttcaagagcgaattactaccaccaagaaagggtctatcacctcagtccaagccatctatgtacctgctgatgatttgactgatcctgctcctgctacaacttttgctcacttggacgccacaactgtgctctcaagacagatttctgagcttggtatctaccctgctgtggatcctttggattcaacatcccgtatgctgtcacctcacattctgggagaggagcattacaacacggctcgtggcgtgcagaaagttctacagaactacaagaacttgcaagatattattgcaattttgggtatggatgagctaagtgaagatgacaagttgactgttgcccgtgcccgtaagatccagagattcttgagtcagccgttccacgttgctgagatcttcactggtgcccctggaaaatatgtcgaccttaaagaaaatatcaacagtttccagggtttgttggatggcaagtacgatgatctttccgaacaatcgttttacatggttggaggtatcgatgaggtggttgcaaaggcagagaagatcgctaaagagtcagcagcttaa

SEQ ID NO: 7033 - protein, 556 aa, Arabidopsis thaliana
MASRRVLSSLLRSSSGRSAAKLGNRNPRLPSPSPARHAAPCSYLLGRVAEYATSSPASSAAPSSAPAKDEGKKTYDYGGKGAIGRVCQVIGAIVDVRFEDQEGLPPIMTSLEVQDHPTRLVLEVSHHLGQNVVRTIAMDGTEGLVRGRKVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLSEQSFYMVGGIDEVVAKAEKIAKESAA

SEQ ID NO: 7034 - DNA, 2029 bp, Zea mays
  CDS (54)..(1715)
cagccgccgcaacccagcgtcccccgaagtctaaccctagatccggaccggccatggcgtcccgccgggtcgtctcctcgctcctccgctccgcgtcccgcctgcgggccgcctcgcccgctgctccacgcccgcgcgcgccaccgcaccgcccgtccccggccgggtacctcttcaaccgcgctgccgcctacgcctcttccgccgcggcccaggcggcacctgccaccccgccgccggccaccgggaagaccgggggcggcaagatcaccgacgagttcaccggcgctggcgccatcggccaggtgtgccaggtgatcggcgccgtcgttgacgtgcgcttcgatgagggcctcccgcccatcctcacggcgctcgaggtgctcgacaacaacatccgcctcgtgctcgaggtggcgcagcaccttggcgagaacatggtgcgcaccatcgctatggacggcacggaggggctcgtccgcggccagcgcgtcctcaacactggctcccccatcaccgtgcctgttggcagggctacccttggacgcatcataaatgttattggtgaaccgattgatgagaagggtgacataaagacaaaccacttcctccctattcatcgtgaagcccctgcctttgttgagcaggccactgagcagcaaattcttgttactggaatcaaggtcgtggatcttcttgcaccctaccaaaggggtggaaagattggtctcttcggtggtgcaggagtgggtaaaactgtgctcattatggagttgatcaacaatgttgctaaggcccatggtggtttctctgtgtttgctggtgttggagaacgtacccgtgaaggtaatgatctgtacagggaaatgattgaaagtggtgtcattaagctagatgacaagcagagcgaaagcaagtgtgctcttgtttacgggcagatgaatgagcccccgggtgctcgtgctcgtgttgggttgactggtttgactgttgctgaacatttccgtgatgctgaaggacaagatgtgcttctgtttattgacaacattttccgttttactcaggcaaactctgaggtgtctgctcttcttggacgtatcccatctgctgtgggataccagccaacccttgccactgatcttggaggactgcaagagcgtattacgacaacaaagaagggttctattacatctgtgcaggccatctacgtgcctgccgatgacttgacggatcctgctcctgctactacctttgcccatcttgatgctacaactgtgttgtcacgacagatctctgagcttggtatttatcctgctgttgatccactggattccacatcaagaatgctttctccccacgtgctgggtgaggatcactacaacactgctcgtggtgtgcagaaggttcttcagaactacaaaaatcttcaggatattattgctatcttgggtatggatgagctcagtgaggatgacaagctgacagtcgcccgtgcaagaaagattcagcgtttcctgagccagcctttccatgtcgctgaagttttcacgggtgctccaggaaagtatgtggagctgaaggaaagcgtgaagagtttccagggtgttttggatgggaagtatgatgacctccctgagcagtcattctacatggttggtggcattgaggaagtcattgctaaggctgagaaaattgccaaggagtctgcttcataaggaggcttcttgcttgttcaaccctgtacaagttccatttttggattttaagcgtttatttatgcttttcccagttaggcatgacgagctggagagtccatctcctgctgagagatgtttgttttacccttctttgcttcctccaccttacacccaaataagcaactgcagtgacgttggttttggctgcacccaaactacatgactgaagaaacttgtggcctgtgtaacgcgaatccatcagaacgccaaagttatggcttctggttgtggcaaattatggttcctccctgttcggttgaaaaaaaaaaaaa

SEQ ID NO: 7035 - protein, 553 aa, Zea mays
MASRRVVSSLLRSASRLRAASPAAPRPRAPPHRPSPAGYLFNRAAAYASSAAAQAAPATPPPATGKTGGGKITDEFTGAGAIGQVCQVIGAVVDVRFDEGLPPILTALEVLDNNIRLVLEVAQHLGENMVRTIAMDGTEGLVRGQRVLNTGSPITVPVGRATLGRIINVIGEPIDEKGDIKTNHFLPIHREAPAFVEQATEQQILVTGIKVVDLLAPYQRGGKIGLFGGAGVGKTVLIMELINNVAKAHGGFSVFAGVGERTREGNDLYREMIESGVIKLDDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVKSFQGVLDGKYDDLPEQSFYMVGGIEEVIAKAEKIAKESAS

SEQ ID NO: 7036 - DNA, 1702 bp, Arabidopsis thaliana
  CDS (1)..(1671)
atggcgtctcgaagagttttatcatctcttctccgttcatcttccggtagatctgccgccaaattagtcaaccgaaaccccaggcttccttctccttcacccgcgcgtcacgccgctccatgtagctacctcctcggccgcgtcgccgagtatgcgacctcttcaccggcaagctctgctgcgccatcctctgctcctgctaaggatgaggggaaaaagacctatgattacggtggcaaaggtgcgatcgggcgtgtttgtcaggtcatcggtgccattgtcgatgtgagattcgaggatcaggaaggattgcctccgatcatgacatctcttgaggttcaggatcatcccacaaggctggtgcttgaggtgtctcatcatttgggtcaaaatgtcgttaggaccattgctatggatggtactgagggtcttgtccgtggaaggaaggttctcaacactggtgctccaatcactgtacctgttggaagagctacccttggccgtatcatgaatgtgcttggagaacccattgacgagagaggcgaaatcaagaccgagcattacttacctattcacagagatgctccggctttggttgatctagccactgggcaagagatcctggccactggtattaaggttgttgatcttcttgctccttaccaaagaggaggaaagattggtctctttggcggtgctggtgttgggaaaactgtgcttattatggagctgatcaacaatgttgccaaagctcatggtgggttctctgtgtttgctggtgtgggggaacgaacccgtgagggcaatgacttgtacagagaaatgattgagagtggtgtcatcaagctaggcgagaagcagtctgagagcaaatgtgccctagtgtatggacaaatgaatgagcccccgggtgctcgtgcccgtgttggactgactggtttgactgtggctgagtatttccgtgatgctgaaggccaagatgtcttgcttttcattgacaacattttccgtttcactcaggccaactctgaagtgtctgctttgctcggtcgtattccgtctgctgtgggttaccagccaactctggcttctgatcttggtgctctgcaagagcgaatcacaaccaccaagaaagggtctatcacctcagtccaagccatctatgtccctgctgatgatttgacggatcctgctcctgccacaacttttgctcacttggacgccacaaccgtgctgtcaagacagatttctgagctcggtatctatcctgctgtggatcctttggattcgacatcccgtatgctctccccccacattctgggtgaggagcactacaacactgctcgtggtgtgcagaaagtgttgcagaactacaaaaatttgcaagatattattgccattttgggaatggatgagctaagtgaagatgacaagctgactgttgcccgtgcccgtaagatccagagattcttgagtcagccattccatgttgctgagatcttcacgggtgcccctggaaaatacgttgatcttaaggaaaacatcaacagtttccagggtctactcgacggtaagtacgatgatctttccgaacaatcgttttacatggttggaggtatcgatgaggtggttgcaaaggcagagaagatcgctaaagagtcagcagcttaaggaattgattcatctctttcatatgcataat

SEQ ID NO: 7037 - protein, 556 aa, Arabidopsis thaliana
MASRRVLSSLLRSSSGRSAAKLVNRNPRLPSPSPARHAAPCSYLLGRVAEYATSSPASSAAPSSAPAKDEGKKTYDYGGKGAIGRVCQVIGAIVDVRFEDQEGLPPIMTSLEVQDHPTRLVLEVSHHLGQNVVRTIAMDGTEGLVRGRKVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLSEQSFYMVGGIDEVVAKAEKIAKESAA

SEQ ID NO: 7038 - DNA, 1680 bp, Arabidopsis thaliana
  CDS (1)..(1680)
atggcgagtcggcgaatcttatcatcgcttctccgttcttcttcgagtagatctacttctaaatcctccttgatcgggagccgaaacccgaggcttttatcccccggtcccgcgcatggagccgctccatgtgggactctccttggccgagtcgccgagtattcgacttcttctccggctaattcggctgcaccatcttctgctcctgctaaagatgagggaaagaagacctatgattacggtggcaaaggcgcgatcgggcgtgtgtgtcaggttattggtgccattgttgatgtgagattcgaagatcaggagggattgcctccgatcatgacatctctcgaggtacaggatcatccaacaaggttggtccttgaggtgtctcatcacttgggtcaaaatgtcgttaggaccattgctatggatggtactgagggtctcgtccgtggaaggaaggttctcaacactggtgctccaatcactgttcctgttggaagggccacccttggacgtatcatgaacgttcttggagaacctattgacgagagaggcgaaattaagaccgagcattacttacccattcacagagacgctccagctttggttgatttggccaccggtcaagagattctcgctactggtattaaggttgttgatctccttgctccttaccaaagaggaggaaagattgggctttttggcggtgctggtgttgggaaaacagtgctcattatggaactgattaacaatgttgccaaagctcatggtggtttctccgtgtttgctggtgtgggagaacggacccgtgaaggcaatgatttgtacagagaaatgattgagagtggtgtcatcaagctaggagagaaacagtctgagagcaaatgtgccctagtgtatggacaaatgaatgagcccccgggtgctcgtgcccgtgttggactgactggtttgactgttgctgagtatttccgtgatgctgaaggccaagatgtcttgcttttcattgacaacatcttccgtttcacccaggccaactctgaagtgtctgcgttgctcggtcgtatcccgtctgctgtggggtaccagccaactctggcttccgatcttggtgctcttcaagagcgaatcacaaccaccaagaaaggttcaattacctctgtccaagccatctatgtccctgctgatgatttgacagatcctgctcctgccacaacttttgctcacttggatgccacaactgtgctttcaagacagatttctgagcttggtatctaccctgctgtggatcctttggattcgacgtcccgtatgctctcgccccacattctaggtgaggagcactacaacacagctcgtggtgtgcagaaagtgttgcagaattacaagaatttgcaagatattatcgccattttgggaatggatgagctaagtgaagatgacaagctgactgttgcccgtgcccgtaagatccagagattcttgagtcagccattccatgttgctgaaatcttcactggtgcccctggaaaatatgtcgaccttaaagaaaacatcaacagtttccagggtttgttggatggcaagtacgatgatctttccgaacaatcgttttacatggttggaggtatcgatgaggtggttgcaaaggcagagaagatcgctaaagagtcagcagcttag

SEQ ID NO: 7039 - protein, 559 aa, Arabidopsis thaliana
MASRRILSSLLRSSSSRSTSKSSLIGSRNPRLLSPGPAHGAAPCGTLLGRVAEYSTSSPANSAAPSSAPAKDEGKKTYDYGGKGAIGRVCQVIGAIVDVRFEDQEGLPPIMTSLEVQDHPTRLVLEVSHHLGQNVVRTIAMDGTEGLVRGRKVLNTGAPITVPVGRATLGRIMNVLGEPIDERGEIKTEHYLPIHRDAPALVDLATGQEILATGIKVVDLLAPYQRGGKIGLFGGAGVGKTVLIMELINNVAKAHGGFSVFAGVGERTREGNDLYREMIESGVIKLGEKQSESKCALVYGQMNEPPGARARVGLTGLTVAEYFRDAEGQDVLLFIDNIFRFTQANSEVSALLGRIPSAVGYQPTLASDLGALQERITTTKKGSITSVQAIYVPADDLTDPAPATTFAHLDATTVLSRQISELGIYPAVDPLDSTSRMLSPHILGEEHYNTARGVQKVLQNYKNLQDIIAILGMDELSEDDKLTVARARKIQRFLSQPFHVAEIFTGAPGKYVDLKENINSFQGLLDGKYDDLSEQSFYMVGGIDEVVAKAEKIAKESAA

SEQ ID NO: 7040 - DNA, 1401 bp, Acetobacterium woodii
  CDS (1)..(1401): transl_table=11
atggcccaaaatatagggaaggttgttcaggttattggaccagtagtcgatgttaaatttcaaaaagacaaactgccaaaattgaacaacgcagtaaatattgagcttaatggacacaccctggtaattgaggtagctcagcaactgggagacgacattgtcagatgtattgccatggattcaacagacggtttgatgagaaatcaggaagctgtggatacagggtcagcgattcaagtacccgttgggaaagcaaccctaggaagaatgtttaacgttttgggtgaaccaattgatggcaagccatttgatacgaaagatgtcgttatgcatccgattcatcggcatccacccagttttgaagaacaacaaacgcaaccagaaatgtttgaaaccggaattaaagtcgttgacttaatttgtccttacgttcgtggtggtaagattggtcttttcggtggtgccggagttggtaaaaccgtattgattcaggaattaattaataatattgcaacccaacacggtggtttatcggtatttgccggtgttggagaacggacccgtgaagggaatgacctttattatgaaatgatggagtctggcgttattaacaaaacagcgctttgctttggtcaaatgaatgagcctcctggagccagaatgcggattgcattagctggactgacgatggctgaatatttccgggatgatgaaggacaggatgtgttattgttcattgataacattttccgctttactcaagctggttcagaagtttcagcacttttgggtcggatgccaagtgccgttggttaccaaccaacactggcaactgaaatgggtgctttacaggaacgaattacatcaaccagtaagggttcaattacctcggttcaggccgtttacgatccagccgatgacttaactgaccctgctccggcaactacttttgcgcatttggatgcaacgacagtattaagtcgtgccattaccgaaaaaggtatttatccggctgttgatccattggattcaacttcacgtattcttgatcctaaaatagttggacaggaacattatgaaacagctcgagaagtgcaggaaattttgcaacgatataaagagttgcaagatattatcgcaattttagggatggatgagttgtcagatgccgataaaattacagtatctcgtgcgcgtaaggttgaacgtttgtttgcgaaccatttaatgttgcggaacagtttaccggtacgctggggtatatgtaaacgatttggtgatacaattaaaggatttaaagaaatccttcaaggacaacatgatgatttaccggaaagtgctttccttttggtaggtacgatcgaagacgctgtagtaaaagcaaaaaaaatcaaaggttag

SEQ ID NO: 7041 - protein, 466 aa, Acetobacterium woodii
MAQNIGKVVQVIGPVVDVKFQKDKLPKLNNAVNIELNGHTLVIEVAQQLGDDIVRCIAMDSTDGLMRNQEAVDTGSAIQVPVGKATLGRMFNVLGEPIDGKPFDTKDVVMHPIHRHPPSFEEQQTQPEMFETGIKVVDLICPYVRGGKIGLFGGAGVGKTVLIQELINNIATQHGGLSVFAGVGERTREGNDLYYEMMESGVINKTALCFGQMNEPPGARMRIALAGLTMAEYFRDDEGQDVLLFIDNIFRFTQAGSEVSALLGRMPSAVGYQPTLATEMGALQERITSTSKGSITSVQAVYDPADDLTDPAPATTFAHLDATTVLSRAITEKGIYPAVDPLDSTSRILDPKIVGQEHYETAREVQEILQRYKELQDIIAILGMDELSDADKITVSRARKVERLFANHLMLRNSLPVRWGICKRFGDTIKGFKEILQGQHDDLPESAFLLVGTIEDAVVKAKKIKG

SEQ ID NO: 7042 - DNA, 1455 bp, Agrobacterium tumefaciens
  CDS (1)..(1455): transl_table=11
atggctaaggcagctacccccaagaaaaccgcagcggtgaacggcgcgggcaaggttacccaggttatcggcgctgttgtcgacgtggcgttcgaaggcgaactgcctccgatcctgaacgcgctcgaaacacagaacaatggcaaccgcctcgttctggaagtcgcgcagcatctcggcgaaaacgtcgtgcgcacgatcgccatggactcgaccgaaggtctggttcgcggtcagtccgttgctgacacgggcgcaccgatcgaggttcctgttggtctggaaacgctcggccgcatcatgaacgtcatcggcgagccggttgacgaagccggtccgatcgtaacggccaagaagcgcgccatccaccaggacgcaccgtcttacgtcgagcagtcgacggaaggccagatcctcgtcaccggcatcaaggtcgtcgaccttctcgctccttacgccaagggcggcaagatcggcctcttcggcggcgccggcgtgggcaagacggttctcatcatggaactgatcaacaacgtcgccaaggcgcatggtggttactcggtattcgccggcgtgggtgagcgtacccgcgaaggcaacgacctttatcacgaaatgatcgagtcgaacgtcaacaagctcggtggcggcgaaggctccaaggctgcgctcgtgtacggccagatgaacgaaccgccgggcgcccgcgctcgcgtcgctctgaccggtctgacgatcgctgaaaacttccgtgatgaaggccaggacgttctgttcttcgtggacaacatcttccgcttcacgcaggctggttctgaagtgtcggctctgctcggccgtattccttcggccgtgggttaccagccgacgctggcaaccgacatgggccagatgcaggaacgcatcaccaccacgaacaagggttccatcacctcggttcaggcaatttacgttcccgccgacgacttgaccgacccggcgccggcaacctcgttcgcgcatcttgacgcaacgacggttctgtcgcgttcgatcgctgaaaagggtatttacccggctgttgacccgctcgactccacctcgcgcatgctcgacccgatgatcgtcggcgaggagcactacgaagttgcccgtaaggttcagtcgaccctgcagcgctacaagtctctccaggacatcatcgccatcctcggcatggacgaactgtcggaagaagacaagctgacggttgcccgcgcccgcaagatcgagcgcttcctgtcgcagccgttcttcgttgctgaagtcttcaccggttctccgggtaagctcgtcgcgctcgaagacacgatcaagggcttcaagggcctggtcaacggcgaatatgacagcctgccggaagcagctttctacatggtcggttcgatggaagaagccatcgaaaaggcaaagaagctgactgctgaagccgcctga

SEQ ID NO: 7043 - protein, 484 aa, Agrobacterium tumefaciens
MAKAATPKKTAAVNGAGKVTQVIGAVVDVAFEGELPPILNALETQNNGNRLVLEVAQHLGENVVRTIAMDSTEGLVRGQSVADTGAPIEVPVGLETLGRIMNVIGEPVDEAGPIVTAKKRAIHQDAPSYVEQSTEGQILVTGIKVVDLLAPYAKGGKIGLFGGAGVGKTVLIMELINNVAKAHGGYSVFAGVGERTREGNDLYHEMIESNVNKLGGGEGSKAALVYGQMNEPPGARARVALTGLTIAENFRDEGQDVLFFVDNIFRFTQAGSEVSALLGRIPSAVGYQPTLATDMGQMQERITTTNKGSITSVQAIYVPADDLTDPAPATSFAHLDATTVLSRSIAEKGIYPAVDPLDSTSRMLDPMIVGEEHYEVARKVQSTLQRYKSLQDIIAILGMDELSEEDKLTVARARKIERFLSQPFFVAEVFTGSPGKLVALEDTIKGFKGLVNGEYDSLPEAAFYMVGSMEEAIEKAKKLTAEAA

SEQ ID NO: 7044 - DNA, 1449 bp, Anabaena variabilis
  CDS (1)..(1449): transl_table=11
atggtcaccaccgcagaaaaaacaaacatcggttacattacccaaatcattggtccggttgtagacgttaaattccctagcggaaaattaccgcaaatctacaacgctctgaccatcaaaggcactaacgaagctggacaggaactcaacctcaccgtagaagtacagcaacttttgggcgacaaccaaatacgcgccgttgctatgagttccacggatggtttagtccgtggtctggaagtcgtcgatacaggcgcgcccatcagcgtacccgttggtaaagcaactctcggacggattttcaacgttcttggcgaacctgtagacaatagaggcccagttaacaaccaagaaactttacccatccaccgtccggctcccaagctcacagagctagaaaccaagccttccgttttcgagaccgggattaaagttgttgacctcctgaccccttatcgacgcggtggtaaaattggtctgttcggcggtgctggtgtcggcaaaaccgtaatcatgatggagctgattaacaacattgctacccagcacggtggcgtgtctgtattcgccggcgtgggagagcgtacccgtgaagggaatgacctctacaacgaaatgattgaatctggggtaatcaacaaagacaacctcaacgaatcaaaaatcgcgttggtgtacggtcaaatgaacgaaccacccggagcaagaatgcgggttggtttgtctggtttgacaatggctgaatacttccgtgatgtcaataagcaagacgtactgttgtttattgacaacattttccggttcgtacaagcaggttctgaagtatccgcgctgttgggtcggatgccttctgctgtgggatatcagccaactttgggtactgatgtaggtcaattgcaagaacggattacctccactaccgaaggttctatcacctcaattcaagctgtgtacgtacctgcggacgacttgacagaccccgcgcctgcaactacctttgctcacttagatggtacaacagtactatctcgtggtttggctgctaaaggtatttatcctgcggtagatccgctaggttccacctctaccatgttgcaacctaacattgttggtgacgaacactacaatactgctcgtgctgtccaatcgaccctgcaacgctacaaagaattgcaagacatcatcgctattctgggtctagatgaactgtctgaagaagacagactcatcgtagcacgggcccggaaagttgagcgtttcttgtctcagcccttcttcgtcgctgaagtattcacaggttctcctggtaagtacgtgaagttagaagacaccatcaaagggttccagaagattctatctggtgagttggatgatctgccagagcaagccttctacttggtaggcgacatcaacgaagcgatcgccaaagccgaaaaactcaaaggctaa

SEQ ID NO: 7045 - protein, 482 aa, Anabaena variabilis
MVTTAEKTNIGYITQIIGPVVDVKFPSGKLPQIYNALTIKGTNEAGQELNLTVEVQQLLGDNQIRAVAMSSTDGLVRGLEVVDTGAPISVPVGKATLGRIFNVLGEPVDNRGPVNNQETLPIHRPAPKLTELETKPSVFETGIKVVDLLTPYRRGGKIGLFGGAGVGKTVIMMELINNIATQHGGVSVFAGVGERTREGNDLYNEMIESGVINKDNLNESKIALVYGQMNEPPGARMRVGLSGLTMAEYFRDVNKQDVLLFIDNIFRFVQAGSEVSALLGRMPSAVGYQPTLGTDVGQLQERITSTTEGSITSIQAVYVPADDLTDPAPATTFAHLDGTTVLSRGLAAKGIYPAVDPLGSTSTMLQPNIVGDEHYNTARAVQSTLQRYKELQDIIAILGLDELSEEDRLIVARARKVERFLSQPFFVAEVFTGSPGKYVKLEDTIKGFQKILSGELDDLPEQAFYLVGDINEAIAKAEKLKG

SEQ ID NO: 7046 - DNA, 1437 bp, Aquifex aeolicus
  CDS (1)..(1437): transl_table=11
atggcggaagtgattaagggaaaggtagttcaggtcataggacccgttgttgacgtggagttcgaaggggtaaaggaacttcccaaaatcaaagacggtctcaaaacaataagaagagctatagacgacagaggtaactggttcgaagaagtactcttcatggaagtggcacagcacataggggagcacagagtaagggcgatagcgatgggtccaacagatggtctcgtgagaggtcaagaagttgagtacttggggggacccataaagatacccgtaggtaaggaagttctcggaaggatattcaacgttgcgggacaacccatagacgagcagggtccggtagaggctaaagagtactggcccatgttcagaaatccacccgaactcgttgaacaatccacgaaagttgaaattcttgaaacgggtattaaagttatagacctcctccagcccatcataaagggtggtaaggttggactcttcggcggtgcgggagttggaaagaccgttctcatgcaggagctcatccacaacatagcgcgtttccacgaagggtattccgttgtcgttggagtgggcgagagaacaagagaaggaaacgacctctggctcgaaatgaaggagtccggagttctcccttacacggttatggtttacggacagatgaacgagcctccgggagttaggttcagggtggcacacaccggacttacaatggctgagtacttcagagacgtggaaggtcaggacgttctcatattcatagacaacatattcaggttcgttcaggcaggtgcggaagtttcaacgcttcttggaagactaccctccgcggttggttaccagcccaccctcaatactgacgtcggtgaagttcaggaaagaattacttcaaccaagaaaggttctattaccgcaattcaggcggtttacgttcccgcagacgacataactgaccccgcaccttggtccatattcgcgcacctcgacgctacgaccgttctcacaagaagactcgctgagctcggaatatatcccgcaatagatcccctcgaatctacatctaagtacctcgctcccgagtatgtcggagaagagcactacgaagttgcaatggaagtaaagaggattctccaaaggtacaaagaacttcaagaaatcatcgcaatcctcggtatggaagaactctctgacgaggacaaggctatcgttaacagggcgagaagaatacagaagttcctctctcaacccttccacgttgcggagcaatttacaggtatgcccggtaagtacgtaaaactcgaggataccataaggtccttcaaggaagttctcacaggaaagtacgaccaccttcccgaaaacgccttctacatggtgggaacaatagaggacgttatagaaaaggcaaaacaaatgggggctaaagtttaa

SEQ ID NO: 7047 - protein, 478 aa, Aquifex aeolicus
MAEVIKGKVVQVIGPVVDVEFEGVKELPKIKDGLKTIRRAIDDRGNWFEEVLFMEVAQHIGEHRVRAIAMGPTDGLVRGQEVEYLGGPIKIPVGKEVLGRIFNVAGQPIDEQGPVEAKEYWPMFRNPPELVEQSTKVEILETGIKVIDLLQPIIKGGKVGLFGGAGVGKTVLMQELIHNIARFHEGYSVVVGVGERTREGNDLWLEMKESGVLPYTVMVYGQMNEPPGVRFRVAHTGLTMAEYFRDVEGQDVLIFIDNIFRFVQAGAEVSTLLGRLPSAVGYQPTLNTDVGEVQERITSTKKGSITAIQAVYVPADDITDPAPWSIFAHLDATTVLTRRLAELGIYPAIDPLESTSKYLAPEYVGEEHYEVAMEVKRILQRYKELQEIIAILGMEELSDEDKAIVNRARRIQKFLSQPFHVAEQFTGMPGKYVKLEDTIRSFKEVLTGKYDHLPENAFYMVGTIEDVIEKAKQMGAKV

SEQ ID NO: 7048 - DNA, 1410 bp, Bacillus anthracis
  CDS (1)..(1410): transl_table=11
atgaataaagggcgcgttacgcaaatcatgggtccggttgtagacgttaagtttgatggcggaaagctaccagaaatctacaacgcccttacggtaaaacagagcaacgaaaacggaacaagcattaacttaacatttgaagttgcacttcatttaggtgatgacacagttcgtacagttgcaatgtcttccacagatggacttgttcgtggcacagaagtagaagatactggtaaagcaatctctgtaccagttggtgatgcaacacttggtcgtgtatttaacgtattaggtgatgcaattgacttagatggtgaggttcctgcggatgtacgtcgtgatccaattcaccgtcaagcacctgcattcgaagaattatctactaaagtagaaattcttgaaactggtattaaagtagtagacttacttgctccttacattaagggtggtaagatcggtctattcggtggtgccggtgtaggtaaaacggtattaattcaggaattaatcaataacatcgcacaagaacacggtggtatctctgtattcgctggtgtaggtgagcgtactcgtgagggtaatgacttataccacgaaatgagcgattctggcgtaattaagaaaactgcgatggtattcggacaaatgaacgagccacctggagcacgtcaacgtgttgcgttaacaggtttaacaatggctgagcatttccgtgatgagcaaggacaagatgtacttctgttcatcgataatatcttccgtttcacgcaagcaggttctgaagtatctgcccttcttggccgtatgccatctgcggtaggttaccaaccaacacttgcaacagaaatgggtcaattacaagagcgtattacatctacaaataaagggtctatcacgtctatccaagcggtatatgtaccagccgatgactatactgacccagcaccagctacaacgttcgctcacttagatgcaacaacaaacttagagcgtcgtttaacacaaatgggtatttacccagccgtagatccattagcatctacatctcgtgcactttctccagaaatcgtaggagaagagcattatgaagtggctcgtcaagtacagcaaactttacaacgctacaaagagcttcaagatatcatcgctatcttaggtatggatgagttatctgaagaagataagttagttgtacatcgtgctcgtcgtattcaattcttcttatctcaaaacttccacgtagcggagcagtttacaggtcaaaaaggttcttatgtacctgtaaaagaaacagttcgtggtttcaaagaaattctagaaggaaaatatgatgaccttccagaagatgcattccgcttagttggtggcattgaagaagttattgaaaacgcgaagaaaatgatggcgtaa

SEQ ID NO: 7049 - protein, 469 aa, Bacillus anthracis
MNKGRVTQIMGPVVDVKFDGGKLPEIYNALTVKQSNENGTSINLTFEVALHLGDDTVRTVAMSSTDGLVRGTEVEDTGKAISVPVGDATLGRVFNVLGDAIDLDGEVPADVRRDPIHRQAPAFEELSTKVEILETGIKVVDLLAPYIKGGKIGLFGGAGVGKTVLIQELINNIAQEHGGISVFAGVGERTREGNDLYHEMSDSGVIKKTAMVFGQMNEPPGARQRVALTGLTMAEHFRDEQGQDVLLFIDNIFRFTQAGSEVSALLGRMPSAVGYQPTLATEMGQLQERITSTNKGSITSIQAVYVPADDYTDPAPATTFAHLDATTNLERRLTQMGIYPAVDPLASTSRALSPEIVGEEHYEVARQVQQTLQRYKELQDIIAILGMDELSEEDKLVVHRARRIQFFLSQNFHVAEQFTGQKGSYVPVKETVRGFKEILEGKYDDLPEDAFRLVGGIEEVIENAKKMMA

SEQ ID NO: 7050 - DNA, 1407 bp, Bacillus cereus
  CDS (1)..(1407): transl_table=11
atgaataaagggcgcgttacgcaaatcatgggtccggttgtagacgttaagtttgatggcggaaagctaccagaaatctacaacgcccttacggtaaaacagagcaacgaaaacggtgaacttaacttaacatttgaagttgcacttcatttaggtgatgatacagttcgtacagttgcgatgtcttccacagatggacttgttcgtggcacagaagtagaagatactggtaaagcaatctctgtaccagttggtgatgcaacacttggtcgcgtatttaacgtattaggtgatgctattgacttagatggtgaggttcctgcggatgtacgccgtgatccaattcaccgtcaagcacctgcattcgaagagttatctactaaagtagaaattcttgaaactggtattaaagtagtagacttacttgctccttacattaagggtggtaagatcggtctattcggtggtgccggtgtaggtaaaacagtattaattcaggagttaatcaacaacatcgcacaagagcacggtggtatctctgtattcgctggtgtaggtgagcgtactcgtgagggtaatgacttataccacgaaatgagcgattctggcgtaattaagaaaactgcgatggtattcggacaaatgaacgagccacctggagcacgtcaacgtgttgcattaacaggcttaacaatggctgaatatttccgtgatgagcaaggacaagacgtacttctgttcatcgataatatcttccgtttcacgcaagcaggttctgaagtatctgcccttcttggccgtatgccatctgcggtaggttaccaaccaacacttgcaacagaaatgggtcaattacaagagcgtattacatctacaaataaagggtctatcacgtctatccaagcggtatatgtaccagccgatgactatactgacccagcaccagctacaacgttcgctcacttagatgcaacaacaaacttagagcgtcgtttaacacaaatgggtatttacccagccgtagatccattagcatctacatctcgtgcactttctccagaaatcgtaggagaagagcattatgaagtggctcgtcaagtacagcaaactttacaacgttacaaagagcttcaagatatcatcgctatcttaggtatggatgagttatctgaagaagataagttagttgtacatcgtgctcgtcgtattcaattcttcttatctcaaaacttccacgtagcggagcagtttacaggtcaaaaaggttcttacgtacctgtaaaagacacagttcgtggtttcaaagaaattctagaaggaaaatatgatgaccttccagaagatgcattccgcttagttggtggcattgaagaagttattgaaaacgcgaagaaaatgatggcgtaa

SEQ ID NO: 7051 - protein, 468 aa, Bacillus cereus
MNKGRVTQIMGPVVDVKFDGGKLPEIYNALTVKQSNENGELNLTFEVALHLGDDTVRTVAMSSTDGLVRGTEVEDTGKAISVPVGDATLGRVFNVLGDAIDLDGEVPADVRRDPIHRQAPAFEELSTKVEILETGIKVVDLLAPYIKGGKIGLFGGAGVGKTVLIQELINNIAQEHGGISVFAGVGERTREGNDLYHEMSDSGVIKKTAMVFGQMNEPPGARQRVALTGLTMAEYFRDEQGQDVLLFIDNIFRFTQAGSEVSALLGRMPSAVGYQPTLATEMGQLQERITSTNKGSITSIQAVYVPADDYTDPAPATTFAHLDATTNLERRLTQMGIYPAVDPLASTSRALSPEIVGEEHYEVARQVQQTLQRYKELQDIIAILGMDELSEEDKLVVHRARRIQFFLSQNFHVAEQFTGQKGSYVPVKDTVRGFKEILEGKYDDLPEDAFRLVGGIEEVIENAKKMMA

SEQ ID NO: 7052 - DNA, 2824 bp, Bacillus caldotenax
  CDS (952)..(2373): transl_table=11
taaggccggcgggggcatatctgccctcatgcctgttagaacccgtgcagcaaaaaggtggtgaaacctttggcatcgttacgcgatattaaaacgcgcatcaatgcgacgaagaagacaagccaaattacaaaagcgatggaaatggtctcgacgtcgaagctgaaccgagcggaaaaacgcgaaatcgttcgtccatatatggagaaaattcaagaagtcgtggccatgtcggcttcggcggcgcgttcgcatccgatgctcgtttcgcgcccggtgaaaaaaaccggttatctcgtgatcacgtcggatcgcggtctggctggcgcgtacaacagcaacgtcgtgcgcctcgtgtacccaaaacgatccaaaaacgccatgcttcctccggacgaaatagcgatcatcgtcatcggccgcgtcgggttgagctttttccgcaagcggaacatgccggtcattctcgacatcacccgcttgccggaccagccgtcgtttgccgatattaaagaaatcgcccgcaaaacggttgggttattcgccgacggtacgtttgacgagctgtatatgtattacaaccattacgtgagcgcgatccagcaagaggtgacggaacggaagcttctgccgctcactgacttcttggcggagaataagcaacgcacggtgtacgaatttgaaccgtcgcaagaagaaattttggacgtcttattgccgcagtatgcggaaagcctcatttacggcgcattgctcgatgcaaaagcaagcgaacacgccgcccgcatgacggcgatgaagaacgcaacggacaatgcgaacgacgtcattcgcacattgacgctttcctacaaccgcgctcgccaagcggcgattacgcaagaaattacggaaattgtcgccggacgaaacgccttgcaatagggcactagcaagttaggagggaaaacgatgacaagaggacgcgttatccaagtcatgggtccggttgtagacgtcaagtttgagaacggccacttgccggcgatctacaacgccctgaaaattcaacataaagcgcgcaacgaaaacgaagtcgacatcgacttgacattggaagtcgccttgcaccttggcgatgatacagtacggacgatcgcgatggcgtccacagacggcctcatccgcggcatggaagtcatcgataccggtgcaccgatttcggtgccggtcggcgaagtcacgcttggccgcgtgttcaacgtcttgggcgagccgatcgacttggaaggcgacattccggctgacgcccgccgcgacccgattcaccgtccggcgccaaaattcgaggaattggcgacggaagtcgaaattttggaaacggggattaaagtcgttgacttgcttgccccgtatattaaaggcggaaaaatcggtttgttcggcggcgctggcgtaggaaaaacggtcttgattcaagagctgatccacaacatcgcccaagagcacggcgggatttccgtctttgctggcgtcggcgaacggacacgcgaaggaaacgacttgtaccatgagatgaaagattccggcgtcatcagcaaaacggccatggtgttcggacaaatgaatgagccgccgggggcgcggatgcgcgtcgccttgaccggcttgacgatggccgaatacttccgtgatgaacaaggccaagacgtgttgctctttatcgataacatcttccgtttcacgcaggccggttcggaagtgtcggcgctgttaggccgcatgccgtcggccgttggttaccaaccgacattggcgacggagatgggtcaattgcaagagcggatcacgtcgacggcgaaaggatcgactacctcgattcaagcgatttacgtcccggccgacgactatacggacccggctccggccacgacgttctcgcacttggatgcgacgacgaacctggagcggaacgtcgcggagatggggatttatccggccgttgacccgctcgcttcgacatcgcgtgcgttggcgccggaaatcgtcggcgaggagcactaccaagtcgcccgcaaagtgcagcaaacgctgcaacgttataaagaattgcaagacatcatcgccatcttggggatggatgaactgtcggatgaagacaaactcgtcgttcatcgcgcccgccgcatccagttcttcttgtcgcaaaacttccacgtggcggagcagttcacgggccaaccgggctcctacgtgccggtgaaagaaacagtgcgcggctttaaagaaattttggaaggcaaatacgaccatcttccggaagatcggttccgcttagtcggccgcattgaagaagtcgttgaaaaagcgaaagcgatgggtgtcgaagtgtgacccgggatagggggattggacaatgaaaacgatccacgtgagcgtcgttactcctgatggcccggtgtacgaagacgatgttgagatggtcagcgtcaaagcgaaaagcggcgagctcggcattttgccggggcacattcggcttgtcgccccgctcgagatcagcgcggcccggctgaaaaaaggcggcaaaacgcaatacattgccgtcagcggcggctttttggaagtccgcccggacaaagtgacgattttggctcaagctgctgaacgggcggaggacattgacgtcctccgcgccaaagcgcgaaagagcgggcggacgccgctgcaaagccagcaggatgacatcgacttcaaacgggccgaactggcgttaaaacgcgccatgaaccgtttgagtgttgcggaaatgaagtaaaaagcaggggaaaactcccctgcttttttt

SEQ ID NO: 7053 - protein, 473 aa, Bacillus caldotenax
MTRGRVIQVMGPVVDVKFENGHLPAIYNALKIQHKARNENEVDIDLTLEVALHLGDDTVRTIAMASTDGLIRGMEVIDTGAPISVPVGEVTLGRVFNVLGEPIDLEGDIPADARRDPIHRPAPKFEELATEVEILETGIKVVDLLAPYIKGGKIGLFGGAGVGKTVLIQELIHNIAQEHGGISVFAGVGERTREGNDLYHEMKDSGVISKTAMVFGQMNEPPGARMRVALTGLTMAEYFRDEQGQDVLLFIDNIFRFTQAGSEVSALLGRMPSAVGYQPTLATEMGQLQERITSTAKGSTTSIQAIYVPADDYTDPAPATTFSHLDATTNLERNVAEMGIYPAVDPLASTSRALAPEIVGEEHYQVARKVQQTLQRYKELQDIIAILGMDELSDEDKLVVHRARRIQFFLSQNFHVAEQFTGQPGSYVPVKETVRGFKEILEGKYDHLPEDRFRLVGRIEEVVEKAKAMGVEV

SEQ ID NO: 7054 - DNA, 1518 bp, Bacteroides fragilis
  CDS (1)..(1518): transl_table=11
atgtcacagattatcggacatatctctcaggtaattggccctgtggtcgatgtgtattttgaaggtacagaatcggacttgatattgccaagtatccacgacgcattagagataaaaaggcacaacggcaaaaagctgattgtagaagttcaacaacacattggtgaaaataccgtacgtacggttgccatggatagtaccgacggcttgcagcgcgggatgaaggtatttccgacgggaggtcctatcacaatgccggtaggcgaacagatcaaaggacgtttgatgaacgtagtcggcgactccatcgatggaatgaaagaactcaatcgcgacggtgcatattctattcaccgtgatcctcccaaatttgaagatttaaccactgtacaggaagttctgtttactggaattaaggtgatagacctgcttgagccttattcaaaaggaggtaagatcggtttgtttggcggggccggagtgggtaaaactgtacttattatggagctcattaataacattgccaagaagcataatggtttttccgtatttgccggagtgggagagcgtacccgtgaaggtaatgatttgcttcgtgagatgattgaatcgggtgtaatccgttatggagaagcattcaaagaaagcatggaaaaaggacattgggacctctcgaaagtggattataatgaggtagaaaagtcacaggctacattggtgttcggacagatgaacgaacctcctggagcacgtgcttcagttgctttgtcaggattgactgtcgctgaatctttccgggatatgggggcaaagtcgggagcgagagatatattgttttttatcgataatattttccgtttcactcaggcgggttccgaggtttcggctttgttggggcgtatgccttctgcggtaggttatcaacctacgttggctaccgaaatgggtgctatgcaagaacgtatcacttcgacaaaaacgggttctatcacttcggtgcaggctgtttacgtaccggctgatgacttgaccgaccctgctccggcaacaacttttacccacttggatgcaacgactgtgttgagtcgtaaaattactgagcttggtatttatccggcagtggatccgttggagtctacttctcgtattctcgatccgcacattgtgggtcaagagcattatgatgtcgcacaacgtgtgaagcagattcttcaacgcaataaagaattacaggatatcatctctattttaggtatggaggaattatccgacgccgaccgtctggtggtaaaccgtgcgcgcagggtacagcgtttcctgtctcaaccatttacagtggccgaacagtttaccggagtaccgggagcaatggtggccattgaagatacaataaaaggattcaaaatgattttggatggtgaagtagattatctgcctgaaccggcgtttctgaatgtgggaaccattgaagaagctatcgaaaaaggtaagaaactgcttgaacaggctaacaaataa

SEQ ID NO: 7055 - protein, 505 aa, Bacteroides fragilis
MSQIIGHISQVIGPVVDVYFEGTESDLILPSIHDALEIKRHNGKKLIVEVQQHIGENTVRTVAMDSTDGLQRGMKVFPTGGPITMPVGEQIKGRLMNVVGDSIDGMKELNRDGAYSIHRDPPKFEDLTTVQEVLFTGIKVIDLLEPYSKGGKIGLFGGAGVGKTVLIMELINNIAKKHNGFSVFAGVGERTREGNDLLREMIESGVIRYGEAFKESMEKGHWDLSKVDYNEVEKSQATLVFGQMNEPPGARASVALSGLTVAESFRDMGAKSGARDILFFIDNIFRFTQAGSEVSALLGRMPSAVGYQPTLATEMGAMQERITSTKTGSITSVQAVYVPADDLTDPAPATTFTHLDATTVLSRKITELGIYPAVDPLESTSRILDPHIVGQEHYDVAQRVKQILQRNKELQDIISILGMEELSDADRLVVNRARRVQRFLSQPFTVAEQFTGVPGAMVAIEDTIKGFKMILDGEVDYLPEPAFLNVGTIEEAIEKGKKLLEQANK

SEQ ID NO: 7056 - DNA, 1413 bp, Bacillus halodurans
  CDS (1)..(1413): transl_table=11
atgaatacaggtcacattactcaggttatgggtccagttgttgacgttcgttttcaaagcggccaactacccgagctaaacaacgcattacgtgtcgaacaaaaaggggcggatcaaaatgcggttgatgtgaacgtaaccttagaagtggctttgcacttaggagatgatacggtacgcacaatcgcgatgggctcaacggatggtctcgttcgtggaactgaggttgttgacacaggtgcagctatttctgtccctgtaggggaagttacgctcggtcgtgtgttcaacgtactcggtgaatccattgaccttgacgagccgattccagctgatgctgagcgttcgccgattcaccgtgaagcaccaaagtttgaagagctctcaacaaaaacggaaattctcgaaacaggaattaaagttgttgacttgcttgccccttacatcaaaggtggtaaaattggtctcttcggtggtgccggcgtagggaaaaccgttttaattcaagaattaatcaacaacatcgcgcaagagcacggcggtatttctgtatttgccggagtaggtgagcgtacacgtgaaggaaatgacctctaccacgaaatgtccgactcgggcgttatcaaaaagaccgcgatggtgtttggacaaatgaacgagccgcctggtgcccgtatgcgtgtagccctttctggtttgacaatggcggaatatttccgtgacaaacaaggacaagacgttcttctgtttatcgataatattttccgctttacacaagcaggttctgaagtatccgcattgcttggacgtatgccatcagcggtaggttaccagccaacacttgcaacggagatgggacagcttcaagagcggatcacatcaacgaaggtcggttcggttacttctatccaagcgatttacgtaccagcggatgactacactgacccagcaccagcaactacgtttgcccacttagatgcgacgaccaaccttgagcgtaagctttcagagatggggatttaccctgccgtagacccactagcgtctacatctcgtgccctctcgccggagattgttggagaagagcattacaatgtcgctcgtcaagtacagcaaacattgcaaaaatataaagaattacaagacatcatcgccatcctcggtatggatgagctttctgaagaagacaagttaattgtcgcgcgtgcacgccggattcagttcttcttgtcacaaaacttccacgtggctgaacagtttacaggacaaccaggttcgtatgtacctgtaaaggaaaccattaaaggatttaaagaaatccttgaaggtaaatatgatgaccttccagaggatgcattccgtctcgttggccggattgaagaggttgttgagagagcgaaacaaatggtctaa

SEQ ID NO: 7057 - protein, 470 aa, Bacillus halodurans
MNTGHITQVMGPVVDVRFQSGQLPELNNALRVEQKGADQNAVDVNVTLEVALHLGDDTVRTIAMGSTDGLVRGTEVVDTGAAISVPVGEVTLGRVFNVLGESIDLDEPIPADAERSPIHREAPKFEELSTKTEILETGIKVVDLLAPYIKGGKIGLFGGAGVGKTVLIQELINNIAQEHGGISVFAGVGERTREGNDLYHEMSDSGVIKKTAMVFGQMNEPPGARMRVALSGLTMAEYFRDKQGQDVLLFIDNIFRFTQAGSEVSALLGRMPSAVGYQPTLATEMGQLQERITSTKVGSVTSIQAIYVPADDYTDPAPATTFAHLDATTNLERKLSEMGIYPAVDPLASTSRALSPEIVGEEHYNVARQVQQTLQKYKELQDIIAILGMDELSEEDKLIVARARRIQFFLSQNFHVAEQFTGQPGSYVPVKETIKGFKEILEGKYDDLPEDAFRLVGRIEEVVERAKQMV

SEQ ID NO: 7058 - DNA, 1422 bp, Bacillus licheniformis
  CDS (1)..(1422): transl_table=11
atgaaaaaaggacgcgttagccaggtattagggccggtcgtagatgttcgttttgaagacggtcacttgcctgaaatatataatgcgattaaagttacacataaagcgcagaacgagaatgaagtggacatcgatcttacccttgaagtagcgcttcacttgggtgatgattcagttcgtacaattgcaatggcttcaactgacggtgttacacgcggaatggaagccatcgacctgggagagccgatctccgttccggtcggaaacgtaacactcggccgcgtatttaatgtactcggggaaaatatcgatttggatgagccgcttccggctgatgctgccaaagatccgattcacagagaagctccaaaatttgatcagctatcaacagaggttgaaatcttagagacgggtattaaagtcgtcgacttgctcgctccatatatcaaaggcggaaagatcggtcttttcggaggagcgggagttggaaaaaccgttttgattcaggagctgatcaacaacatcgctcaagagcacggcggtatctctgtattcgcaggtgtcggcgagcgtacgcgtgaaggaaacgacctttactatgaaatgaaagattccggcgttatcggcaaaacggcaatggtcttcggtcagatgaacgagccgcctggtgcgcggatgcgcgttgccttgaccggacttacaatggccgagcatttccgtgataaagaaggccaggacgtattgttctttatcgataacatcttccgattcactcaagcaggatctgaagtatctgcacttcttggacgcatgccgtcagcggttggttatcagccgacgcttgcgaccgaaatgggtcagcttcaggaacggatcacatcaacaaatgtcggatctgtaacatcgattcaggcgatctacgttcctgccgatgactatactgacccggcgccggctacgacgttcgctcacttggatgcgacgacgaaccttgagcgtaagctgtcggaaatggggatttatcctgcggtcgatccgcttgcatccacttcccgtgcgctttcgcctgaaatcgtcggagaagagcactatgaagtggcgcgcagcgttcagcagatcctgcagcgctacaaagagcttcaggatatcatcgcgatgctcggaatggatgagttgtcagacgaagataagcttgtcgtcagccgtgcgcgccgcgtacaattcttcctgtcgcaaaacttccacgtagctgaacagtttacaggacaaaaaggttcttacgtacctgtcaaagaaacggtaaaaggcttcaaagaaatccttgaaggtaagtatgatcaccttcctgaggacgctttccgccttgtcggccgaatcgaagaagttgtcgaaaaagcgaaagaaatgggtgtagaagtataa

SEQ ID NO: 7059 - protein, 473 aa, Bacillus licheniformis
MKKGRVSQVLGPVVDVRFEDGHLPEIYNAIKVTHKAQNENEVDIDLTLEVALHLGDDSVRTIAMASTDGVTRGMEAIDLGEPISVPVGNVTLGRVFNVLGENIDLDEPLPADAAKDPIHREAPKFDQLSTEVEILETGIKVVDLLAPYIKGGKIGLFGGAGVGKTVLIQELINNIAQEHGGISVFAGVGERTREGNDLYYEMKDSGVIGKTAMVFGQMNEPPGARMRVALTGLTMAEHFRDKEGQDVLFFIDNIFRFTQAGSEVSALLGRMPSAVGYQPTLATEMGQLQERITSTNVGSVTSIQAIYVPADDYTDPAPATTFAHLDATTNLERKLSEMGIYPAVDPLASTSRALSPEIVGEEHYEVARSVQQILQRYKELQDIIAMLGMDELSDEDKLVVSRARRVQFFLSQNFHVAEQFTGQKGSYVPVKETVKGFKEILEGKYDHLPEDAFRLVGRIEEVVEKAKEMGVEV

SEQ ID NO: 7060 - DNA, 1419 bp, Bacillus megaterium
  CDS (1)..(1419): transl_table=11
atgacaaaaggacgcgttactcaaatcatgggtccagttgtagacgtaaagtttgacaacggacaccttccagcaatttataacgcccttaaaatttcacataaaccgagcagtgcaagtgaagttgcaatcgaattaacattagaagttgcgattcacttaggtgataacacagttcgtacagtagcaatgtcatccactgacggcttagttcgtggattagaagtagaagatacaggtgcagcaatctcagtaccagttggtgacgttacgttaggtcgtgtattcaacgtattaggtgaaaaaatcgacttagacgccccaatcgatgcaggtgcacgtcgtgatccaatccaccgtcaagcaccaaagttcgaaaatctatctacacaagctgaaattcttgaaacaggtattaaagtagtagacttattagctccttacattaaaggtggaaaaatcggtctattcggtggtgccggtgtaggtaaaacagtattaattcaagagttaatcaataacattgctcaagagcacggcggtatttcggtattcgctggtgtaggtgagcgtacgcgtgaaggtaatgacttataccatgaaatgacagattccggtgttattaagaagacggctatggtatttggacaaatgaatgagccacctggtgcacgtcaacgtgttgcattaacaggattaacaatggcagaatacttccgtgacgaacaaggtcaagacgtattattctttatcgataatatcttccgtttcacacaagcgggttcagaagtatcagcattacttggccgtatgccatcagcagtaggttatcagccaacattagcgacggaaatgggtcagcttcaagagcgtatcacgtcaacaagcgtaggttctgtaacatcgattcaagcgatttacgtaccagccgatgactatacggatccagctccagcgacaacatttgctcacttagatgcaacaacaaacttagagcgtaaattatcagagatgggtatttaccctgcggtagatccattagcatctacatctcgcgctttatctcctgaaattgttggagaagagcactatgcaattgcgcgtcaagttcaacaaacgttacagcgttataaagagttacaagatatcattgcaatcctaggtatggatgagttatctgatgaagataaacttgttgtaccacgtgctcgtcgcgttcaattcttcttgtctcaaacttcagtagcagaacaatttacaggtcaaaaaggttcttatgttcctgtaaaagaaactgttaaaggatttaaagagatcttggaaggtaaatacgatcatttacctgaagatgcgttccgtttagttggtcgcattgaagaagttattgaaaatgcgaaacgtatgggagtagaagtttaa

SEQ ID NO: 7061 - protein, 472 aa, Bacillus megaterium
MTKGRVTQIMGPVVDVKFDNGHLPAIYNALKISHKPSSASEVAIELTLEVAIHLGDNTVRTVAMSSTDGLVRGLEVEDTGAAISVPVGDVTLGRVFNVLGEKIDLDAPIDAGARRDPIHRQAPKFENLSTQAEILETGIKVVDLLAPYIKGGKIGLFGGAGVGKTVLIQELINNIAQEHGGISVFAGVGERTREGNDLYHEMTDSGVIKKTAMVFGQMNEPPGARQRVALTGLTMAEYFRDEQGQDVLFFIDNIFRFTQAGSEVSALLGRMPSAVGYQPTLATEMGQLQERITSTSVGSVTSIQAIYVPADDYTDPAPATTFAHLDATTNLERKLSEMGIYPAVDPLASTSRALSPEIVGEEHYAIARQVQQTLQRYKELQDIIAILGMDELSDEDKLVVPRARRVQFFLSQTSVAEQFTGQKGSYVPVKETVKGFKEILEGKYDHLPEDAFRLVGRIEEVIENAKRMGVEV

SEQ ID NO: 7062 - DNA, 1528 bp, Bacillus PS3
  CDS (61)..(1482): transl_table=11
gaaattgtcgccggagcaaacgccttgcaataggggactagcaagttaggagggaaaacgatgacaagaggacgcgttatccaagtcatgggtccggttgtagacgtcaagtttgagaacggccacttgccggcgatctacaacgccctgaaaattcaacataaagcgcgcaacgaaaacgaagtcgacatcgacttgacattggaagtcgccttgcaccttggcgatgatacagtacggacgatcgcgatggcgtccacagacggcctcatccgcggcatggaagttatcgataccggtgcaccgatttcggtgccggtcgggcaagtcacgcttggccgcgtgttcaacgtcttgggcgagccgatcgacttggaaggcgacattccggctgacgcccgccgcgacccgattcaccgtccggcgccaaaattcgaggaattggcgacggaagtcgaaattttggaaacggggattaaagtcgttgacttgcttgccccgtatattaaaggcggaaaaatcggtttgttcggcggcgctggcgttggaaaaacggtcttgatccaagagctgattcacaacatcgcccaagagcacggcgggatttccgtctttgctggcgtcggcgaacggacacgcgaaggaaacgacttgtaccatgagatgaaagattccggcgtcatcagcaaaacggccatggtgttcggacaaatgaatgagccgccgggggcgcggatgcgcgtcgccttgaccggcttgacgatggccgaatacttccgtgatgaacaaggccaagacggcttgctctttatcgataacatcttccgtttcacgcaggccggttcggaagtgtcggcgctgttaggccgcatgccgtcggccattggttaccaaccgacgttggcgacggagatgggtcaattgcaagagcggatcacgtcgacggcgaaaggctcgatcacctcgattcaagcgatttacgtcccggccgacgactatacggacccggctccggccacgacgttctcgcacttggatgcgacgacgaacctggagcggaagctcgcggagatggggatttatccggccgttgacccgctcgtctcgacatcgcgtgcgttggcgccggaaatcgtcggcgaggagcattatcaagtcgcccgcaaagtgcagcaaacgctcgaacgttataaagaattgcaagacatcatcgccatcttggggatggatgaactgtcggatgaagacaaactcgtcgttcatcgcgcccgccgcatccagttcttcttgtcgcaaaacttccacgtggcggagcagttcacgggccaaccgggctcgtacgtgccggtgaaagaaacagtgcgcggctttaaagaaattttggaaggcaaatacgaccatcttccggaagatcggttccgcttagtcggccgcattgaagaagtcgttgaaaaagcgaaagcgatgggtgtcgaagtgtgacccgggatagggggattggacaatgaaaacgatccacgtgagcgtc

SEQ ID NO: 7063 - protein, 473 aa, Bacillus PS3
MTRGRVIQVMGPVVDVKFENGHLPAIYNALKIQHKARNENEVDIDLTLEVALHLGDDTVRTIAMASTDGLIRGMEVIDTGAPISVPVGQVTLGRVFNVLGEPIDLEGDIPADARRDPIHRPAPKFEELATEVEILETGIKVVDLLAPYIKGGKIGLFGGAGVGKTVLIQELIHNIAQEHGGISVFAGVGERTREGNDLYHEMKDSGVISKTAMVFGQMNEPPGARMRVALTGLTMAEYFRDEQGQDGLLFIDNIFRFTQAGSEVSALLGRMPSAIGYQPTLATEMGQLQERITSTAKGSITSIQAIYVPADDYTDPAPATTFSHLDATTNLERKLAEMGIYPAVDPLVSTSRALAPEIVGEEHYQVARKVQQTLERYKELQDIIAILGMDELSDEDKLVVHRARRIQFFLSQNFHVAEQFTGQPGSYVPVKETVRGFKEILEGKYDHLPEDRFRLVGRIEEVVEKAKAMGVEV

SEQ ID NO: 7064 - DNA, 1413 bp, Bacillus clausii
  CDS (1)..(1413): transl_table=11
atgtcaacaggccgtatcattcaaattacagggcccgtcgtagacgtgaaattcccaagtgggcagctaccggaaatcaataacgcattgacagtcaaccagcaaggcgcagctgatggcgccgttgatgtgaaagtgacgttagaagtagcgcttcaccttggaaacgatacagtccgcacggtagcaatgggttcaactgacgggcttatgcgcggaacagaagtcctagatacaggcggtcctatctccgttcctgttggagaagcaacgcttggccgtgtttttaatgtattaggtgaagagattgacttacaggagcctgtggctgaggggacgcgtcgcgatccaatccaccgcgaggcgccaagctttgaagaactgacaacgacaactgaaattcttgaaaccggcattaaagtcgttgacttgcttgctccatatacaaagggcggaaaaatcggcctttttggcggtgcaggtgtagggaaaacggtcttaatccaagaactaatcaacaacgttgctcttgagcatggcggtatctccgtatttgcaggcgtaggggaacggacccgtgaaggaaatgacctttatcatgaaatgaaagacgccggcgtcatcactaaaacagcgatggtgtttggccaaatgaacgaaccgcctggcgcccgtatgcgtgtcgctttgactggcttgacaatggccgagtatttccgcgatgaacaaggcgcagatgtattgttgttcattgacaacatcttccggtttacgcaagctggttcggaagtgtcggctttgcttgggcgtatgccttcagccgtaggttatcagccaacgcttgctaccgaaatgggtcagttgcaagagcgtatcacatcgacgaagaaaggttctgttacatcgattcaggcgatttatgtacctgccgatgactatacagacccagctccggcgacgacatttgcccacttggatgctacaacaaaccttgaacgtaaattgacggaacaagggatttatccagcagtggacccgcttgcgtcaacatcgcgtgccctttcgcctgagattgtcggtgaagagcattacaatgttgcccgaggcgtgcaacaaacgttgcaaaaatatcgggaactgcaggatattattgcgattttagggatggaagaactgtctgaagaggataaattgattgtagcccgtgctcgccgaatccagttcttcctctcacagaatttccatgtcgctgagcagtttacaggacagccaggctcttatgtgccggttaaagaaacaatccaaggctttaaagacattcttgcaggcaagtacgacgatcttcctgaagacgcgttccgtctcgttggccgtattgaagaagtcgttgaaaaagccaagcaaatggcgtaa

SEQ ID NO: 7065 - protein, 470 aa, Bacillus clausii
MSTGRIIQITGPVVDVKFPSGQLPEINNALTVNQQGAADGAVDVKVTLEVALHLGNDTVRTVAMGSTDGLMRGTEVLDTGGPISVPVGEATLGRVFNVLGEEIDLQEPVAEGTRRDPIHREAPSFEELTTTTEILETGIKVVDLLAPYTKGGKIGLFGGAGVGKTVLIQELINNVALEHGGISVFAGVGERTREGNDLYHEMKDAGVITKTAMVFGQMNEPPGARMRVALTGLTMAEYFRDEQGADVLLFIDNIFRFTQAGSEVSALLGRMPSAVGYQPTLATEMGQLQERITSTKKGSVTSIQAIYVPADDYTDPAPATTFAHLDATTNLERKLTEQGIYPAVDPLASTSRALSPEIVGEEHYNVARGVQQTLQKYRELQDIIAILGMEELSEEDKLIVARARRIQFFLSQNFHVAEQFTGQPGSYVPVKETIQGFKDILAGKYDDLPEDAFRLVGRIEEVVEKAKQMA

SEQ ID NO: 7066 - DNA, 1422 bp, Bacillus stearothermophilus
  CDS (1)..(1422): transl_table=11
atgacaagaggacgcgttatccaagtcatgggtccggttgtagacgtcaagtttgagaccggccacttgccggcgatctacaacgccctgaaaattcaacatcaagcgcgcaacgaaaacgaagtcgacatcgacttgacattggaagtcgccttgcaccttggcgatgatacagtacggacgatcgcgatggcgtccacagacggcctcatccgcggcatggaagtcatcgataccggtgcaccgatttcgcgtccggtcggcgaagtcacgcttggccgcgtgttcaacgtcttgggcgagccgatcgacctcgaaggcgacattccggctgacgcccgccgcgacccgattcaccgtccggcgccaaaattcgaggaattggcgaccgaagtcgaaattttggaaacggggattaaagtcattgacttgcttgccccgtatattaaaggcggaaaaatcggtttgttcggcggcgctggcgtaggaaaaacggtcttgattcaagagctgatccacaacatcgcccaagagcacggcgggatttccgtctttgctggcttcggcgaacggacgcgcgaaggaaacgacttgtaccatgaaatgaaagactccggcgttatcagcaaaaccggcatggtgttcgggcaaatgaacgagccgccggggccgcggatgcgcgtcgccttgaccggtttgacgatggcggagtacttccgcgatgagcaagggcaagacgtgctgctgtttatcgacaacaatttccgcttcacgcaggctggttcggaagtatcggcgttgttaggacgcatgccgtcggctgttggttaccaaccgacattggcgacggagatgggccaattgcaagagcggatcacgtcgacggcgaaaggctcgatcacctcgattcaagcgatttacgtcccggccgacgactatacggacccggctccggccacgacgttctcgcacttggatgcgacgacgaacctggagcggaagctcgcggagatggggatttatccggccgttgacccgctcgcctcgacgtcgcgcgcgctggcgccggaaatcgtcggcgaggagcactatcaagtcgcccgcaaagtgcagcaaacgctgcaacgttataaagaattgcaagacatcatcgccatcttggggatggacgaactgtcggacgaagacaaactcgtcgttcaccgcgcccgccgcatccagttcttcttgtcgcaaaacttccacgtggcggagcagttcacgggccaaccgggctcctacgtgccggtcaaagaaacggtgcgcggctttaaagaaattttggaaggcaaatacgaccatcttccggaagatcggttccgcttagtcggccgcattgaagaagtcgttgaaaaagcgaaagcgatgggtgtcgaagtgtga

SEQ ID NO: 7067 - protein, 473 aa, Bacillus stearothermophilus
MTRGRVIQVMGPVVDVKFETGHLPAIYNALKIQHQARNENEVDIDLTLEVALHLGDDTVRTIAMASTDGLIRGMEVIDTGAPISRPVGEVTLGRVFNVLGEPIDLEGDIPADARRDPIHRPAPKFEELATEVEILETGIKVIDLLAPYIKGGKIGLFGGAGVGKTVLIQELIHNIAQEHGGISVFAGFGERTREGNDLYHEMKDSGVISKTGMVFGQMNEPPGPRMRVALTGLTMAEYFRDEQGQDVLLFIDNNFRFTQAGSEVSALLGRMPSAVGYQPTLATEMGQLQERITSTAKGSITSIQAIYVPADDYTDPAPATTFSHLDATTNLERKLAEMGIYPAVDPLASTSRALAPEIVGEEHYQVARKVQQTLQRYKELQDIIAILGMDELSDEDKLVVHRARRIQFFLSQNFHVAEQFTGQPGSYVPVKETVRGFKEILEGKYDHLPEDRFRLVGRIEEVVEKAKAMGVEV

SEQ ID NO: 7068 - DNA, 1422 bp, Bacillus subtilis
  CDS (1)..(1422): transl_table=11
atgaagaaaggacgcgttagccaggtattaggaccggtcgtcgacgtgcgttttgaagacggtcacttgcctgaaatttataatgcgattaaaatttcacagccagctgcaagtgaaaacgaagtaggtattgatttaacgcttgaggtcgctcttcatttaggtgatgatacagtccgtacaatcgcaatggcatctacagatggtgttcagcgcggtatggaagctgtagatacaggagcgccaatctcagtaccggttggtgatgtaacacttggacgtgtatttaacgttctcggagaaaatattgatttgaatgagccggttcctgcggatgcgaaaaaggatccgattcacagacaggcgccttcattcgatcagctttcaacagaagttgaaattcttgaaacaggtattaaagttgttgatttgcttgctccttacattaagggcggtaaaatcggattgttcggtggtgccggtgtaggtaaaaccgtattaatccaggaattaatcaacaacatcgcgcaagagcacggcggtatctctgtattcgccggcgtaggagagcgtactcgtgaagggaacgaccttttctacgaaatgagtgactctggcgtaatcaacaaaacagccatggtattcggacaaatgaacgagccgccgggcgcacgtatgcgtgttgctttgacaggccttacaatggctgagcacttccgtgatgtacaaggacaggacgtactgttcttcatcgataacattttccgtttcacacaagcgggttcagaggtttcagcccttcttggccgtatgccttcagcggttggttatcagccgacgcttgcaactgagatgggtcagctccaagagcgtatcacgtctacgaacgttggatcagttacatctatccaggcgatctacgtgcctgccgatgactacactgacccggcgccggcgacaacgttcgctcacttggatgcgacaacaaaccttgagcgtaaattaactgaaatgggtatttaccctgcggttgatccgttggcatctacatcacgcgcccttgctcctgaaattgttggagaagagcactatgcggttgcgcgtgaagtacagtcaacgcttcagcgttacaaagagcttcaggatatcattgcgattctcggtatggatgaattaggcgaggaagacaaacttgtcgttcaccgcgcacgtcgtatccagttcttcctttctcagaacttccacgtggctgaacagttcactggacaaaaaggttcttacgtgcctgtaaaagagacggtacaaggcttcaaagaaatcttagccggtaaatatgaccatcttccagaagatgcattccgtcttgtaggccgtatcgaagaagttgttgagaaagcaaaagaaatgggtgtagaagtttaa

SEQ ID NO: 7069 - protein, 473 aa, Bacillus subtilis
MKKGRVSQVLGPVVDVRFEDGHLPEIYNAIKISQPAASENEVGIDLTLEVALHLGDDTVRTIAMASTDGVQRGMEAVDTGAPISVPVGDVTLGRVFNVLGENIDLNEPVPADAKKDPIHRQAPSFDQLSTEVEILETGIKVVDLLAPYIKGGKIGLFGGAGVGKTVLIQELINNIAQEHGGISVFAGVGERTREGNDLFYEMSDSGVINKTAMVFGQMNEPPGARMRVALTGLTMAEHFRDVQGQDVLFFIDNIFRFTQAGSEVSALLGRMPSAVGYQPTLATEMGQLQERITSTNVGSVTSIQAIYVPADDYTDPAPATTFAHLDATTNLERKLTEMGIYPAVDPLASTSRALAPEIVGEEHYAVAREVQSTLQRYKELQDIIAILGMDELGEEDKLVVHRARRIQFFLSQNFHVAEQFTGQKGSYVPVKETVQGFKEILAGKYDHLPEDAFRLVGRIEEVVEKAKEMGVEV

SEQ ID NO: 7070 - DNA, 1518 bp, Bacteroides thetaiotaomicron
  CDS (1)..(1518): transl_table=11
atgtcacagattatcggacatatctcacaggtgatcggccctgtggtcgacgtgtactttgaaggtacggacgcagagttaatgctgccaagcattcacgacgcactggagataaagaggccaaacggcaaaatactggttgtagaagttcagcaacacatcggcgagaatacggttcgtaccgtggctatggacagcactgacggacttcagcgaggcatgaaggtgtatcccaccggaggcccgatcacaatgccgataggcgaacagattaaaggacgactgatgaacgtagtgggcgactctatcgacggtatgaagagtctcgaccgtacaggcgcatattccatccaccgtgatcccccaaagtttgaagatttgacaactgtgcaggaggtactcttcacgggtatcaaagtaatcgacctgctggagccgtatgccaaaggtggcaagatcggactctttggcggtgccggtgtaggaaagaccgtacttattcaggaactgatcaataatattgccaagaaacataacggattctccgtatttgccggagtcggcgagcgtacccgtgaaggtaacgacttgctgcgtgaaatgatcgagtcgggcgttatccgctacggcgaggctttcaaggaaagtatggagaagggcgactgggacctttcgaaagtagactataatgaactggaaaagtcgcaggtatccttgattttcggacagatgaacgagcctccgggcgcacgtgcctctgtggcattgtccggactgacggtagcggaatctttccgtgatgccggcaaggaaggtgagaaacgtgatatcctgttttttatcgataacattttccgtttcacgcaggcgggttcggaagtctcggctctgctgggacgtatgccttctgccgttggttatcagccgacacttgccacggaaatgggtgcgatgcaggaacgtatcacttccacccggaaaggttctatcacctccgtacaggcagtatatgtgcctgcggatgacttgacggaccctgctccggcaacaaccttcagccatctggatgcaacgaccgtgctcgaccgtaagattacggaattgggtatctatccggctgtcgatccactggcttctacgtcccgtatccttgacccgcacatcgtgggacaggaacattatgacgtagcacagcgcgtgaaacagattttgcagcgcaacaaggaattgcaggacatcatctccatccttggtatggaggaactttcggaagaagataaactggtcgtgaaccgtgcgcgccgtgtgcagcgtttcctttcgcagccgtttgccgttgccgaacagtttacaggcgttccgggcgtgatggtaggcatcgaggatacaatcaaagggttcagaatgattctcgacggtgaggtagacaacctccccgaacaggctttcctgaacgtgggcacgattgaagaagcgatagagaaaggcaagaaattgctggaacaagcgaaaaagtaa

SEQ ID NO: 7071 - protein, 505 aa, Bacteroides thetaiotaomicron
MSQIIGHISQVIGPVVDVYFEGTDAELMLPSIHDALEIKRPNGKILVVEVQQHIGENTVRTVAMDSTDGLQRGMKVYPTGGPITMPIGEQIKGRLMNVVGDSIDGMKSLDRTGAYSIHRDPPKFEDLTTVQEVLFTGIKVIDLLEPYAKGGKIGLFGGAGVGKTVLIQELINNIAKKHNGFSVFAGVGERTREGNDLLREMIESGVIRYGEAFKESMEKGDWDLSKVDYNELEKSQVSLIFGQMNEPPGARASVALSGLTVAESFRDAGKEGEKRDILFFIDNIFRFTQAGSEVSALLGRMPSAVGYQPTLATEMGAMQERITSTRKGSITSVQAVYVPADDLTDPAPATTFSHLDATTVLDRKITELGIYPAVDPLASTSRILDPHIVGQEHYDVAQRVKQILQRNKELQDIISILGMEELSEEDKLVVNRARRVQRFLSQPFAVAEQFTGVPGVMVGIEDTIKGFRMILDGEVDNLPEQAFLNVGTIEEAIEKGKKLLEQAKK

SEQ ID NO: 7072 - DNA, 1596 bp, Bartonella henselae
  CDS (1)..(1596): transl_table=11
atggtaaaagcagtgacgtcaagtaaggaaacagcaaaagttgagaaaaagaaatctgctcctcgttcaggcgtgaaaaaagccgtctcgaaatctcaagctggtgtaaaggattcctctagtcctgtgcataagtcttctaaaaaagctccgcttgcagaagcagcagtcggtgtgatcaaacaagttattggtgctgttgttgatgtgcagtttgaaggccctttgccaaatattctcaatgcattagaaacagataatttgggcaatcggctagttttagaagttgctcagcatttgggtgaaaataccgtgcgtaccattgccatggatactaccgatggtcttgtccgtggtcaaaaagtttttgatacaggaacacagatcagtgttcccgtgggagaagcaacacttggtcgtattatgaatgtgattggagagccggttgataatgttggcccaattgctacaagcaaaacccgttccattcaccaagaggctcctgaatatgtggagcaatcaaccgcatcagaaatccttgtgactggtattaaagtcgttgatctgttagctccttattctaaaggggggaaggttggtttgtttggaggtgccggtgttggtaaaaccgttctcattatggagcttatcaacaatattgcaaaggcgcatggtggctattcagtgtttgccggtgttggtgaacgtacacgtgagggaaatgatctttattatgaaatgatcgaaagccgtgtgaatgtgaatccaaaagacaacaatggttcaacagaaggatcaaaatgtgcactcgtttatgggcaaatgaatgaaccaccaggggcgcgtgcacgtgtggctctttcaggattgaccattgcagaaagtttccgtgatgagggacaagatgttttgttcttcgtagataatattttccgttttacgcaagcaggcgctgaagtgtcagctcttttagggcgtattccttctgctgtagggtatcagccaactttggcaactgatatgggggctttgcaagagcgtattaccagtacaagaacaggctctattacctctgttcaggctatttatgttcctgccgatgacttgacagatcccgctcctgcaacatcttttgcccatttggatgcgaccacagttctttctcgttccattgctgaaaagggtatttatccagcagtcgatccactcgattctttctcacgtatgttagatccattgatcgtgggggaagagcattatactgttgcttgtcaagttcagaccattttgcaacgttataggtcattgcaggatattattgctattcttggaatggatgaactttctgaagatgataagttactggtagggcgtgcccgtaaaattgaacgtttcctttcccaacctttccatgttgctgaagcctttaccggttcacctggaaaattggtgcctttagaagagacaatcaaaggctttaagggtctttgcgctggtgagtatgataatttgccagaagcggctttttatatggtcggttcgattgatgaagcagttgaaaaaggaaagcgtcttattgcagaagtttcttcataa

SEQ ID NO: 7073 - protein, 531 aa, Bartonella henselae
MVKAVTSSKETAKVEKKKSAPRSGVKKAVSKSQAGVKDSSSPVHKSSKKAPLAEAAVGVIKQVIGAVVDVQFEGPLPNILNALETDNLGNRLVLEVAQHLGENTVRTIAMDTTDGLVRGQKVFDTGTQISVPVGEATLGRIMNVIGEPVDNVGPIATSKTRSIHQEAPEYVEQSTASEILVTGIKVVDLLAPYSKGGKVGLFGGAGVGKTVLIMELINNIAKAHGGYSVFAGVGERTREGNDLYYEMIESRVNVNPKDNNGSTEGSKCALVYGQMNEPPGARARVALSGLTIAESFRDEGQDVLFFVDNIFRFTQAGAEVSALLGRIPSAVGYQPTLATDMGALQERITSTRTGSITSVQAIYVPADDLTDPAPATSFAHLDATTVLSRSIAEKGIYPAVDPLDSFSRMLDPLIVGEEHYTVACQVQTILQRYRSLQDIIAILGMDELSEDDKLLVGRARKIERFLSQPFHVAEAFTGSPGKLVPLEETIKGFKGLCAGEYDNLPEAAFYMVGSIDEAVEKGKRLIAEVSS

SEQ ID NO: 7074 - DNA, 1611 bp, Bartonella quintana
  CDS (1)..(1611): transl_table=11
atggtaaaagcagtgtcgtcaagcaaaggagcagcaaaagttgaacaaaaaaaatcagctgcccgttcaggcgtgaaaaaaaacgcctcaaaatctcaagccagtctacaggatacctctagtcctctaaaaacttcttctaaaaatgcccatgcaaaaaaagatgtccaggcaaaaggagcagtgggtgagatcaaacaggttattggtgctgtggtcgatgtgcaatttgaaggcgcgttgccaaatattcttaatgcattagaaacagaaaatttaggcaatcgactggttttagaagtcgctcagcatttgggtgaaaatacagtgcgtacaatcgccatggatacaactgatggtcttacgcgtggtcaaaaggtttttgatacagaaacacagatctgtgttcctgtgggagaagcaacccttggtcgtattatgaatgtcattggagagccggtcgacaatgttggaccaatcgctacaaccaaaacccgttccattcaccaaaaggcccctgaatatgttgaccaatcaacagcatcagaaatccttgttactggtattaaagtcgttgatttgttagcaccttattctaaaggtggtaaggttggtttgtttggcggtgctggtgtgggtaaaaccgttctcattatggagctcatcaacaatattgcaaaggcccatggcggttattcagtatttgccggtgttggagagcgcacacgtgaaggaaatgatctctattatgaaatgatcgaaagccgtgtgaatgtgaatccaaaagacaacaatggttcaacaaaaggatcaaaatgtgccctcgtttatggacaaatgaatgagccaccaggagcacgggcacgtgttgcactttcaggattgaccattgcagaaagtttccgtgatgaaggtcaagatgttcttttcttcgtcgataatatcttccgttttacacaagcaggcgctgaagtgtcagctcttttaggacgtatcccttctgctgtgggctatcagccaactttggcaacggacatgggggctttgcaagagcgtattacaagtacaaaaacaggctctattacctctgttcaggctatttatgtgccggctgatgacttgacagatccagcaccagctacatcttttgcccatttggatgcgacaacggttctttcccgttcgattgctgaaaagggtatttatccagcagttgatccccttgattctttctcacgcatgttggatccattggttgtgggtgaagagcattatactgttgcctgtcaagttcagaccattttgcaacgttatagatcgttgcaggatattattgctattcttggaatggatgaactttctgaagaggacaagttgctggtagggcgagcgcgtaaaattgaacgttttctttcgcaacctttccatgtggctgaaacctttactggatcacccggaaaactggtacctttagaagaaacaatcaaagggtttaaaggtctttgtgctggtgattatgatgatctgccagaagcagctttttatatggtgggttcgattgatgaagctcttgaaaaaggaaaacgtcttattgcagaagctgcttcataa

SEQ ID NO: 7075 - protein, 536 aa, Bartonella quintana
MVKAVSSSKGAAKVEQKKSAARSGVKKNASKSQASLQDTSSPLKTSSKNAHAKKDVQAKGAVGEIKQVIGAVVDVQFEGALPNILNALETENLGNRLVLEVAQHLGENTVRTIAMDTTDGLTRGQKVFDTETQICVPVGEATLGRIMNVIGEPVDNVGPIATTKTRSIHQKAPEYVDQSTASEILVTGIKVVDLLAPYSKGGKVGLFGGAGVGKTVLIMELINNIAKAHGGYSVFAGVGERTREGNDLYYEMIESRVNVNPKDNNGSTKGSKCALVYGQMNEPPGARARVALSGLTIAESFRDEGQDVLFFVDNIFRFTQAGAEVSALLGRIPSAVGYQPTLATDMGALQERITSTKTGSITSVQAIYVPADDLTDPAPATSFAHLDATTVLSRSIAEKGIYPAVDPLDSFSRMLDPLVVGEEHYTVACQVQTILQRYRSLQDIIAILGMDELSEEDKLLVGRARKIERFLSQPFHVAETFTGSPGKLVPLEETIKGFKGLCAGDYDDLPEAAFYMVGSIDEALEKGKRLIAEAAS

SEQ ID NO: 7076 - DNA, 1407 bp, Bdellovibrio bacteriovorus
  CDS (1)..(1407): transl_table=11
atggcattcggtaaagtaaaacaggtaatgggtcccgtagtagacgtggaatttgaaggcggggaacttcctgcgatcaactccgctctgcgtgtatcaaataaatttatctctgacgttgaattcaaccttgttcttgaagttgctcagcacttgggtgacggtgttgtaagaactatctctatggaccaaactgaaggtttggttcgtggtgaaaaagttaaagcgttgggcactcaaatcacagcgccagtaggccgtgaagctttgggccgtatcatcaacgtagttggtgaaccaatcgacgaaatgggtccagtaaacgcaaaagaacaatggggcatccacagaacggctcctaaattcgaagaccaagcaactgctgctgcaatgttgatgactggtatcaaagtcgtagacttgctggctccatacgctaagggtggtaagatcggtctgttcggtggtgccggcgtaggtaaaacagtacttatccaggaacttatccgtaacatcgctacagagcacggtggtttctccgtattcgcgggcgttggtgagcgtactcgtgaaggtaatgacttgtggcaagagatgaagcagtctggcgttttggccaagacttccctggtgttcggtcagatgaacgaacctcctggagctcgtgcgcgtgttgctttgactggtttgactgttgctgagtacttccgtgacgttgaaaaccaagacgtattgttcttcgtcgacaacatcttccgcttcactcaagcgggtgccgaagtttctgcattgttgggtcgtatcccttctgcggttggttaccagccaactcttgcgactgagatgggtactcttcaagagcgtatcacttccactaaaaaaggttccatcacttccgttcaagcggtttacgtaccagcggatgactacacggatccagctccagcaaccacgttcactcacttggatgctacgacaaacttggatcgtgatatcgcggctatggcgatcttccctgcggttcacccattgacgtccacttcacgtcttttggatccaactgttatcggcgaagaacactacaagtgcgctcgtgacgttcaggcgttgttgcagcgtaaccgtgagcttcaagacatcatcgcgatcctaggtatggacgagttgtctgaatctgataaattggttgtttcccgttctcgtaagatccagcgtttcttgtctcagccgttcttcgttgctgagcagttcactggcttgccaggtaagtacgtggatatcaaagacactgttaaaggtttccgcgagatccttgatggtaaacacgatgctcttccagagcaggcgttctaccttgttggtactatcgaagacgctatcgagaaagctaagaagctgcaggcctag

SEQ ID NO: 7077 - protein, 468 aa, Bdellovibrio bacteriovorus
MAFGKVKQVMGPVVDVEFEGGELPAINSALRVSNKFISDVEFNLVLEVAQHLGDGVVRTISMDQTEGLVRGEKVKALGTQITAPVGREALGRIINVVGEPIDEMGPVNAKEQWGIHRTAPKFEDQATAAAMLMTGIKVVDLLAPYAKGGKIGLFGGAGVGKTVLIQELIRNIATEHGGFSVFAGVGERTREGNDLWQEMKQSGVLAKTSLVFGQMNEPPGARARVALTGLTVAEYFRDVENQDVLFFVDNIFRFTQAGAEVSALLGRIPSAVGYQPTLATEMGTLQERITSTKKGSITSVQAVYVPADDYTDPAPATTFTHLDATTNLDRDIAAMAIFPAVHPLTSTSRLLDPTVIGEEHYKCARDVQALLQRNRELQDIIAILGMDELSESDKLVVSRSRKIQRFLSQPFFVAEQFTGLPGKYVDIKDTVKGFREILDGKHDALPEQAFYLVGTIEDAIEKAKKLQA

SEQ ID NO: 7078 - DNA, 1473 bp, Bifidobacterium longum
  CDS (1)..(1473): transl_table=11
atggctgacaaccagaccactgcggccgagcctaccaacggtcgcgtcacccgcgtccagggctcggttatcgacgttgaattcccggtgggtcatctgcccgacatctacaacgccctgaaagtaacgatcgtcaacaccagcgccaaggaagaaggcgaggcgaaggagaccgagatcaccctcgaggtcgaacagcacctcggtgattccacggtccgttgcgtcgctctgaagcccaccgacggcctggttcgtggtgcctccgtctccgacaccggcgccccgatctccgtgccggtcggcgacgtgaccaagggccacgtcttcgacgtgtccggtaacatcctcaacaagaagccggatgagaccatcaccgtctccgagcgttggcctatccaccgcaacccgccggccttcgatcagctggagtccaagacccagatgttcgaaacgggcatcaaggtcatcgatctgctgaccccgtacgtgcagggcggcaagatcggtctgttcggtggtgcaggtgtgggcaagaccgtgctgattcaggaaatgattcagcgcgtggcccagaaccacggtggtgtgtccgtgttcgctggcgtcggcgagcgtacccgtgagggtaacgatctgatcggcgaaatggccgaggccggcgtgcttgagaagaccgcactggtcttcggccagatggatgagcagccgggtacccgtctgcgtgtcccgctgaccgcactgaccatggcagagtacttccgtgacgtgcagaaccaggacgtgctgctgttcatcgacaacatcttccgcttcacccaggccggttccgaggtgtccaccctgctggggcgtatgccttccgccgtgggttaccagccgaacctggccgatgagatgggttccctccaggagcgcatcacctcgacccgtggtcactcgatcacctcgttgcaggccatttacgtgccggccgatgattacaccgacccggccccggccacgaccttcgcccacttggatgcaaccaccgagctttctcgtgacattgcctccaagggtatctacccggctgtggacccgctgagctccacctcgcgaatcctcgatccgcgttacgtgggccaggctcactacgactgcgccaaccgcgtcaaggcgattctgcagcgtaacaaggagctgcaggacatcatcgccctgatcggtatcgacgagctcggcgaagaggacaagaccaccgtgaaccgtgctcgtaagatcgagcagttcctcggccagaacttctatgtggctgagaagttcaccggtcgccccggctcctacgtgccggccgacgagaccatcgaagccttcacccgcatctgcgacggcgtgtacgacgacgtcccggagcaggcgttctccggcatcggcggcatcgacgacctcgaagagaagtggcacaacatgcagaaggaactgggtgcgtga

SEQ ID NO: 7079 - protein, 490 aa, Bifidobacterium longum
MADNQTTAAEPTNGRVTRVQGSVIDVEFPVGHLPDIYNALKVTIVNTSAKEEGEAKETEITLEVEQHLGDSTVRCVALKPTDGLVRGASVSDTGAPISVPVGDVTKGHVFDVSGNILNKKPDETITVSERWPIHRNPPAFDQLESKTQMFETGIKVIDLLTPYVQGGKIGLFGGAGVGKTVLIQEMIQRVAQNHGGVSVFAGVGERTREGNDLIGEMAEAGVLEKTALVFGQMDEQPGTRLRVPLTALTMAEYFRDVQNQDVLLFIDNIFRFTQAGSEVSTLLGRMPSAVGYQPNLADEMGSLQERITSTRGHSITSLQAIYVPADDYTDPAPATTFAHLDATTELSRDIASKGIYPAVDPLSSTSRILDPRYVGQAHYDCANRVKAILQRNKELQDIIALIGIDELGEEDKTTVNRARKIEQFLGQNFYVAEKFTGRPGSYVPADETIEAFTRICDGVYDDVPEQAFSGIGGIDDLEEKWHNMQKELGA

SEQ ID NO: 7080 - DNA, 1395 bp, Blochmannia floridanus
  CDS (1)..(1395): transl_table=11
atgagtattggaaaaattattcaggtgattggagcggtgattgatgtagaatttcaatataatgatattcccaatttatatcatgcacttgaggtgaatattgataatggtaattctcatcaggtgttaatattagaagtagtgcaacaattagggagaagtattgtacgttgtattgcaatgggaagtacaaatggattaaaacgtggtttagatgtaacgaatttaaaacatggtattcaagttccggtaggtaaggaaacattaggcagagtaatggatgttttaggcaatccaatagatatgaaaggaccaattaattcaatagaaaaatggtctattcatcgatctgctcctttgtatgaagagttatcatcaaatcaagagttgttgattactggaattaaagtaattgatttaatgtgtccttttataaaaggaggtaaaatagggctttttggaggagcaggggttggaaaaactgttaatataatggaattaattcgtaatattgctatagaacatgctggttattcggtatttgttggagtgggcgaacgcattcgagaaggtaatgatttttatcatgaaatgatacattctggtatacttgataaggttgctttagtttatggtcaaatgaatgagcctcctggaaatagattacgggtggctttaactggtttaactatagcagaaaaatttcgtgatgaaggtcatgatgtgttgttatttattgataatatatatcgttatactcttgctggaacagaagtttctgctttgttagggcgtgttccatctgctgtagggtatcaatctacgttatctgaagaaatggggatgttacaggaacgtattgcttctactaaatctggatcaattacttctgttcaggcgatatatgtacctgcagatgatttaactgatccatctcctacaactacttttgctcatttggatgcaactatagttttaagccgacagattgctgctcttggaatttatccagcagtagatccattagattcttacagtaaacagttagatccatgtattgtaggtcaggagcattatgatattgctaataatgttaagtctattttacagcgttatcaagagttaaaggatattattgctattttaggtatggatgaattatctgaggaggataaattaatagtattgagatctcgaaaaattcaacgatttttatctcaaccattttttgttgctgaagtatttactggattttctggatcatatgtatctttagaagatacaattgcaggttttaaagaaattatcgatggaaagtatgatcatttaccggagcaatctttttatatggttggatctgttaaggaagctatagagaaaagtaaaatactttaa

SEQ ID NO: 7081 - protein, 464 aa, Blochmannia floridanus
MSIGKIIQVIGAVIDVEFQYNDIPNLYHALEVNIDNGNSHQVLILEVVQQLGRSIVRCIAMGSTNGLKRGLDVTNLKHGIQVPVGKETLGRVMDVLGNPIDMKGPINSIEKWSIHRSAPLYEELSSNQELLITGIKVIDLMCPFIKGGKIGLFGGAGVGKTVNIMELIRNIAIEHAGYSVFVGVGERIREGNDFYHEMIHSGILDKVALVYGQMNEPPGNRLRVALTGLTIAEKFRDEGHDVLLFIDNIYRYTLAGTEVSALLGRVPSAVGYQSTLSEEMGMLQERIASTKSGSITSVQAIYVPADDLTDPSPTTTFAHLDATIVLSRQIAALGIYPAVDPLDSYSKQLDPCIVGQEHYDIANNVKSILQRYQELKDIIAILGMDELSEEDKLIVLRSRKIQRFLSQPFFVAEVFTGFSGSYVSLEDTIAGFKEIIDGKYDHLPEQSFYMVGSVKEAIEKSKIL

SEQ ID NO: 7082 - DNA, 1401 bp, Bordetella bronchiseptica
  CDS (1)..(1401): transl_table=11
atgagcaacggaaccatcgttcagtgcatcggcgccgtggtggatattcagttcccccgcgataacatgcccaagatctacgaagcgctcaccctggtcgacgagggttcctcgttcgccgagaagggcttgacgctggaagtgcaacaacagctgggcgacggcgtggtgcgtaccatcgcgctgggttccagcgacgggctgcgccgcggcatgcaagtggctggcaccggcgcaccgatctcggtgcccgtgggccacggcaccctgggccgcatcatggacgtgctgggccgtcccatcgacgaagccggtcccatcgcgtccgacgagaagcgcgccatccaccagcccgcgccccgtttcgacgagctgtcgccgtcggtcgagctgctggaaaccggcatcaaggttatcgacctggtgtgcccgttcgccaagggcggcaaggtcggcctgttcggcggcgccggcgtgggcaagaccgtcaacatgatggaactgatcaacaacatcgccaagcagcacagcggcttgtcggtgttcgccggcgtgggtgagcgtacccgcgaaggcaacgacttctaccatgaaatggaagagtcgaacgttctggacaaggtggccatggtgttcggccagatgaacgagcccccgggcaaccgcctgcgcgtggcgctgaccggcctgaccatggccgagaagttccgcgacgaaggccgtgacatcctgttcttcgtcgacaacatctaccgctacaccctggccggtaccgaagtgtcggcgctgctgggccgtatgccgtcggcggtgggctaccagcctacgctggccgaggaaatgggcgtgctgcaagagcgcatcacctcgaccaagaccggttcgatcacctcgatccaggccgtgtacgtgcctgccgacgacttgaccgacccgtcgcccgccacgaccttccagcacttggactcgaccgtcgtgctgtcgcgtgacatcgctgcgctgggtatctaccccgccgtggacccgctggactcctccagccgccagctcgacccgcaagtcgtgggcgaagagcactaccaggtggctcgtggcgtgcagcagacgctgcagcgctacaaggaactgcgcgacatcatcgcgattctgggcatggacgaactgtcgccggaagacaagcaggccgtggcccgcgcgcgcaagatccagcgcttcctgtcgcagcccttccacgtggccgaagtgttcaccggctcgccgggcaagtacgtgtcgctggccgaaacgatccgtggcttcaagatgatcgtcgacggcgagtgcgacgcgctgcccgagcaggcgttctacatggtcggcacgatcgacgaggccttcgagaaggccaagaaactccaataa

SEQ ID NO: 7083 - protein, 466 aa, Bordetella bronchiseptica
MSNGTIVQCIGAVVDIQFPRDNMPKIYEALTLVDEGSSFAEKGLTLEVQQQLGDGVVRTIALGSSDGLRRGMQVAGTGAPISVPVGHGTLGRIMDVLGRPIDEAGPIASDEKRAIHQPAPRFDELSPSVELLETGIKVIDLVCPFAKGGKVGLFGGAGVGKTVNMMELINNIAKQHSGLSVFAGVGERTREGNDFYHEMEESNVLDKVAMVFGQMNEPPGNRLRVALTGLTMAEKFRDEGRDILFFVDNIYRYTLAGTEVSALLGRMPSAVGYQPTLAEEMGVLQERITSTKTGSITSIQAVYVPADDLTDPSPATTFQHLDSTVVLSRDIAALGIYPAVDPLDSSSRQLDPQVVGEEHYQVARGVQQTLQRYKELRDIIAILGMDELSPEDKQAVARARKIQRFLSQPFHVAEVFTGSPGKYVSLAETIRGFKMIVDGECDALPEQAFYMVGTIDEAFEKAKKLQ

SEQ ID NO: 7084 - DNA, 1401 bp, Bordetella pertussis
  CDS (1)..(1401): transl_table=11
atgagcaacggaaccatcgttcagtgcatcggcgccgtggtggatattcagttcccccgcgataacatgcccaagatctacgaagcgctcaccctggtcgacgagggttcctcgttcgccgagaagggcttgacgctggaagtgcaacaacagctgggcgacggcgtggtgcgtaccatcgcgctgggttccagcgacgggctgcgccgcggcatgcaagtggccggcaccggcgcaccgatctcggtgcccgtgggccacggcaccctgggccgcatcatggacgtgctgggccgtcccatcgacgaagccggtcccatcgcctccgacgagaagcgcgccatccaccagcccgcgccccgtttcgacgagctgtcgccgtcggtcgagctgctggaaaccggcatcaaggttatcgacctggtgtgcccgttcgccaagggcggcaaggtcggcctgttcggcggcgccggcgtgggcaagaccgtcaacatgatggaactgatcaacaacatcgccaagcagcacagcggcttgtcggtgttcgccggcgtgggcgagcgtacccgcgaaggcaacgacttctaccacgaaatggaagagtcgaacgttctggacaaggtggccatggtgttcggccagatgaacgagcccccgggcaaccgcctgcgcgtggcgctgaccggcctgaccatggccgagaagttccgcgacgaaggccgtgacatcctgttcttcgtcgacaacatctaccgctacaccctggccggtaccgaagtgtcggcgctgctgggccgtatgccgtcggcggtgggctaccagcctacgctggccgaggaaatgggcgtgctgcaagagcgcatcacctcgaccaagaccggttcgatcacctcgatccaggccgtgtacgtgcctgccgacgacttgaccgacccgtcgcccgccacgaccttccagcacttggactcgaccgtcgtgctgtcgcgtgacatcgctgcgctgggcatctatcccgccgtggacccgctggattcctccagccgccagctcgacccgcaagtcgtgggcgaagagcactaccaggtggcccgtggcgtgcagcagacgctgcagcgctacaaggaactgcgcgacatcatcgcgattctgggcatggacgaactgtcgccggaagacaagcaggccgtggcccgcgcgcgcaagatccagcgcttcctgtcgcagcccttctacgtggccgaagtgttcaccggctcgccgggcaagtacgtgtcgctggccgaaacgatccgtggcttcaagatgatcgtcgacggcgagtgcgacgcgctgcccgagcaggcgttctacatggtcggcacgatcgacgaggccttcgagaaggccaagaaactccaataa

SEQ ID NO: 7085 - protein, 466 aa, Bordetella pertussis
MSNGTIVQCIGAVVDIQFPRDNMPKIYEALTLVDEGSSFAEKGLTLEVQQQLGDGVVRTIALGSSDGLRRGMQVAGTGAPISVPVGHGTLGRIMDVLGRPIDEAGPIASDEKRAIHQPAPRFDELSPSVELLETGIKVIDLVCPFAKGGKVGLFGGAGVGKTVNMMELINNIAKQHSGLSVFAGVGERTREGNDFYHEMEESNVLDKVAMVFGQMNEPPGNRLRVALTGLTMAEKFRDEGRDILFFVDNIYRYTLAGTEVSALLGRMPSAVGYQPTLAEEMGVLQERITSTKTGSITSIQAVYVPADDLTDPSPATTFQHLDSTVVLSRDIAALGIYPAVDPLDSSSRQLDPQVVGEEHYQVARGVQQTLQRYKELRDIIAILGMDELSPEDKQAVARARKIQRFLSQPFYVAEVFTGSPGKYVSLAETIRGFKMIVDGECDALPEQAFYMVGTIDEAFEKAKKLQ

SEQ ID NO: 7086 - DNA, 1434 bp, Bradyrhizobium japonicum
  CDS (1)..(1434): transl_table=11
atggcagcccagtccggtcgcgtcacccaggtcatcggcgccgtcgtcgacgtgcagttcgaaggccacctcccggccattctcaattcgctcgagaccaagaacggcggcaaccgcctggtgctcgaagtcgcccagcatctcggcgaatccaccgtgcgcacgatcgcgatggacaccaccgagggtctggtccgcggccaggaagtgaccgacaccggttcgccgatccgcgttcccgtcggcgaaggcacgctcggccgcatcatcaacgtcatcggcgagccgatcgacgaagccggcccggtcaagtcggaaggcctgcgcgccatccaccaggaagcgccgacctacaccgaccagtccaccgaagctgaaattctcgtcaccggcatcaaggtcgtcgatctcctggctccctatgcgaagggcggcaagatcggcctgttcggcggcgccggcgtcggcaagaccgtgctgattcaggagctgatcaacaacgtcgcgaaggcgcacggtggttactccgtgttcgccggcgtcggcgagcgtacccgcgagggcaacgacctctatcacgagttcatcgagtccaaggtcaacgccgatccgcacaatccggatccgagcgtgaagtcgaagtgcgcgctggtgttcggccagatgaacgagccgccgggcgcccgcgcccgcgtcgcgctcaccggtctgaccatcgcggaagacttccgcgacaagggccaggacgtgctgttcttcgtcgacaacatcttccgcttcacccaggccggctcggaagtgtcggcgctgctcggccgtattccttcggcggtgggttatcagccgacgctcgcgaccgacatgggcgcgctgcaggagcgcatcaccaccacgcagaagggctcgatcacctcggtgcaggccatctacgttccggccgacgacttgaccgacccggcgcccgcgacctcgttcgcgcatctggacgcgaccaccacgctgtcgcgctcgatcgccgaaaagggcatctacccggcggtggacccgctcgactcgacctcgcgcatgctctccccgctggtcgtcggcgaggagcactacgcggtcgcccgtcaggtccagcaggtgctgcagcgctacaaggcgcttcaggacatcatcgccattctcggcatggacgagctttcggaagaggacaagctgacggtggcccgcgcccgcaaggtcgagcgcttcatgtcgcagccgttccacgtcgccgaaatcttcaccggctcgcccggcaagttcgtcgacctcgccgacaccatcaagggcttcaagggcctggtggaaggcaagtacgaccacctgccggaagctgccttctacatggtcggcaccatcgaagaggcggtcgagaagggcaagaagctcgccgctgaagcggcctaa

SEQ ID NO: 7087 - protein, 477 aa, Bradyrhizobium japonicum
MAAQSGRVTQVIGAVVDVQFEGHLPAILNSLETKNGGNRLVLEVAQHLGESTVRTIAMDTTEGLVRGQEVTDTGSPIRVPVGEGTLGRIINVIGEPIDEAGPVKSEGLRAIHQEAPTYTDQSTEAEILVTGIKVVDLLAPYAKGGKIGLFGGAGVGKTVLIQELINNVAKAHGGYSVFAGVGERTREGNDLYHEFIESKVNADPHNPDPSVKSKCALVFGQMNEPPGARARVALTGLTIAEDFRDKGQDVLFFVDNIFRFTQAGSEVSALLGRIPSAVGYQPTLATDMGALQERITTTQKGSITSVQAIYVPADDLTDPAPATSFAHLDATTTLSRSIAEKGIYPAVDPLDSTSRMLSPLVVGEEHYAVARQVQQVLQRYKALQDIIAILGMDELSEEDKLTVARARKVERFMSQPFHVAEIFTGSPGKFVDLADTIKGFKGLVEGKYDHLPEAAFYMVGTIEEAVEKGKKLAAEAA

SEQ ID NO: 7088 - DNA, 2123 bp, Brassica napus
  CDS (545)..(2041)
gactttttataaatcgaaatatttaatattaaaataataataaaatcactcttgacagtaatatatgttgtatatgtaaatcctagatatgacaatatgcggaattcatccatgaaaatgaaaaacaaggggggggttgatatcgatgggacgcataaccggatatgctaaaatgaaaatatgaaaaaaaaaaagctaatgagatcgaaataatgaatcataaatagagttccatttcggaattggctagataaaacaaagtcttgcctattatgacaaataaatcaaagactttccacaaaaattttttttattcatatattttttattttaaaactaggttttggttagttgagcttgaaaacgactattccttcattgaaatttaattaagtaaaaaattgaattgcatattcgcttgggtggtaccaatgaaatcgagtgcttactcccatttattattgaattaaccaatgaatttactatacgaagattttttctgtattcgaaaaatttcgcaacaaaattgaacatattttttattatgagaataaatcctactacttcggatccagcggtttcaatacgtgaaaaaaacaacctgggacgtattgcccaaatcattggtccggtactggatgtagcctttcccccgggcaagatgcctaatatttacaatgctctggtggttaagggtcgagatacgcttggtcaagaaattaatgtgacttgtgaagtacagcaattattaggaaacaaccgagttagagctgtagctatgagcgcgaccgagggtttaaagagagggatggacgtggttgatatgggaaatcctctaagtgttccagtcggcggagcgactctaggacgaattttcaatgtacttggggaacctgttaataatttaggtcctgtcgatactctcacaacatctcctatccataaatccgcgcctgcttttatagacttagatacaaccttatctatttttgaaacaggaattaaagtagtagatcttttggccccttatcgtcgtgggggaaaaatcggactattcggtggggctggcgtgggtaaaacagtactaattatggaattgatcaacaacattgccaaagctcatggtggtgtatccgtatttggtggagtaggcgaacgaacccgtgaaggaaatgatctttacatggaaatgaaagagtctggagtcattaatgaactaaaccttgcggactccaaagtagccctagtctacggtcagatgaatgaaccgccgggagctcgtatgagagttggtctgactgccttaactatggcggaatatttccgagatgttaatgagcaagacgtacttctatttatcgacaatatcttccgttttgtacaagcaggatccgaggtatccgctttattgggtagaatgccttctgctgtgggttaccaacccacccttagtgccgaaatgggttctttacaagaaagaattacttctacgaaaaaagggtccataacctctattcaagcagtttatgtacctgcagacgatttgactgaccctgctcctgccaccacatttgcacatttagatgcgactaccgtactatcaagaggattagctgctaaaggcatctatccagcggtagatcctttagattcaacgtcaactatgctacaacctcgaatcgttggcgaggaacattatgaaactgcgcaacaagtaaagcaaactttacaacgttacaaggagcttcaggacattatagctatcctggggttggacgaattatccgaagaggatcgcttaaccgtcgcaagagcacgaaagattgagcgtttcttatcacaaccttttttcgtagcagaagtatttacaggttctccgggaaaatatgttgggctagcggaaacaattagagggtttaatttgatcctttccggagaatttgattctcttcctgaacaggccttttacttagtgggtaacatcgatgaagctactgcgaaggctacgaacttagaaatggagagtaaattgaagaaatgaccttaaatctttgtgtactgactccgaatcgaattgtttgggattcagaagtaaaagaaatcattttatctactaatagcgg

SEQ ID NO: 7089 - protein, 498 aa, Brassica napus
MRINPTTSDPAVSIREKNNLGRIAQIIGPVLDVAFPPGKMPNIYNALVVKGRDTLGQEINVTCEVQQLLGNNRVRAVAMSATEGLKRGMDVVDMGNPLSVPVGGATLGRIFNVLGEPVNNLGPVDTLTTSPIHKSAPAFIDLDTTLSIFETGIKVVDLLAPYRRGGKIGLFGGAGVGKTVLIMELINNIAKAHGGVSVFGGVGERTREGNDLYMEMKESGVINELNLADSKVALVYGQMNEPPGARMRVGLTALTMAEYFRDVNEQDVLLFIDNIFRFVQAGSEVSALLGRMPSAVGYQPTLSAEMGSLQERITSTKKGSITSIQAVYVPADDLTDPAPATTFAHLDATTVLSRGLAAKGIYPAVDPLDSTSTMLQPRIVGEEHYETAQQVKQTLQRYKELQDIIAILGLDELSEEDRLTVARARKIERFLSQPFFVAEVFTGSPGKYVGLAETIRGFNLILSGEFDSLPEQAFYLVGNIDEATAKATNLEMESKLKK

SEQ ID NO: 7090 - DNA, 1566 bp, Brucella melitensis
  CDS (1)..(1566): transl_table=11
atggcaaaagcagcgaccccgaaaactaccgccgcggccgaagcaaagccagcggcgaaggcacccgccaaaaaggcggcgcccaagaccaccgcagcagccaagcccgctgctacgaagtctggcgcccccaaggcagcagcagccggtgcgatcggccacattacgcaggtcatcggcgctgtcgtcgacgtcaagttcccggaaggccagttgccgctgatcctgaacgcgcttgaagtggacaatcagggccatcgtctggttctcgaagttgcccagcacctcggcgaagacaccgtgcgcaccatcgccatggacgcgaccgaaggtctcgttcgcggtcaggaagcacgcgacactggcgaaccgatcatggtgccggtcggcgtcgaaacgcttggccgcatcatgaacgtcatcggcgagccggttgacgaagcaggccccatcaagaccaaggcaacccgcgccatccaccagaacgcgccggaatatatcgaacagtcgaccgaagccgaaattctggtcacgggcatcaaggtcgtcgaccttctggcgccttacgccaagggcggcaagatcggcctcttcggcggtgcaggcgtcggcaagaccgttctcatcatggaactcatcaacaacgtcgccaaggcgcacggcggttattccgtgttcgcaggcgtcggtgagcgtacccgtgagggcaacgacctttaccacgaaatgatcgagtcgggcgtgaacaagctcggcggcggcgaaggctccaaggcagccctcgtttacggccagatgaacgaacccccgggtgcccgcgcccgcgttgccctttccggtctgacggttgctgaaaacttccgtgaccagggccaggacgttctgttcttcgtggacaacatcttccgcttcacgcaggcaggttcggaagtgtcggctcttctcggccgtattccttccgctgtgggttatcagccgacgctggcaaccgacatgggcgccatgcaggaacgcatcaccacgacgaccaagggttcgatcacctcggttcaggccatttacgtgcctgccgacgacttgaccgacccggcaccggcaacctcgttcgcccacctggacgcaacgaccgttctgtcgcgctcgatcgctgaaaagggtatctacccggctgttgacccgctcgactccacgtcgcgtatgctcgacccgaaggtcgtcggtgaagaacactatgccgtcgcccgtcaggttcagtcgatcctgcaacgttacaaggcccttcaggacatcatcgcgatcctgggcatggacgaactgtctgaagaagacaagctcaccgttgcccgcgcccgcaagatcgaacgcttcctgtcgcagccgttcttcgttgctgaagtcttcaccggttcgccgggcaagctggtcgatctcgccgacaccatcaagggcttcaagggcctttgcgctggcgactacgatcaccttccggaagctgccttctacatggtcggcagcatcgaggaagcactcgaaaaggccaagaagctggcggctgaagctgcctga

SEQ ID NO: 7091 - protein, 521 aa, Brucella melitensis
MAKAATPKTTAAAEAKPAAKAPAKKAAPKTTAAAKPAATKSGAPKAAAAGAIGHITQVIGAVVDVKFPEGQLPLILNALEVDNQGHRLVLEVAQHLGEDTVRTIAMDATEGLVRGQEARDTGEPIMVPVGVETLGRIMNVIGEPVDEAGPIKTKATRAIHQNAPEYIEQSTEAEILVTGIKVVDLLAPYAKGGKIGLFGGAGVGKTVLIMELINNVAKAHGGYSVFAGVGERTREGNDLYHEMIESGVNKLGGGEGSKAALVYGQMNEPPGARARVALSGLTVAENFRDQGQDVLFFVDNIFRFTQAGSEVSALLGRIPSAVGYQPTLATDMGAMQERITTTTKGSITSVQAIYVPADDLTDPAPATSFAHLDATTVLSRSIAEKGIYPAVDPLDSTSRMLDPKVVGEEHYAVARQVQSILQRYKALQDIIAILGMDELSEEDKLTVARARKIERFLSQPFFVAEVFTGSPGKLVDLADTIKGFKGLCAGDYDHLPEAAFYMVGSIEEALEKAKKLAAEAA

SEQ ID NO: 7092 - DNA, 1392 bp, Burkholderia cepacia
  CDS (1)..(1392): transl_table=11
atgagtactgctgctttggtagaaggcaagatcgtacagtgcatcggcgccgttatcgacgtggaattcccgcgcgacagcatgccgaagatctacgacgcgctcattctcgatggctcggaactgacgctcgaagtccagcaacagctgggcgacggcgtggtccgtaccatttgtctgggtgcatccgacggcctgcgccgcggcctgaccgtgaagaacacgagcaagccgatttcggtgccggtcggcaagccgaccctcggtcgtatcatggacgtcctcggccgtccgatcgacgaagccggcccgatcgaaagcgaacatacgcgttcgatccaccagaaggctccggcgttcgacgaactgtcgccgtcgaccgaactgctcgaaacgggtatcaaggtcatcgacctgatctgcccgttcgcaaagggcggcaaggtcggcctgttcggcggtgctggcgtgggcaagaccgtcaacatgatggagctcatcaacaacatcgcgaaggaacacggcggttactccgtgttcgcgggcgtgggcgagcgtacccgtgaagggaacgacttctaccacgaaatgaaggactcgaacgttctcgacaaggtcgcgctggtgtacggccagatgaacgagccgccgggcaaccgtctgcgcgtgctgaccggcctgacgatggccgagcacttccgtgacgaaggcctcgacgtcctgttcttcgttgacaacatctaccgtttcacgctggccggtaccgaagtgtcggcactgctcggccgtatgccgtcggcagtgggctatcagccgacgctggctgaagaaatgggcaagctgcaagagcgcatcacgtcgaccaagaagggctcgattacgtcggtccaggccgtgtacgtccctgcggacgacttgaccgacccgtcgccggccacgaccttcggccacctggacgcaaccgtcgttctgtcgcgtgacatcgcttcgctgggtatctacccggcggtcgacccgctcgactcgacgtcgcgccagatcgacccgaacgtgatcggtgaagagcactactcgatcacccgtcgcgttcagcagacgctgcagcgctacaaggaactgcgcgacatcatcgcgattctgggcatggacgaactgtcgccggaagacaagctgtcggtcgcacgtgcgcgtaagatccagcgtttcctgtcgcagccgttccacgtcgctgaagtgttcacgggctcgccgggcaagtacgtgccgctgaaggaaacgatccgtggcttcaagatgatcgtcgacggcgagtgcgaccacctgccggaacaggcgttctacatggtcggcacgatcgacgaagccttcgaaaaggccaagaagatctcgtaa

SEQ ID NO: 7093 - protein, 463 aa, Burkholderia cepacia
MSTAALVEGKIVQCIGAVIDVEFPRDSMPKIYDALILDGSELTLEVQQQLGDGVVRTICLGASDGLRRGLTVKNTSKPISVPVGKPTLGRIMDVLGRPIDEAGPIESEHTRSIHQKAPAFDELSPSTELLETGIKVIDLICPFAKGGKVGLFGGAGVGKTVNMMELINNIAKEHGGYSVFAGVGERTREGNDFYHEMKDSNVLDKVALVYGQMNEPPGNRLRVLTGLTMAEHFRDEGLDVLFFVDNIYRFTLAGTEVSALLGRMPSAVGYQPTLAEEMGKLQERITSTKKGSITSVQAVYVPADDLTDPSPATTFGHLDATVVLSRDIASLGIYPAVDPLDSTSRQIDPNVIGEEHYSITRRVQQTLQRYKELRDIIAILGMDELSPEDKLSVARARKIQRFLSQPFHVAEVFTGSPGKYVPLKETIRGFKMIVDGECDHLPEQAFYMVGTIDEAFEKAKKIS

SEQ ID NO: 7094 - DNA, 1395 bp, Burkholderia mallei
  CDS (1)..(1395): transl_table=11
atgagtactgctgctttggtagaaggcaagatcgtacagtgcatcggcgccgttatcgacgtggaattcccgcgcgagagcatgccgaagatctacgacgcgctcattctggaaggctcggaactgacgctcgaagtccagcagcagctgggcgacggcgtggtccgtaccatctgtctgggtgcctccgacggcctgcgccgcggcgtcgtggtgaagaatacgggcaatccgatttcggtgccggtcggcaagccgaccctcggccgcatcatggacgtgctcggccgcccgatcgacgaggcgggaccgatcgagagcgaaaacaagcgctcgatccaccagaaggcgccggcgttcgacgagctgtcgccgtcgaccgaactgctcgaaacgggcatcaaggtcatcgatctgatctgcccgttcgcaaagggcggcaaggtcggcctgttcggcggcgcgggcgtgggcaagaccgtcaacatgatggagctcatcaacaacatcgcgaaggagcacggcggttactccgtgttcgcgggcgtgggcgagcgtacccgtgaagggaacgacttctaccacgaaatgaaggactcgaacgttctcgacaaggtcgcgctggtgtacggccagatgaacgagccgccgggcaaccgtctgcgcgtggcgctgacgggcctcacgatggccgagcacttccgtgacgaaggcctcgacgtgctgttcttcgtcgacaacatctaccgtttcacgctggccggtaccgaagtgtcggcgctgctcggccgtatgccgtcggcagtgggctatcagccgacgctggctgaagaaatgggcaagctgcaagagcgcatcacgtcgacgaagaagggctcgatcacgtcggttcaggccgtgtacgtgcctgcggacgacttgaccgacccgtcgccggccaccaccttcggccacttggacgcaaccgtcgttctgtcgcgtgacatcgcatcgctcggtatctatccggccgtcgacccgctcgactcgacgtcgcgccagatcgacccgaacgtgatcggcgaagagcactactcgatcacccgccgcgttcagcagacgctgcagcgctacaaggaactgcgcgacatcatcgcgattctgggcatggacgagctgtcgccggaagacaagctgtcggttgcgcgcgcacgtaagatccagcgtttcctgtcgcagccgttccacgtcgccgaagtgttcacgggctcgccgggcaagtacgtgccgctgaaggaaacgatccgcggcttcaagatgatcgtcgacggcgagtgcgaccacctgccggaacaggcgttctacatggtcggcacgatcgacgaagccttcgagaaggccaagaagatccagtaa

SEQ ID NO: 7095 - protein, 464 aa, Burkholderia mallei
MSTAALVEGKIVQCIGAVIDVEFPRESMPKIYDALILEGSELTLEVQQQLGDGVVRTICLGASDGLRRGVVVKNTGNPISVPVGKPTLGRIMDVLGRPIDEAGPIESENKRSIHQKAPAFDELSPSTELLETGIKVIDLICPFAKGGKVGLFGGAGVGKTVNMMELINNIAKEHGGYSVFAGVGERTREGNDFYHEMKDSNVLDKVALVYGQMNEPPGNRLRVALTGLTMAEHFRDEGLDVLFFVDNIYRFTLAGTEVSALLGRMPSAVGYQPTLAEEMGKLQERITSTKKGSITSVQAVYVPADDLTDPSPATTFGHLDATVVLSRDIASLGIYPAVDPLDSTSRQIDPNVIGEEHYSITRRVQQTLQRYKELRDIIAILGMDELSPEDKLSVARARKIQRFLSQPFHVAEVFTGSPGKYVPLKETIRGFKMIVDGECDHLPEQAFYMVGTIDEAFEKAKKIQ

SEQ ID NO: 7096 - DNA, 1398 bp, Campylobacter jejuni
  CDS (1)..(1398): transl_table=11
atgcaaggatttatttcacaggtattaggtccggttgttgatgtagattttaacgactatttgcctcaaattaatgaagcaattgttgtaaattttgaaagcgaaggaaaaaaacataaacttgttttagaagtagcagctcatttaggagataatagagttagaactattgctatggatatgacagatggtttggtaaggggcttaaaagctgaggctttaggtgctcccattagtgttcctgttggtgagaaagttttaggaagaattttcaatgttactggagatttgatcgatgaaggtgaagaaatttctttcgataaaaaatgggcaattcatagagatccaccagcttttgaagatcaaagcacaaaaagtgagatttttgaaacagggattaaagttgtagatttacttgctccttatgcaaaaggtggtaaagtaggtctttttggtggtgcaggtgttggtaaaactgttattattatggagcttattcacaatgttgcatttaagcatagcggctattctgtatttgcaggtgtgggtgagagaactcgtgaaggaaatgacctttataatgaaatgaaagaaagtaatgttttagacaaagttgctctatgttatggacaaatgaatgaaccaccaggggcaagaaatcgtattgctttaacaggtttaacaatggctgagtattttagagatgaaatgggtcttgatgtgcttatgtttattgataatatctttagattttcacaatcaggttctgaaatgtcagcacttttaggaagaattccatcagctgtgggttatcaaccaaccttagcaagtgaaatgggtaaattccaagaaagaattacttcaactaaaaaaggctcaatcacttcagttcaagctgtttacgttccagctgatgacttaacagacccagctccagcaactgtttttgctcacttagatgctacaacggttttaaatagagctattgctgaaaagggtatttatcctgcagttgacccacttgactcaacttcaagaatgcttgacccaaatatcattggagaagaacattataaagttgctcgtggtgttcaatcagtgcttcaaaaatacaaagatttacaagatatcatcgccattttaggtatggatgagcttagcgaagaggataaacttgtagttgaaagagcaagaaagattgaaaaattcttatcacaaccatttttcgttgcagaagttttcacaggtagcccaggaaaatatataagccttgaagatacaatagcaggatttaagggaattttagaaggtaaatatgatcatttaccagaaaatgctttctatatggttggaaatatagatgaagctattgcaaaagcggataaattaaaaggttaa

SEQ ID NO: 7097 - protein, 465 aa, Campylobacter jejuni
MQGFISQVLGPVVDVDFNDYLPQINEAIVVNFESEGKKHKLVLEVAAHLGDNRVRTIAMDMTDGLVRGLKAEALGAPISVPVGEKVLGRIFNVTGDLIDEGEEISFDKKWAIHRDPPAFEDQSTKSEIFETGIKVVDLLAPYAKGGKVGLFGGAGVGKTVIIMELIHNVAFKHSGYSVFAGVGERTREGNDLYNEMKESNVLDKVALCYGQMNEPPGARNRIALTGLTMAEYFRDEMGLDVLMFIDNIFRFSQSGSEMSALLGRIPSAVGYQPTLASEMGKFQERITSTKKGSITSVQAVYVPADDLTDPAPATVFAHLDATTVLNRAIAEKGIYPAVDPLDSTSRMLDPNIIGEEHYKVARGVQSVLQKYKDLQDIIAILGMDELSEEDKLVVERARKIEKFLSQPFFVAEVFTGSPGKYISLEDTIAGFKGILEGKYDHLPENAFYMVGNIDEAIAKADKLKG

SEQ ID NO: 7098 - DNA, 1422 bp, Carboxydothermus hydrogenoformans
  CDS (1)..(1422): transl_table=11
atgaacgtaggtcgggtagtgcaggttatcggcgttgtggtggacgtagagtttgaaccgggtaaggttcctcccatttataacgccttaaaaataagaagcgaagaccaggacacacccaccgaagtgcccattaacctgacgctggaagttgcccagcacctgggcaacaaccgggtccgggcggtagcgatgtcgtctaccgatggcctggttcggggcatgaaagtggtggataccggagcgcccattaccgttccggtaggccgtcctgttttgggacgcctgttaaacgtgctcggggaacccattgacggtaagggaccggtggaaagcgaccattactatcccattcaccggcccgctcctcctctggaagaacagtccacccgggcggaaatcctggaaacggggattaaggttatcgaccttttggtaccgttcttaaagggtggtaaaatcgggcttttcggcggtgccggagtaggtaagaccgttatcgtgatggagctcatcaacaacattgccaagcagcacggtggtatttccgtgtttgccggtgtgggcgagcggacccgggaaggtaacgacctttaccacgaaatgaaagaagcgggcgttttggataagaccatcatggtgttcgggcaaatgaacgaaccacccggggtgcgtcttagagtagggcttaccggtcttaccatggcggaatacttccgggatgaagaggggcaggacgtgctcctctttatcgacaacatcttccgcttcacccaggccggatccgaagtgtccgccctactgggccggatgccttcggcggtgggttaccagcccaccctggcgaccgagatgggtcagctccaggagcggattacctcaacccggaaaggttcgattacttcggtgcaggcggtttacgtgccggcggacgacttaaccgacccggcgccggcgacaaccttcgcacacctggatgctaccgtcgttctttcccggcaaattgccgagctcgggatttatccggcggtggaccccctggactccacttcccggattttagacccgcatatcgtcggggaggaacattatcaggtagcccggggtgtgcagcgggtgctccagcgctataaagaactgcaggacatcatcgccattctcggtatggatgagctttccgacgaagacaagctgatcgtggcccgggcccggaagctgcagcgcttcctttcccagccgtttaccgtggccgaagcgtttaccgggcggcccgggaagtacgtgccggtgaaagaaaccatccggggctttaaagaaatcctggaaggcaagcacgacgatattccggagacctgcttctacatggcgggcaccatcgacgaagtggtggaaagggcccgggagcttgaaggaagtgcataa

SEQ ID NO: 7099 - protein, 473 aa, Carboxydothermus hydrogenoformans
MNVGRVVQVIGVVVDVEFEPGKVPPIYNALKIRSEDQDTPTEVPINLTLEVAQHLGNNRVRAVAMSSTDGLVRGMKVVDTGAPITVPVGRPVLGRLLNVLGEPIDGKGPVESDHYYPIHRPAPPLEEQSTRAEILETGIKVIDLLVPFLKGGKIGLFGGAGVGKTVIVMELINNIAKQHGGISVFAGVGERTREGNDLYHEMKEAGVLDKTIMVFGQMNEPPGVRLRVGLTGLTMAEYFRDEEGQDVLLFIDNIFRFTQAGSEVSALLGRMPSAVGYQPTLATEMGQLQERITSTRKGSITSVQAVYVPADDLTDPAPATTFAHLDATVVLSRQIAELGIYPAVDPLDSTSRILDPHIVGEEHYQVARGVQRVLQRYKELQDIIAILGMDELSDEDKLIVARARKLQRFLSQPFTVAEAFTGRPGKYVPVKETIRGFKEILEGKHDDIPETCFYMAGTIDEVVERARELEGSA

SEQ ID NO: 7100 - DNA, 1620 bp, Caulobacter crescentus
  CDS (1)..(1620): transl_table=11
atggccaagacccccgctgaaaagccggcgaccgccgccaagaagcccgccgcccccaaggccgccgctgctccgaaggccgccgccgccaaggcccccgccgccgccaaggctccggccgccaagaagccggccgctccgaaggccgccgccgcgccgaaggctcccgccgccggcctggaaggcgccaccggccgcctcgtccagatcatcggcgccgtcgtcgatatcgagttcgacggcgctctgccggcgatcctgaacgccgtcgagaccgtcaacaccgccacgggccagcgcctggtgttcgaagtcgcccagcacctgggtcagagcaccgtccgcgccatcgccatggacgccaccgaaggcctggttcgtggccagcccgtgcgcgacaccggcgagccgatccgcgtgccggtcggtccgggcaccctgggccgcatcatgaacgtcatcggcgagccgatcgacgaacagggcccgatccgttcggacatcagccgcacgatccaccgtgacgccccgtccttcgccgagcagaccaacaccgctgaagtgctggtcacgggcatcaaggtcatcgacctgatgtgcccctacaccaagggcggcaagatcggcctgttcggcggcgccggcgtcggcaagaccgtgacgatgcaggaactgatcaacaacatcgccaaggcttacggcggttactcggttctggccggcgtgggtgagcgcacccgcgaaggcaacgacctgtatcacgagatgatcgagtcgaacgtgaacgtcgacccgaaggctaacaacggctcgaccgaaggctcgcgctgcgccctcgtttacggccagatgaacgaacccccgggcgcccgcgcccgcgtcgccctgaccggcctctccatcgcggaatacttccgtgacgaagaaggcaaggacgtgctgctgttcgtcgacaacatcttccgcttcacccaggccggcgccgaagtgtcggctctgctgggccgtatcccgtcggccgtgggttaccagcccaccctggccaccgagatgggcaacctgcaggagcgcatcacctcgacgaacaagggttcgatcacctcggtccaggccatctacgtgcccgccgacgacttgaccgacccggctccggccacctcgttcgcccacttggacgccaccaccgttctgtcgcgtgacatcgcggcccaggccatcttcccggccgtggacccgctggactcgacctcgcggatcatggacccgctggtcatcggcgaagagcactacacggtggcgcgccgcgtccaggaagtgctgcagcagtacaaggccctgaaggacatcatcgccatcctgggcatggacgaactgtcggaagaggacaagctggtcgtggctcgcgcccgcaagatccagcgcttcctgtcgcagccgttccacgtcgccgagcagttcaccaacacgccgggcgccttcgtccagctgaaggacacgatccgctcgttcaagggcatcgtcgacggcgagtacgatcacctgccggaaggcgccttctacatggtcggtccgatcgaagaagccgtggccaaggccgaaaagatggcggctgaagcctaa

SEQ ID NO: 7101 - protein, 539 aa, Caulobacter crescentus
MAKTPAEKPATAAKKPAAPKAAAAPKAAAAKAPAAAKAPAAKKPAAPKAAAAPKAPAAGLEGATGRLVQIIGAVVDIEFDGALPAILNAVETVNTATGQRLVFEVAQHLGQSTVRAIAMDATEGLVRGQPVRDTGEPIRVPVGPGTLGRIMNVIGEPIDEQGPIRSDISRTIHRDAPSFAEQTNTAEVLVTGIKVIDLMCPYTKGGKIGLFGGAGVGKTVTMQELINNIAKAYGGYSVLAGVGERTREGNDLYHEMIESNVNVDPKANNGSTEGSRCALVYGQMNEPPGARARVALTGLSIAEYFRDEEGKDVLLFVDNIFRFTQAGAEVSALLGRIPSAVGYQPTLATEMGNLQERITSTNKGSITSVQAIYVPADDLTDPAPATSFAHLDATTVLSRDIAAQAIFPAVDPLDSTSRIMDPLVIGEEHYTVARRVQEVLQQYKALKDIIAILGMDELSEEDKLVVARARKIQRFLSQPFHVAEQFTNTPGAFVQLKDTIRSFKGIVDGEYDHLPEGAFYMVGPIEEAVAKAEKMAAEA

SEQ ID NO: 7102 - DNA, 1389 bp, Chlorobium limicola
  CDS (1)..(1389): transl_table=11
atgcaagaaggtaagatttcccagatcatcggacctgtcgttgacgttgactttgctgaaggacagcttccgtctatcctcgatgccctcacggtcacccgccaggatggctcgaaactggttctcgaaacgcagcagcacctcggcgaagagcgcgttcgccgaatcgccatggagggaacagatggcctggtcaggggcatgagcgccaaaaacaccggcaaaccgatccaggtaccggtaggcgaagaggtgctcggcagaatgctgaacgttgtcggcgatcccattgatggcaaaggccctgtactttcaaagaaatcctactccatccatcgcaccgctcccaaatttgatgagctttcgaccaaggccgagatgttcgaaaccggcatcaaggttatcgaccttctcgaaccgtactcgcgcggcggcaaaaccggcttgttcggcggcgcaggcgtcggcaagaccgtgcttatcatggagcttatcaacaatatcgccaaagaacagtccggtttctcggtatttgccggcgtcggcgagcgcacccgcgaaggaaacgacctctggcacgagatgatggagtctggcgttatcgacaaaaccgcactcgtgttcggccagatgaacgagcctccgggagcacgtgcgcgcgtcgccctgaccggcctgagcatcgccgaatacttccgtgatgaagagggtcgtgacgtgcttctgttcatcgacaacatcttccgcttcacccaggcaggctccgaagtgtccgcgcttctcggacgtatgccgagcgccgtgggctaccagccgaccctcagcaccgagatgggtgagcttcaggacagaatcacctccaccaagaaaggttcggtcacctcggtgcaggccatctacgtccctgccgatgaccttaccgaccctgccccggccaccgcgttcacccacctcgacgccacgaccgtgctttcgcgtcagatcgccgagctgggcatctaccccgccgtggatccgctcgattcgacctcgcgaatcctcgatccaaacgtcatcggcgacgatcactacgacaccgcccaggccgtcaagcagattctccagcgctacaaggacttgcaggacatcatcgccattctcggtatggacgagctgagcgatgacgacaagctcgtggtcgcccgcgcccgcaaggtgcagcgcttcctgtcgcagcccttcttcgtggccgaggcgttcaccggtctggccggcaagtacgtcaagctcgaagacaccatcaagggcttcaaggagatcatcgcaggccgtcacgacaaccttccggaagcagctttctacctggtcggcactatcgaagaggcggtcgccaaagttaaaacgctctaa

SEQ ID NO: 7103 - protein, 462 aa, Chlorobium limicola
MQEGKISQIIGPVVDVDFAEGQLPSILDALTVTRQDGSKLVLETQQHLGEERVRRIAMEGTDGLVRGMSAKNTGKPIQVPVGEEVLGRMLNVVGDPIDGKGPVLSKKSYSIHRTAPKFDELSTKAEMFETGIKVIDLLEPYSRGGKTGLFGGAGVGKTVLIMELINNIAKEQSGFSVFAGVGERTREGNDLWHEMMESGVIDKTALVFGQMNEPPGARARVALTGLSIAEYFRDEEGRDVLLFIDNIFRFTQAGSEVSALLGRMPSAVGYQPTLSTEMGELQDRITSTKKGSVTSVQAIYVPADDLTDPAPATAFTHLDATTVLSRQIAELGIYPAVDPLDSTSRILDPNVIGDDHYDTAQAVKQILQRYKDLQDIIAILGMDELSDDDKLVVARARKVQRFLSQPFFVAEAFTGLAGKYVKLEDTIKGFKEIIAGRHDNLPEAAFYLVGTIEEAVAKVKTL

SEQ ID NO: 7104 - DNA, 1389 bp, Chlorobium tepidum
  CDS (1)..(1389): transl_table=11
atgcaagaaggtaagatttcccagatcatcggccctgtcgttgacgttgactttcctgaaggacagcttccgtctatcctcgatgccctcactgtcacccgtcaggacggctcgaaactggtactcgaaacccagcagcaccttggagaggagcgtgttcggacaatcgccatggaagggaccgacggtctggtcagaggcatgagcgctgtcaacaccggcaaaccgatccaggtcccggtaggcggagaggtgctcggcagaatgctgaacgttgtcggcgatcccatcgacggcaaaggccctgtcccggcaaagaaaacctactctatccatcgcgccgctccgaaattcgacgaactttcgaccaaaaccgagatgttcgaaaccggcatcaaggttatcgatctcctcgagccctactcccgcggtggtaaaaccggtctgttcggcggcgctggcgtcggcaagaccgtgctcatcatggagctgatcaacaatatcgccaagcagcagtcgggttactccgtgttcgctggcgtcggcgagcgcacccgtgaaggaaacgacctctggcacgagatgatggagtctggcgttatcgacaagaccgctctcgtgttcggccagatgaacgagcctccgggagcacgcgcacgcgtcgccctgaccggccttagcatcgccgagtacttccgtgaggaagagggccgtgacgtgcttctgttcatcgacaacatcttccgcttcacccaggcaggttccgaggtatccgcgcttcttggccgtatgccgagcgccgtaggctaccagccgactctcagcaccgagatgggtgagcttcaggacaggatcacctccaccaagaaaggttcggttacctccgtgcaagccatctacgtccctgccgatgaccttaccgatccagctccggctaccgcattcacccacctcgatgccacgaccgtgctttcacgtcagatcgccgagcttggtatctacccggctgtcgatccgcttgattcaacctcccgaatcctcgatccgaacatcgtcggtgacgatcactacaacaccgcgcaggctgtcaagcagattctccagcgctacaaagaccttcaggacatcatcgccattctcggtatggacgagctgagcgacgaggacaaactcgtggttgcccgcgcccgcaaagtgcagcgcttcctgtcgcagccctttttcgtggctgaagcgtttaccggtcttgcaggcaagtacgtcaagctcgaagacaccatcaagggcttcaaggagatcatcgatggccgtcacgacaacctgcccgaagctgccttctacctggtcggcaccatcgaagaggcggttgccaaagcaaaaacgctctaa

SEQ ID NO: 7105 - protein, 462 aa, Chlorobium tepidum
MQEGKISQIIGPVVDVDFPEGQLPSILDALTVTRQDGSKLVLETQQHLGEERVRTIAMEGTDGLVRGMSAVNTGKPIQVPVGGEVLGRMLNVVGDPIDGKGPVPAKKTYSIHRAAPKFDELSTKTEMFETGIKVIDLLEPYSRGGKTGLFGGAGVGKTVLIMELINNIAKQQSGYSVFAGVGERTREGNDLWHEMMESGVIDKTALVFGQMNEPPGARARVALTGLSIAEYFREEEGRDVLLFIDNIFRFTQAGSEVSALLGRMPSAVGYQPTLSTEMGELQDRITSTKKGSVTSVQAIYVPADDLTDPAPATAFTHLDATTVLSRQIAELGIYPAVDPLDSTSRILDPNIVGDDHYNTAQAVKQILQRYKDLQDIIAILGMDELSDEDKLVVARARKVQRFLSQPFFVAEAFTGLAGKYVKLEDTIKGFKEIIDGRHDNLPEAAFYLVGTIEEAVAKAKTL

SEQ ID NO: 7106 - DNA, 1389 bp, Chlorobium vibrioforme
  CDS (1)..(1389): transl_table=11
atgcaagaaggtaagatttctcagatcatcggccctgtcgttgacgttgattttcctgaagggcagctgccatctatcctcgatgcccttacagtcacccgccaggacggctcgaagctggttctcgaaacacaacagcaccttggcgaggagcgcgtcagaacgatctccatggaaggtacagatggtctcgtcagaggcatgagcgtggccaataccggtcggccgatccaggctccggtcggcgcagaagtgctcggcagaatgcttaacgttgtcggcgaaccgatcgacggcaaaggccccgtaccctcaaagaaatcgtacccgatccaccgttccgctccgaagttcgacgagctttcgaccaaagccgaaatgttcgaaaccggcatcaaggttatcgaccttctcgagccttactctcgcggtggtaaaaccggtttgttcggtggtgcaggcgttggcaagaccgtgctcatcatggagctgatcaacaatattgctaaagaacagtccggttactccgtgtttgccggtgtcggtgagcgtacccgtgaagggaacgacctctggcacgagatgatggagtccggcgttatcgacaagaccgctcttgtattcggccagatgaacgagcctccgggtgcccgtgcccgcgttgcgctgaccggcctcagcatcgcagagtacttccgtgatgaagagggccgtgacgtgctgctgttcattgacaacatcttccgcttcacccaggcgggtgctgaagtgtccgcacttctcggtcgtatgccgagcgctgtgggttaccagccgaccctcggtactgaaatgggtgagcttcaggacagaatcgtttcgaccaagaaaggttcggtcacctcggtacaggctatctatgtgcctgctgatgaccttaccgacccggctccggccaccgcatttacccacctcgatgcaacgaccgtgctttcgcgtcagattgctgagttgggcatctacccggctgttgacccgctcgactccacctcgcgtatcctcgacccgaacatcatcggtaacgaccactacgacaccgcgcaggccgtcaagcagatcctccagcgctacaaggatcttcaggacatcatcgccattctcggtatggacgaactgagcgacgaagacaagctcgtggttgcccgcgctcgtaaggtgcagcgcttcctgtcgcagccgttcttcgtggctgaagcatttaccggtcttgctggcaaatatgtcaagctcgaagacaccatcaaaggcttcaaggagatcatcgcaggtaaacatgacagcctgcctgaaaatgccttctacctggtcggcaccattgaagaggcagtcgaaaaagcaaaaaagctctaa

SEQ ID NO: 7107 - protein, 462 aa, Chlorobium vibrioforme
MQEGKISQIIGPVVDVDFPEGQLPSILDALTVTRQDGSKLVLETQQHLGEERVRTISMEGTDGLVRGMSVANTGRPIQAPVGAEVLGRMLNVVGEPIDGKGPVPSKKSYPIHRSAPKFDELSTKAEMFETGIKVIDLLEPYSRGGKTGLFGGAGVGKTVLIMELINNIAKEQSGYSVFAGVGERTREGNDLWHEMMESGVIDKTALVFGQMNEPPGARARVALTGLSIAEYFRDEEGRDVLLFIDNIFRFTQAGAEVSALLGRMPSAVGYQPTLGTEMGELQDRIVSTKKGSVTSVQAIYVPADDLTDPAPATAFTHLDATTVLSRQIAELGIYPAVDPLDSTSRILDPNIIGNDHYDTAQAVKQILQRYKDLQDIIAILGMDELSDEDKLVVARARKVQRFLSQPFFVAEAFTGLAGKYVKLEDTIKGFKEIIAGKHDSLPENAFYLVGTIEEAVEKAKKL

SEQ ID NO: 7108 - DNA, 1398 bp, Chromobacterium violaceum
  CDS (1)..(1398): transl_table=11
atgagccaaggcaaaatcgtacaaatcattggcgcggtgatcgacgtggaatttccgcgcgacgccatgccgaaggtttatgatgccctgaagctggtagacgccgacctgacgctcgaagttcagcaacagctgggcgacggcgtggtccgtaccattgcgatgggcagctccgacggtctgaagcgtggcatggctgtagccaacaccggcgcaccgatttcggtgccggttggcgccgccaccctcggccgcatcatggacgtactgggcaacccggtggacgaagcgggtccggtcgcgaccgacgcgcgtcgcgccatccaccaagctgcgccgaagttcgacgaactgtcggccgcagccgacatcctggaaaccggcatcaaggtgatcgacctgctgtgcccgttcgccaagggcggcaaggtgggtctgttcggcggcgccggtgtgggcaagaccgtgaacatgatggagttgatcaacaacatcgccaaggcccactcgggtctgtccgtgttcgccggcgtgggtgagcgtacccgtgaaggtaacgacttctaccacgaaatgaaggactccaacgtcctggacaaggtggcgatggtgtacggtcagatgaacgagccgccgggcaaccgtctgcgcgtggccctgaccggcctgaccatggccgagcacttccgcgacgagaaggacgaaaacggcaagggccgcgacgtgctgctgttcgtggacaacatctaccgctacaccctggccggtaccgaagtgtccgctctgctgggccgcatgccgtccgcggtgggctaccagccgacgctggccgaggaaatgggccgtctgcaagaacgtattacctcgaccaaggatggttccattacctccatccaggccgtgtacgtccctgcggatgacttgaccgacccgtccccggcgaccaccttcgcccacttggacgctaccgtggtactgtcgcgcgacatcgcctcgctgggtatctacccggccgtggacccgctcgactccacctcgcgccagctggatccgctggtggtgggcgacgagcattacaccgtcgcccgcggcgtgcagtccactctgcagcgctacaaggaactgcgcgacatcatcgcgattctgggtatggacgagctgtccgaggaagacaaactggtcgtggctcgcgcccgtaagatccagcgcttcctgtcccagccgttccacgtggccgaagtgtttaccggttccccgggcaaatacgtgccgctgcgcgaaaccatcaagggcttcaaggccattctcgctggcgaatacgaccacctgccggaacaagcgttctacatggttggcgcgatcgaagaagctgccgagaaagccaagacccttaactaa

SEQ ID NO: 7109 - protein, 465 aa, Chromobacterium violaceum
MSQGKIVQIIGAVIDVEFPRDAMPKVYDALKLVDADLTLEVQQQLGDGVVRTIAMGSSDGLKRGMAVANTGAPISVPVGAATLGRIMDVLGNPVDEAGPVATDARRAIHQAAPKFDELSAAADILETGIKVIDLLCPFAKGGKVGLFGGAGVGKTVNMMELINNIAKAHSGLSVFAGVGERTREGNDFYHEMKDSNVLDKVAMVYGQMNEPPGNRLRVALTGLTMAEHFRDEKDENGKGRDVLLFVDNIYRYTLAGTEVSALLGRMPSAVGYQPTLAEEMGRLQERITSTKDGSITSIQAVYVPADDLTDPSPATTFAHLDATVVLSRDIASLGIYPAVDPLDSTSRQLDPLVVGDEHYTVARGVQSTLQRYKELRDIIAILGMDELSEEDKLVVARARKIQRFLSQPFHVAEVFTGSPGKYVPLRETIKGFKAILAGEYDHLPEQAFYMVGAIEEAAEKAKTLN

SEQ ID NO: 7110 - DNA, 1497 bp, Citrus sinensis
  CDS (1)..(1497)
atgagaataaatcctactacttccggtcctggggtttccgcgtttgcaaacaaaaacctaggacatatcgctcaaatcattggtccggtactggatgtagcctttccccccggcaagatgcctaatatttacaatgctctggtagttaagggtcgagatactgtcgatcaaccaattaatgtgacttgcgaggtacagcaattattagggaataatcgagttagagctgtagccatgagtgctacagatggtctaacgaggggtatggaagtaattgacacgggagctcctctaagtgttccagtcggcggagtgactctaggacgaattttcaacgtgcttggagagcccgttgataatttaggtcctgtagatactcgcacaacatcccctattcataaatccgcgcctgcttttatacagttagatacaagattatctatttttgaaacaggaattaaagtagtagatcttttagctccttatcgtcggggaggaaaaatcggactatttgggggagctggggtgggtaaaacagtactcattatggaattgatcaacaacattgccaaagcccatgggggtgtatccgtatttggcggagtcggtgaacgtactcgtgaaggaaatgatctttacatggaaatgaaagagtctggagtaattaatgaccaaaatctttcggaatcaaaagtggctctagtctacggtcagatgaatgaaccaccaggagctcgtatgagagttggtttgacggccctaactatggcggaatatttccgagatgttaatgaacaagacgtacttctatttatcgacaatatcttccgtttcgtccaagcgggatccgaggtatccgccttattgggtagaatgccttccgctgtgggttatcaacctacccttagtaccgaaatgggttctttacaagaaagaattacttctaccaaagaggggtccataacttctattcaagcagtttatgtacccgcggatgatttgactgatcccgctcctgccacgacatttgcccatttagatgctactaccgtactatcaagaggattagctgctaaaggtatctatccagcagttgatcctttagactcaacgtcaactatgctgcaacctcggatcgttggcgaggaacattatgaaacggcgcaaagagttaagcaaactttacaacgttacaaagaacttcaggacattatagctatccttgggttggacgaactgtccgaagaggatcgtttaactgtagcaagggcgcgaaaaattgagcgtttcttatcacaaccctttttcgtagccgaagtatttaccggttccccggggaaatatgttggtctagccgaaactattagagggtttaaattgatcctgtccggagaattagatggtcttcctgagcaggccttttatttggtaggtaacatagatgaagttactgcgaaggctacaaacttagaaatggagagtaatttgaagaaatga

SEQ ID NO: 7111 - protein, 498 aa, Citrus sinensis
MRINPTTSGPGVSAFANKNLGHIAQIIGPVLDVAFPPGKMPNIYNALVVKGRDTVDQPINVTCEVQQLLGNNRVRAVAMSATDGLTRGMEVIDTGAPLSVPVGGVTLGRIFNVLGEPVDNLGPVDTRTTSPIHKSAPAFIQLDTRLSIFETGIKVVDLLAPYRRGGKIGLFGGAGVGKTVLIMELINNIAKAHGGVSVFGGVGERTREGNDLYMEMKESGVINDQNLSESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEVTAKATNLEMESNLKK

SEQ ID NO: 7112 - DNA, 1398 bp, Clostridium perfringens
  CDS (1)..(1398): transl_table=11
atgtctaataatataggtaaagtagttcaggttattggaccagttgtagatataaaatttgcaaatgatgaacttcctaatatatttaatgcaatacacataaaaatggacgatggaaaaatcttagtttgtgaggtagagcaacacgtaggagacgatatagttagaactatagctatggaagctactgaaggactaagaagaggtgtagaagctgttgatacaggagcacctatatcagtaccagttggtgaatgcgtattaggaagaatatttaacgtattaggtaaaccactagatagtggagctgaagttaataacgaagaaaaatatccaattcatagaccagctccatcatttgaagaacaatcagttgttcctcaaatgtttgagacaggaataaaggttatcgaccttttagcaccttaccaaagagggggaaaaatcggtctatttggaggtgcaggtgttggtaaaacagttcttatccaagagcttataaacaacatagctaaagagcacggtggactttctgtattcacaggagttggagaaagatcaagagaaggtaatgacctttactatgaaatgatggaatcaggagttataaaaaatacagcattagtatttggacaaatgaacgaaccacctggagcaagaatgagagttgctttaacaggacttactatggctgagtacttcagagaccaaggtcaagacgtgttattattcatagataacatattcagattctcacaagctggatcagaggtttcagctttattaggaagaataccatcagctgttggttaccaaccaactcttgctacagagatgggagctcttcaagagagaatcacatcaactacccatggatcaattacatcagttcaagcggtatacgtaccagccgatgacttaactgacccagctccagctacaacattcaaccaccttgatgctaaaacagttttatcaagaagtatagctgaaataggtatttacccagctgttgatcctctagattcttcatcaagaatattagacccaagagttgttggagaagaacactatgaagttgcttcaaaagttaagcatatattagaaagatataaagaacttcaagatatcatagctatccttggtgttgatgagcttgcagatgaagataaattaatagttgctagagcaagaagaatacaaaaattcttatcacaaccattcacagtagcagagcaatttactggaatgcaaggtagatatgttccaataaaagaaactataagaggtttcaaagaaatattagaaggtaaacatgacaatgttcctgaatcagctttcttatttgctggaacaatagaagaagtactagaaaaagctagagcaatggcccaataa

SEQ ID NO: 7113 - protein, 465 aa, Clostridium perfringens
MSNNIGKVVQVIGPVVDIKFANDELPNIFNAIHIKMDDGKILVCEVEQHVGDDIVRTIAMEATEGLRRGVEAVDTGAPISVPVGECVLGRIFNVLGKPLDSGAEVNNEEKYPIHRPAPSFEEQSVVPQMFETGIKVIDLLAPYQRGGKIGLFGGAGVGKTVLIQELINNIAKEHGGLSVFTGVGERSREGNDLYYEMMESGVIKNTALVFGQMNEPPGARMRVALTGLTMAEYFRDQGQDVLLFIDNIFRFSQAGSEVSALLGRIPSAVGYQPTLATEMGALQERITSTTHGSITSVQAVYVPADDLTDPAPATTFNHLDAKTVLSRSIAEIGIYPAVDPLDSSSRILDPRVVGEEHYEVASKVKHILERYKELQDIIAILGVDELADEDKLIVARARRIQKFLSQPFTVAEQFTGMQGRYVPIKETIRGFKEILEGKHDNVPESAFLFAGTIEEVLEKARAMAQ

SEQ ID NO: 7114 - DNA, 1497 bp, Coffea arabica
  CDS (1)..(1497)
atgaaaataaatcctactacttctggttctggggtttccacgcttgaaaaaaaaaacatggggcgtattgtccaaatcatcggcccggtactagatgtagcctttccggcgggcaagatgccgaatatttataacgccctagtagttaaaggtcgagatactgttggtcaaccaattaatgtaacttgtgaggtacagcaattattaggaaataatcgcgttagagctgtagctatgagttctacagatggtctaacgagaggaatggaagtgattgacacgggagctcctctaagtgttccggtaggaggagcaactctgggacgaattttcaacgtgcttggagaacccgttgataatttaggtgctgtagatactcgtacaacatctcctattcatagatctgcgcccgcctttatacagttagatacaaaattatctatttttgaaacgggaattaaagtagtagatcttttagccccttatcgccgtggaggaaaaataggactcttcgggggagctggagtaggtaaaacagtactcattatggaattgattaacaatattgccaaagcccatggaggcgtatccgtatttggcggagtgggtgaacgtactcgtgaaggaaatgatctttacatggaaatgaaagaatctggagtgattaataaagaaaatattgcagaatcaaaagtggctctagtttacggtcagatgaatgaaccgccgggagctcgtatgagagttggtttgactgccctaactatggcggaatatttccgagatgttaatgaacaagacgtacttctatttatcgacaatattttccgtttcgtccaagcaggatccgaagtctcggccttattgggtagaatgccttccgctgtgggctaccaacccaccctgagtaccgaaatgggttctttacaagaaagaattacgtctaccaaagagggatctataacttctattcaagcagtttatgtacctgcagacgatttaaccgaccccgcccctgctacgacatttgcacatttagatgccactaccgtactatcaagaggattagctgccaaaggtatctatcccgcagtagatcctttagattcaacatcaaccatgcttcaacctcggattgttggtgaggaacattatgaaactgcgcaaagggttaagcaaactttacaacgttataaagaactccaggatattatagctatcctcgggttagatgaattatccgaagaggatcgtttaaccgtagcacgagcacgaaaaattgagcgtttcttatcacaaccctttttcgtagcagaagtatttaccggttctccaggaaaatatgttggtctagcagaaacaattagaggatttcaattgatcctttccggagaattagatagtcttcctgaacaggctttttatttggtaggtaatatcgatgaagctaccgcgaaggctatgaacttagaaatggagaacaatttgaagaaatga

SEQ ID NO: 7115 - protein, 498 aa, Coffea arabica
MKINPTTSGSGVSTLEKKNMGRIVQIIGPVLDVAFPAGKMPNIYNALVVKGRDTVGQPINVTCEVQQLLGNNRVRAVAMSSTDGLTRGMEVIDTGAPLSVPVGGATLGRIFNVLGEPVDNLGAVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINKENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEMENNLKK

SEQ ID NO: 7116 - DNA, 1386 bp, Colwellia psychrerythraea
  CDS (1)..(1386): transl_table=11
atgagtacaggtaaagtcgtccaaataattggcgcagttgtggatgtagaatttccacaagatgccgtacctcaggtatatgacgcattaaagataactgaaggtgaccttgaaggtttagtacttgaagtgcaacagcagcttggtggcggcgttgtgcgtactatcgcaatgggtacatctgacggtttgcgtcgtggtctgaatgtagtaaatacaggtcaaggaatccaagtaccagttggtgttgagactttaggtcgcatcatgaacgtactgggtgagccaattgatgaagctggccctatcggcgaaaaagaccgttggtctattcaccgtgaagcacctgcttatgctgaacaatcaatgtctaacgaattgttagaaactggtatcaaagtaatcgatttagtttgtccattcgctaagggtggtaaagttggtcttttcggtggtgctggtgttggtaaaacagtaaacatgatggaacttatccgtaacatcgcaatcgagcacagtggttactcagtatttgctggtgttggtgagcgtacacgtgaaggtaacgatttctatcacgaaatgaatgattctaatgtacttgataaagtatcattagtttacggccaaatgaacgagcctccaggaaaccgtttacgtgttgcctttactggtttaactatggctgagaaattccgtgacgaaggtcgtgacgtattattctttgttgataatatctatcgttatactcttgcgggtactgaagtttctgcacttcttggacgtatgccatcagcggttggttatcaaccaacacttgctgaagaaatgggtgtattacaagaacgtattacttcaactaacaaaggttcaatcacttcaatccaagcggtatacgtaccagcagatgatttaactgaccctagccctgcaactacttttgctcacttagatgcaactgttgtattaagtcgtgatattgcttcgcaaggtatttatcctgcgattgacccactagattcatcttcacgtcaactagatccattagtagttggtactgaacattatgaaactgctcgtggcgttcaaacagtattacaacgttacaaagaacttaaagatatcatcgccatcttaggtatggatgagttatctgaagaagataagcaaactgtatctcgtgcacgtaagattcagcgttacttatctcagccgttcttcgttgctgaagtatttactggttctcctggtaaatatgtatcattaaaagacaccattgctggctttaaaggcattttagctggtgaatacgatgatatgcctgagcaagcgttctacatggttggtggtattgaagaagccatcgagaaagcgaacaagatgtaa

SEQ ID NO: 7117 - protein, 461 aa, Colwellia psychrerythraea
MSTGKVVQIIGAVVDVEFPQDAVPQVYDALKITEGDLEGLVLEVQQQLGGGVVRTIAMGTSDGLRRGLNVVNTGQGIQVPVGVETLGRIMNVLGEPIDEAGPIGEKDRWSIHREAPAYAEQSMSNELLETGIKVIDLVCPFAKGGKVGLFGGAGVGKTVNMMELIRNIAIEHSGYSVFAGVGERTREGNDFYHEMNDSNVLDKVSLVYGQMNEPPGNRLRVAFTGLTMAEKFRDEGRDVLFFVDNIYRYTLAGTEVSALLGRMPSAVGYQPTLAEEMGVLQERITSTNKGSITSIQAVYVPADDLTDPSPATTFAHLDATVVLSRDIASQGIYPAIDPLDSSSRQLDPLVVGTEHYETARGVQTVLQRYKELKDIIAILGMDELSEEDKQTVSRARKIQRYLSQPFFVAEVFTGSPGKYVSLKDTIAGFKGILAGEYDDMPEQAFYMVGGIEEAIEKANKM

SEQ ID NO: 7118 - DNA, 1446 bp, Corynebacterium diphtheriae
  CDS (1)..(1446): transl_table=11
atgaccacagctcttgaagagcagaacacgcagcaggcgtccgtcgccggccgcgtcgtgcgcgtcatcggtccggtcgtcgacgtggagttcccgcgtggcgagctgccggcactgtacaacgcgctgactgtcgaggtcaccctcgaggcagtcgctaagaccattacccttgaggttgcccagcacttgggcgacaacctcgttcgcgccgtgtccatggctcctaccgacggccttgtccgtggtgctgttgtgaccgactcgggcaagccaatctccgtgccagttggcgacgttgttaaaggccacgttttcaacgcactgggcgattgcttggatgagccaggtctcggccgcgatggcgagcagtggggaattcaccgcgatccaccaccattcgatcagctcgaaggtaagaccgaaatcctcgagaccggtattaaggtcatcgacttgctcaccccttacgttaagggcggcaagattggtctgttcggtggtgcaggtgtgggtaagaccgtgctcatccaggagatgatcactcgtattgctcgcgagttctccggtacctccgtattcgctggcgttggtgagcgtacccgtgagggcaccgacctcttcctcgaaatggaagaaatgggtgttcttcaggacaccgctctcgtgttcggccagatggacgagccaccaggagtccgtatgcgcgttgctctgtccggtctgaccatggcggagtacttccgcgatgttcagcaccaggacgtgcttctgttcatcgataacattttccgtttcacccaggccggttccgaggtttcgacccttcttggtcgtatgccttccgccgtgggttaccagccaaccttggctgacgagatgggtgttctccaggagcgtattacctctattaagggtaagtcgattacgtctctgcaggccgtttacgttcctgccgacgactacaccgacccagctcctgcgactacgttcgctcacttagatgcaaccaccgagctcgaccgtgcaatcgcctccaagggtatttacccagcagtgaacccgctgacctctacctctcgtatcctcgagccaggtatcgtaggcgagcgtcactacgcagttgcacagcgcgtgatcaacattctgcagaagaacaaggaactccaggacatcatcgccatcctcggtatggacgagctgtctgaagaggataagatcaccgttcagcgcgcacgtcgccttgagcgcttcttgggccagaacttcttcgttgctgaaaagttcaccggcatcccaggctcctacgtgccgctggctcacaccatcgacgcattcgagcgcatctgcaacggcgacttcgaccactacccagagcaggccttcaacggcttgggtggcttggacgacgtcgaggctgcatacaagaagatgaccgagaagtag

SEQ ID NO: 7119 - protein, 481 aa, Corynebacterium diphtheriae
MTTALEEQNTQQASVAGRVVRVIGPVVDVEFPRGELPALYNALTVEVTLEAVAKTITLEVAQHLGDNLVRAVSMAPTDGLVRGAVVTDSGKPISVPVGDVVKGHVFNALGDCLDEPGLGRDGEQWGIHRDPPPFDQLEGKTEILETGIKVIDLLTPYVKGGKIGLFGGAGVGKTVLIQEMITRIAREFSGTSVFAGVGERTREGTDLFLEMEEMGVLQDTALVFGQMDEPPGVRMRVALSGLTMAEYFRDVQHQDVLLFIDNIFRFTQAGSEVSTLLGRMPSAVGYQPTLADEMGVLQERITSIKGKSITSLQAVYVPADDYTDPAPATTFAHLDATTELDRAIASKGIYPAVNPLTSTSRILEPGIVGERHYAVAQRVINILQKNKELQDIIAILGMDELSEEDKITVQRARRLERFLGQNFFVAEKFTGIPGSYVPLAHTIDAFERICNGDFDHYPEQAFNGLGGLDDVEAAYKKMTEK

SEQ ID NO: 7120 - DNA, 1446 bp, Corynebacterium efficiens
  CDS (1)..(1446): transl_table=11
atgactacagctcttacagagcagaacgcacagcaggcagctactgccggccgtgtcgtgcgtgtcattggcgcggtcgtcgacgtggagttcccccgcggcgagctgccggcactgtacaacgcactgactgccgaggttaccctcgaatcagtcgccaagaccgttgtcctcgaggttgctcagcacctcggcgacaacctcatccgtaccatcgccatggcacccaccgacggcatggtccgtggtgcaaccgtgaccgataccggtaagccgatttccgtgcctgtcggtgacgtcgtcaagggccacgtcttcaacgccctcggtgactgcttggacgttcccggcctcggccgtgacggcgagcagtggggcatccaccgcgagccgccgtcattcgaccagctcgagggtaagaccgagatcctggagaccggcatcaaggtcatcgacctgctgaccccgtacgtcaagggcggcaagatcggtctgttcggtggtgccggtgtcggcaagaccgttctgatccaggagatgatcacccgtatcgcccgcgagttctccggtacctcggtgttcgctggtgtgggtgagcgtacccgtgagggtaccgacctcttcctcgagatggaggagatgggcgtgctccaggacaccgctctggtgttcggtcagatggatgagccgccgggagtccgtatgcgcgtggctctgtccggtctgaccatggcggagtacttccgcgatgtccagaaccaggacgttctgctgttcatcgacaacatcttccgtttcacccaggcaggttccgaggtgtccacccttctgggtcgtatgccttccgccgtgggttaccagccgaccctggctgacgagatgggtgttctccaggagcgcatcacctccaccaagggccgttcgatcacctctctgcaggccgtttacgtccctgccgatgactacaccgacccggctccggcgaccaccttcgcccacctggatgccaccaccgagcttgaccgctcgatcgcatcgaagggtatctaccccgcggtgaacccgctgacctcgacttctcgtatcctcgagccgtcgatcgtcggtgagcgtcactacgaggtgtcccagcgcgtgatcggtatcctgcagaagaacaaggaactccaggacatcatcgccatcctcggtatggacgagctgtctgaagaggacaagatcaccgtggcccgcgcccgtcgtctcgagcgcttcctcggccagaacttcttcgttgcggagaagttcaccggtctgcctggttcctacgtgccgctggctgacaccatcgatgccttcgagcgcatctgcaacggcgacttcgaccactacccggagcaggcattcaacggtctgggtggcctggacgacgtcgaggctgcgtacaagaagctgaccggaaagtag

SEQ ID NO: 7121 - protein, 481 aa, Corynebacterium efficiens
MTTALTEQNAQQAATAGRVVRVIGAVVDVEFPRGELPALYNALTAEVTLESVAKTVVLEVAQHLGDNLIRTIAMAPTDGMVRGATVTDTGKPISVPVGDVVKGHVFNALGDCLDVPGLGRDGEQWGIHREPPSFDQLEGKTEILETGIKVIDLLTPYVKGGKIGLFGGAGVGKTVLIQEMITRIAREFSGTSVFAGVGERTREGTDLFLEMEEMGVLQDTALVFGQMDEPPGVRMRVALSGLTMAEYFRDVQNQDVLLFIDNIFRFTQAGSEVSTLLGRMPSAVGYQPTLADEMGVLQERITSTKGRSITSLQAVYVPADDYTDPAPATTFAHLDATTELDRSIASKGIYPAVNPLTSTSRILEPSIVGERHYEVSQRVIGILQKNKELQDIIAILGMDELSEEDKITVARARRLERFLGQNFFVAEKFTGLPGSYVPLADTIDAFERICNGDFDHYPEQAFNGLGGLDDVEAAYKKLTGK

SEQ ID NO: 7122 - DNA, 1386 bp, Coxiella burnetii
  CDS (1)..(1386): transl_table=11
atgacaacagcaaaatcaggcacaaccattgaaattatcggcgctgtcgttgacgttgagtttccccgtcacgctgtcccgaaagtgtacgatgctttgcaggtggatgaaaataatttaacgctcgaagtccaacagcaactcggggacggtgtcgtgcgcacaattgccatgggcagcactgagggcttaaaacgcgatatcgccgtaaaaaatacggaaaaaccgattgaagttcccgtaggaaaagaaactttaggtcgtatcatgaacgtgctgggtgagccgatcgatgagttaggtcccattaattcaaaagaaaaactccctattcatcgtcctgcgccgagctttattgagcaatctggcgctaccgaattattagaaaccggtattaaagtggtcgatttgctttgcccctttgctaagggaggcaaagtgggtctttttggaggcgcgggcgttggaaaaacggttaatatgatggaattaatccgtaatatcgccattgaacacagcggttattctgtttttgcgggtgtgggagaaagaacgcgagaaggcaatgatttttatcatgaaatgaaagaatccaatgtcttggataaagtggcgttggtgtacggacaaatgaacgagccgccagggaaccgcttgcgggtgggtttgacggggcttacgctggcggaagccttccgtgacgaaggacgcgacgttctgttatttatcgataatatctttcgttacactttggcaggggttgaagtctctgccctcctcggtcggatgccatcggctgtgggttatcagccgacgttggccgaagagatgggggccctgcaagaacgcattacttccactaaaaaagggtccattacgtcgatccaagctgtttatgttcccgctgacgatttaaccgatccatcgccagcaaccactttcgcgcatttggatgcgacagttgtgctctcgcggcaaattgccgaacggggaatttatccagccattgatccgttggattccaccagccgccagcttgaccccttaatcattggcgaagaacattatcgagtggctcgaggcgttcaagaaaccttgcagcgatacgaagaattaaaagatatcattgccattcttggcatggatgaattgtccgaagacgacaaacgagccgtccgacgcgcgcgcaagatccaacgctttttatcgcaacctttctttgtggctgaagtatttaccggcgcgccgggcaaatatgtttcgctacaagatacgattcgcggatttaaagggatcatcaatggcgaatacgatgagctgcccgagcaagctttttacatggtaggctcaatcgaagaagccgttgagaaagcgaaatcactatga

SEQ ID NO: 7123 - protein, 461 aa, Coxiella burnetii
MTTAKSGTTIEIIGAVVDVEFPRHAVPKVYDALQVDENNLTLEVQQQLGDGVVRTIAMGSTEGLKRDIAVKNTEKPIEVPVGKETLGRIMNVLGEPIDELGPINSKEKLPIHRPAPSFIEQSGATELLETGIKVVDLLCPFAKGGKVGLFGGAGVGKTVNMMELIRNIAIEHSGYSVFAGVGERTREGNDFYHEMKESNVLDKVALVYGQMNEPPGNRLRVGLTGLTLAEAFRDEGRDVLLFIDNIFRYTLAGVEVSALLGRMPSAVGYQPTLAEEMGALQERITSTKKGSITSIQAVYVPADDLTDPSPATTFAHLDATVVLSRQIAERGIYPAIDPLDSTSRQLDPLIIGEEHYRVARGVQETLQRYEELKDIIAILGMDELSEDDKRAVRRARKIQRFLSQPFFVAEVFTGAPGKYVSLQDTIRGFKGIINGEYDELPEQAFYMVGSIEEAVEKAKSL

SEQ ID NO: 7124 - DNA, 1509 bp, Cytophaga lytica
  CDS (1)..(1509): transl_table=11
atgtctaaagttacaggtaaagtttcccaaattattggcccagttatagatgtggagttccaagcaggggtagatcttccaaaaatttatgattcattagaaattaaaaaagcagatggatcaattttggttttggaagtacaatcacacattggtgagaacacagtaagaactatatctatggattcttctgatggtttaagtcgtggagcagaggttaatgcaacaggaagcgctatacaaatgccagttggagatgacgtttacggacgtttatttaacgtaattggagacgctattgatggtcttgggaatttaccaaaatctggtaaagatggtttgccaatacacagagaggcaccaaaatttgaagacttatctacttctacagaagtattatttacaggtattaaagtaattgaccttattgagccttatgcaaaaggtggtaagattggtttatttggaggtgccggagtaggtaaaacagtattaattcaggaattaattaacaacattgcaaaaggtcacggtggactttctgtatttgctggtgtaggtgagcgtactcgtgagggtaacgatttactacgtgagatgttagagtctggtattattaaatacggagatgactttatgcactctatggaagaaggtggttgggatttatctaaagttgataaatctgtaatgaaagattctaaagcaacctttgtatttggacaaatgaatgagccaccaggagcacgtgcacgtgttgcattatctggtttaactattgcagaatatttccgtgatggagcaggtgaaggtcaaggtaaagatgtacttttctttgtggataacattttccgttttacacaagctggttctgaggtatctgcattacttggtcgtatgccatctgcggtaggttaccaaccaacattagcaacagaaatgggtgctatgcaagagcgtattacatcaacaaaaagaggttctattacatctgtacaggcggtttacgtacctgcggatgatttaacggatccagcaccggcaactacctttgctcacttagatgcaacaacggtattgtctcgtaaaattgcagagttaggtatttacccagcggtagatccattagattctacttctagaatcttagctccagaaattttaggaaaagatcactactcttgtgcacaacgtgtaaaagagttgttacaacgttataaagaattacaagatattattgctatccttggtatggaagaattatctgaggaagataaaatggcagttggtagagcaagacgtgtacaacgtttcttatctcagcctttccacgtagcagagcaatttacaggtcttaaaggtgttttagtagatatcaaggatactattaaaggatttaatatgattatggatggtgaattagatcacttaccagaatctgcatttaaccttaaaggtactattgaagaagctatagaagcaggagaaaaaatgcttgctgaagcataa

SEQ ID NO: 7125 - protein, 502 aa, Cytophaga lytica
MSKVTGKVSQIIGPVIDVEFQAGVDLPKIYDSLEIKKADGSILVLEVQSHIGENTVRTISMDSSDGLSRGAEVNATGSAIQMPVGDDVYGRLFNVIGDAIDGLGNLPKSGKDGLPIHREAPKFEDLSTSTEVLFTGIKVIDLIEPYAKGGKIGLFGGAGVGKTVLIQELINNIAKGHGGLSVFAGVGERTREGNDLLREMLESGIIKYGDDFMHSMEEGGWDLSKVDKSVMKDSKATFVFGQMNEPPGARARVALSGLTIAEYFRDGAGEGQGKDVLFFVDNIFRFTQAGSEVSALLGRMPSAVGYQPTLATEMGAMQERITSTKRGSITSVQAVYVPADDLTDPAPATTFAHLDATTVLSRKIAELGIYPAVDPLDSTSRILAPEILGKDHYSCAQRVKELLQRYKELQDIIAILGMEELSEEDKMAVGRARRVQRFLSQPFHVAEQFTGLKGVLVDIKDTIKGFNMIMDGELDHLPESAFNLKGTIEEAIEAGEKMLAEA

SEQ ID NO: 7126 - DNA, 1497 bp, Daucus carota
  CDS (1)..(1497)
atgaaaataaatcctactaattctagttcgttgacttccacgcttgaaaaaaaaaacctcgggaatatcacccaaatcattggtccggtactagatgtagcttttccaccgggcaagatgcctaatatttataacgctctggtagttaagggtcgagatactgctggtcaacaaattaatgtgacttgtgaggtacagcaattactaggaaacaatcgagttagggctgtggctatgagtgctacagatggtctaacgagaggaatggaagtaatggatacgggagctcctctaagtgttccggtcggtggaacgactcttggacgaattttcaacgtacttggagagcccgttgataatttagggcctgtagatactcgcacaacatctcctattcatagatctgcgcccgcctttatacagttagataccaaattatctatttttgaaaccggaattaaagtagtagatcttttagccccttatcgtcgtggaggaaaaattggactattcgggggggctggagtgggtaaaacagtcctcattatggaattgattaacaatattgccaaagctcatgggggtgtatctgtatttggcggagtaggtgaacgtactcgtgaaggaaatgatctttacatggaaatgaaagaatccggggtgattaatgaagaaaatattgcagaatcaaaagtggctctagtttacggtcagatgaatgaaccgccgggagctcgtatgagagttggtttgactgccctcactatggctgaatattttcgagatgttaatgaacaagatgtacttctatttatcgacaatatcttccgtttcgtccaagcaggatcggaagtatccgccttattgggtagaatgccttccgctgtgggttatcaacccacccttagtaccgaaatgggtacgttacaagaaagaattacttcgacgaaagaggggtccataacctctattcaagcagtttatgtacctgcagacgatttgaccgaccctgcgcccgctacgacatttgcacatttggatgctactactgtactatcaagaggattagccgccaaaggtatctatccagcagtagatcctttagattcaacgtcaactatgctccaaccccggattgttggtgaggaccattatgaaactgcccaaaaagttaagcaaactttacaacgttacaaagaacttcaggacattatagctatccttggattggacgaattatccgaagaggatcgcttaaccgtagcaagagcgcgaaaaattgagcgtttcttatcacaaccctttttcgtagcagaagtttttaccggttctccaggaaaatatgttggtttatcagaaacaattagagggtttcggttgatcctttccggagaattagacagtcttcctgaacaggccttttatttggtaggtaacatcgatgaagctaccgcgaaggctatgaacttagaaatggagagcaattcgaataaatga

SEQ ID NO: 7127 - protein, 498 aa, Daucus carota
MKINPTNSSSLTSTLEKKNLGNITQIIGPVLDVAFPPGKMPNIYNALVVKGRDTAGQQINVTCEVQQLLGNNRVRAVAMSATDGLTRGMEVMDTGAPLSVPVGGTTLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEDHYETAQKVKQTLQRYKELQDIIAILGLDELSEEDRLTVARARKIERFLSQPFFVAEVFTGSPGKYVGLSETIRGFRLILSGELDSLPEQAFYLVGNIDEATAKAMNLEMESNSNK

SEQ ID NO: 7128 - DNA, 1401 bp, Dechloromonas aromatica
  CDS (1)..(1401): transl_table=11
atgagtcaaggttcaatcgttcagtgcatcggcgccgttgtggacatccacttcccgcgcgacgcgatgccgaaggtctacgacgctctcaagctggatgcttccgaagcaaacggcatggcagaagatggcctgaccttcgaagtgcaacaacaactgggtgacggcgtcgtccgcaccatcgccatgggttcgtccgacggtctgcgtcgtggcatgaaggtgaacaacaccggcgccggcatttccgtgcctgtcggtatgggcaccctgggccgcatcatggatgtgctgggtcgcccgatcgacgaagccggtccgatcgattccaccgagctgcgcgttattcaccagccggctccgaagtttgacgaactgtcgtcttccgtcgatctgctggaaaccggcatcaaggttatcgatctgatctgcccgttcgccaagggcggcaaggttggcctgttcggtggcgccggcgtcggcaagaccgttaacatgatggaactgatcaacaacatcgcgaagcagcacgccggcttgtccgtgtttgctggcgtgggcgagcgtacccgtgaaggtaacgacttctaccacgaaatgaaggactccaacgttctcgacaaggtcgcgatggtgttcggtcagatgaacgagccgccgggcaaccgtctgcgcgtcgcgctgaccggcctgaccatggctgagcgtttccgtgacgacggtcgtgacattctgttcttcgtcgacaacatttaccgctacacgctggctggtacggaagtttccgcactgcttggccgtatgccttccgccgtgggctatcagccgacgctggctgaagaaatgggtcgtctgcaagagcgtatcacctcgaccaaggttggttcgatcacctccatccaggccgtttacgtgcctgccgatgacttgaccgacccgtccccggctaccaccttcctgcacttggactccacggttgtgttgtcgcgtgacatcgcctcgctgggtatctacccggctgtcgatccgcttgactccacttcccgccagctcgacccgcaggtcgttggtgaagagcattactccgttgcccgtgccgtgcagatgaatctgcagcgctacaaggaactgcgtgacatcatcgcgattctgggtatggacgaactgtctccggaagacaagctggccgtgtcccgcgcccgcaagattcagcgcttcctgtcgcagccgttccacgtggctgaagtcttcaccggctcgccgggcaagttcgtttccctgaaagaaacgatcaagggcttcaagggcatttgtgccggcgaatacgatcacctgccggaacaagcgttctacatggtgggcggtatcgaggaagtcatcgagaaggccaagacgctgtaa

SEQ ID NO: 7129 - protein, 466 aa, Dechloromonas aromatica
MSQGSIVQCIGAVVDIHFPRDAMPKVYDALKLDASEANGMAEDGLTFEVQQQLGDGVVRTIAMGSSDGLRRGMKVNNTGAGISVPVGMGTLGRIMDVLGRPIDEAGPIDSTELRVIHQPAPKFDELSSSVDLLETGIKVIDLICPFAKGGKVGLFGGAGVGKTVNMMELINNIAKQHAGLSVFAGVGERTREGNDFYHEMKDSNVLDKVAMVFGQMNEPPGNRLRVALTGLTMAERFRDDGRDILFFVDNIYRYTLAGTEVSALLGRMPSAVGYQPTLAEEMGRLQERITSTKVGSITSIQAVYVPADDLTDPSPATTFLHLDSTVVLSRDIASLGIYPAVDPLDSTSRQLDPQVVGEEHYSVARAVQMNLQRYKELRDIIAILGMDELSPEDKLAVSRARKIQRFLSQPFHVAEVFTGSPGKFVSLKETIKGFKGICAGEYDHLPEQAFYMVGGIEEVIEKAKTL

SEQ ID NO: 7130 - DNA, 1413 bp, Desulfovibrio desulfuricans
  CDS (1)..(1413): transl_table=11
atgagtaacataggcaagatcactcaggtcatcggcgccgttgtcgacgtcgagtttgccgatggcaaccttcctaacattctgaacgcgttggtcattaaaaaccccaacaacgctgactgccccgagcttatctgcgaagtggcacagcatctgggtgacaacgttgttcgcacaatcgccatggacgcgaccgaaggtcttgtccgcggcatggaagtgaccgatactggcaaccccatcatggtgcccgtgggcagcgcctctctgggccgcatcatgaacgttgtgggccgtcctgtggacgaaatgggcgacatcgacgcggcgaaaagccttcccattcaccgtcccgcacccgaattcaacgagcagaacaccaacgttgaactgcttgaaaccggcatcaaggttgttgacctgctgattcccttccccaagggcggcaaaatgggtctcttcggcggtgcaggcgtgggtaaaaccgttattctgatggaaatgatcaacaacattgcaaaacagcacggcggtatttccgtgtttgcaggtgttggtgagcgtacccgtgaaggtaacgacctgtaccacgaaatgaaggacgccggcgttctggaaaaagccgcacttgtgtacggccagatgaacgaacctccgggagcacgtgcacgtgttgcactgactgcactggcctgcgcggaatacttccgtgacgaagaaaatcaggacgtgctgctctttgttgacaatatattccgctttacgcaggcaggttcggaagtgtccgcactgctcggccgtatgccttccgcggtgggttaccagcccacgctgggcaccgaccttggcggcctgcaggaacgcatcacctccaccaccaagggttccatcacctcggtgcaggctgtttacgttcccgcggacgaccttaccgaccccgcgcctgcaaccacgttctcgcaccttgacggaacgctcgtgctttcgcgtcagattgcagaactcggcatctaccctgcggttgacccgctggactccacttcgcgtattctcgaccccaacgttgttggtgccgaacactacagcgtggcacgtgaagttcagatggtgctgcagaagtacaaagacctgcaggacatcattgccattctgggtatggacgaactgtcggacgaggacaagcagaccgttgcgcgcgcacgccgcatccagcgtttcctctctcagccgttccacgtggcagaagtgttcaccggcacccctggtgtgtatgtaaagctggaagagaccatcaaggccttccgcggcattctgaacggtgaatacgaccatctggctgaaaacgacttctacatggtcggcggtatcgaaatggccgtggagcgttataaccagcgtcagcaagccgcgtaa

SEQ ID NO: 7131 - protein, 470 aa, Desulfovibrio desulfuricans
MSNIGKITQVIGAVVDVEFADGNLPNILNALVIKNPNNADCPELICEVAQHLGDNVVRTIAMDATEGLVRGMEVTDTGNPIMVPVGSASLGRIMNVVGRPVDEMGDIDAAKSLPIHRPAPEFNEQNTNVELLETGIKVVDLLIPFPKGGKMGLFGGAGVGKTVILMEMINNIAKQHGGISVFAGVGERTREGNDLYHEMKDAGVLEKAALVYGQMNEPPGARARVALTALACAEYFRDEENQDVLLFVDNIFRFTQAGSEVSALLGRMPSAVGYQPTLGTDLGGLQERITSTTKGSITSVQAVYVPADDLTDPAPATTFSHLDGTLVLSRQIAELGIYPAVDPLDSTSRILDPNVVGAEHYSVAREVQMVLQKYKDLQDIIAILGMDELSDEDKQTVARARRIQRFLSQPFHVAEVFTGTPGVYVKLEETIKAFRGILNGEYDHLAENDFYMVGGIEMAVERYNQRQQAA

SEQ ID NO: 7132 - DNA, 1416 bp, Desulfotalea psychrophila
  CDS (1)..(1416): transl_table=11
atgagtgagcaaaaaattggaaagattacacaggttattggacctgttgtagatgttgagtttgagccgggccagctgcctaatattctgaatgcctgtactgtgaccaatcctggtattaatgacgtcccggataacctggttatcgagattgctcagcatttaggtgataacgtttgtcgttgtattgctatggaccagaccgatggtcttgttcgtggcatggttgtaagagatacgggcctgcctatcaccattcctgtcggtgagggtgctcttggtcgtatcatgaacgttgttggtcgtcccgtggatggactcggtcccattccggcaaagacaagcatgtccattcaccgtgatgcgccactttttaccgagcaggacaccgaagtgcgtgttcttgaaaccggtattaaggtaattgatctccttgttccattcccacttggtggaaagatggggctcttcggtggtgccggttgtggtaagaccgttattatgatggagatggttaataatattgccatgcatcatggtggtatctctgtcttctgtggtgttggagagcgtacccgtgagggtaatgatctctacaacgagatgaaggagtccggtgttcttcctaaggctgcccttgtttatggtcagatgacagagcctccgggagcacgtgcccgggttgccctgaccggtcttactgctgctgagtatttccgtgatgaagaggggcaggatgtactgttcttcgtggataatatctttcgttttacccaggcaggctccgaagtttctgccctccttggccgtattccatctgcggtaggttatcagcctaccttggcaacggatcttggtgccctgcaggaacgtattacctccaccaacaagggttctattactgctgttcagtgtgtatatgtaccggcggatgatttaaccgatcctgcccctgctaccacctttgctcaccttgatggtaccgttgttctttctcgtcagatctctgagcttggtatctaccctgccgttgatccgctggattcaacctctcgtattctcgatccgaatgttatcggtgaagagcattacgacgttgcccgtggtgtccaggtaagcctgcagaagtacaaagatcttcaggatattattgctattcttggtatggatgagctctctgaggaagatcagcagttggtttcccgtgcccgtaagattcagcgatacctgtcgcaaccatttaccgttgccgaggtatttaccggtatgcctggtaaattcgttaaggttgccgatactgttcagggcttcaaagagatcctggaaggaaagcacgacgcactcaacgagaactccttctatatggttggtagcattgacgaagctgttgcaaaggatgctgcatctaaggcgtaa

SEQ ID NO: 7133 - protein, 471 aa, Desulfotalea psychrophila
MSEQKIGKITQVIGPVVDVEFEPGQLPNILNACTVTNPGINDVPDNLVIEIAQHLGDNVCRCIAMDQTDGLVRGMVVRDTGLPITIPVGEGALGRIMNVVGRPVDGLGPIPAKTSMSIHRDAPLFTEQDTEVRVLETGIKVIDLLVPFPLGGKMGLFGGAGCGKTVIMMEMVNNIAMHHGGISVFCGVGERTREGNDLYNEMKESGVLPKAALVYGQMTEPPGARARVALTGLTAAEYFRDEEGQDVLFFVDNIFRFTQAGSEVSALLGRIPSAVGYQPTLATDLGALQERITSTNKGSITAVQCVYVPADDLTDPAPATTFAHLDGTVVLSRQISELGIYPAVDPLDSTSRILDPNVIGEEHYDVARGVQVSLQKYKDLQDIIAILGMDELSEEDQQLVSRARKIQRYLSQPFTVAEVFTGMPGKFVKVADTVQGFKEILEGKHDALNENSFYMVGSIDEAVAKDAASKA

SEQ ID NO: 7134 - DNA, 1413 bp, Desulfovibrio vulgaris
  CDS (1)..(1413): transl_table=11
atgagtgctaacattggcaagatcgttcaggttatcggcgccgtcgtcgacgtcgagtttccgagcggccagctgccgaacattctgaacgcgctggatatcaagaaccccaacaacacggacgcgcccgacctcgtctgcgaagttgcccagcaccttggcgacaacatcgtgcgcaccatcgccatggacgcgaccgaaggtctcgtgcgcggcatggaagcctccgacaccggcaagcccatcatggtgcccgtcggcaaggcctcccttggccgtatcatgaacgtcgtgggtcgccccgtggacgaactcggccccatcaacgcggacaagtcgcttccgattcaccgcgctgctcccgagttcaccgaacagaacaccaaggttgaactgctcgaaaccggcatcaaggtcgtcgacctgctcatcccgttccccaagggcggcaagatgggcctcttcggcggcgcaggcgtcggcaagacggttatcctcatggaaatgatcaacaacatcgcgaagcagcacggcggtatctccgtgttcgccggtgttggtgagcgtacccgtgaagggaacgacctttaccacgaaatgaaggacgctggcgttctggagaaggccgcactcatctacggccagatgaacgaaccgccaggagcccgtgcccgcgtcgccctgaccgccctcgcctgcgcggagtacttccgtgacgtcgagaaccaggacgtgctgctgttcgtcgacaacatcttccgtttcacccaggcgggttcggaagtgtcggcactgctcggccgcatgccttcggcggttggttaccagcccaccctcggtaccgacctcggtgccctgcaggaacgcatcacctccaccaccaagggttcgatcacctcggttcaggccgtctacgtccccgcggacgaccttaccgaccccgcgcccgcaaccacgttctcgcaccttgacggtacgctcgttctgtcccgtcagattgcagaactcggcatctaccccgcggttgacccgctcgactccacgtcgcgcatcctcgaccccaacgtggtgggtgttgaacactacggcgttgcccgtcaggttcagcaggtactccagaagtacaaggaccttcaggacatcatcgccattctcggcatggacgaactgtccgacgaggacaagctgaccgtcgcccgcgcgcgccgcatccagcgcttcctctcgcagccgttccacgtcgcagaaaccttcaccggcacgcccggcgtgtacgtgaagcttgaagacaccatcaagggcttcatgggcatcctgaacggtgactacgaccacctcgcagaaggcgacttctacatggtgggcggcatcgaaatggctctggagaagtacaagaaacgccaggagcagtaa

SEQ ID NO: 7135 - protein, 470 aa, Desulfovibrio vulgaris
MSANIGKIVQVIGAVVDVEFPSGQLPNILNALDIKNPNNTDAPDLVCEVAQHLGDNIVRTIAMDATEGLVRGMEASDTGKPIMVPVGKASLGRIMNVVGRPVDELGPINADKSLPIHRAAPEFTEQNTKVELLETGIKVVDLLIPFPKGGKMGLFGGAGVGKTVILMEMINNIAKQHGGISVFAGVGERTREGNDLYHEMKDAGVLEKAALIYGQMNEPPGARARVALTALACAEYFRDVENQDVLLFVDNIFRFTQAGSEVSALLGRMPSAVGYQPTLGTDLGALQERITSTTKGSITSVQAVYVPADDLTDPAPATTFSHLDGTLVLSRQIAELGIYPAVDPLDSTSRILDPNVVGVEHYGVARQVQQVLQKYKDLQDIIAILGMDELSDEDKLTVARARRIQRFLSQPFHVAETFTGTPGVYVKLEDTIKGFMGILNGDYDHLAEGDFYMVGGIEMALEKYKKRQEQ

SEQ ID NO: 7136 - DNA, 1524 bp, Ehrlichia canis
  CDS (1)..(1524): transl_table=11
atgtcaagtttagctaataaagcaaaaagtaaaggtaaaagtagtaaaagtaagagtaatgtgaatactcaagttgatgaattaagtgatagtattgggctagtagttcgtgtaatgactgcagttgtagatataaaatttgatggtggtaaagttccaaaaatacttaatgcattagagagtaagaaattttataatggaaaaaagttggttcttgaagtatctcaacatattagtgacaatatagtaaggtgcatagcacttgatagtactgatggcttatctaggaatgatgaattcattgatactcgtgctcctatatcagttcctgtgggtcgtgggacattaggtagggtttttgatgtcttaggcaatacaatagatgactgtggaccattagaagaatcaaaatatatcattaagccaatatattctgagattcctaaattaactgatcaaaagattgcaacagaaatattggttactgggattaaagtaatagatttacttgctccatatcttaaaggtggaaaggttggtctatttggtggtgctggagtaggtaaaactgtactaattatggaattaatacataacattgcaaaagcgcatagaggagtatctgtttttgctggtgttggagaacgtacacgtgaaggaaatgatctttatcatgaaatgatagaatctggtgtaataaatttaaatgaaaaagatcaatcacaagcagttttagtatatggtcaaatgaatgaacctcctggagcaagactaagagttgcattgtcagctttaactatggctgaatactttagagattctgaaaatcaagacgttttattttttgtggataatatctttaggtttacccagtctgggtcagaaatttcagcattgttaggtagaataccatctgccgttggttatcagccaacattagcagctgaaatgggtgcaatgcaggaaaggattacttctactaataatggttctattacttctgtgcaagcaatatatgtaccagcagatgacttaacagatcctgctccagctacttcttttgcacatcttgattcaactacagttttatcaaggcaaatatctgagttaggtatatacccagctgttgatcctttagattcaacatctcaagccttatccgctgatattgtaggtgaagaacattatgaagttgctaaagaagttcagcgcatactacagacatataaatctttacaagatattatcgcaattcttggtatggatgagctttcagaagatgataaacttatagttgctagagcaagaaaaattcaaagatttttatcacagcctttccatgttgctgaggtctttacaggctcccctggtaagtttgtatctcttgaagatactgtttcaagttttaaaggactagtagaagggaaatatgatcacttacctgaagctgcattttacatggttggtagtatagatgatgtgataaaaaaagcagaattacttcaaaaagaaggtaaagtgtaa

SEQ ID NO: 7137 - protein, 507 aa, Ehrlichia canis
MSSLANKAKSKGKSSKSKSNVNTQVDELSDSIGLVVRVMTAVVDIKFDGGKVPKILNALESKKFYNGKKLVLEVSQHISDNIVRCIALDSTDGLSRNDEFIDTRAPISVPVGRGTLGRVFDVLGNTIDDCGPLEESKYIIKPIYSEIPKLTDQKIATEILVTGIKVIDLLAPYLKGGKVGLFGGAGVGKTVLIMELIHNIAKAHRGVSVFAGVGERTREGNDLYHEMIESGVINLNEKDQSQAVLVYGQMNEPPGARLRVALSALTMAEYFRDSENQDVLFFVDNIFRFTQSGSEISALLGRIPSAVGYQPTLAAEMGAMQERITSTNNGSITSVQAIYVPADDLTDPAPATSFAHLDSTTVLSRQISELGIYPAVDPLDSTSQALSADIVGEEHYEVAKEVQRILQTYKSLQDIIAILGMDELSEDDKLIVARARKIQRFLSQPFHVAEVFTGSPGKFVSLEDTVSSFKGLVEGKYDHLPEAAFYMVGSIDDVIKKAELLQKEGKV

SEQ ID NO: 7138 - DNA, 1524 bp, Ehrlichia chaffeensis
  CDS (1)..(1524): transl_table=11
atgtcgggtttagctagtaaagcaaagagtagggttaagagtagcaaaggtaaaaatagcacaaatattcatgctgatgaattaaacgaagatgttggagtagtagttcgtgttatgacagcagtcgtagatgtaaagtttgctagtggtaaaataccaaaaatacttaatgcgttagaaagtaaagaaatttataatggtaagaaattagttcttgaagtgtctcagcatattagtgatagtattgtaaggtgtatagcacttgatggcactgatggtttgtctagaaatgataaatttattgatactggtgctcctatatcagttcctgtagggcgtggcacattaggacgagtttttgatgtactaggtaatacaatagatgaatgtggcccgttagaagaatcaagttactttattaagcaaatatattcagagattcctaagttaactgatcagaaaattgcaactgaaatattggtgactggtattaaagtaatagatttacttgctccataccttaaaggtggaaaagttggattgtttggtggtgctggtgtaggtaaaactgtattgattatggaattaatacataatattgcaaaagcacataaaggagtatcagtttttgctggtgttggggaacgtacacgtgaagggaatgatctttatcatgagatgatagaatctggtgtaataaatttagaaaataaggatcagtcacaggcggttttagtatatggtcaaatgaatgaacctcctggagcaaggttaagggttgcattatcagctttaactatggctgaatattttagggatgctgaaaatcaagatgtactattttttgtagataatattttcaggtttactcaatctggatcagaaatttcagctttgttagggagaataccttctgctgttggttatcagccaacattggcagcagaaatgggtgcaatgcaagaaagaattacttccactaatagtggatctattacctctgtacaagcaatatatgtaccagcagatgatttaacagatcctgctcctgctacttcttttgcacatcttgattcaactactgttttgtcaagacaaatatctgagctagggatatatccagctgttgatcctttagattcaacatctcaagctttatctgctgatgttgtaggtaaagagcattatgacgttgctaaggaagtacaacgtatattacagacatataagtctttacaagatattattgcaattcttggtatggatgaactttcagaggaagataagcttatagtggcaagggcaaggaaaattcaaaggtttttatcacaaccttttcatgttgctgaagtgtttacaggtgctcctggtaaatttgtatctcttgaagatactgttttaagttttaaaggattggtagaaggtaaatatgatcacttgcctgaagctgcattttatatggttggtagtatagatgatgtcataaaaaaagcagaattacttcaaaaggaaggtaaagtttaa

SEQ ID NO: 7139 - protein, 507 aa, Ehrlichia chaffeensis
MSGLASKAKSRVKSSKGKNSTNIHADELNEDVGVVVRVMTAVVDVKFASGKIPKILNALESKEIYNGKKLVLEVSQHISDSIVRCIALDGTDGLSRNDKFIDTGAPISVPVGRGTLGRVFDVLGNTIDECGPLEESSYFIKQIYSEIPKLTDQKIATEILVTGIKVIDLLAPYLKGGKVGLFGGAGVGKTVLIMELIHNIAKAHKGVSVFAGVGERTREGNDLYHEMIESGVINLENKDQSQAVLVYGQMNEPPGARLRVALSALTMAEYFRDAENQDVLFFVDNIFRFTQSGSEISALLGRIPSAVGYQPTLAAEMGAMQERITSTNSGSITSVQAIYVPADDLTDPAPATSFAHLDSTTVLSRQISELGIYPAVDPLDSTSQALSADVVGKEHYDVAKEVQRILQTYKSLQDIIAILGMDELSEEDKLIVARARKIQRFLSQPFHVAEVFTGAPGKFVSLEDTVLSFKGLVEGKYDHLPEAAFYMVGSIDDVIKKAELLQKEGKV

SEQ ID NO: 7140 - DNA, 1515 bp, Ehrlichia ruminantium
  CDS (1)..(1515): transl_table=11
atgtcaagtttaactggtaaagtaaaaggtagagctaggaaaattaaaggtgatgcagatattcgtattaatgagtccactgagaatgttggattagtaatccgtgtgatgactgcagttgtagatattaagtttcctagtgggaaggtacctaagatactaaatgcattagaaagtaaagaaatttataatggtaaaaaattagttcttgaggtatctcagcatattagtgatagtattgtaaggtgtatagcacttgatagtactgatggtttatctagaaatgatgaatttattgatactggtgctcctatctctgttcctgttggtagagcaactttgggtagggtttttgatgtattaggaaatccaatagataattgtggcccattaactaaatcagattactctattaagccaatatattcagaagttcctaaattaacggatcaaaaggttactacagaaatattggtaactggtattaaggtaatagatttactggcaccgtaccttaaaggtggaaaagttggtttgtttggaggtgctggtgtaggtaaaactgtacttattatggagttaatacataatattgcaaaagctcataagggggtttcagtatttgctggggtaggagaacgtacacgtgaaggaaatgatttatatcatgagatgatagaatctggtgtaatcaatttagaggaaaaagataagtcacaagcagttttagtatatggtcagatgaatgaacctcctggggcaaggttacgtgttgcattatctgctttaactatggcagaatattttagggatgttgaaaatcaggatgtattgttttttgtagataacatatttagatttactcagtctggttctgaaatttcagctttattaggtagaatcccatctgctgtaggttatcagcctactcttgctgcagaaatgggtgctatgcaagagagaattacttctacaaatcgtggttctattacttcagtacaagcaatatatgtgccagcagatgatttaacagatccagctccagcaacttcttttgctcatcttgattcgacaactgtcttgtcaagacaaatagctgagttgggtatatatcctgctgttgatcctttagattcggcttctcaggcgttgtctattgatattgttggggaaaaacattatgaggtatctaaggaagtgcagcgtatattacaaacgtataagtctttacaagatattattgcaattcttggtatggaggagttgtcagaagaagataagcttatagtggcaagagcgaggaaaattcagaggtttttatcgcaaccttttcatgttgcagaggtgtttactggtacaccaggtgtatttgtttctcttgaagacacagtctctagttttaaggatatagtggaaggtaagtatgatcatttacctgaagctgcattctatatggttagtaacataaatgaagctgttaaaaaagcagagctattgcaaaaagaaggtaaataa

SEQ ID NO: 7141 - protein, 504 aa, Ehrlichia ruminantium
MSSLTGKVKGRARKIKGDADIRINESTENVGLVIRVMTAVVDIKFPSGKVPKILNALESKEIYNGKKLVLEVSQHISDSIVRCIALDSTDGLSRNDEFIDTGAPISVPVGRATLGRVFDVLGNPIDNCGPLTKSDYSIKPIYSEVPKLTDQKVTTEILVTGIKVIDLLAPYLKGGKVGLFGGAGVGKTVLIMELIHNIAKAHKGVSVFAGVGERTREGNDLYHEMIESGVINLEEKDKSQAVLVYGQMNEPPGARLRVALSALTMAEYFRDVENQDVLFFVDNIFRFTQSGSEISALLGRIPSAVGYQPTLAAEMGAMQERITSTNRGSITSVQAIYVPADDLTDPAPATSFAHLDSTTVLSRQIAELGIYPAVDPLDSASQALSIDIVGEKHYEVSKEVQRILQTYKSLQDIIAILGMEELSEEDKLIVARARKIQRFLSQPFHVAEVFTGTPGVFVSLEDTVSSFKDIVEGKYDHLPEAAFYMVSNINEAVKKAELLQKEGK

SEQ ID NO: 7142 - DNA, 1407 bp, Enterococcus faecalis
  CDS (1)..(1407): transl_table=11
atgagttcaggaaagattgttcaagtaatcggtcccgttgttgacgtggaattttcattagatcaatccttacccgatattaacaacgctttagtcgtttataaaaatggcgaagcaaaacaaaaagtagtacttgaagtcgctttagaactaggtgatggagtgattcgttctatcgctatggaatcgacagatggtttacaacgtggaatggaagttatcgatacaggaaaatcaatttcagttcctgttggtaaagatacattaggtcgtgtgtttaacgttttaggagacacaattgacttagaagcgccattccctgcagatgctgaacgtagtgggattcataaaaaagcgccagcatttgatgaattaagtaccagtaatgaaattttagaaacagggattaaagttattgacttattagcaccttatctaaaaggtggtaaagtcggacttttcggtggtgccggtgttggtaaaaccgtcttaattcaagaattaattcataatattgcccaagaacatggagggatttccgtctttactggtgttggtgaacggacacgtgaagggaacgacctgtactatgaaatgaaagattcaggcgttattgaaaaaacagccatggtttttggtcaaatgaacgaaccaccaggtgcacggatgcgtgtggccttaactgggttaacgattgctgaatatttccgtgatgtggaaggacaagacgtgctattatttattgataacattttccgtttcacccaagccggttcagaagtttctgcccttttaggtcggatgccgtcagccgttggttaccaaccaaccttagcgactgaaatgggacaattacaagaacggattacttcaacgaaaaaaggatcaattacctctattcaagcaatctatgttccagccgatgactataccgatccagcgccagcaacagcgtttgcccatttggatgcaacaactaacttggaacgtaaattaaccgaacaagggatttatccagcggtagatccgttagcttcatcttctagtgccttggctcctgaaattgttggagaagaacactacgaagtggctaccgaagtgcaacatattttacaacgttaccgtgaattacaagatatcatcgctattttagggatggacgaattatcagatgacgaaaaagtacttgttggtcgcgcacgccgtgttcaattcttcttatctcaaaactttaacgttgctgaacaatttacaggtcaacctggttcttatgtaccagttgcggaaacagttcgtggctttaaagaaattcttgaaggtaaacatgacaatctgccagaagaagccttccgtagtgtcggtaaaattgaagatgccatcgaaaaagcgaaacaattaaactactag

SEQ ID NO: 7143 - protein, 468 aa, Enterococcus faecalis
MSSGKIVQVIGPVVDVEFSLDQSLPDINNALVVYKNGEAKQKVVLEVALELGDGVIRSIAMESTDGLQRGMEVIDTGKSISVPVGKDTLGRVFNVLGDTIDLEAPFPADAERSGIHKKAPAFDELSTSNEILETGIKVIDLLAPYLKGGKVGLFGGAGVGKTVLIQELIHNIAQEHGGISVFTGVGERTREGNDLYYEMKDSGVIEKTAMVFGQMNEPPGARMRVALTGLTIAEYFRDVEGQDVLLFIDNIFRFTQAGSEVSALLGRMPSAVGYQPTLATEMGQLQERITSTKKGSITSIQAIYVPADDYTDPAPATAFAHLDATTNLERKLTEQGIYPAVDPLASSSSALAPEIVGEEHYEVATEVQHILQRYRELQDIIAILGMDELSDDEKVLVGRARRVQFFLSQNFNVAEQFTGQPGSYVPVAETVRGFKEILEGKHDNLPEEAFRSVGKIEDAIEKAKQLNY

SEQ ID NO: 7144 - DNA, 1422 bp, Geobacillus kaustophilus
  CDS (1)..(1422): transl_table=11
atgacaagaggacgcgttatccaagtcatgggtccggttgtagacgtcaagtttgagaacggccacttgccggcgatctacaacgccctgaaaattcaacataaagcgcgcaacgaaaacgaagtcgacatcgacttgacattggaagtcgccttgcaccttggcgatgatacagtacggacgatcgcgatggcgtccacagacggcctcatccgcggcatggaagtcatcgataccggtgcaccgatttcggtgccggtcggcgaagtcacgcttggccgcgtgttcaacgtcttgggcgagccgatcgacttggaaggcgacattccggctgacgcccgccgcgacccgattcaccgtccggcgccaaaattcgaggaattggcgacggaagtcgaaattttggaaacggggattaaagtcgttgacttgcttgccccgtatattaaaggcggaaaaatcggtttgttcggcggcgctggcgtaggaaaaacggtcttgattcaagagctgatccacaacatcgcccaagagcacggcgggatttccgtctttgctggcgtcggcgaacggacgcgcgaaggaaacgacttgtaccatgagatgaaagattccggcgtcatcagcaaaacggccatggtgttcggacaaatgaatgagccgccgggggcgcggatgcgcgtcgccttgaccggcttgacgatggccgaatacttccgtgatgaacaaggccaagacgtgttgctctttatcgataacatcttccgtttcacgcaggccggttcggaagtgtcggcgctgttaggccgcatgccgtcggccgttggttaccaaccgacattggcgacggagatgggtcaattgcaagagcggatcacgtcgacggcgaaaggatcgatcacctcgattcaagcgatttacgtcccggccgacgactatacggacccggctccggccacgacgttctcgcacttggatgcgacgacgaacctggagcggaagctcgcggagatggggatttatccggccgttgacccgctcgcttcgacatcgcgtgcgttggcgccggaaatcgtcggcgaggagcactaccaagtcgcccgcaaagtgcagcaaacgctgcaacgttataaagaattgcaagacatcatcgccatcttggggatggatgaactgtcggatgaagacaaactcgtcgttcatcgcgcccgccgcatccagttcttcttgtcgcaaaacttccacgtggcggagcagttcacgggccaaccgggctcctacgtgccggtgaaagaaacagtgcgcggctttaaagaaattttggaaggcaaatacgaccatcttccggaagatgcgttccgcttagtcggccgcattgaagaagtcgttgaaaaagcgaaagcgatgggtgtcgaagtgtga

SEQ ID NO: 7145 - protein, 473 aa, Geobacillus kaustophilus
MTRGRVIQVMGPVVDVKFENGHLPAIYNALKIQHKARNENEVDIDLTLEVALHLGDDTVRTIAMASTDGLIRGMEVIDTGAPISVPVGEVTLGRVFNVLGEPIDLEGDIPADARRDPIHRPAPKFEELATEVEILETGIKVVDLLAPYIKGGKIGLFGGAGVGKTVLIQELIHNIAQEHGGISVFAGVGERTREGNDLYHEMKDSGVISKTAMVFGQMNEPPGARMRVALTGLTMAEYFRDEQGQDVLLFIDNIFRFTQAGSEVSALLGRMPSAVGYQPTLATEMGQLQERITSTAKGSITSIQAIYVPADDYTDPAPATTFSHLDATTNLERKLAEMGIYPAVDPLASTSRALAPEIVGEEHYQVARKVQQTLQRYKELQDIIAILGMDELSDEDKLVVHRARRIQFFLSQNFHVAEQFTGQPGSYVPVKETVRGFKEILEGKYDHLPEDAFRLVGRIEEVVEKAKAMGVEV

SEQ ID NO: 7146 - DNA, 1413 bp, Geobacter metallireducens
  CDS (1)..(1413): transl_table=11
atgagtcagaactttggtagaatttcgcaggttatcggcgcggttatcgacgtcgagttcgagccgggcaaactgcctcccatctacaacgccctccgggtcaccaacccggccattgacgataaagaatacaacctggtgctcgaagttgcccagcacctgggcgagaactccgtccggaccatcgccatggactccaccgacggtctcgttcggggccaggctgccctcgacaccggcaagcagatctccgtgccggtcggccgcaagaccctgggccgcatcctgaacgtcatcggcgagcccgttgacgagatgggtccggtcaatgcagagaaggagtacggcatccaccgcgaatccccttccttcgtggaccagtccaccaaggttgaagccttcaccaccggcatcaaggtcgtcgacctcctcgctccctatgcccgggggggcaagatcggcctcttcggcggcgccggcgtcggcaagactgttctcatcatggagctcatcaacaacatcgccaagcagcacggcggtttctccgtgttcgccggcgttggcgagcggacccgtgaaggaaacgacctctggatggagatgaaggagtccggcgttctcgataaggctgctcttgtctacggccagatgaacgagccgccgggagcccgtgcccgggtggcactctccgcgctttccattgcggagtacttccgtgacgaagaagggcagaacgtgctcctcttcatcgataacatcttccgtttcacccaggcgggttccgaggtttcggcgcttctcggccggatcccttctgccgttggttaccagcctactctggccactgagatgggtgagctccaggagcggatcacctccaccaccaaaggttccatcacttcggttcaggcgatctacgttccggctgacgaccttaccgaccctgcaccggcaacggccttcgcccacctggatgcaaccacggttctgtcccgtcagatcgccgagcttggcatctacccggccgttgaccccctcgactccacgtcgcggattctcgacccccaggtaatcggcgaagagcactacgccatcgcccgccaggttcagtacgtcctccagaagtacaaggacctccaggacatcatcgccattctcggcatggacgagctctccgaggaggacaagctggtggttgcccgcgcccggaagatccagcgcttcctctcccagcccttccacgtggcagaagccttcaccggcagccccggcaagtacgttgagctgaaggacaccatcaagggcttccaggagatcgttgccggcaagcacgacgacatccccgagcaggccttctacatggttggcaccatcgaagaggcactagaaaaagcgaagaagcttgctgcctaa

SEQ ID NO: 7147 - protein, 470 aa, Geobacter metallireducens
MSQNFGRISQVIGAVIDVEFEPGKLPPIYNALRVTNPAIDDKEYNLVLEVAQHLGENSVRTIAMDSTDGLVRGQAALDTGKQISVPVGRKTLGRILNVIGEPVDEMGPVNAEKEYGIHRESPSFVDQSTKVEAFTTGIKVVDLLAPYARGGKIGLFGGAGVGKTVLIMELINNIAKQHGGFSVFAGVGERTREGNDLWMEMKESGVLDKAALVYGQMNEPPGARARVALSALSIAEYFRDEEGQNVLLFIDNIFRFTQAGSEVSALLGRIPSAVGYQPTLATEMGELQERITSTTKGSITSVQAIYVPADDLTDPAPATAFAHLDATTVLSRQIAELGIYPAVDPLDSTSRILDPQVIGEEHYAIARQVQYVLQKYKDLQDIIAILGMDELSEEDKLVVARARKIQRFLSQPFHVAEAFTGSPGKYVELKDTIKGFQEIVAGKHDDIPEQAFYMVGTIEEALEKAKKLAA

SEQ ID NO: 7148 - DNA, 1413 bp, Geobacter sulfurreducens
  CDS (1)..(1413): transl_table=11
atgagtcagaacttcggtaaaatttcgcaggtcatcggcgcggttattgacgtcgagtttgagccgggcaaactgcctcccatctacaacgccctccgggtgaccaacccggccattgacgataaggaatacaacttggtgctcgaagtggcccagcacctgggtgaaaacgcggtccggaccatcgccatggattccaccgacggtcttgtccggggccaggcagtgctcgataccggtaagcagatttccgtgccggtgggccgcaagaccctgggtcgaatcctcaacgtcatcggcgagccggtggacgagatgggtccggtcaacgccgagaaagagtacggaatccaccgcgaagctcccgccttcgtggaccagtccaccaaggttgaagccttcaccaccgggatcaaggtcgtcgaccttctcgctccctacgctcggggcggcaagattggcctcttcggcggcgccggcgtcggcaagaccgttctcatcatggagctcatcaacaacatcgccaagcagcacggtggcttctccgtgtttgccggcgtcggtgagcggacccgcgaaggaaacgatctctggatggagatgaaggagtccggggttctcgacaaggccgccctcgtctacggccagatgaacgagccgccgggagcacgtgcccgggttgccctctccgccctttccatcgccgagtacttccgtgacgaagaaggtcagaacgtgcttctcttcgttgacaatatcttccgcttcacccaggcgggttccgaagtttccgcgctcctcggccggattccctccgccgttggttaccagcccacactggccacagagatgggagagcttcaggagcgaatcacctccaccaccaagggctccattacctcggttcaggcgatctacgttccggccgacgaccttaccgacccggctccggcaaccgccttcgcccacctggacgcaacgaccgttctttcccgtcagattgccgagctcggtatctacccggccgttgacccgctggactccacgtcgcggattctcgatccccaggtaatcggcgaggagcactactccattgcccggcaggtccagtacgtgctccagaagtacaaggatctccaggacatcatcgctattctcggtatggacgaactctccgaggaggacaagctggtcgttgcccgggcccggaagatccagcgtttcctctcccagccgttccacgttgccgaagccttcaccggcagccccggcaagtacgttgagctgaaggacaccatcaagggcttccaggagatcgtcgccggcaagcatgacgatgtccccgagcaggccttctacatggtcggaaccattgaagaggccctcgaaaaggccaagaagctcgctgcctaa

SEQ ID NO: 7149 - protein, 470 aa, Geobacter sulfurreducens
MSQNFGKISQVIGAVIDVEFEPGKLPPIYNALRVTNPAIDDKEYNLVLEVAQHLGENAVRTIAMDSTDGLVRGQAVLDTGKQISVPVGRKTLGRILNVIGEPVDEMGPVNAEKEYGIHREAPAFVDQSTKVEAFTTGIKVVDLLAPYARGGKIGLFGGAGVGKTVLIMELINNIAKQHGGFSVFAGVGERTREGNDLWMEMKESGVLDKAALVYGQMNEPPGARARVALSALSIAEYFRDEEGQNVLLFVDNIFRFTQAGSEVSALLGRIPSAVGYQPTLATEMGELQERITSTTKGSITSVQAIYVPADDLTDPAPATAFAHLDATTVLSRQIAELGIYPAVDPLDSTSRILDPQVIGEEHYSIARQVQYVLQKYKDLQDIIAILGMDELSEEDKLVVARARKIQRFLSQPFHVAEAFTGSPGKYVELKDTIKGFQEIVAGKHDDVPEQAFYMVGTIEEALEKAKKLAA

SEQ ID NO: 7150 - DNA, 1422 bp, Geobacillus thermoleovorans
  CDS (1)..(1422): transl_table=11
atgacaagaggacgcgttatccaagtcatgggtccggttgtagacgtcaagtttgagaacggccacttgccggcgatctacaacgccctgaaaattcaacataaagcgcgcaacgaaaacgaagtcgacatcgacttgacattggaagtcgccttgcaccttggcgatgatacagtacggacgatcgcgatggcgtccacagacggcctcatccgcggcatggaagtcatcgataccggtgcaccgatttcggtgccggtcggcgaagtcacgcttggccgcgtgttcaacgtcttgggcgagccgatcgacttggaaggcgacattccggctgacgcccgccgcgacccgattcaccgtccggcgccaaaattcgaggaattggcgacggaagtcgaaattttggaaacggggattaaagtcgttgacttgcttgccccgtatattaaaggcggaaaaatcggtttgttcggcggcgctggcgtaggaaaaacggtcttgattcaagagctgatccacaacatcgcccaagagcacggcgggatttccgtctttgctggcgtcggcgaacggacgcgcgaaggaaacgacttgtaccatgagatgaaagattccggcgtcatcagcaaaacggccatggtgttcggacaaatgaatgagccgccgggggcgcggatgcgcgtcgccttgaccggcttgacgatggccgaatacttccgtgatgaacaaggccaagacgtgttgctctttatcgataacatcttccgtttcacgcaggccggttcggaagtgtcggcgctgttaggccgcatgccgtcggccgttggttaccaaccgacattggcgacggagatgggtcaattgcaagagcggatcacgtcgacggcgaaaggatcgatcacctcgattcaagcgatttacgtcccggccgacgactatacggacccggctccggccacgacgttctcgcacttggatgcgacgacgaacctggagcggaagctcgcggagatggggatttatccggccgttgacccgctcgcttcgacatcgcgtgcgttggcgccggaaatcgtcggcgaggagcactaccaagtcgcccgcaaagtgcagcaaacgctgcaacgttataaagaattgcaagacatcatcgccatcttggggatggatgaactgtcggatgaagacaaactcgtcgttcatcgcgcccgccgcatccagttcttcttgtcgcaaaacttccacgtggcggagcagttcacgggccaaccgggctcctacgtgccggtgaaagaaacagtgcgcggctttaaagaaattttggaaggcaaatacgaccatcttccggaagatcggttccgcttagtcggccgcattgaagatgtcgttgaaaaagcgaaagcgatgggtgtcgaagtgtga

SEQ ID NO: 7151 - protein, 473 aa, Geobacillus thermoleovorans
MTRGRVIQVMGPVVDVKFENGHLPAIYNALKIQHKARNENEVDIDLTLEVALHLGDDTVRTIAMASTDGLIRGMEVIDTGAPISVPVGEVTLGRVFNVLGEPIDLEGDIPADARRDPIHRPAPKFEELATEVEILETGIKVVDLLAPYIKGGKIGLFGGAGVGKTVLIQELIHNIAQEHGGISVFAGVGERTREGNDLYHEMKDSGVISKTAMVFGQMNEPPGARMRVALTGLTMAEYFRDEQGQDVLLFIDNIFRFTQAGSEVSALLGRMPSAVGYQPTLATEMGQLQERITSTAKGSITSIQAIYVPADDYTDPAPATTFSHLDATTNLERKLAEMGIYPAVDPLASTSRALAPEIVGEEHYQVARKVQQTLQRYKELQDIIAILGMDELSDEDKLVVHRARRIQFFLSQNFHVAEQFTGQPGSYVPVKETVRGFKEILEGKYDHLPEDRFRLVGRIEDVVEKAKAMGVEV

SEQ ID NO: 7152 - DNA, 1437 bp, Gloeobacter violaceus
  CDS (1)..(1437): transl_table=11
atggtaacaacgacggcaaaaaacgttggctatatcacccagatcattggtcctgtggtcgacgcagaattcccggaaggcgatttgcctgccatctacaacgccctacttatcgaaggcaagaccgactcggggctcgacatccgcctgacctgcgaagtgcagcagctgctcggtgacaagaaggtgcgggcggtctcgatgagcacgaccgacggcatggtgcggggcatgaaggcgatcgacaccggtgccccgatcacagttccggtgggcaagtcgactctgggccgcatcttcaacgtgctgggcgagccgatcgacgagttggggccggtcgagattgtcgataagttctcgatccaccgctccgctcccaaattcaccgacctggtgacccaaccggagattttcgaaacgggcatcaaggtcatcgacctgctggctccctaccgcaagggcggcaagatcggcctgttcggcggcgcgggtgtgggcaagacggtgctcattcaagaactcatccacaacatcgccaaagaacactcgggcgtgtcggtgttcggcggtgtgggcgagcggacccgcgagggcaacgacctctacaacgaatttaaagaatcgaacgtgctcgggcaggtggcgctggtctacggccagatgaacgagccgccgggggcgcgcatgcgcgtgggtctgacggccctcaccatggccgagtacttccgcgacgtgagcaagcaggacgtgctgttgtttatcgacaatatcttccgctttgtgcaggcgggttctgaagtatcggcgctcttgggccgcatgccctcggcggtcggctaccaaccgactttgggcaccgagatgggcgatttgcaggagcgcatcacctccaccaacgaaggctcgatcacctcggtgcaggcggtctacgtgccggcggacgacctgaccgaccccgcccccgccaccaccttcgcccacctcgacgccaccacggtactctcacggcagttggcctctttgggcatctacccggcggtggacccgctctcctccacctcgacgatgctgcaacccgccgtcgtcggcgaagagcactacaacatcgcccgcggcgtgcaatcgaccctgcagcgctacaaagatctccaggacatcatcgccattttgggcctcgacgaactctcgcccgaagacaagctggtggtcaaccgggcgcgcaaactgcagcgctttttgtcgcagccgttccacgtcgccgagatcttcaccggctcccccggcaagtacgtctccctggataaaacgatcgccggcttcaagcgcgtgctgcagggcgaattcgacgatctgcccgagcaggctttttacctggtgggcgacctcgacgaggcgctcgaaaaggccaaaaagctcaaagacgaaggtaagtcgtaa

SEQ ID NO: 7153 - protein, 478 aa, Gloeobacter violaceus
MVTTTAKNVGYITQIIGPVVDAEFPEGDLPAIYNALLIEGKTDSGLDIRLTCEVQQLLGDKKVRAVSMSTTDGMVRGMKAIDTGAPITVPVGKSTLGRIFNVLGEPIDELGPVEIVDKFSIHRSAPKFTDLVTQPEIFETGIKVIDLLAPYRKGGKIGLFGGAGVGKTVLIQELIHNIAKEHSGVSVFGGVGERTREGNDLYNEFKESNVLGQVALVYGQMNEPPGARMRVGLTALTMAEYFRDVSKQDVLLFIDNIFRFVQAGSEVSALLGRMPSAVGYQPTLGTEMGDLQERITSTNEGSITSVQAVYVPADDLTDPAPATTFAHLDATTVLSRQLASLGIYPAVDPLSSTSTMLQPAVVGEEHYNIARGVQSTLQRYKDLQDIIAILGLDELSPEDKLVVNRARKLQRFLSQPFHVAEIFTGSPGKYVSLDKTIAGFKRVLQGEFDDLPEQAFYLVGDLDEALEKAKKLKDEGKS

SEQ ID NO: 7154 - DNA, 1464 bp, Gluconobacter oxydans
  CDS (1)..(1464): transl_table=11
atgtccgaaactcttaccccttctgccggagctgccaacaacgtggtcggccgtgtcacccaggtgcgtggtccggtcgtggacgtgcagttcgaaggcgatcttcccttcattctgaacgctctgcacgtccagaacggcgaccatacgctggttctggaagtcgcccaggaaatcggcgagcgtcaggtccgctgcattgccatggacacgaccgacggtctggttcgcggaactgaagtccgtgacacgggcaagcagatcatggtgccggttggtccggcaacgctcggccgtatcctgaacgtcgttggcgaaccgatcgacgaacgcggtccgatcagcagcgaactgcgtttcccgattcaccgtccggctccgtccttcgaagagcaggctgctgcatccgagatcctcgtgaccggcatcaaggtcgtcgatctgctctgcccgtacctcaagggtggtaagatcggcctgttcggcggcgctggcgtcggcaagacggttatcattcaggaactcatcaacaacatcgcgaaggcccacggtggtgtgtccgttttcgcaggtgtcggtgagcgtacccgtgaaggtaacgacctgtatttcgaaatgcaggacgcaggcgtcatcaagatcgccgaagacggttcgaccgagggctccaaggttgcgctggtctatggccagatgaacgagccgccgggagcccgttcgcgcgtggctctgacgggtctgtcgctcgcggaatacttccgtgacgaagaaggccaggacgtcctgttcttcgtggacaacatcttccgcttcacgcaggccggttccgaagtctccgcacttctgggccgtatcccctccgcagtgggttaccagccgacgctggccaccgagatgggcgccctgcaggagcgtatcacctccaccaagaagggctccatcacgtccgttcaggccgtgtatgtccctgctgacgatctgaccgatccggctccggcggcaaccttcgcgcatcttgatgctacgacggttctaaaccgttcgatcgctgaaatgggcatctatccggctgtcgatccgctggattccacgtcccgttcgctcgatccgaagatcgttggcgaagagcactaccaggttgcccgtcaggttcagcagacgctccagacctacaagggcctgcaggacatcatcgcgattctcggcatggacgagctgtccgaggacgacaagaagatcgttggccgcgcccgtcgcatccagcgcttcctgtcccagcctttccatgtggctgaagtcttcacgggtgctcccggcaagctggtctcgctcgaagacacgatccgttccttcaaggctgtcgtggccggcgagtacgatcacctgccggaaggcgccttctacatggttggtgacatcgacgaggccattgcgaaggccgagaagatgaagcaggaggcctga

SEQ ID NO: 7155 - protein, 487 aa, Gluconobacter oxydans
MSETLTPSAGAANNVVGRVTQVRGPVVDVQFEGDLPFILNALHVQNGDHTLVLEVAQEIGERQVRCIAMDTTDGLVRGTEVRDTGKQIMVPVGPATLGRILNVVGEPIDERGPISSELRFPIHRPAPSFEEQAAASEILVTGIKVVDLLCPYLKGGKIGLFGGAGVGKTVIIQELINNIAKAHGGVSVFAGVGERTREGNDLYFEMQDAGVIKIAEDGSTEGSKVALVYGQMNEPPGARSRVALTGLSLAEYFRDEEGQDVLFFVDNIFRFTQAGSEVSALLGRIPSAVGYQPTLATEMGALQERITSTKKGSITSVQAVYVPADDLTDPAPAATFAHLDATTVLNRSIAEMGIYPAVDPLDSTSRSLDPKIVGEEHYQVARQVQQTLQTYKGLQDIIAILGMDELSEDDKKIVGRARRIQRFLSQPFHVAEVFTGAPGKLVSLEDTIRSFKAVVAGEYDHLPEGAFYMVGDIDEAIAKAEKMKQEA

SEQ ID NO: 7156 - DNA, 1497 bp, Gossypium hirsutum
  CDS (1)..(1497)
atgaaaataaatcctactacttctgttcctggagtttccacgcttgaaaaagaaaatctggggcgtatttctcaaatcatcggtccagtactggatgtagcctttcccccgggcaagatgcctaatatttacaacgccctagtagttaagggtcaagataccgccggtcaacaaattaatgtaacttgtgaggtacagcaattattaggaaataatcgagttagagctgtagctatgagcgctacagatggtctaacgagaggaatggaagtgattgacacgggagctgctctaagtgttccagtcggcggagcgaccctaggacgaatttttaacgtgcttggggagcccgttgataatttaggtcctgtagatactcgcacaacatcccctattcataaatccgcgcccgctttcatacaattagatacaaaattatctatttttgaaacaggaattaaagtagtcgatcttttagctccttatcgtcgtggaggaaaaatcggactatttgggggggctggggtaggtaaaacagtactcattatggaattgatcaacaacattgccaaagctcatgggggcgtatccgtatttggcggagtaggtgaacggactcgtgaaggaaatgatctttacatggaaatgaaagaatctggagtaattaatgaacaaaatcttgcggaatcaaaagtggctttagtctacggtcagatgaatgaaccgccaggagctcgtatgagagttggattgactgccctaactatggcggaatatttccgagatgttaatgaacaagacgtacttctatttatagacaatatcttccgttttgtccaagcgggatccgaagtatctgccttattgggtagaatgccttccgctgtgggttatcaacccacccttagtaccgaaatgggtactttacaagaaagaattacttctaccaaggagggatccataacttctattcaagcagtttatgtacctgcggatgatttgaccgaccctgcccctgccacaacatttgcgcatttagatgctactaccgtactatcaagaggattagctgccaaaggtatttatccagcggtagatcctttagactcaacgtccactatgctccaacctcgaatcgttggtgaggaacattatgaaactgcgcaaagggttaagcaaaccttacagcgttacaaagaacttcaggacattatagctatccttgggttggacgaattgtccgaagaggatcgcttaaccgtagcaagagcgcgaaaaattgagcgtttcttatcacaaccctttttcgtagcggaagtatttaccggttccccggggaaatatgttggtctagcagaaacaattagaggatttaaattgatcctttccggagaattagacggtcttcctgaacaggccttttatttggtaggtaacatcgacgaagctactgcgaaggctacgaacttagaaatggagagcaaattgaagaaatga

SEQ ID NO: 7157 - protein, 498 aa, Gossypium hirsutum
MKINPTTSVPGVSTLEKENLGRISQIIGPVLDVAFPPGKMPNIYNALVVKGQDTAGQQINVTCEVQQLLGNNRVRAVAMSATDGLTRGMEVIDTGAALSVPVGGATLGRIFNVLGEPVDNLGPVDTRTTSPIHKSAPAFIQLDTKLSIFETGIKVVDLLAPYRRGGKIGLFGGAGVGKTVLIMELINNIAKAHGGVSVFGGVGERTREGNDLYMEMKESGVINEQNLAESKVALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDGLPEQAFYLVGNIDEATAKATNLEMESKLKK

SEQ ID NO: 7158 - DNA, 1497 bp, Helianthus annuus
  CDS (1)..(1497)
atgagaatgaatcctactacttctagttctggggttgccacgcttgacaaaaagaacctggggcgtatcgcccaaatcattggtccggtactagatgtagcctttccgccaggcaaaatgcctaatatttataacgctttggtagttaagggtcgagatactgttggtcaaccaattaatgtgacttgtgaggtacagcaattattaggaaacaatcgagttagagccgtagctatgagtgctacagacggtctaacgagaggaatggacgtaattgatacgggagctccgctaagtgttccggtcggtggagcgactctcggacgaattttcaacgtgcttggggagcctattgataatttaggtcctgtagataatagcacaacatttcctattcatagatccgcgcctgcctttatacagttagatacaaaattatctatttttgaaaccggaattaaagtagtagatcttttagccccttatcgccgtggaggaaaaatcggactattcgggggagctggcgtgggtaaaacagtactcattatggaattgattaacaatattgccaaagctcacggaggcgtatctgtatttggcggagtcggtgaacggactcgtgaaggaaatgatctttacatggaaatgaaagaatctggagtcattaatgaacaaaatattgcagaatcaaaagtggctctagtttacggtcaaatgaacgaaccgccgggagctcgtatgagagttggtttgactgccctaactatggcggaatatttccgagatgttaatgaacaagacgttcttttatttgttgacaatatcttccgttttgtccaagcaggatctgaagtatccgccttgttgggtagaatgccttccgctgtgggttatcaacctacccttagtaccgaaatgggttctttacaagaaagaattacttctaccaaagaagggtccataacttctattcaagctgtttatgtacctgcagatgatttgaccgaccctgctcctgctacgacatttgcacatttagatgctacgaccgtattatcaagaggattggctgccaaaggtatctatccagcagtagatcctttagattcaacgtcaactatgctacaaccccggatcgttggtgacgaacattatgaaactgcacaacaggttaagcaaactttacaacgttacaaagaacttcaagatattatagctattcttggattagacgaattatccgaagaagatcgtttaaccgtagcaagagcgcgaaaaattgagcgtttcttatcacaaccttttttcgtagcagaagtatttacgggttctccgggaaaatatgttggtttagcagaaacaattagaggctttcaattaatcctttccggagaattagatggtcttcccgaacaggccttttatttggtaggtaacatcgatgaagctacggcgaaggctatgaacttagaaatggagagcaattcgaagaaatga

SEQ ID NO: 7159 - protein, 498 aa, Helianthus annuus
MRMNPTTSSSGVATLDKKNLGRIAQIIGPVLDVAFPPGKMPNIYNALVVKGRDTVGQPINVTCEVQQLLGNNRVRAVAMSATDGLTRGMDVIDTGAPLSVPVGGATLGRIFNVLGEPIDNLGPVDNSTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFVDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGDEHYETAQQVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNSKK

SEQ ID NO: 7160 - DNA, 1410 bp, Helicobacter pylori J99
  CDS (1)..(1410): transl_table=11
atgaaagcgatggaaggtaaaatcattcaggttttaggcccggtggtagatgtggagtttgaatcctatctaccggcgatttttgaagcgttagacattaattttgaagtcaatggcactcaaaaggctttagttttagaggtggcagcccatttgggaggtaatcgggtgcgagcgattgctatggatatgacagaaggcttagtgcgtaaccaagccgtcaaagctcgtggcaaaatgattgaagtgcctgtgggcgaagaagtgttagggcgcatttttaatgttgtgggcgagagcattgacaatttagagcctcttaagccgtccttaacttggcccattcacagaaaagcccctagttttgagcaacaaagcactaaaacagaaatgtttgaaaccggtattaaagtcattgacttactcgcaccttattctaagggcggtaaagtaggcttgtttggcggggctggcgtaggcaaaacagtgatcattatggagcttatccacaatgtggcttataagcataacgggtattcggtgtttgcaggtgtgggggagcgcaccagagaagggaacgatctgtattttgagatgaaagaagggggcgttttagacaaagtcgcgctgtgctatgggcaaatgaatgagccaccaggcgcaaggaaccgcatcgcattcaccggcttgacgatggcggagtattttcgtgatgaaaagggattagacgtgttgatgttcattgataacatctttagatacgctcaaagcggtgccgagatgagcgcgctactaggccgtatcccttcagccgtggggtatcagcccacgctagccggggaaatggggaaacttcaagagcgtatcgcttccactaaaaatggctctatcacttcggttcaagcggtgtatgtgccagcagacgacttgactgacccagcccctgcttcagtgtttgcgcatttggatgcgactacggtattgaacagaaagatcgctgaaaaagggatttatccggcagtggatcctttggattccacttcaaggattttaagccctcaaatgattggcgagaagcactatgaaatcgctaccggtatccagcaagttttgcaaaaatacaaggatttgcaagatattattgcgattttgggattggacgaattgagcgaagaggataaaaaaacggttgaaagggccagaaaaattgagaagtttttatcccagccgttttttgtggctgaagtgtttacgggaagtcccggtaaatatgtaacccttcaagagactttagagggctttggagggattttagagggcaaatacgatcacattcctgaaaacgcgttttacatggtgggcagcattcaagaggttttagaaaaagctaaaaacatgaaaaattcctaa

SEQ ID NO: 7161 - protein, 469 aa, Helicobacter pylori J99
MKAMEGKIIQVLGPVVDVEFESYLPAIFEALDINFEVNGTQKALVLEVAAHLGGNRVRAIAMDMTEGLVRNQAVKARGKMIEVPVGEEVLGRIFNVVGESIDNLEPLKPSLTWPIHRKAPSFEQQSTKTEMFETGIKVIDLLAPYSKGGKVGLFGGAGVGKTVIIMELIHNVAYKHNGYSVFAGVGERTREGNDLYFEMKEGGVLDKVALCYGQMNEPPGARNRIAFTGLTMAEYFRDEKGLDVLMFIDNIFRYAQSGAEMSALLGRIPSAVGYQPTLAGEMGKLQERIASTKNGSITSVQAVYVPADDLTDPAPASVFAHLDATTVLNRKIAEKGIYPAVDPLDSTSRILSPQMIGEKHYEIATGIQQVLQKYKDLQDIIAILGLDELSEEDKKTVERARKIEKFLSQPFFVAEVFTGSPGKYVTLQETLEGFGGILEGKYDHIPENAFYMVGSIQEVLEKAKNMKNS

SEQ ID NO: 7162 - DNA, 1410 bp, Helicobacter pylori
  CDS (1)..(1410): transl_table=11
atgaaagcgatggaaggtaaaatcattcaggttttaggccctgtggtagatgtggagtttgaatcctatctgccggcgatttttgaagcgttagacattaattttgaagtcaatggtgttcaaaagtctttagttttagaggtggcagcccatttgggcggtaatcgggtgcgagcgattgctatggatatgacagaaggcttagtgcgtaaccaagtgatcaaggctcgcggcaaaatgattgaagtgcctgtgggcgaagaagtattagggcgtatttttaatgttgtgggcgagagcattgacaatttagagccgcttaagccgtccttaacttggcccattcacagaaaagcccctagttttgagcagcaaagcactaaaacagaaatgtttgaaactggtattaaagtcattgacttactcgcgccttattctaagggcggtaaagtaggcttgtttggtggggctggcgtaggcaaaacggtgatcattatggagcttatccataatgtggcttataagcataacgggtattcggtgtttgcaggtgtgggggagcgcaccagagaggggaatgatctgtattttgaaatgaaagaagggggcgttttagacaaagtcgcactgtgttatgggcaaatgaatgagccaccaggcgcgaggaaccgcatcgcattcaccggcttgacgatggcggagtattttcgtgatgaaaagggcttagatgtgttgatgtttattgacaacatctttagatacgctcaaagcggtgcggaaatgagcgcgctattaggccgtatcccttcagcggtggggtatcagcccacgctagccggggaaatggggaaacttcaagagcgtatcgcttccactaaaaatggctctatcacttccgttcaagcggtgtatgtgccagcagatgacttgactgacccagcccctgcttcggtgtttgcgcatttggatgcgactacggtgttgaatagaaagatcgctgaaaaagggatttatccggcggtggatcctttggattccacttcaaggattttaagccctcaaatgatcggtgagaaacactatgaagtcgctaccggtatccagcaggttttacaaaaatacaaggatttgcaagacattattgcgattttgggattagacgaattgagcgaagaggataaaaaaacggttgaaagggccagaaaaattgagaagtttttatcccagccgttctttgtggctgaagtgtttacaggaagtcctggtaaatatgtaacccttcaagagactttagagggctttggagggattttagagggcaaatacgatcatattcccgagaacgcgttttatatggtgggtagcattcaagaggttttagaaaaagctaaaaacatgaaaaattcctaa

SEQ ID NO: 7163 - protein, 469 aa, Helicobacter pylori
MKAMEGKIIQVLGPVVDVEFESYLPAIFEALDINFEVNGVQKSLVLEVAAHLGGNRVRAIAMDMTEGLVRNQVIKARGKMIEVPVGEEVLGRIFNVVGESIDNLEPLKPSLTWPIHRKAPSFEQQSTKTEMFETGIKVIDLLAPYSKGGKVGLFGGAGVGKTVIIMELIHNVAYKHNGYSVFAGVGERTREGNDLYFEMKEGGVLDKVALCYGQMNEPPGARNRIAFTGLTMAEYFRDEKGLDVLMFIDNIFRYAQSGAEMSALLGRIPSAVGYQPTLAGEMGKLQERIASTKNGSITSVQAVYVPADDLTDPAPASVFAHLDATTVLNRKIAEKGIYPAVDPLDSTSRILSPQMIGEKHYEVATGIQQVLQKYKDLQDIIAILGLDELSEEDKKTVERARKIEKFLSQPFFVAEVFTGSPGKYVTLQETLEGFGGILEGKYDHIPENAFYMVGSIQEVLEKAKNMKNS

SEQ ID NO: 7164 - DNA, 1416 bp, Herpetosiphon aurantiacus
  CDS (1)..(1416): transl_table=11
atggcaactggaaagattttacaaattactggcgtggttatcgacgcagaatttcctgccgatagcctgccacaaatttataacgcgttggaaattcccttgggccaaggccgaccatcgctgatctgcgaagtccaacaacagttgggcgatagcgtcgtgcgcgcggtcgcaatgtccaccaccgacggccttgtccgtgggatggacgttatcaacactggtgcaccaattagcgtgccagtcgggcccgaaaccttgggtcgggtgttcgacgttcaaggtcggccaatcgacggtgaaggcccagttggtacaaccaaaacgatgccaattcaccgcccagctccaaccttcgaagaacaatcaaaccgcgctgagttgttcgaaaccggcatcaaagtcatcgacttgatcgcgccctttaccaagggtggcaaaaccggcgtgttcggcggcgccggcgtgggcaagaccgttattatccaagagttgatctcgaatatcgctaaagaacaatccggttactcggtgttcgcaggcgtaggcgagcgctcacgcgaaggtaacgacttgatccacgaaatgaaggattcgaagattcctggcaccgaccaaaccgtattcgataaaacggtgatggtgttcggccaaatgaacgaaccaccaggagcacgcttgcgggtagcactttcagctttgaccatggctgaatacttccgcgaagaaggccgcgacgtgctgttgttcgtcgataacatcttccgctttacccaagcaggctcggaagtgtcggcgctcttgggccggatgccttcacaggtgggttaccaaccaactcttgggaccgagatgggtgagttgcaagaacgcatcacctcgaccaagactggctcgattacctcgttgcaagcagtctacgtgcctgctgacgactacaccgacccagctccagcaacaacctttgctcacttggatgcaacgatttcgctggaacgctcgatctcggaaaaaggtatctaccctgcggtggacccactggcttcgaccagccggattctcgaccccaacattgtgggcgaagaacactaccgcgtcgcgaccgaagtccaacggatgttgcaacgctacaaagacttgcaagatattattgcaatcttgggtgtcgaagaattgtcagacgacgacaaattgacagtttcccgcgcccgcaagctcgaacgcttcttctcacaaccattcggtgtggctgaagtgtttaccaacattcctggcaagtacgtcgccgttggcgatactgtcaagagctttgcccgcgttctcgctggcgagttcgaccacattcccgaaagcttcttctttatgaagggtcgcatcgacgatgtggtagccgccttcgacgcatcaaagcaataa

SEQ ID NO: 7165 - protein, 471 aa, Herpetosiphon aurantiacus
MATGKILQITGVVIDAEFPADSLPQIYNALEIPLGQGRPSLICEVQQQLGDSVVRAVAMSTTDGLVRGMDVINTGAPISVPVGPETLGRVFDVQGRPIDGEGPVGTTKTMPIHRPAPTFEEQSNRAELFETGIKVIDLIAPFTKGGKTGVFGGAGVGKTVIIQELISNIAKEQSGYSVFAGVGERSREGNDLIHEMKDSKIPGTDQTVFDKTVMVFGQMNEPPGARLRVALSALTMAEYFREEGRDVLLFVDNIFRFTQAGSEVSALLGRMPSQVGYQPTLGTEMGELQERITSTKTGSITSLQAVYVPADDYTDPAPATTFAHLDATISLERSISEKGIYPAVDPLASTSRILDPNIVGEEHYRVATEVQRMLQRYKDLQDIIAILGVEELSDDDKLTVSRARKLERFFSQPFGVAEVFTNIPGKYVAVGDTVKSFARVLAGEFDHIPESFFFMKGRIDDVVAAFDASKQ

SEQ ID NO: 7166 - DNA, 1497 bp, Hordeum vulgare
  CDS (1)..(1497)
atgagaaccaatcctactacttctcgtcccggggtttccacaagtgaagaaaaaagtacaggtcgtatcgatcaaattattggacccgtgctggatgtcacttttcccccgggcaagttaccttatatttataacgctttagtagtccagagtagagacactgccgataagcaaattaatgtgacttgtgaggtacaacaattattaggaaataatcgagttagagctgtagctatgagtgctacggacgggttgatgagaggaatggaagtgattgacacgggagctcctctcagtgttccggtcggtggagctactctcggacgaattttcaacgttcttggggagcctgttgacaatttgggtcctgtagatagtagtgcaacgttccctattcatagatctgcgcctgcctttatcgagttagatacgaaattatccatctttgaaacaggtattaaggtcgtcgatcttttagctccttatcgacgtggaggaaaaataggactatttgggggggctggagtaggtaaaacagtactgatcatggaattaatcaataacattgctaaagctcatgggggcgtatccgtattcggtggagtaggggaacggactcgtgaaggaaatgatctttatatggaaatgaaggaatccggagtaattaatgaaaaaaatattgaagaatcaaaggtagctctagtctatggccaaatgaatgaaccaccgggagctcgtatgagagttggtttaactgccctaactatggcagaatatttccgagatgttaataagcaagacgtgcttttatttatcgataatatctttcgttttgttcaagcaggatcagaggtatccgctttattagggagaatgccctccgcagtgggttatcaacctactcttagtacagaaatgggttctttgcaagaaagaattgcttctactaaaaagggatctataacttcgattcaagcagtttatgtacctgcggacgatttgaccgaccctgcccctgccacaacatttgcacatttggatgctactaccgtactttccagaggattagcttccaagggtatttatccagcagtagatcctttagattcaacatcaactatgttacagcctcggatcgttggcaacgaacattatgaaactgcgcaaagagttaaggaaactttacaacgttacaaagaacttcaggacattatcgcaattcttggcttggatgaattatcggaagaggatcgtttaactgtagcaagagcaagaaaaattgagcgtttcttatcacaaccgttctttgtggcagaagtttttactggttctccaggaaagtatgttgctcttgcggaaactattaggggatttcaactaatcctttccggagaattagacggcctacctgaacaggctttttatttggtgggtaacatcgatgaagctagcacgaaagctataaccttagaagaggagaacaaatcgcagaaatga

SEQ ID NO: 7167 - protein, 498 aa, Hordeum vulgare
MRTNPTTSRPGVSTSEEKSTGRIDQIIGPVLDVTFPPGKLPYIYNALVVQSRDTADKQINVTCEVQQLLGNNRVRAVAMSATDGLMRGMEVIDTGAPLSVPVGGATLGRIFNVLGEPVDNLGPVDSSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERIASTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVALAETIRGFQLILSGELDGLPEQAFYLVGNIDEASTKAITLEEENKSQK

SEQ ID NO: 7168 - DNA, 1386 bp, Idiomarina loihiensis
  CDS (1)..(1386): transl_table=11
atgagtcaaggtaaggtcgtacaaattatcggcgccgttgtggatttagaatttccacaagacgctgtaccaaaagtatacgacgcactgaaagtgaccgaaggtggcttagaaggtttggttctggaagttcagcagcagctgggcggcggaatcgtacgtgccatcgcaatgggtacaactgacggtctgcgtcgtggtatcaccgctaaaaataccggtgaatcaatcatggttccagtgggtaagaaaaccctgggccgtattatggatgtattgggtaacccaattgatgaagcgggccctatcggtgaagaagagaaaatgtctattcaccgtgcggcaccaagctacgaagaacagtcaaacactaacgaactgttagaaaccggtatcaaagtcatcgacttgatttgcccgtttgctaaaggtggtaaagttggtctgttcggtggtgctggtgttggtaaaaccgttaacatgatggagcttatccgtaacatcgctatcgagcacagcggctactcagtattcgctggtgttggtgagcgtactcgtgaaggtaacgacttctatcacgagatgaacgattcaaacgttctggataaagtatcactggtttatggtcagatgaacgagccaccgggtaaccgtttacgtgttgctctgactggtttgactatcgctgagaaattccgtgacgaaggtcgcgatgtacttttcttcgttgataacatctaccgttacaccttggccggtactgaggtatcagcactgttaggccgtatgccttcagcggttggttatcagcctaccctggccgaagaaatgggtgttctgcaggaacgtatcacctctactaagacaggttcaatcacgtctgtacaggccgtttatgtgccagcggatgacttgactgacccatctccggcaacaacctttgctcacttggatgcaaccgttgtacttaaccgtgacatcgcgtcgttgggtatctaccctgcggttgacccgctggactcaacgtcacgtcagttggatccacaggttatcggtgatgagcactacgacacagcaatgggtgttcaggaagtactgcaacgctataaagagctgaaagacatcattgcgattctgggtatggacgagctgtctgaagaagacaaattgtcagtatctcgtgctcgtaaaattcagcgcttcttgtcgcagcctttcttcgtagccgaagtattcactggtgcgccaggtaaatacgtatctttgaaagatactattgccggctttaaaggcattttggacggtgattacgacgatatgccagagcaggccttctacatggttggtaccatcgaagaagcggtagaaaaagccaaaaacctgtaa

SEQ ID NO: 7169 - protein, 461 aa, Idiomarina loihiensis
MSQGKVVQIIGAVVDLEFPQDAVPKVYDALKVTEGGLEGLVLEVQQQLGGGIVRAIAMGTTDGLRRGITAKNTGESIMVPVGKKTLGRIMDVLGNPIDEAGPIGEEEKMSIHRAAPSYEEQSNTNELLETGIKVIDLICPFAKGGKVGLFGGAGVGKTVNMMELIRNIAIEHSGYSVFAGVGERTREGNDFYHEMNDSNVLDKVSLVYGQMNEPPGNRLRVALTGLTIAEKFRDEGRDVLFFVDNIYRYTLAGTEVSALLGRMPSAVGYQPTLAEEMGVLQERITSTKTGSITSVQAVYVPADDLTDPSPATTFAHLDATVVLNRDIASLGIYPAVDPLDSTSRQLDPQVIGDEHYDTAMGVQEVLQRYKELKDIIAILGMDELSEEDKLSVSRARKIQRFLSQPFFVAEVFTGAPGKYVSLKDTIAGFKGILDGDYDDMPEQAFYMVGTIEEAVEKAKNL

SEQ ID NO: 7170 - DNA, 1518 bp, Kluyveromyces lactis
  CDS (1)..(1518)
atggtcttgccaagattttatgctgcttcatctcgtgcagctttgcaagctgcgagacgtgctgttcccttcaccggtgtgagaggttatgctgctgctgcctcttctcaaggtaaggttagagccgttattggtgctattgttgatgttcaatttgaacaaggtcaattgccagctattttgaacgctttggaaatcgacactccagaaggaaagttggttttggaagtcgctcaacatttgggtgaaaacactgtcagaaccattgctatggatggtactgaaggtttagtccgtggtgaaaacgtttctgacactggtgctccaatttccgtcccagttggtagagaaaccttgggtagaattatcaacgttattggtgagccaattgacgaaagaggtccaatcaactccaagatgagaaagccaattcatgctgatcctccattattcgttgaacaatccactgctgctgaagttttggaaactggtatcaaggttgtcgacttgttggccccatacgccagaggtggtaagattggtttgttcggtggtgccggtgtcggtaagaccgttttcatccaagaattgattaacaacattgccaaggctcatggtggtttctctgtcttcactggtgtcggtgaaagaaccagagaaggtaacgatttgtaccgtgaaatgaaggaaactggtgttatcaacttggaaggtgattctaaggtcgcgttggttttcggtcaaatgaacgaacctcctggagctagagctagagtcgccttgactggtttgaccatcgctgaatacttcagagatgaagaaggtcaagatgtcttgttgtttatcgacaacattttcagattcacacaagccggttccgaagtgtccgctttgttgggtcgtattccatccgctgtcggttatcaaccaactttggccaccgatatgggtttgttgcaagaaagaattactaccaccaagaagggttccgtcacttctgtccaagccgtttacgtgccagctgatgatttgactgatcctgctccagctaccactttcgcgcatttggatgccaccactgtgttgtccagagggatctctgaattgggtatctacccagctgtcgatcctttggattccaaatctagattgttggatgctgccgtcgttggtcaagaacattacgatgtcgctactcaagttcaacaaactttgcaagcttacaagtctttgcaagatatcattgccattttgggtatggatgaattgtccgaacaagataagttgaccgtcgaaagagctagaaagattcaaagattcttgtctcaacctttcgctgtcgctgaagtcttcactggtatcccaggtagattggtcagattaaaggacaccatctcttctttcaaggctgtcttggacggtaagtacgatcacttgccagaaaacgccttctacatggttggtggtattgaagatgttgttgctaaggctgaaaagttggctgctgaagctaattaa

SEQ ID NO: 7171 - protein, 505 aa, Kluyveromyces lactis
MVLPRFYAASSRAALQAARRAVPFTGVRGYAAAASSQGKVRAVIGAIVDVQFEQGQLPAILNALEIDTPEGKLVLEVAQHLGENTVRTIAMDGTEGLVRGENVSDTGAPISVPVGRETLGRIINVIGEPIDERGPINSKMRKPIHADPPLFVEQSTAAEVLETGIKVVDLLAPYARGGKIGLFGGAGVGKTVFIQELINNIAKAHGGFSVFTGVGERTREGNDLYREMKETGVINLEGDSKVALVFGQMNEPPGARARVALTGLTIAEYFRDEEGQDVLLFIDNIFRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDAAVVGQEHYDVATQVQQTLQAYKSLQDIIAILGMDELSEQDKLTVERARKIQRFLSQPFAVAEVFTGIPGRLVRLKDTISSFKAVLDGKYDHLPENAFYMVGGIEDVVAKAEKLAAEAN

SEQ ID NO: 7172 - DNA, 1514 bp, Lactobacillus casei
  CDS (55)..(1467): transl_table=11
ctccgacttctaagcgcgctggttcacgctcacttttacaacaggaggacgaatatgccaaattcaactggtaaaatcgcgcaagtgatcggtcctgttgtcgacgtagccttcccaatcaatgacaatttgccagaaattaacaacgccttgacgattacccgtaaggacggctctcagcttgtgctggaagttgcgctggaactgggtgatggtgtgatgcggactatcgcgatggattcgactgatggtttgcaacgcggcatggcggttgaagatactggcggtccgatttcagtgcctgtcggtaaagacacactgggtcgcgtgttcaatgtattgggtgacccgatcgatgacggtgaggctttggacctgaatcatcggcgtgacagcatccaccgtgatgcaccaaaatttgaagatttgaataccagttctgagattctggaaactggcatcaaagtcatcgatttgctcgaaccttacctgcgaggcgggaaggttggacttttcggtggtgctggtgttggtaaaaccgttttgattcaggaactgattcataacattgctgaagagcatggcggcatctccgtcttcaccggggtcggcgaacggacccgtgaagggaacgacctttacttcgaaatgaaggaaagcggcgttatggagaatacagcgatggtctttggtcagatgaatgagccgcctggtgcccggatgcgggttgccttgactggactgacgattgcggagtacttccgtgatgtcgaaggtcaagacgtcctgctgttcatcgacaacattttccggttcacccaggctggttctgaagtttcggccttgcttggtcggattccttcagctgttggttatcagccaacgttggctactgaaatgggtcagttgcaggaacggattacgtcgactaaaaaaggatcggttacatcgattcaggcgatttatgttcctgctgatgactataccgatccggcgccacggacaacatttgcccatttggatgccacgactaacttggagcggcgtttgactgaacaagggatttatccggctgtggatccgctggagtcatcttcaagtgctttgaccccggaaattgtcggtgaagaacactataaagtcgcaacagaagtccaacaggttctccaacgttaccgtgagttacaggatattatctctatcttagggatggatgaattatcagacgaggaaaaggttatcgttgcccgtgctcgtcgggttcaattcttcctgtcacagaactttaacgttgcggaacggttcactggtcagccgggttcttatgtaccggttgaagaaacggtcaaaggctttaaacaaattctggaaggcaagtacgatgactatccagaagatgcattccgttcagttggacggattgaagaagtcgttgaaaaggctaaaaagatgggctttgctccctgatgatcaggacacggatgctgacgaaaagccagctgcacaagctgcag

SEQ ID NO: 7173 - protein, 470 aa, Lactobacillus casei
MPNSTGKIAQVIGPVVDVAFPINDNLPEINNALTITRKDGSQLVLEVALELGDGVMRTIAMDSTDGLQRGMAVEDTGGPISVPVGKDTLGRVFNVLGDPIDDGEALDLNHRRDSIHRDAPKFEDLNTSSEILETGIKVIDLLEPYLRGGKVGLFGGAGVGKTVLIQELIHNIAEEHGGISVFTGVGERTREGNDLYFEMKESGVMENTAMVFGQMNEPPGARMRVALTGLTIAEYFRDVEGQDVLLFIDNIFRFTQAGSEVSALLGRIPSAVGYQPTLATEMGQLQERITSTKKGSVTSIQAIYVPADDYTDPAPRTTFAHLDATTNLERRLTEQGIYPAVDPLESSSSALTPEIVGEEHYKVATEVQQVLQRYRELQDIISILGMDELSDEEKVIVARARRVQFFLSQNFNVAERFTGQPGSYVPVEETVKGFKQILEGKYDDYPEDAFRSVGRIEEVVEKAKKMGFAP

SEQ ID NO: 7174 - DNA, 1404 bp, Lactobacillus plantarum
  CDS (1)..(1404): transl_table=11
atgagtacaggtaaagttgtacaagttattggacccgttgttgacgttgaattctctctaaacgataagttacccgatattaataacgccttgatcattcagaaggacaacgatgacactttaacggtggaagtatcgttggaattaggtgatggggttgttcggaccgtcgcgatggatggtacggatggcttgcgccggggaatgacagttgaagacactggttcttcaattactgttcccgttggtaaagagacgttaggccgggtcttcaacgttttaggggaaaccattgatggtggtccagaattcggtccagacgcagaacgtaacccgattcatcgggatgcgcctaaatatgatgaattaacgaccagtactgaagtattggaaactggaattaaagttattgacctcttagcaccttatgttcgtggtggtaagattgggttgttcggtggtgccggtgttggtaaaactgttttaatccaggaattaattcataacattgcccaagaacataacgggatttccgtgtttaccggtgttggtgaacggacgcgtgaagggaatgacctttacttcgaaatgaaggcttccggcgttttgaagaataccgccatggtttatggtcaaatgaacgaaccacctggtgcccggatgcgggtggccttgaccggtttgacgattgcggaatacttccgtgatgttcaaggtcaagacgtgttgttattcatcgacaatatcttccggttcacgcaagctggttctgaagtttccgccttacttggtcggattccttcagccgttggttaccaaccaaccttagccactgaaatgggtcaattacaagaacggatcacttctaccaagaaggggtcagttacttcgattcaagccgtttatgtacctgccgatgattataccgacccggcacctgcaacgactttcgcccatttggatgcgacgaccaacttggaacgttctttgacggaacaagggatctacccagccgttgacccattagcttcttcttcaatcgctctggacccatcaatcgtgggcgaagaacattatcaagttgcaacggaagttcaacgggtcttgcaacgttatcgtgaattgcaagatattatctcgattttagggatggatgaattatctgacgaagaaaagacaactgttgcgcgtgcacggcggattcaattcttcttgtcacaaaacttcttcgttgccgaaaactttacgggccaacctggttcgtatgtgccaatcaacgataccatcaagggcttcaaagaaattcttgaaggtaaatatgatgacctaccagaagacgcattccgtcaagttggtaagatcgacgacgtggtcgaaaaagcgaaatcgatggtaactgattag

SEQ ID NO: 7175 - protein, 467 aa, Lactobacillus plantarum
MSTGKVVQVIGPVVDVEFSLNDKLPDINNALIIQKDNDDTLTVEVSLELGDGVVRTVAMDGTDGLRRGMTVEDTGSSITVPVGKETLGRVFNVLGETIDGGPEFGPDAERNPIHRDAPKYDELTTSTEVLETGIKVIDLLAPYVRGGKIGLFGGAGVGKTVLIQELIHNIAQEHNGISVFTGVGERTREGNDLYFEMKASGVLKNTAMVYGQMNEPPGARMRVALTGLTIAEYFRDVQGQDVLLFIDNIFRFTQAGSEVSALLGRIPSAVGYQPTLATEMGQLQERITSTKKGSVTSIQAVYVPADDYTDPAPATTFAHLDATTNLERSLTEQGIYPAVDPLASSSIALDPSIVGEEHYQVATEVQRVLQRYRELQDIISILGMDELSDEEKTTVARARRIQFFLSQNFFVAENFTGQPGSYVPINDTIKGFKEILEGKYDDLPEDAFRQVGKIDDVVEKAKSMVTD

SEQ ID NO: 7176 - DNA, 1497 bp, Lactuca sativa
  CDS (1)..(1497)
atgagaatgaatcctactacttctggttctggggttaccacgcttgacaaaaagacactggggcgtatcgcccaaatcattggtccggtactagatgtagcctttccgccaggcaaaatgcctaatatttataacgctctggtagttaagggtcgagatactgctggtcaaccaattaatgtgacttgtgaggtacagcaattattaggaaacaatcgagttagggccgtagctatgagtgctacagatggtctaacgagagggatggacgtaattgatacgggagctccactaagtgttccggtcggtggagcgactctcggacgaattttcaacgtgcttggcgagcctgttgataatttaggtcctgtagatactagtacaacatttcctattcatagatctgcgcctgcctttatacagttagatacaaaattatctatttttgaaaccggaattaaagtagtagatcttttagccccttatcgccgtggaggaaaaatcggactattcgggggagctggcgtgggtaaaacagtactcattatggaattgattaacaatattgccaaagctcacggaggcgtatctgtatttggcggagtcggtgaacggactcgtgaaggaaatgatctttacatggaaatgaaagaatctggagtaattaatgaaaaaaatattccagaatcaaaagtagctctagtttacggtcagatgaatgaaccgccgggagctcgtatgagagttggtttgactgccctaactatggcggaatatttccgagatgttaatgaacaagatgtacttttatttattgacaatatcttccgttttgtccaagcaggatctgaagtatccgccttgttgggtagaatgccttccgctgtgggttatcaacctacccttagtaccgaaatgggttctttacaagaaagaattacttctaccaaagaagggtccataacttctattcaagctgtttatgtacctgcagatgatttgaccgaccctgctcctgctacgacatttgcacatttagatgctactaccgtactatcaaggggattagccgccaaaggtatctatccagcagtagatcctttagattcaacgtcaactatgctacaaccccggatcgttggtgaagaacattatgacactgcacaagaggttaagcaaactttacaacgttacaaagaacttcaagatattatagctattcttggattggacgaattatccgaagaggatcgtttaaccgtagcaagagcgcgaaaaattgagcgtttcttatcacaacctttttttgtagcagaagtatttacgggttctccgggaaaatatgttggtttagcagaaacaattagaggctttcaattaatcctttccggagaattagatggtcttcctgaacaggctttttatttggtaggtaacatcgatgaagctacggcgaaggctatgaacttagaaatggagagcaatttgaagaaatga

SEQ ID NO: 7177 - protein, 498 aa, Lactuca sativa
MRMNPTTSGSGVTTLDKKTLGRIAQIIGPVLDVAFPPGKMPNIYNALVVKGRDTAGQPINVTCEVQQLLGNNRVRAVAMSATDGLTRGMDVIDTGAPLSVPVGGATLGRIFNVLGEPVDNLGPVDTSTTFPIHRSAPAFIQLDTKLSIFETGIKVVDLLAPYRRGGKIGLFGGAGVGKTVLIMELINNIAKAHGGVSVFGGVGERTREGNDLYMEMKESGVINEKNIPESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYDTAQEVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESNLKK

SEQ ID NO: 7178 - DNA, 1404 bp, Leptospira interrogans
  CDS (1)..(1404): transl_table=11
atgaataaaggtaaaatcaagcagatcatcggttccgttttggatatcgaatttgaaaacggagaacttccagaaatttataacgcattggaaatcgaaacgaacgttttcggaaaaaaggaaacgattatcgccgaggttcaaacccatatcggaggaaaagcggtgcgtgcgattgcactttcttctacagatggtttgatccgaggacaagaagtttccaatacaggaaaaccgatcagtgttcctgtaggagacgcaacactcggaagaatttttaacgttctaggtaaaaccatcgacgaaggtcccgcgattaccgtaaaggaaacccgtccgattcacagagccgctccttctttcgacgagctcacttctaaaaccgaagtatttgaaaccggaattaaggtgatcgatcttctcgctccttatatcaagggtggaaagacagggctcttcggaggtgctggagtaggtaagacagttctcattcaggaactcatcaacaatatcgccaaacaacacggtggattttccgtgtttgctggagtaggagaaagaacccgcgaaggaaacgatctctggagagagatgaaggaatctggagtaattgataaaacagttctttgttacggtcagatgaacgaacctcctggtgctcgtttaagagttgcgttatccgctcttacaatggcggaacattttcgtgattctattggaaccgacgttcttcttttcgtagataatatatttcgtttttcgcaagctggttcggaagtttctgcgcttctcggaagaatgccttctgccgtgggttaccaacctacactttctaccgaaatgggtgcgcttcaagaaagaattacatctactaaaaaaggatcaatcacttctgttcaggcgatttacgttcctgcagacgacttgaccgacccggctcctgcaaacgcgtttgctcacttggacgcaaccacggttctttctcgtgctatttccgataaaggaatttatcctgcagtggatcctctggattctacttccagagtaatgaatgctcaggttctgggagaagaacactatttagtcgctcgggaagttcagagaattctgcaaagatataaagacttacaagatattattgccattttgggaatggatgaactttctgaagacgataaagtgctcgtagctagagcgcgaaaaatagaaaaattcctttctcaaccttttcatgtggcggaagtttttacaggagctcctggaaaatacgtaaaacttgcggatacggttcgttcttttaaagaagtgatttctggaaactatgatcaccttccagaacaagctttttatatggttggttctatagacgatgccatcgaaaaagcaaaaggttacaaaggataa

SEQ ID NO: 7179 - protein, 467 aa, Leptospira interrogans
MNKGKIKQIIGSVLDIEFENGELPEIYNALEIETNVFGKKETIIAEVQTHIGGKAVRAIALSSTDGLIRGQEVSNTGKPISVPVGDATLGRIFNVLGKTIDEGPAITVKETRPIHRAAPSFDELTSKTEVFETGIKVIDLLAPYIKGGKTGLFGGAGVGKTVLIQELINNIAKQHGGFSVFAGVGERTREGNDLWREMKESGVIDKTVLCYGQMNEPPGARLRVALSALTMAEHFRDSIGTDVLLFVDNIFRFSQAGSEVSALLGRMPSAVGYQPTLSTEMGALQERITSTKKGSITSVQAIYVPADDLTDPAPANAFAHLDATTVLSRAISDKGIYPAVDPLDSTSRVMNAQVLGEEHYLVAREVQRILQRYKDLQDIIAILGMDELSEDDKVLVARARKIEKFLSQPFHVAEVFTGAPGKYVKLADTVRSFKEVISGNYDHLPEQAFYMVGSIDDAIEKAKGYKG

SEQ ID NO: 7180 - DNA, 1422 bp, Listeria innocua
  CDS (1)..(1422): transl_table=11
atgtctaaaggacaagtaatccaagttatgggtccggttgtagacgttaaatttgaaggtggaaacttacctgaaatctacaacgccctagttattgaatataaatctgatgcagaagaagcaccaactagccaacttactttagaagtagccatccaattaggtgatgacgttgtgcgtacaatcgcaatggcatcaacagatggtgttcaaagaggtatggaagttattgatactgggagcccaattaccgttccagttggtacagtaactcttggtcgtgtatttaatgtattaggaaacaccatcgatttggacgaaccacttccaagcgatattaaacgtaataaaattcaccgcgaagcaccaactttcgatcaattagcaacaacaacagaaattcttgaaacaggaattaaagtagttgacttgctagctccatacttaaaaggtggtaaaatcggactgttcggtggtgccggtgtaggtaaaaccgttctaattcaagagcttatccataatatcgcacaagaacacggtggtatttcagtgttcgcaggcgttggagagcgtactcgtgaagggaacgacctttactttgaaatgaaagattctggtgttattgaaaaaacagcgatggtattcggtcaaatgaatgagccaccaggtgcgcgtatgcgtgtagccttaactggtttaacaattgctgaatatttccgtgatgaagagcaccaagatgtacttttattcattgataacattttccgtttcacacaagctggttcagaggtttcggctttactaggtcgtatgccatctgcggtaggttaccaaccaaccctagctactgaaatgggtcaattacaagaacgtattacatctactaacgttggatccgttacttctatccaagcgatttatgtgccagccgatgactatactgaccctgctccggctacaactttcgcccatttagatgcaacaactaacttggaacgtaaattaacggaacaaggtatttatccagcggtagatccacttgcttctacatcccgtgctctttctcctgatatcgtaggtgaagaacactatgaagtagcaacggaagtacaacgtttactacaaagatataaagaacttcaagacattatcgctatccttggtatggatgagttatctgatgaagataaacaatcggtttctcgtgcgcgtcgtgtacaattcttcttatctcaaaatttccacgttgcagaacaatttacaggccaaaaaggttcttatgtccctgttaaagaaacagttaaaggattcaaagacttattagccggaaaatacgaccatattcctgaagatgcattccgttcagttggacgtattgaggatgttcttgaaaaagcaaaagatatgggcgttgaagtctga

SEQ ID NO: 7181 - protein, 473 aa, Listeria innocua
MSKGQVIQVMGPVVDVKFEGGNLPEIYNALVIEYKSDAEEAPTSQLTLEVAIQLGDDVVRTIAMASTDGVQRGMEVIDTGSPITVPVGTVTLGRVFNVLGNTIDLDEPLPSDIKRNKIHREAPTFDQLATTTEILETGIKVVDLLAPYLKGGKIGLFGGAGVGKTVLIQELIHNIAQEHGGISVFAGVGERTREGNDLYFEMKDSGVIEKTAMVFGQMNEPPGARMRVALTGLTIAEYFRDEEHQDVLLFIDNIFRFTQAGSEVSALLGRMPSAVGYQPTLATEMGQLQERITSTNVGSVTSIQAIYVPADDYTDPAPATTFAHLDATTNLERKLTEQGIYPAVDPLASTSRALSPDIVGEEHYEVATEVQRLLQRYKELQDIIAILGMDELSDEDKQSVSRARRVQFFLSQNFHVAEQFTGQKGSYVPVKETVKGFKDLLAGKYDHIPEDAFRSVGRIEDVLEKAKDMGVEV

SEQ ID NO: 7182 - DNA, 2560 bp, Zea mays
  CDS (539)..(2035)
gaattcgataggaattgagttgttgttatggtaagttaacacggttcgttattaaaccgtgatttgattcaccaaatccatcattattgtatactctttgatagatatagcgcaacccaaaccctaatctttattttacaatttttaaagttcttcccctttgatattttgaatctaaatacctaaatactaagaaaattctctgttgacagcaatctatgcttcacagtagtatatattttgtatatcgaagtcctagataggaaagtagagtaggcacagatccttcacaaaaggcgaaatttatatgaaaaaaatggattgaactttccaacggattcattccataagtaaacgattgaatgggattcgcttgggcaacgaaatcaagtgcgagtccccttttcttttttattgaattaactaattcatttccttttgacttttggatttttggatattttttttgatttggcattattcaacaagaaaaaaaatttcgacaaattcttttttttttgaaaattatgtgataattatgagaaccaatcctactacttcgcgtcccgggatttccacaattgaagaaaaaagcgtagggcgtattgatcaaattattggacccgtgctggatatcacttttcccccgggcaagttgccttatatttataatgctttgatagtcaagagtcgagacactgccgataagcaaattaatgtgacttgtgaggtacaacaattattaggaaataatcgagttagagctgtggctatgagtgctacagaggggttgatgagaggaatggaagtgattgacacgggaactcctctcagtgttccagtcggtggagctactctcggacgaatttttaacgttcttggggagcctattgacaatttgggtcctgtggatactagtgcaacatttcctattcatagatctgcgcctgcctttatcgagttagatacgaaattatctatctttgaaacaggtattaaggtggtcgatcttttagctccctatcgacgtggaggaaaaatcggactgtttgggggggcaggagtaggtaaaacagtactcatcatggaattaatcaataacattgctaaagctcatggaggcgtatccgtatttggcggagtaggggaacggactcgtgaaggaaatgatctttatatggaaatgaaggaatccggagtaattaatgaaaaaaatattgaggaatcaaaggtagctctagtctatggccaaatgaatgaaccgccgggagctcgtatgagagttggtttaactgccctaactatggcagaatatttccgagatgttaataagcaagacgtgcttttattcatcgataatatctttcgttttgttcaagcaggatcggaagtatccgccttattaggcagaatgccctccgcagtgggttatcaacctacccttagtacagaaatgggttctttgcaagaaagaattacttctaccaaaaagggatctataacttcgatccaagcagtttatgtacctgcagacgatttgaccgaccctgctcctgccacaacatttgcacatttggacgctactaccgtactttccagaggattagcttccaagggtatttatcccgcagtggatcctttagattcaacctcaactatgttacagcctcggattgttggcaacgaacattatgaaactgcgcaaagagttaaggaaactttacaacgttacaaagaacttcaggacattatcgcaattcttggattggatgaattatcggaggaggatcgtttaactgtagcaagagcacgaaaaatcgagcggttcttatcacaaccgttctttgtggcagaagtttttaccggttctccaggaaagtatgttggtcttgcagaaacaattaggggatttcaactaatcctttccggagaattagacggcctacccgaacaggctttttatttagtggggaacatcgatgaagctagcacgaaagctataaacttagaagaggagagcaaattgaagaaatgaaattaaatctttatgtactgactcctaaacgaattatttgggattgtgaagtgaaagaaatcattttatctactaatagtggccaaattggtgtattaccaaaccacgcccccattaacacagctgtagatatgggtcctttgagaatacgcctcctgaacgaccaatggttaacggcggttctgtggagtggttttgcaagaatagttaataatgagatcatcattttaggaaatgatgcagaactgggtagtgacattgatccagaagaagctcaacaggcacttgaaatagccgaagctaacttgagtaaagctgaaggtacgaaagaattggttgaagcgaagctagctctcagacgagctaggatacgagtcgaggctgtcaattggattcccccatccaattgatgaagacaatccaaagatttcgttgatacaaagaaaaaggaaagaagggtagaaaaagttattagatagcgaagcgaagtaagtccaatgctatctagtaatttttctacctacc

SEQ ID NO: 7183 - protein, 498 aa, Zea mays
MRTNPTTSRPGISTIEEKSVGRIDQIIGPVLDITFPPGKLPYIYNALIVKSRDTADKQINVTCEVQQLLGNNRVRAVAMSATEGLMRGMEVIDTGTPLSVPVGGATLGRIFNVLGEPIDNLGPVDTSATFPIHRSAPAFIELDTKLSIFETGIKVVDLLAPYRRGGKIGLFGGAGVGKTVLIMELINNIAKAHGGVSVFGGVGERTREGNDLYMEMKESGVINEKNIEESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLASKGIYPAVDPLDSTSTMLQPRIVGNEHYETAQRVKETLQRYKELQDIIAILGLDELSEEDRLTVARARKIERFLSQPFFVAEVFTGSPGKYVGLAETIRGFQLILSGELDGLPEQAFYLVGNIDEASTKAINLEEESKLKK

SEQ ID NO: 7184 - DNA, 1377 bp, Mannheimia succiniciproducens
  CDS (1)..(1377): transl_table=11
atgtcagcaggaaaaattgtacagattatcggtgcggtaatcgacgttgaattcccagaaaatgcagtaccaaaagtttacgacgcattaaaagttgcggaaggcggtttaacccttgaagtgcaacaacaattaggtggcggtatcgttcgttgtatcgcaatgggttcttccgacggtttaaaacgcggtttaagtgtcagtaatacggggaaacctatttccgtacccgtaggaactaaaactttgggccgtattatgaatgtacttggagaaccggtagacgaacaaggtccaatcggcgcagaagaagaatgggctatccatcgtgaagcgccaagttacgaagaacaatcaaacagtactgaacttttggaaacgggtattaaagttatcgacttgatctgtccgttcgctaagggtggtaaagtaggtctgttcggtggtgcgggtgttggtaaaaccgttaacatgatggaattaatccgtaacatcgcaatcgaacactcgggtttctccgtatttgccggtgtaggcgaacgtactcgtgaaggtaacgacttctaccatgaaatgacggattctaacgtattggataaagtatcactggtgtatggtcagatgaatgagccgccgggtaaccgtctacgcgtggctttaacaggcttaactatggcggaaaaattccgtgatgaaggccgtgatgtattgttcttcgtggataatatttatcgttatactcttgccggtacagaagtatccgcattgttgggccgtatgccttctgcggttggttatcagccgacgttagcggaagaaatgggggtattacaagaacgtattacatccaccaaaaccggttccattacttctgtgcaggcggtttacgtgccggcggacgacttaaccgacccgtctcctgcaacaacttttgctcacttggactcaaccgtagtattaagccgtaatatcgcatctttaggtatttatccggctgttgacccgttagattccacttcacgtcagcttgatccgcaagtagttggtcaagaacattacgatgtggcgcgcggtgtacagggtattctacagcgttacaaagaattgaaagatattattgcgattcttggtatggacgagctttcggaagacgataaattagtggtagcgcgtgcgcgtaaaattgaacgtttcttatcacaaccgttcttcgttgctgaagtatttaccggttcaccgggtaaatacgtatcattgaaagataccattcgtggttttaaaggtattcttgaaggcgaatacgaccatattccggaacaggcgttctatatggtaggttcaatcgaagaagttgttgaaaaagcgaaaaatatgtaa

SEQ ID NO: 7185 - protein, 458 aa, Mannheimia succiniciproducens
MSAGKIVQIIGAVIDVEFPENAVPKVYDALKVAEGGLTLEVQQQLGGGIVRCIAMGSSDGLKRGLSVSNTGKPISVPVGTKTLGRIMNVLGEPVDEQGPIGAEEEWAIHREAPSYEEQSNSTELLETGIKVIDLICPFAKGGKVGLFGGAGVGKTVNMMELIRNIAIEHSGFSVFAGVGERTREGNDFYHEMTDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPQVVGQEHYDVARGVQGILQRYKELKDIIAILGMDELSEDDKLVVARARKIERFLSQPFFVAEVFTGSPGKYVSLKDTIRGFKGILEGEYDHIPEQAFYMVGSIEEVVEKAKNM

SEQ ID NO: 7186 - DNA, 2444 bp, Medicago sativa
  CDS (538)..(2010)
gagcctcttatttttttaatttttgatttttttattctcaataataaaaaatttactcttgaccttgacagtgatatatgttgtatatgtaaatcctagatgaaaaaatgggcagaattcgcccacgaaaagaaaaataggtaaaaaaattggctaagtataaatcctatgtatgctgaggaaataaaaaatgagatagaaaaactgaatcgtaaacaaagtttaggttcgaattccatagataatatagatagtattgtctataatctataatgataaacaaatgaaagactttcaaaagatttcatccaattcaaattttcataatgactgggttgactttgaaaatgcattcattgaaattgaattggttgggtggtaccaagaaaatcgattattaacttacatttcttattaaatattaattaatattaaatattaattaaattaactgatcaacttgctttgttatcaaacatttttttcttgatttcaatttttttttttgaaaaaaaaaaaaaacggatatattttaatatgagactaactcctaccacttcggatactgaggtttctggacttgaaaaaaaaaatctaggacgtatcacgcaaataattggtccggtactcgatgtagttttttcaccagggaagatgcctaatatttacaacgctctgatagttcaaggtcgagatactgttggacaagaaattaacgtaacttgtgaagtacagcaattattaggaaataatagagttagagctgtagctatgagtgctacagatggtctaaagagaggaatggatgtgattgacacgggagctcccctaagtgttccagtcggcggagcaaccctaggtcgaattttcaacgtgcttggagagcctattgataatttaggtcctgtagatactggcacaacatctcctattcatagatccgcgcctgcctttatacagttagatacaaaattatccatttttgaaacaggaattaaagtagtagatcttttagctccttatcgccgtggcggaaaaataggacttttcggtggagctggggtaggtaaaacagtactgattatggaattgatcaataacattgccaaagctcatggaggtgtatccgtatttggcggagtaggtgagcgtactcgtgagggaaatgatctttatatggaaatgaaagaatccggagtcattaatgaaaaaaatattgcggaatcaaaagtagctctagtctacgggcaaatgaatgaaccccccggagctcgtatgagagttggtttaactgccctaactatggcagaatatttccgagatgtcaatgaacaggacgtccttctatttatcgacaatatcttccgttttgtccaagccggatccgaagtatctgccctattgggccgaatgccttccgctgtgggttatcaacccaccctgggtactgaaatgggtactttacaagaacgaattacttctaccaaagaagggtctataacttctattcaagcagtttatgtacctgcagacgatttgaccgatcctgctcctgccacgacatttgcacatttggatgctactactgtactatcaagaggattagcttccaaaggtatctatccagcagtcgatcctttagattcaacgtcaaccatgctccaacctcggatcgttggtgaagaacattatgaaactgcgcaaagggttaaacaaacgttacaacgttacaaagaacttcaggacattatagctattcttgggttggacgaattatccgaagaggatcgtttaaccgtagcaagagcacgaaaaattgaacgtttcttatcccaaccttttttcgtagcagaagtatttacaggttccccagggaaatatgttggtctagcagaaacaattagagggtttaaattgattctttctggagaattagatagtcttcctgaacaagccttttatttggtgggtaatatcgatgaagctactgcgaaggctgcgaacttgtaaatggagaacaaattcaagaaatgactttaaatctttgtgtactgacccccaatcgaactgtttgggattcagaagtgaaggaaattattttatctactaatagtggacaaattggggtattaaaaaatcatgcgcctattgccacagctttagatataggtattttgaaaatacgccttaccaaccaacaatgggtaacgatggctctgatgggcggttttgctagaataggcaataatgagatcactattttagtaaatgatgcggaaaagagcattgacattgatccacaagaagcacaacaaactctaaaaatagcagaagctaacttgaataaggctgaagggaaaagacaaacaattgaggcaaatctagctctccgacgagctaggacacgagtagagactatactagagtctatcaataggttctag

SEQ ID NO: 7187 - protein, 490 aa, Medicago sativa
MRLTPTTSDTEVSGLEKKNLGRITQIIGPVLDVVFSPGKMPNIYNALIVQGRDTVGQEINVTCEVQQLLGNNRVRAVAMSATDGLKRGMDVIDTGAPLSVPVGGATLGRIFNVLGEPIDNLGPVDTGTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEKNIAESKVALVYGQMNEPPGARMRVGLTALTMAEYFRDVNEQDVLLFIDNIFRFVQAGSEVSALLGRMPSAVGYQPTLGTEMGTLQERITSTKEGSITSIQAVYVPADDLTDPAPATTFAHLDATTVLSRGLASKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFKLILSGELDSLPEQAFYLVGNIDEATAKAANL

SEQ ID NO: 7188 - DNA, 1383 bp, Methylococcus capsulatus
  CDS (1)..(1383): transl_table=11
atgagttctgggaaaatcgtacagatcatcggcgcggtggtcgacgcggaatttccgcgcgaatccttaccgaagatttacgacgcattgcgcgtcgacgaggtcggcctcgtcctggaagtccagcagcagctgggcgacggtgtggtgcgctgcatcgccatgggttccaccgacggggtccggcgcggcgtcacggtgaccaacaccggtgcgccgatctcggtaccggtgggcacggagaccttgggtcgcatcatgaacgtgctgggcgatcccatcgacgagaagggaccgatcggcgagaaggaacgctggggcatccaccgcaaggcgccttcctatcaggaccaggcggccgccaacgaattgctggagaccggcatcaaggtgatcgacctgatctgcccgttcgccaaaggcggcaaagtcgggctgttcggtggcgccggcgtgggcaagaccgtcaacatgatggagctgatccgcaacatcgccatcgaacacagcggctactcggtgttcgcgggcgtaggcgaacgtacccgtgagggtaacgacttctaccacgaaatgaaggaatccaacgttctcgacaaggtgtcgctggtttacggccagatgaacgaaccgccgggcaaccgtctgcgcgtggctctgaccggcctgaccatcgccgagaagttccgcgacgaaggccgtgacgtgctgctgttcatcgacaacatttaccgctacaccctggcgggtacggaagtgtcggccctgctcgggcgcatgccttcggccgtgggttaccagcccaacctggcggaggaaatgggtattctgcaggagcgcatcacctccaccaagaccggttccatcacgtctatccaggccgtgtacgttccggccgacgacttgaccgacccgtctccggcgaccaccttcgcgcatctcgacgccaccgtcgtgctgtcgcgccagatcgccgagctgggtatctacccggcggtcgatccgctggattccaccagccgccagctcgatccgctggtaatcgggcacgagcattacgagacgacccgccgggtgcagagcactctgcagcgctacaaggagctgcgcgacatcatcgccatcctcggcatggacgagctgtcggaaaacgacaagctgatcgtctcgcgcgcccgcaagatccagcgcttcctgtcgcagccgttcttcgtggccgaggtgttcaccggctcgcccggcaagtacgttcccctcaaggacacgatcgccggtttcaaggggatcgtcgacggagactacgacgacgtgccggagcaggcgttctacatggtcggttcgatcgacgaggcgctggagaaagccaaacgcctggccgcttga

SEQ ID NO: 7189 - protein, 460 aa, Methylococcus capsulatus
MSSGKIVQIIGAVVDAEFPRESLPKIYDALRVDEVGLVLEVQQQLGDGVVRCIAMGSTDGVRRGVTVTNTGAPISVPVGTETLGRIMNVLGDPIDEKGPIGEKERWGIHRKAPSYQDQAAANELLETGIKVIDLICPFAKGGKVGLFGGAGVGKTVNMMELIRNIAIEHSGYSVFAGVGERTREGNDFYHEMKESNVLDKVSLVYGQMNEPPGNRLRVALTGLTIAEKFRDEGRDVLLFIDNIYRYTLAGTEVSALLGRMPSAVGYQPNLAEEMGILQERITSTKTGSITSIQAVYVPADDLTDPSPATTFAHLDATVVLSRQIAELGIYPAVDPLDSTSRQLDPLVIGHEHYETTRRVQSTLQRYKELRDIIAILGMDELSENDKLIVSRARKIQRFLSQPFFVAEVFTGSPGKYVPLKDTIAGFKGIVDGDYDDVPEQAFYMVGSIDEALEKAKRLAA

SEQ ID NO: 7190 - DNA, 1398 bp, Methylobacillus flagellatus
  CDS (1)..(1398): transl_table=11
atgagtcaaggtaaggttgttcaatgtattggtgccgtggttgacgtagagttcccacgtgaccagatgcccaaagtatatgacgcactgattctggatgaagattcacccacagtggaagcgggcctgaccctggaagtgcaacagcaattaggcgatggcgtggtacgtaccattgccatgggctccagcgatggcttgtcccgcggcatgaaggtaaagaacaccggcagtcagattcaagttcccgtaggtcatggcacactgggccgtatcatggacgtactgggtcgccctattgatgaggctggccctatcgaggctgacgaaaagcgttccatccatcagaaggcaccgaccttcgaagagctctctccttccgttgacctgttggaaaccggcatcaaggtgattgacctggtctgtccgtttgcaaagggtggtaaggttggcctgttcggtggcgcgggtgtgggcaagaccgtgaacatgatggaactgatcaataacatcgccaagcagcacagcggtttgtccgtattcgccggtgtaggtgagcgtactcgtgaaggtaacgacttctaccatgaaatgaaggactccaacgttctggacaaggtaggcatggtgttcggtcaaatgaacgaacctccaggcaaccgcctgcgggtagcgttgaccggcctgaccatggctgaacggttccgcgacgaaggccgtgacatcctgttcttcgttgacaacatctatcgttataccctggcaggtaccgaagtatccgcattgctgggccgtatgccttcggccgtgggttatcagcctaccctggcggaagaaatgggccgcctgcaggaacgtattacttccaccaaggtgggttccatcacttccattcaggccgtttacgtgcctgcggatgacttgaccgacccatccccagccaccacgttcttgcacttggactctaccgtcgtgctgtcgcgtgacatcgcagcattgggtatctaccctgctgttgacccattggattccacttcccgtcagctggatccgcaaatcgtcggcgaagagcattacagtgtggcgcgcgcagtacaatccacattgcagcgctataaggaattgcgtgacattatcgcgattctgggcatggacgaactgtctccagaagacaagctcgctgtggcccgtgcgcgtaagatccagcgcttcctgtcccagcctttccacgtggctgaagtctttactggtgcgcccggcaagtatgtgccactgaaggacaccatcaagggcttcaaggccatcgtcaacggtgaatacgatcacctgccggaacaagcgttctacatggtaggctcgatcgaagaagcggttgagaaggccaagaccctcaactaa

SEQ ID NO: 7191 - protein, 465 aa, Methylobacillus flagellatus
MSQGKVVQCIGAVVDVEFPRDQMPKVYDALILDEDSPTVEAGLTLEVQQQLGDGVVRTIAMGSSDGLSRGMKVKNTGSQIQVPVGHGTLGRIMDVLGRPIDEAGPIEADEKRSIHQKAPTFEELSPSVDLLETGIKVIDLVCPFAKGGKVGLFGGAGVGKTVNMMELINNIAKQHSGLSVFAGVGERTREGNDFYHEMKDSNVLDKVGMVFGQMNEPPGNRLRVALTGLTMAERFRDEGRDILFFVDNIYRYTLAGTEVSALLGRMPSAVGYQPTLAEEMGRLQERITSTKVGSITSIQAVYVPADDLTDPSPATTFLHLDSTVVLSRDIAALGIYPAVDPLDSTSRQLDPQIVGEEHYSVARAVQSTLQRYKELRDIIAILGMDELSPEDKLAVARARKIQRFLSQPFHVAEVFTGAPGKYVPLKDTIKGFKAIVNGEYDHLPEQAFYMVGSIEEAVEKAKTLN

SEQ ID NO: 7192 - DNA, 1416 bp, Mycoplasma gallisepticum
  CDS (1)..(1416): transl_table=4
atgaatacaaaatatagttatggtaaggtttaccaagtagttggtccagttgtggatgttgtttttgaaaaacaagatgacctacctaagatctatgattgtttaatcatcgatgaaccaaatatgaaacttcatctagaagttgctcagttaattggtgatgatattgcaagatgtattgcgatgggtcctactgaagggttagctagaaatgtgaaagtaacttcaactaaccaaccgatttcagtacctgtagggactgaagtattaggccggatgtttaatgtgatcggtgaaccgatcgatgagaaaaaaccgatcgatgcatcagtaaaaagaatgtcaattcaccgacctgctccgagttttgctgaccaatctaacgagttagagatctttgaaaccgggatcaaagtgatcgatcttttaatcccttatgcaaaaggtggtaagatcggtctatttggtggtgctggtgttggtaaaacggtattagtacaagaattaatccataatattgcaactggtcacggtggtttatctgtctttgctggtgttggtgaaagaactcgtgaaggaaacgatctttattatgaaatgatcgaaggtggggtgattgataagaccgcattagtttttggtcagatgaatgaacctcccggtgccagaatgcgtgtggcgcttaccggattaacgatggctgaatatttcagagatgttaataaccaagatgtcttattattcattgataatatcttcagattcacccaagctggttcagaagtatcagcactattaggtcggatgccttcagctgtaggttatcaacctactttagctgaagagatgggttcattacaagaacggattacttcaactaaatctggttcaatcacttcagttcaagcgatctatgtgcctgcagatgacttaactgaccctgcaccatcaacaacgtttacacaccttgatgctaaaacagttttagaccgtaatattgcttcactagggatctttcctgcagttaacccccttgattcaacatcaagattactggacccaagtgtagtgggaattcaacactaccaaactgctcgtaaggtacagatgatcttacaaaaattcttagaattacaagatattattgcgatccttggaattgatgaactatctgaagaagataaattaactgtttcaagagcacgtaagattagaaacttcttatcacaaccgttctttgttgctgaaaaattcagcggtaataaaggcaaatacgtaccgatcagtgaaacaataaaagggttcagtgagatcgttgaaggaaaacatgacgatcttcctgaacaagcattcttctatgttggttcgatcgatgaagcaatcgaaagagctaaaacattaacacgtaatggttaa

SEQ ID NO: 7193 - protein, 471 aa, Mycoplasma gallisepticum
MNTKYSYGKVYQVVGPVVDVVFEKQDDLPKIYDCLIIDEPNMKLHLEVAQLIGDDIARCIAMGPTEGLARNVKVTSTNQPISVPVGTEVLGRMFNVIGEPIDEKKPIDASVKRMSIHRPAPSFADQSNELEIFETGIKVIDLLIPYAKGGKIGLFGGAGVGKTVLVQELIHNIATGHGGLSVFAGVGERTREGNDLYYEMIEGGVIDKTALVFGQMNEPPGARMRVALTGLTMAEYFRDVNNQDVLLFIDNIFRFTQAGSEVSALLGRMPSAVGYQPTLAEEMGSLQERITSTKSGSITSVQAIYVPADDLTDPAPSTTFTHLDAKTVLDRNIASLGIFPAVNPLDSTSRLLDPSVVGIQHYQTARKVQMILQKFLELQDIIAILGIDELSEEDKLTVSRARKIRNFLSQPFFVAEKFSGNKGKYVPISETIKGFSEIVEGKHDDLPEQAFFYVGSIDEAIERAKTLTRNG

SEQ ID NO: 7194 - DNA, 1428 bp, Mycoplasma pneumoniae
  CDS (1)..(1428): transl_table=4
atgaaaaaggaaaacattacatacggtaaggtccaccaagtgattggcccggtagttgatgtcatctttacggaaagtagtcagttaccccgcatttacgattgtttgagtgttaagttagctggggaagaactgtttttggaagccgcgcagctaataggcgatgacattgtgcgctgcattgctttgggtccaactgaagggttagcacgcaacgaaaaggtgactaactataaccacccgattgaagtcccagttggcaaaaacgtcttgggccggatgtttaatgttttgggtaaacccattgacgggaaggaggagttacccaaaaaaccacaactcccgattcaccgcaaaccaccttcgtttgatgaccagtccaatacgctagaaatctttgaaacagggattaaggtgattgacttgctcactccctatgcccgtggtggtaagattggtttatttggtggtgctggtgttggtaaaacggttttagtgcaagagttaatccacaacattgctaaggaacactctggtttaagtgtgtttgctggtgtgggggaacgcacccgggaaggtaatgatctctactatgaaatgatccagggtggggtgattgacaaaactgctttagtgtttggtcagatgaacgaacccccaggagcacggatgcgggtcgctttaacggcgcttactatggccgaatacttccgtgaccatgacaaccaggatgtcttgctcttcattgacaacatcttccgttttacccaagctggtagtgaggtatcagcactgttaggtcggatgccatcagccgtgggttaccaaccaacgttggcgactgaaatggggcaattacaagagcggattgcttccactaaaaccggttcgattacctcggtgcaagcgatctatgtgccagctgatgacttgactgaccccgctccggctaccacctttacccacctggatgctaaaacggtgttagaccggaacatagcagcgttgggaatttttccagcgatcaatcccttagagtctaccagtcgcttattggatcctaatattgtcgggattaaccactataaggtagcgttaggggtgcaaaacatcttacagcgctttgcggaactacaagacattattgccatcttgggaattgatgagttagcggatgaggacaagatcattgtggaacgggcacgccggatccgcaacttcctctcccaaccgttctttgtagcggaaaagttctcggggattgctgggaagtatgtccctttaagtgacacgatccaatcgtttaaggaaatcttggacggtaagcatgatgatctccccgaacaggccttcttctttgttggtaccattcaggaagcagtggagaaagcgaagcggcttaaaaaagctactgttgaggagaaataa

SEQ ID NO: 7195 - protein, 475 aa, Mycoplasma pneumoniae
MKKENITYGKVHQVIGPVVDVIFTESSQLPRIYDCLSVKLAGEELFLEAAQLIGDDIVRCIALGPTEGLARNEKVTNYNHPIEVPVGKNVLGRMFNVLGKPIDGKEELPKKPQLPIHRKPPSFDDQSNTLEIFETGIKVIDLLTPYARGGKIGLFGGAGVGKTVLVQELIHNIAKEHSGLSVFAGVGERTREGNDLYYEMIQGGVIDKTALVFGQMNEPPGARMRVALTALTMAEYFRDHDNQDVLLFIDNIFRFTQAGSEVSALLGRMPSAVGYQPTLATEMGQLQERIASTKTGSITSVQAIYVPADDLTDPAPATTFTHLDAKTVLDRNIAALGIFPAINPLESTSRLLDPNIVGINHYKVALGVQNILQRFAELQDIIAILGIDELADEDKIIVERARRIRNFLSQPFFVAEKFSGIAGKYVPLSDTIQSFKEILDGKHDDLPEQAFFFVGTIQEAVEKAKRLKKATVEEK

SEQ ID NO: 7196 - DNA, 1446 bp, Myxococcus xanthus
  CDS (1)..(1446): transl_table=11
atgagcgctcaagttccgacggcaggcagaatcatccaggtcctcggccccgtggtcgacgtcgagttcccgcccggcggtctccccgaggtctacacggccctcaaggtcaccaacgcgaacctgagcgccgccgctgacaacctcaccctcgaggtggcgcagcacctgggcgagaacaccgtccgcaccatcgccatggactccacggagggcctgggccgcggcatggccgtcacgaacacgggcgcccccatccaggtgccggtgggcaaggccaccctgggccgcatcctgaacgtcaccggtgagccggtggacgagatgggccccgtgaaggcgcaggagtactggtccatccaccgcgcgccgccgcccttcacggagcaggacgtgcgcgtgcagatgttcgagacgggcatcaaggtcatcgacctgctcgccccgtacacccgcggtggcaagattggcctcttcggcggcgccggcgtgggcaagacggtgctcctgcaggagctcatccgcaacgtggccgtggagcgcggtggcttctcggtgttcgccggcgttggtgagcgcacccgcgagggcaacgacctctaccacgagatgcaggacacgaaggtcatccagacggacaacctggaggccagccaggccgtgctggtgtacggccagatgaacgagccgcccggcgcccgcgcccgcgtggccctgtccgcgctgaccatggccgagtacttccgcgacgtggaaggccgcgacgtgctcctcttcgtggacaacatcttccgcttcacccaggccggctccgaagtgtccgccctcctgggccgcatccccagcgccgtgggttaccagcccacgctggccacggagatgggcggtctgcaggagcgcatcacctccaccacgaagggttccatcacctccgtgcaggccatctacgtccccgccgacgacctcacggacccggcgcccgcgacggccttcgcccacctcgacgcgacgacggtgctcaaccgctccatcgccgagctcgccatcttccccgccgtggacccgctggactccaccagccgcatcctggacccggccgtcatcggcgcggagcactacggcgtggcccgcaaggtccagggcatcctccagcggtacaaggagctgcaggacatcatcgccatcctcggcatggacgagctctccgaggatgacaagctggtggtggcccgcgcccgcaagattcagcgcttcctgtcgcagcccttcttcgtggccaaggtcttcacgggcaaggacggccgctacgtgaagctccaggacaccatccagggcttcaaggagatcgccgagggcaagcacgacgacatccccgagggcgccttctacatgacgggcagcatcgacgaggtggtcgagaacgcgcggaagctcgcggcgagctaa

SEQ ID NO: 7197 - protein, 481 aa, Myxococcus xanthus
MSAQVPTAGRIIQVLGPVVDVEFPPGGLPEVYTALKVTNANLSAAADNLTLEVAQHLGENTVRTIAMDSTEGLGRGMAVTNTGAPIQVPVGKATLGRILNVTGEPVDEMGPVKAQEYWSIHRAPPPFTEQDVRVQMFETGIKVIDLLAPYTRGGKIGLFGGAGVGKTVLLQELIRNVAVERGGFSVFAGVGERTREGNDLYHEMQDTKVIQTDNLEASQAVLVYGQMNEPPGARARVALSALTMAEYFRDVEGRDVLLFVDNIFRFTQAGSEVSALLGRIPSAVGYQPTLATEMGGLQERITSTTKGSITSVQAIYVPADDLTDPAPATAFAHLDATTVLNRSIAELAIFPAVDPLDSTSRILDPAVIGAEHYGVARKVQGILQRYKELQDIIAILGMDELSEDDKLVVARARKIQRFLSQPFFVAKVFTGKDGRYVKLQDTIQGFKEIAEGKHDDIPEGAFYMTGSIDEVVENARKLAAS

SEQ ID NO: 7198 - DNA, 1425 bp, Neorickettsia sennetsu
  CDS (1)..(1425): transl_table=11
atgccagtaagtataggaaaaatagttcgagtcgttggtccgacagttgatgtaaagttcgaagacggcacattgccaaaaatagagaatgctcttacctgtgacaataatggaaagatcctatacttagaagttgcacagcaattgggagatggaatagtccgcgctgtagcaatggattcgacggatggtttgacaagagataaagtcgttaaagatactgggaaaccgatctgtgtgccagtcggtagacagactcttgggcgaatctttaatgtagttggggaaatcatagatggtggtggccctgtaccagaacctaataaagtttcttcgatatatgcagagcctcctaggtttgatatgcagagtacctcctctgaaattttggagacggggatcaaagtaatcgacctacttgcaccctattccaagggaggtaaggttggtctctttggtggtgcaggagttggaaagactgtccttattatggaacttatcaacaatatcgctaaggcctatggaggtttctcagtctttgcaggtgttggtgagcgaaccagagaggggaatgatctttacagcgaaatggttgagtctggggtgatcgacaaggaacatcctgagaaatctaaggttgtcctggtttatggtcagatgaacgagcctcctggtgcacgtgcgaaggttgctatgagtgctcttaccatggctgaatattttcgtgacaaagaggggcaggatgtgcttttctttgtggataatatctttagattcactcaagcgggcgcagaactttctactttgttgggaagaatcccgtcggcggtaggctatcagccaacccttgcaacggatatgggaaggcttcaggagcgtattacctccactaaaaacggttctattacttctgttcaggcaatatatgttcctgctgatgacattaccgacccggctccggctacctcttttgctcacctagattctacaactgttctgtcaagacaagttgctgaagccggtatatatcctgcagttgatgcgcttgcttctagtgcacagattctttctccggaagtgttaggtcaagaacattacgaagttgcacaaaaggtgaagggaattcttcaaagttataaatcccttcaagatatcattgcgattttgggcatggaagagctttctgaggaagataagcttacggtttatagggcaagaaaaattgagaaatttttatctcagccgtttcatgtagcagaggtctttacaggtcagccaggcaaattcgtgagccttaaagatacaatcgccggtttcaaggagttagttgagggcaaatgtgatgatatgcctgaagctgctttttatatggttggtaacatgaacgaggcgagagaaaaggccattagtctaagggagaaatag

SEQ ID NO: 7199 - protein, 474 aa, Neorickettsia sennetsu
MPVSIGKIVRVVGPTVDVKFEDGTLPKIENALTCDNNGKILYLEVAQQLGDGIVRAVAMDSTDGLTRDKVVKDTGKPICVPVGRQTLGRIFNVVGEIIDGGGPVPEPNKVSSIYAEPPRFDMQSTSSEILETGIKVIDLLAPYSKGGKVGLFGGAGVGKTVLIMELINNIAKAYGGFSVFAGVGERTREGNDLYSEMVESGVIDKEHPEKSKVVLVYGQMNEPPGARAKVAMSALTMAEYFRDKEGQDVLFFVDNIFRFTQAGAELSTLLGRIPSAVGYQPTLATDMGRLQERITSTKNGSITSVQAIYVPADDITDPAPATSFAHLDSTTVLSRQVAEAGIYPAVDALASSAQILSPEVLGQEHYEVAQKVKGILQSYKSLQDIIAILGMEELSEEDKLTVYRARKIEKFLSQPFHVAEVFTGQPGKFVSLKDTIAGFKELVEGKCDDMPEAAFYMVGNMNEAREKAISLREK

SEQ ID NO: 7200 - DNA, 1722 bp, Neurospora crassa
  CDS (31)..(1590)
ccaccatcgtcgcgcttaatcatcgtcaagatgttcaagagcggcatttccgccttcgcccggactgcccgtccctcctttgcggcggcgtcccgtcgcgccgtccgcccggctgccctcaacctccgtgcccctgccctcagcagattcgccagctccgccggtgttggtgatggcaagatctaccaggtcattggtgccgtcgtcgatgtcaagttcgataccgacaagctccctcccattctcaacgcccttgagacccagaacaatggccagaagctcgtcctcgaggtctcgcaacatctcggcgagaacgtcgtgagatgcattgccatggacggtactgagggtctcgttcgtggtgccaaggcctccgacactggtgctcccatcaccatccctgtcggccctgccacccttggccgtatcatcaacgtcactggtgaccccatcgacgagcgcggtcccatcaagaccgacaagttccgccctatccacgccgaggctcccgagttcgttgagcagtccaccactgccgagattctcgtcactggtatcaaggtcgtcgatctcctcgccccctacgctcgtggtggaaagattggtctcttcggtggtgctggtgtcggcaagaccgtcttcattcaggagctcatcaacaacatcgccaaggctcacggtggttactccgtcttcaccggtgtcggtgagcgtacccgtgagggtaacgatctgtaccacgaaatgcaggagacctccgtcattcagctcgatggtgactccaaggtcgctcttgtcttcggtcagatgaacgagccccccggagctcgtgcccgtgtcgcccttactggtcttaccattgccgagtacttccgtgatgaggagggtcaggatgtgttgctcttcattgacaacattttccgtttcacccaggccggttctgaggtgtccgctcttctcggtcgtattccctctgccgtcggttaccagcccactctcgccgtcgacatgggtcagatgcaggagcgtattaccaccaccaccaagggttccattacctccgtccaggccgtctacgtccccgctgacgatttgactgatcctgcccccgccaccactttcgcccatcttgacgccaccactgtcttgtcccgtggtatctctgagttgggtatctaccccgctgtcgatccccttgactccaagtcccgtatgctcgacccccgtattgtcggccaggagcactacgagaccgccacccgcgtccagcagatcctccaggagtacaagtccctccaggatatcattgccattcttggtatggacgaactttccgaggccgacaagctcaccgtcgagcgtgcccgtaagatccagcgtttcctcagccagcctttcactgtcgctcaggtcttcactggtatcgagggtaagctcgttgaccttaaggacaccattgcctccttcaaggctattctcgctggtgagggtgatgacctccccgagggtgccttctacatggttggcgacttcgcctctgctcgcgccaagggtgagaagattcttgctgagcttgagggccaggcttaagcgattaatgcgggagttcaaaatcgggacggaaacgatggcctgtgtatagagtaaagaaagggtttttcgggacgttcctcctatgagctgtgtatcaaatgaagttcctttttttttctctatatacct

SEQ ID NO: 7201 - protein, 519 aa, Neurospora crassa
MFKSGISAFARTARPSFAAASRRAVRPAALNLRAPALSRFASSAGVGDGKIYQVIGAVVDVKFDTDKLPPILNALETQNNGQKLVLEVSQHLGENVVRCIAMDGTEGLVRGAKASDTGAPITIPVGPATLGRIINVTGDPIDERGPIKTDKFRPIHAEAPEFVEQSTTAEILVTGIKVVDLLAPYARGGKIGLFGGAGVGKTVFIQELINNIAKAHGGYSVFTGVGERTREGNDLYHEMQETSVIQLDGDSKVALVFGQMNEPPGARARVALTGLTIAEYFRDEEGQDVLLFIDNIFRFTQAGSEVSALLGRIPSAVGYQPTLAVDMGQMQERITTTTKGSITSVQAVYVPADDLTDPAPATTFAHLDATTVLSRGISELGIYPAVDPLDSKSRMLDPRIVGQEHYETATRVQQILQEYKSLQDIIAILGMDELSEADKLTVERARKIQRFLSQPFTVAQVFTGIEGKLVDLKDTIASFKAILAGEGDDLPEGAFYMVGDFASARAKGEKILAELEGQA

SEQ ID NO: 7202 - DNA, 1613 bp, Nicotiana rustica
  CDS (1)..(1497)
atgagaatcgatcctactacttctggttctggggtttccacgcttgaaaaaaaaaacccggggcgtgtcgtccaaatcatcggtccggtactagatgtagcctttcccccgggcaagatgccgaatatttataacgctctggtagttcaaggtcgagatagtgttggtcaaccaattaatgtggcttgtgaggtacagcaattattaggaaataatcgagttagggctgtagctatgagtgctacagaaggtctaacgagaggaatggaagtgattgacacaggagctcctataagtgttccggtcgggggagcgactctgggacgaatttttaatgtgctcggagcagctgttgataatttagggcctgtagatactagtacaacgtctcctattcatagatctgcgcccgcctttatacagttggatacaaaattatctatttttgaaacaggaattaaagtagtagatcttttagccccttatcgccgtggaggaaaaatcggactattcgggggagctggagtgggtaaaacagtacttattatggaattgattaacaatattgctaaagctcacgggggcgtatccgtatttggcggagtgggtgaacgtactcgggaaggaaatgatctttacatggaaatgaaagaatctggagtgattaatgaagaaaatattgcagaatcaaaagtggccctagtttacggtcagatgaatgaaccgccgggagctcgtatgagagttggtttgactgccctaactatggcggaatatttccgagatgttaatgaacaagacgtacttctatttattgacaatatcttccgtttcgtccaagcaggatccgaagtatcggccttattgggtagaatgccttccgctgtgggttatcaacccaccctgagtaccgaaatgggttctttacaagaaagaattacttctaccaaagaagggtccataacctctattcaagcagtttatgtacccgcagacgatttgaccgaccctgctcctgctacgacatttgcacatttagatgctactaccgtactatcaagaggattggctgccaaaggtatttatccagcagtagatcctttagattcaacgtcaaccatgcttcaacctcggatcgttggtgaggaacattacgaaaccgcccaaagagttaagcaaactttacaacgttacaaagaacttcaggacattatagctatccttggattggacgaattatccgaagaggatcgtttactcgtagcaagagcgcgaaaaattgagcgtttcttatcacaaccctttttcgtagcagaagtatttaccggttctccagggaaatatgttggtctagcagaaacaattcgaggatttcaattgatcctttccggagaattagatggtcttcctgaacaggccttttatttggtaggtaatatcgatgaagctaccgcgaaggctatgaagttagaaatggagagcaatttgaagaaatgaccttaaatcttagtgtactgacccctaatcgaattgtttgggattcagaagtggaagaaattgttttatctactaatagcggtcaaattggcatattaccaaatcaccgcccccta

SEQ ID NO: 7203 - protein, 498 aa, Nicotiana rustica
MRIDPTTSGSGVSTLEKKNPGRVVQIIGPVLDVAFPPGKMPNIYNALVVQGRDSVGQPINVACEVQQLLGNNRVRAVAMSATEGLTRGMEVIDTGAPISVPVGGATLGRIFNVLGAAVDNLGPVDTSTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLLVARARKIERFLSQPFFVAEVFTGSPGKYVGLAETIRGFQLILSGELDGLPEQAFYLVGNIDEATAKAMKLEMESNLKK

SEQ ID NO: 7204 - DNA, 1497 bp, Nicotiana sylvestris
  CDS (1)..(1497)
atgagaatcaatcctactacttctggttctggggtttccacgcttgaaaaaaaaaacccggggcgtgtcgtccaaatcatcggtccggtactagatgtagcctttcccccgggcaagatgccgaatatttataacgctctggtagttcaaggtcgagatagtgttggtcaaccaattaatgtggcttgtgaggtacagcaattattaggaaataatcgagttagggctgtagctatgagtgctacagagggtctaacgagaggaatggaagtgattgacacaggagctcctataagtgttccggtcgggggagcgactctgggacgaatttttaacgtgctcggagaacctgttgataatttagggcctgtagatactagtacaacgtctcctattcatagatctgcgcccgcctttatacagttggatacaaaattatctatttttgaaacaggaattaaagtagtagatcttttagccccttatcgccgtggaggaaaaatcggactattcgggggagctggagtgggtaaaacagtacttattatggaattgattaacaatattgctaaagctcacgggggcgtatccgtatttggcggagtgggtgaacgtactcgggaaggaaatgatctttacatggaaatgaaagaatctggagtaattaatgaagaaaatattgcagaatcaaaagtagccctagtttatggtcagatgaatgaaccgccgggagctcgtatgagagttggtttgactgccctaactatggcggaatatttccgagatgttaatgagcaagacgtacttctttttattgacaatatcttccgtttcgtccaagcaggatccgaagtatcggccttattgggtagaatgccttccgctgtgggttatcaacccaccctgagtaccgaaatgggttctttacaagaaagaattacttctaccaaagaagggtccataacctctattcaagcagtttatgtacccgcagacgatttgaccgaccctgctcctgctacgacatttgcacatttagatgctactaccgtactatcaagaggattggctgccaaaggtatttatccagcagtagatcctttagattcaacgtcaaccatgcttcaacctcggatcgttggtgaggaacattacgaaaccgcccaaagagttaagcaaactttacaacgttacaaagaacttcaggacattatagctatccttggattggacgaattatccgaagaggatcgtttactcgtagcaagagcgcgaaaaattgagcgtttcttatcacaaccctttttcgtagcagaagtatttaccggttctccagggaaatatgttggtctagcagaaacaattcgaggatttcaattgatcctttccggagaattagatggtcttcctgaacaggccttttatttggtaggtaatatcgatgaagctaccgcgaaggctatgaacttagaaatggagagcaatttgaagaaatga

SEQ ID NO: 7205 - protein, 498 aa, Nicotiana sylvestris
MRINPTTSGSGVSTLEKKNPGRVVQIIGPVLDVAFPPGKMPNIYNALVVQGRDSVGQPINVACEVQQLLGNNRVRAVAMSATEGLTRGMEVIDTGAPISVPVGGATLGRIFNVLGEPVDNLGPVDTSTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEENIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLLVARARKIERFLSQPFFVAEVFTGSPGKYVGLAETIRGFQLILSGELDGLPEQAFYLVGNIDEATAKAMNLEMESNLKK

SEQ ID NO: 7206 - DNA, 1383 bp, Nitrosomonas europaea
  CDS (1)..(1383): transl_table=11
atgagccatcaaggaaagatcgttcagtgcattggcgcagtaatcgatgtggagtttacgccgggggaaataccaaaagtatatgatgccctggtaatggaaggatcggagttgacgctggaagtgcagcaacagctcggagatggggtcgtcaggactattgctcttgggtcgtccgatggtctgcgacgtggaatgatggttactaatacccaaaaacagatttcggttcctgtaggtactaaaacacttggccgtattatggacgtccttggcagacccattgatgaaatgggagaaatcggcgcgaattccttaatgcctatccatcgggctgctcctgcttttgatgagctgtcggcatccacggagttattggaaaccgggattaaagtgatcgatttggtttgcccctttgcgaaaggaggcaagatcgggcttttcggtggtgccggtgtaggtaaaaccgtaaatatgatggagcttattcgtaatattgcaatcgagcatagtggctactcggtttttgctggcgtgggtgaaaggacacgtgagggtaatgatttctaccatgaaatgaaagactctaacgtactggataaggtagctttggtttatggccagatgaatgagccgcctggtaaccgtttacgtgtagcacttaccggtctgacgatggctgaggcatttcgtgacgaagggcgtgatgtattgttctttgtggataatatttatcgttataccttggcaggtactgaagtttccgcactgttagggcgtatgccatcagcagtagggtatcagccaacacttgcagaagaaatgggccggctgcaagaaaggattacttcttccaagacagggtcgattacatccattcaggccgtttatgttccggcggatgacttgactgacccatctcctgcaacgacattcggtcaccttgatgctacagtggtactttccagggatattgcttcactcgggatttatccggctgttgatccacttgattcgacttcgcgccagctggatcctttgattattggtgaggatcattacaataccgcacgtgaagttcagcaaacattgcagcgatataaagaattacgcgatatcattgctattttgggtatggatgagctgtcccctgaggataagttgtcagttagtcgtgcccgtaaaatacaaagatttctctctcagccattcttcgttgctgaagtctttacaggatcgccgggtaaatatgtaccattgaaagaaaccatcaagggattcaagggtattgtcagtggtgagtatgacgatattcctgaacaggctttctacatggtaggtggtattgaggaagtgcttgagaaagccaaatcaattcaataa

SEQ ID NO: 7207 - protein, 460 aa, Nitrosomonas europaea
MSHQGKIVQCIGAVIDVEFTPGEIPKVYDALVMEGSELTLEVQQQLGDGVVRTIALGSSDGLRRGMMVTNTQKQISVPVGTKTLGRIMDVLGRPIDEMGEIGANSLMPIHRAAPAFDELSASTELLETGIKVIDLVCPFAKGGKIGLFGGAGVGKTVNMMELIRNIAIEHSGYSVFAGVGERTREGNDFYHEMKDSNVLDKVALVYGQMNEPPGNRLRVALTGLTMAEAFRDEGRDVLFFVDNIYRYTLAGTEVSALLGRMPSAVGYQPTLAEEMGRLQERITSSKTGSITSIQAVYVPADDLTDPSPATTFGHLDATVVLSRDIASLGIYPAVDPLDSTSRQLDPLIIGEDHYNTAREVQQTLQRYKELRDIIAILGMDELSPEDKLSVSRARKIQRFLSQPFFVAEVFTGSPGKYVPLKETIKGFKGIVSGEYDDIPEQAFYMVGGIEEVLEKAKSIQ
